United States Patent 10,240,205 (METHODS FOR ASSESSING RISK OF DEVELOPING A VIRAL DISEASE USING A GENETIC TEST) - sequence listing, part 6

SEQ ID NO: 198 - DNA, 1491100 bp, Homo sapiens
gcacaaaacactttatttgtgttcctctgggcaaaacgaacccaggggagaagctgtatatacaacatgacatttgtagccaatcaacatatggctctttgtcatcatttctgaaaactagcatgcaaaggagaacaagttttctttttgatttttgtagcaaacttcaataatctccaactcaaacaaacaaacaaacaaacaaacaaacaaaaaatgctttagtggagctctgtgctaagggattttcctccctggagcctcccttcctctccctgtgttctaatcctcatttccgggaggtcattttaattagcaggctgtcatggtgactcagcctgctgtttccacagacaggaagggagcagacccccctggacccattcatcatacaaaggcactttactcttcacaaaaatgccaatatttagcttgccacaccttgggaattgctactactgttttattttatcattcctccctgcctcagggtgcatccttctgtcttttgcatcttccttgcctggcaatcaccctttcctcattgcagattagcaatgcctacatcttcaggggccaggcttaatccctgtcacctgggatctggagaccttaaccataataaaccttttaaaatgagtgaccagtgctttttgtctttagagctaaaattttaattaaactaccgaggaaattgggaaacagctctcaaaacagttttctaaatctgcatgctggggtttgagggaatcagcaagcatgcagcttagatacagtgaccatatatttaagtccaccgttgatttcaaaaattctgtcccattgttccctaggatgcatttgccctttggttgcatgtgttgttgctgttgttttggatcagaaaatacaaacactgcatttctaaagctgtaaacaaccaagcctatttaaaaggtaaccatctgcagtaactataaaacttaaaaatgtaaagtggctttgaaagaactgacctgatatgtgtcaaatctcttaaaagggatgtgtaggttttcctcatcttggaagatctctatgttgtagaaaatagcatctgtgctcacctggttccgatctcctattttgttcctgagctttttgagctgaaggcttacaattgattttccattggaaaaagggaaaatcagtgatgaagtttctcattgtatcccttccctttcactagcctatgcattaatccacaaatccttggaagctagagaagagtgattaatttcattccccagcagaaaatgcatgctcctgtccccataagacctcccaggactccgtgtctttaaaaaggggttgaagggtctttgtggttcactgagctcttcttgtcccctttgctgttggggtagttgctggctgggccccgcaggagtgggtgcttgtaaggaggggatttttctttcctgcaaagggggagataacagaaagagagaagacagcccatatacacactgtgatgaaatcatttgtgtgcatgtctatcttccccactggactgtagcctcccaggaacagtaacctagtcttcttcccacagacactaaaggtgacaaaaatgagcagacattgatactgtcttcaagttgcttatagcttaggagaggggataattgtataaaataactacacaaaacaataactataatatgtgtcaggaagtggttagtgtcataaatatgagaatctcttgaactaagtttgaattcaaattgaagatgtggcttttgtaacccatcaagctctgaccttggtacacccatttttctttactgttgatgagtcatgaataaggtaaagacagaataggtggcagcacataaagggacactttgccctaacatactgccccctccaccaggaagcctcactgcctgaaaatccacattcattgaagagccttgctaacataacaaggctgccagaataggtgagatacagccctggagcacatgcatggtatgttacttacgggcaatgtcatcttgaagcagttccttaccttctctggacttctatttctttatttctaaaataggagaaaaattcatgtccttcctgcctcttaggctctagtaaatggaagttgaagaggtgctattcatctgtcattgaaggatgttgtttttaacacccaaacggagcataggacgtaagtatgtttttatggggaaaaagaagagggaagcccagatttggtcatagctggggcagccatggggggatagtggcaaggggataagttgtgcagaggctagagaggacagtgaatgtgcagaaggacttagggagggtgggctaggaaggcaaaaagccatcaaccaaagatggggacacgagagagcaaggagccactggaaggcaaaacatcccatacctttaggcctctgcagaggctgtttccttccctacctctctagtctcacctctttttggaagacaaactcccacaaaataagcctcccccatccccaggcctttgtagcactttgtacatttcatcgctcctcaccctgctgttttctaggttgttctttgctcatctctttctctcatgagacgataagtttgatgtgtacgctttttctctataattcctgagccaagtgcaggtctggtgtggagtaggtgcttgaggagtatttgatgactagaaatgaactttctgtcttatctttaccatatcatttactctaaacgttctggccttgtcactgccatggaatgtgtcttgttaggtcctgcttctgtctgttctctactctattccccaatacagaataccctttatcccctttctatttcatcagtcaaaattccatatgtctgttaaagccaagttcaaatgccacttcttctctgaagttttcttggacatgcctgccagctacaaaatacttgccagatttggtaggagaggaacttctgcttgggtctcacttttcttttctttagtgtgaaggggttgaagtcggtaattttgggggcttcttcagttctaccacagctcagtaacagtcatggattatttagaatttaatctatgctaggccctgcaccatgcactaaggatacagaagtaagtaagactgaggacactgaagctaccagagaagccagacatgcatagaagccatgacaatacaccacaggacataccatgctagaggtatgtacaaaacacagttaggagctcagcagagaggaagcagctctgtctcgggcagagaacatggacaaggaaacaggttgtgatatttggactgagttttgaatgataattatgagctcaccatctacaagcagaaagggagctcattccagcaagaggaaaaaggatgtacaaagacatggaggcaagaaaacagctaacttgttcaggctgaagcatagggcacgaggtgacagaaatcaggtgggagggacagggtgctcacaggggtggaggggtggtagaaagcagtaaatgaagtttaaaatgtaggccaaggtcttgaataacaagaagagttgaaacattaccctaaaggtaatggggagccatagaaggtttttgagagaaggcataatctgatacatagttgagtacttatacacttttcagtattgtttgttatgtttgcatttgtacttgcctttatcctccataaatctgagcacacaatgggcaggggctatttataatcctctagcagttggcacaaggactggcacgtagtgggctccagtgtgttgaggagctgacaagccccgttacacacacatacacacatcataacctcaccatggagccagccctgccagcctgtgactaagcctgagtccacctcttgctcagaggccacactcatgctctgtttacctacagaagcacacctgctctgtttcttcttcctgtctgattttgtcccctttgctggagcattttgggcttgcgactataccactgtgtgctaaacaaaatgtgggacctcagctttggtcatcaatgccatgcccctgagcctgagctcttgtgcccacattgctgcccctcctgagggaccctatctgaagggtgtcccagtatccaatgatgccggcaggcttctgccagcgtgtgagcagaaagtgacatattgtaattatccatggagatgggagaaaacaaagattagttttgagtcaaaacatgtaattttcctttaaagccagactgctctttcacttaaactatttgatgcttgggtggaaaataatacaaaaaaggggaagtatttatatcccaaattagagctcagagtcttgtatcctcctgggaattcatttttaaaggattactgaccaatctagagctaaatggtgctcacagtttgatgaggcagaggtgtgtgcatagggaggaggttattaagttttttcttaatttaaaggtgggtgcatttagctcaagtcctcaaaactctgaactcatgaggaaggagctctctagatcttttctgaagagggctccaaagctcaaggcaaggaagtgccatgaacagttaaactcagggccctgagatctcccctatgtcctttagatccgtgtcggggttccatcctctcccatctccacgaactcttcactggtagacactgaacacactgcatggcagggtgagggcctgtgctccagtcctggctctgaccacatgactctgaccagctccttctgctccctaagtccccatgtcctcatctgtatcgtgaagagagtctagaggatcactaaggtctccctgagtgtcagcaccatttcattggtatatgacaatgcaacatgcaagaaaaaaatgattaaggatcaagataattttatttaggcagaggacctgaaagagacaatccccaaattaacttgtaaatgagattctaagaattcttttgagttttataaagctttaaacgtttaagaactttaaccaatcacgaatgacttctaagaatgaactgagcattttcctctagatgtgagctcctcagaggcaggggtcatgctttaatcagccactcatcccagcacttccctcctgtcaggggcctggtataaagtgttgcttttcctgagtgaatgaatgaatgtatacatgcacgtatgcacaatgcaggacaggcacttcaggggcacaagaaatagacgtgattctcctgcaagagtttctaatatgccatggtggtggggcacaaagaccctagatgatttagaaacaatctgggacagggtatcagaataccttgtcatgaagactctatgacatggggctaagagatgtatgactcatagcattgtggaacataggccctgagacatcacccaaacaaataagtcaaagacttgccctaggtcttgatgagttggttggaaatctgggactgcaacccagaaactggaggacatgaaaacatttattgagcatctactagctgctgggcactatactaagcttgtatccattctacaaaaccatatttagagattgttgttattatccccatttataggtaagtagaaaaaagcttcaagaggccaagaaacttgcctaagatcctataactcacatgagtctgagacagaatttgaacccatgctgatgaacttctacttgcggtgaaccttagctagacttcaattcagctttcaaatcataaaagcctaggatgaaaccctggctctcccaaaaactctttgacctcaggcatctcagaccttctcatcatctttcttagtctccttttcctcatttgtaagatgggaaatacaatgtctatgaggaataaataatacaatgtacacaaagtactctgtacaataaataacggtgatttatattgtttttatcaataacagcgtagggaggaaggtgcatcagtgcaaaggccctgaggcacccacatacatgagcaaggtcatggcaaaggtcagtggaaagaatggtctggcaggagccgggagttgggcattgtcatgtccttcaagtaggatggaccactgaaggagtgggagatgagtctaagaggtagggcagggccagcacattccagatgccatgtgatgtcactgttctcatgctagctgggttcacagccagtggtcatggaagtgcccagtgcttcaggctctggccaagtcctcagacaggatggaggctcacctcctgaccttctctcctcagcagccctgcaagttggccccagaagaggacccaaggtagaacttctcaagggtgtgtcctctccagcccaaatctttacatcttgagggaaggagactatcatgtactgacagcactgtgctgggtgctttaacacatatctcataataatcatgtatgtgaggactgctgtcctcactttatagatgaggaaaccgaaggatcagagaagttcatataggaacctcagaggatgaggtatcaggagaggtagcacatagaaacacccaaatttagaacaatgactgaactcagctccccagcaagccccatccctgtggattcctaagttagaaccagaaatgtgaccatgccctcactgtctgaccccttaatgacactttctttatgctcaggaactatgctcttctgccccataaaatctcggtggcagggccaggattatctttcctgcggcacagatgggatgctgagtgtcagcaaaaggctaagggaagttgcccctgaatacagcccgtggagcagaactcaagccgaaacctctctgctctgccacttaccgcagtctcggcatgggaattgccaccttttcaaccacggggttcagccgataatagtccaaaaaggttcttgccacattccgccccagcttcatatctgcaggtgtgtgcattaaggagcaacttcgaaaacagattgagacagagtgaaaagagaactactaataaaaataataacagtaataaaaacagttacacactcattgttctaagctttttgtatgcgctgtcttttttgatccttgaaaaaccttaaatggtaatcactattattatcctaattttatagataagaaaactgaggtgcacagaagtgaagtaatttgcctaaggtcacaaaactgggaaaaggaggagccaggatatgagtctagggagtcataacccaaagcctgtgctcatagctttcagggtacagccctttggaaatcactgggctgctctggtctagcctcaggtggctcaggatggagccaggtaagcaaaaaacccaaggacaagagacatttgttgcatatagacaagggcctgcttgacccttagggctcagtcatccactttagtaacctcaggcacaatggtaaaaccctgtgaccctaaacagtgttcccactgcaccttgaaattcctctgacaatgaatcttcctggtaaagatttgtggctgtaaaagcacaaacttcttggggaagggccaatttcatattgaccattaacaccttaatgtgaataagtacaacaatcattattcaacaacagaatatcttctctgtgcattatagctcacatctctgggcttcatacatgttatttcctctgctgaagtacctccctgcccactcctgccttctccttggctaattcatgccccttgcttctctaatgaggtgatatctctttattagagccctccaggatattcttctcctctcttcccagaactgtgattcgtgcccttgccccacactttcatgactcctgaactggcttcattcaaagcacttatcacttatctcacagcaagagaattatgtgtttactcagcttaatccttagcgattgcttctccctcatctcttagctctgaacatccaagctgtcactaacccttctccaagacacctcccatatcttgaatgttttcacttctttccacccccctagaataggccagcatcatctttctcctagattgctgtcatcctgtcctaactagtttccctgccacagaatttctcccctctggtccattttctaccgtgcagccagggggattctgcaatgcagctctgaatatgtcactcagctgaataaaacacttcagtggttctcagttaccttcaaagtccaaatctctgagtgtgatttaccgtactgttcatagtcaggtccctgattattttctcaacattatgcttgctacctcccacctactccccttgcccttcacattccagaaacactgagcttcttctgcctccaggcctgtgcccatacatgccatctttctagatcactcttcctcccttcacatgccttccaggacccactccttctcagcttcaagagctcaattcagttgtcactctactgggtaagtcttccttggctgcccttgctgggataggggtctctcctaggttttcccacaacctcttcttcctggccttcaccaaccagagtgctaatcatactgcattttacctgtctcttcttttcagtagccccttctagcctgcaagctctatgaggcagaggtcatatctgtcttattcatcacctaaatacccacacactcatctgacaataagtatgaaatatatatttgttgaattagtaaataatagctgggtgggtgcagtggctcacgcctgtaatctcagcactttgggaggctgaagtgggtggatcacctgaggtaaggagcttgagaccagcttgaccaacatgatgaaaccccatctctactaaatacaaaattagttgggcgttggggcgcatgcctgtaatcccagctactggggaggctgaggcaggaggctcgcttgaacccaagagacggaggttgcagtgagccaggatcgcaccattgcattccagcctgggcaacaagagtgaaactccatctccagaaaaaaataaaaaaataaaataaataaataatagctaatacttatataatgtttaatacgtgctaggcaatctttttttttatatatactttaagttctgggatacatgtgcagaacgtgcaggtttgttacataggtatacacgtgccatggtggtttgctgcacccatcaacccatcatttacattaggtatttctcctaatgctatccctcccctagcacccaaccccctgactggccccagtgtgtgtttttcccctccctgtgtccatgtgttctcatagttaaacttccacttatgagtgagaacatatggtgtttggttttctgttcctgtgttagtttgctgagaatgatggtttccagcttcatccatgtccctgcaaagcacatgaactcattcttttttatggctgcataatattccgtggtgcatatgtgccacattttctttatccattctatcattgatgggcatttgggttggttccaagtcttttctattgtgaatagtgctacaataaacatacgtgtgcatgtgtctttatagtagaatgatttataatcctttgggtataaacccagtaatgcgattgctggatcaaatggtatttctagttctaggtccttgaggaattgccacactgtcttccacaatggttgaaataatttacactcccaccaacagtataaaagcgttcctatttcttcacatcctctccagcatctgttgtttcctgactttttaacgatcgccattctaactggcgtgagatggtatttcattgtggttttgattttcatttctctaatgaccagtgatgatgagctttttttcatatgtttgtcagctgcataaatttcttctttggagaagtgtctgttcatatcctttgctcactttttgatggggttgtttttttcttgtaaatttgtttaagttccttgtagattctggatattagccctttgtcagatggagagattgcaaaaattttcttccattctgtagcttgtctgttcactctgatggtagtttcttttgctgtgcagaagctctttagtttaattagatcccatttgtcaactttggcttttgttgccattgcttttggtgtttcagtcatgaagtctttcgtgctgggcaatcttctaagtgccttttgtatactgactcattcaattctcacaataacccaatgaagtaggtatattattcccactgttcagagaagataagggatttccccaaatgttgggcacctaatgaagagctgggattgaaagtgagtaccctggctgcatgtgtttatcgaccttcccaaactacctctccagcacctgcaccattccatattcacttctgtgtctctcttgcctaataagtggtaggttaccttccacgtactgagaaacaagactcacacccctgactcaggagtaggtgaggggggcatgcagggtaatatgcagaggaggaggaacctgaggttggtcctagaggatcagtggagaaggaccattctcagctgggctataaaggctggacaactgaaggggcatttcggggagaagacacagagtgagtaacagtgcagaaatgatttaccatccatccatccatccatccatccatccatccatccatccatccatctacccgtccatccatccaacaagcatatttggaagcctccagtgtgtcagggcttgtgtgagaggagtgtttggtgggaggggtcttggtaggtcatagtggaaaggacaaagtggagtgggaagaaaagatgcagttgcttgcatttgcaggattgttgggcagttgccacaggccttccttcagtgctgtctagggctgggccaggtctcctgggccattactccatccaggaccatggagatggacaagtgtttgagaaatgggcaagtgagttctcagtaccttcttcaagaagtccccaagctggggttggacatggcctaggacatgaaacttagcatttacggagcacctactatgtgccaggcactgcactggctgctttgcctacaagtgcattttaattttcaaaacaatccagtaatgaaggctattttatctcttttttgttatgggaggttaaggaatttgtccaaggccacataactggtaatggcactgtcaggactcaaacccaggcaggtttgactccagaaccatgagctttccactatcctggcccatttcctgatttgaaggcaccttttctgtcaaagcctgagtcatcccaggccagtgcctgatgggagaaggaaaaacaccagacaagttgtttatgacagtgaaatgtactgcaggctcactgggctctggggctgccacctgctttcttcctctggatgtgactgacctcctctgtcctcttgtttaaaaagttcacaagctggcattgggcatgacctctctgagcagcagactctggaggcagtctcacccagctttcacccagccagtctccatttggctggaggaaaccaaatggtggttgtgtgcgccagcagtaagagctacagggcagagaggaaagcagaggttcctgtggactgaggtaaaagattgcagcaaacattgtggaggcagatatatttaatccaaatcctggctctgccacatgctgtgtatggcagatcgtattttccaaagatgcctgcaacaatatctccaatctcacatgttattgtagtacatgaccttgccactccttccactgagtagtatacttactcttcccttgaatttggttgggcctgggacttgtttgtaaccaaaaaaatggcagaagtgagagaagtgaaacagtgggatttctgaggtgaggccagaaaaggtgaagaaacttgtacttgcttgctgaaattctcaagctggaatcccgagcctccatgtgagcagtctgactgccctgagaccctgagaccctgagactacagaaaaagagaagagagagattcccagccagcctacagctcccccagcactgtactgttccatctccagccattgtctgactgcaacacaccactcttcaagctagaaccactcagctgaggcctcctcaaatttctgacccacagagaacataggaaaatagctattgttttaagccactaagttttggggagattttctaatgtagaactagagaactagaatactgtgtgaccttgcatgagccatttcgtttccctgagttgcagtttcctgctcacagcattgttgggatgaagagtgtgactgcacctagttgatgaataacataggggttggatgaatgaatgaatgaatgaggaagagagaagcctgatccctttctcaccattccatactgagagccagacttaaagcaactgtaggaggtagccttgtaaatcaatcctcttgaactctgcaagggaaaggagatgggctgttccagtaaaaggtgccactgtaaggtgttgatcattttggacaggatctgtttaaaagccagtgttttaaaaatgggcattttctgggacaactctctttcccttccccctccaaccctattacatattccctaaccttgaaagcctcactccagattatttactgcagtggccctgtttgagtcaagaaacaggacatgggcaggaggagaggagggattgattgaacattttcaattaaaacaagctgaatttaaaattcaggcaaggagaggcaataattctcttggctggaatgcttttcattgtattgtagaattaatagataaaaaattgggggtgaaaactcccaactattcattatgaacaaaaatctcaagatggtctgtaagttaaaattctcatcattttcaggttcctgtgtaggtcattgatctgtttctcaaaaatggcagggtatagccagccacatggggaagatggaatcaagacactcaaagcaataaaccaggagaattcagctgggattgtcctaaacttggactgactccatgacttccatacagagctcttttgaaataaagtgtgggtgtaagtagccctagcctcctatttaatgaggtccttcaacaggtaatgaaggtttgaacatttactgttcattctcattcattcactcattccttcatgcatccattcaaacgtttgttgggctcctcccatgtgtatactgctatgaagaggacagggattggggttaaaggaaaattagacagatacactttatagcctagagaaggaaactcacatgttccagttaactatattacctgggaggctgttgcactgtcatcttcacaaaagcaggaactattttttttagagtttactccgcaatgcatacagtgtagttactatcaccaatcctcaccaaagccctgcaaagtcaaagtacaattcgacatatatttcacagatgaggaaattgaaaatcagagagtttacataactaattcagagtctcgtggcttgaatgtaacaaaggtagcatacgaacttcagtgtcttctaacagcgtgcgtatgttgtttcctttcttgagtgtaatcataaattcaaacacaaaattctgtggatgtgtggaaggagattgaattccaaatggaggaattgtgaaaggcttcatggaggtgcacatataacaaagatttgaaggacaaagaccggtcttaaagcgggtggaagagaaagacaagtatcagcagagaaacggagtgcggtcaggcacatgacctgaaataacacagaaaagggtccgaaggcccatgtagctaaccgcgtagagtggaaggtgacgctgaaatattaggctagagacaagtgagtgaaggctttgaatgccaagttaagaaacttaaacttctattctgtaggcaatgaaagccagtgaacatatatgggttgtatctgtaaatatgaatttactcagtgtatatttaatatcatctactatgtttattatgttcaggctttttggaaggctcagggtatactatggttaaaaacaaaagaagacaaaaccaagacaatggttcttaagtctagaagcagagacaaatagcgaggtagtaaaacaaacaaacacacacacacacacacacacacacacacacacatacataatagcaattgatatatactatgaagaaaatgcacagagtctgtacctgcagataatgcaggcgtgggaaggcctctctgaggaggggatatgaactgagagtgagcagtgactgcagcggtacctaagaagagggaagggtgtctgggaagggtcctcgggtgagagacggaaactggaagagggctggcagagggtgataggcaagggctagatcaccaagaactctcggccaccttaaggagtctggactttcttggtgaatgggaagctactgaagagtttgaagcaggaaaatgacacggtctcatttttatttccaaagtcactgctgcactaaaagagaaggcaagagtggaagcaggcagagtagctagggacgactgcaatggtacaggggaagaaaagggaggtcccagctgtacagaggcagtagagatgggaagatgtatttgtaggaagagcaaacaggacctgcttccaagttggatgtggggcccaaaggaggggaaggagtgaaggatgactccttcatctttggctttagcagctgggtcgatgggggtgccctgatctggcatatgaaagaatgtggcaggaatagcttcaggggagagattaggaggtcagttcggagcatgttgggtttgagctatgagacattaagtatccaggttctgaatcagaaatgggaaaaaatcagaaaatgggaattgtttctgaattttcagctctttgggattattcatgccacaaattcttgctgactgtgcagtgtgttccattctgctcaggtctccacctcttcctccctgctcttagggtgtcccaagggctttaggggaatggcagtaactgaaggatcctctgttctcctgtctcagggcctcagatctggggccttgagagtgcacacaagtgggaatcaagagaccaatgtggttttcatcattaactagccatgtgaccttgggccatttcccttcactgggcctaacttctctgtgggtaaatgtagtctcttgagtcctttttcagttaacatggtacattgaagcaaagccctcaatacaataagcttatgagaaatcccatctgcattctttcactcacaaatatttagggagaactgactatgtgccaagttattttagacacttgggatatacagtgaacaaaactggcaaagacctctgtctttatggagtttaaattctagctatgggaaacaagctgtagacctaataatacatgtgtaaattatatagaatgctggaacgtgataagtgctatggagtaaagataaagagtagggtaaggggagtgctggggccaagaagaagatcgcagcattaagtagagtgctcagagaggcttccttgagaaggtgggtgggaatgggcttgggggaggtgaaggtgctggccagcaccaaagcggagttaatcctcctcatctgaaacacagccctgaccagtcatttcacaattaggctcttgctaaatccagcccaatcccaaactggggataataatcaacctcagggacgagtcctccctcatggggtcaggaacacctttttcgtggtaatggctgttttctgtctccaggtccaggtcctcttcacctcccagagcagcttcggcagagacaagcctcacacacatcctcccgcctggcctgcggcctcccttccctgtcctgctcctccccttgtggactcatctctgaagctttctccatacttctcactccctgcagctcttctagaaccctcagcaagctcagctggcctgactgcattgaagggtgctgagctctgccccacttctcagacacaataacccacttctcctttccccctagttgtgggccatggcagctctgattaccatctccattttgcagatgaaaaatcagaagtcacttgtctgatgagtcacatcaagtattggcgcaaggaggattgaaacccattgatttattctctcatttgttcatttatatattcatattaagtggcttctatgtgccagacactgttctaggagctaggatacaacaaagagaaaacagacacatccctgtcctcataaaggtcttttcttgccattatcctgcttccaaataagaaaattgaattcctacctgctccctgtttggaaactcccacctagaattcattttctgctcatactcctgcccctcccagcaacagatgatcaccattaaagggggaagattaattgtgcagagggataggccaaggaaaagtgatttctctttggtaaggctgacagcactgctagaatattaagaggcacctgcctaggagcctctaggtaaagctagaagaaaaatgtgacaatgaaatatcttttgtctctgcctgcctcaccaatcctcccacagtgtcagacaagtgcatgactaaacaggtgaatccttctctgaagtgcagtgtggaggctgcagatgcaattgcagagtcctttcccattgcaggcaagtccagaggcaccccctaggtaagaagacctgtgaaagagaggagagggagaaggagagggagagggagagggagaaagagagaaagagatagagagagatggattagagggtcagggagagacagcaggagagaggaagagacaaagaggccgcagaggcagagaccaaaagcgaaagagatgcaaatggacaggaaaatacagagaaactggtcaggatgaggcaagaagataaggagagaaggataatcagagaggctgagagagactcaggcttgaaaactgaggagaaatggggtgaggagcagagagagaaaaacagggagcaaatgacagaaaaggaaagaatcaaactgaaagaggtgtgagagagatataaatgtaggcaacaggagaagggagggagagaggggagaaaggcaaaagataagacagaaagagacaaaagaaaaaaatgcagagaagcacagccgcagaggacagactgtaaatgagatgcataagactgaaatagagacaggaacagtgagagagactgagaaggactgagagaagaaggtggagagacacagatagggacgggaagggaggcctcttttttgatgggtgaaatgcaattccacagagtaggtatttcctgaaaggctcacttcacggaggatgctggagatgaatgcttatacggaaattgtgagaagagtgtccaatccatcacagaatgaattaaagtttggggtaactataaggctcgaaattagttttccattgccactgtaacaaatcaccacacacttagtggcttaaaacaacagaaatgtattctctcagttctggaggccagaagtcagaaatcagtttcactggggccaaaatctaggtgtcacaggcctgcattccctccacaggccccggggagaaaacagagaaatagttggtttctggtggctgttggcattccttgctttgtgatcatatcattcccatctctgcccccatggtcacattgcctcctccctcttcagtgtatgtcagatctctctctgcctgtctcttctagggatacatgtgattgtatttaggacctatccagataatccaggatagtctcaacctcccatctgaagagccttaaccataacatttacaaagaccttgtttccatataaggtattattgataggttctagggatcaggaaccgaatgtctttgggggtcattattcagcctattccacactgcctgagatttcatctgcttagctaagagctggcagatgaaacatcctggcatacccaggatgaaggtgctgggtatcaggggtggagttctggctctgtgtaagacaccttgctgggtgctccaccaactccaccccacctgacctacacatgcagcaagtggatttaccaggattcagacccagatatgtctaatttcagagtgctttttgctggcattatttgctgcctctcaagggcaatgttgcctaccgtacttcttaaacatagtaaacctgctcctcctcttcctccactgctattgcattgttcagatccttgtctcttatctgaactattgcttcagcatcctaattggtcttctggcttccagtttctccccattattgctgagaatgatgttctcacaattgctgaccttgtcacttcctgacctacaaccctacactgattcactgtcacctccaaggtaagacctaaattctcagatctggctttcatggccttccataagctagtataagccttatctcctgacactgtattccgttgtgcatgtatttagaaggccaggtttaaagtccaaaaagcatgggttttaatcctggctcctacatgtttagctgtgtgaacctgggcaggctatttactgtctctgagccttagtgtcctcatctctaaaatacataatgcttcctacctcaggattattgcattgattagaaattatatatccaagatacccagtacaatgctggtatgcagtagcttttttattatcattactacatatgaaactgtcatctccaacaaagtatgagctcttcaaggacaagagtgtgtcacattcacatttgtttccagagttatttagcatgttaggcctatgaacaaaggtagggagaaaaagcaagacaaaaacaaatcaagatgagagagagagaaagaaaagaacagagagacagagacggggagagatgaagaaactatttgtaaaattctgtgttttctggacgtttggtataacatcttgtaggtttcttccatgctgtgtgccttggtttcctctcctgtaaaattggcgggcagttgaactagatgatctctagttctaattctcactctccgctctaccctgggaaaaacgtttccctggagcaggggatatcctttctgaccaagcagatgtgcagcagctttatcaggtgtgacagtgctgcccatcaccctaatggggtcttttgaagagaagccaagttagaggctggtgggctagatcagatggagatctgacctcatttttaatgtgcctgattctggatgagataaccttggtgggtatttggacttcagaccacattaggcaggttgctgttattcattcacttgttcattcattatttatttttcattcattcatttatttttgagatggagtcttgctctgtcgctcaggctggagtggagtggtgcgatctcagctcactgcaacctccgcctcctgggttcaagtgattctcctgcctcagcctcccaagtagctgggactacaggtgtgtgccaccatgcccggctaatttttgtgtttttaacagagacgaggtttcaccatgctgatcaggcttgtctcgaactcctgaccttatgatccgcctgcctcagcttcccaaagtgctaggattacaggcatgagccactgcacccagcctcattcattatttattactcattgattcattcaacagataagttatcaatcacctcctctgtgctgggccatgtaataggtatacagaacattcacactggctatgtagagtaaacaaaacaggaatggctgtgctctcaatctgtttatagtccaggtactattgacatgtttggctaaatgattctgtgttgtgggggcagccctgtgcattgtagggtgtttagcagcatccgtggtttctcccactagatgtcagcagcacccacctcattgtgacaaccaagtgtgtcttcaaacattgccaaacactccctggggcaaacacacctgggggtgagaaccactggtctagtggttgtacagtatctggtggagatacagcaagtgacatgagagaggtgggcaggatcttgactgggaagggtcttggcttccctacttagaaaaaagtaatccctgaatggatccttggagacagggaaggggagagggataccactcacaggctgcattaatctagtaagacggttatctaatcaccctcctcattactttggcagggaagagtgtcctccctccatttctagcacacctcaatacccgagatgcctctcccttctctacttgcccaagactgctggtatttatagcttgtctgtctaactcagacccacttctcactcaagagggaaattaatctctctctccaaatcccacactatcacttgcctcatggcttcctcattcccctgctcctccaatccaggcaccagcaatttcccagcagtgcctccctttccccactgacagttgaccgtggctctgaaaattggctcttggaatcagctgtgcctgcccagctgggccccagctcagcagtgcctgggactttgatgcagttcaacctgagagggggctctgcttttctgagagatattcagctcctgcttgtctcacatatatttttagaagcttcaactggatgcacagttaaaaatgagactgaagaccaaagtaaatatttgcatagcaggatcttggagtggcggagaagagagaaggaagagaggagttctgatgggcctggcttcaggcctcagctctgcttctgagtggctgcacttgcttggagcaagtctcctttaggtatcagttttccaatctgtaaatttggaggagggactggcttgccgatgttttgaaacatttcagctccgatgttctgtgagcctctatatcagaagggccattaaggggttcctgaaccctctgatactactgacaaactgtgtaaattttctgggaagagtattcataattttctacaattttcaaaaaaaaaatcagcatcttctaaaatgttaagaatctctgctctaggtctgtggatagagataattgagtttatcaccaacttcctggtaatgttccttcttctcattttctaacctgttcccttgttatagtctgactcttctgcgattagtgagaatctggcagagtgcaggggagtaaaaccaagctagacttgaaatggaatgaacaatatgaagaatctatcctgagtgcatctgcattaacttaactagaaaacctcaaagagtcctgtggcccaagtctgctgcagcggtcaaagaacagtgcagcaaagaagatccctaggaggtaactgcaaaactcagctgaagtctgggccattctgtgggtgagaattggggttcggtcttttcctgggaagcatcaaatcctgggctcagaacttaaaaggtccactaaagggtttgctggagggacaggacatggggtcctctacctttaaaagaagcccactcccctgctcttgtgtcttcacccctgattaggcctgaatctgaagcacttacatggattaatggaatgagcaatgtcctgtgaatcaagagacctatatttgagcaacagctttcaccaaatgctgtatgccttgggcaggtcactgacccactcctgggcttcagtttctccatttagacaataaagaggaattggcttgcttcacagtttcaccaaagaatgactattattatagtgaaactccattataatatctcattattggtcatttccttgcatttattcctcattttgagacatccttgttatatttcaagcaaaacagcaatgaatcccatgcctaggaagtgtgtgattataaacttaaatcccaatctttaggaccctcatggttctaacattttatgattttttttttctgctgtgatgttactttctttttaactgttgttttgaacttaaaacttagggaatgaaattaatgttgatgaccacggactattttccaggtactgtgctagtttcatttattacaagcaaggtagattttggtatccttgtgttataggttagaaaactgaggttcagagatgtcacctttctaataccactcagttagcaagcggacggttaggacttaaactcgggtctgtcctactacaaggcctgtggcttgaaaaattatttttatgctataattctttattattttaactttcttaaaattaattcatttattcaatatttattgagtatctgctgtgtaaggtactgtgccagacgctatgggtttggagatgagaaatcagtccctgttcttgagcagcctttagagaagacatgtaaataaaagttgcaagttagggcaatgacactatggcaggggaaataagggaagtcagggtgcaaaaagtgggatttaatattggagacaccctggaagcttctcagaataggaaacacctgagctgaattgagggggtaagattgtcttttttttttttcctgagataactctttattaaacaagttagtcaacaattaattgagaatctatgatgtaccagatacttttctagtttcaggaatacaattgcatacaacgacaaactcttatagagctcacaagggaagaaaggcagtaaaccaaccaacaaatacagtataagattgaaatccaggtgactggaaaagtaagacttggccaggtaaagagagttgaatggcatgaaacagcatcctgaataaaggcagaggcatgtgcaagcatgctgaggcatgatgatccctttgaagatgtttgtcacggctggaatatcttctaaaagataaagaaggaagcaagagaaaaatgcaagcacagatcatgagtgccttgtgtgatgttatgagtatgaactttctcctgcagataatgggaagccaggggagggttttaagagacagaggcacaatgctcaaatttggttccagggtgatttctcctgtggccctggtgaagtgggatttgaaggggacccagactgcagacaggaagaatggtcctggtccagggagaatggtgagttagggcctgagctcaggcactctcaggggagttgtgaggaggacaaagaattagaaatatttgtctagtaagaaagatgatacttgggtgctggcagaggtgactggactaggaaaagcatcaagaatagcacaccaggttcctgccttggagaactgcatggtggtgttcccatcaaccttgggaaggaagtctaaaggtggctcctagaaggcagggagctctgtgctccctagagtactttccatcctgcccttcttagtagtaatgttgcctaattttattttgctataccgatgtgccaagtagctattatgattcctatagtgaatctccattaaaaggaccagttagtggaattttcttgtatctaatgctcttctttggacatatcaagcaaagctgacaatgatcccactgacaggatgggtatgaggctggccttaaactccccatgaggccaacatatttatccaatctttaggacagaatatgttttctctggaacttttcctttctcttccattctcactcccccacacctctgacgggccagctggcctgtctgtctgactgactgcctccctctctttaatatatgctaatcaggatccactcactgtcaggatataaaacatgcctgttccatgtctcactccatcctgctccattttagtaactataagaacaagcatattatatcccacgcgttcattcaccccatgggcaacaggatttcttaaaccagttctatgccacttgtcatcttccctctgtggcagggcctctgcccaaaaggctgttccaaaccccctgcctcgttgcctctaaataactcctactaattcttcagacgtcagctccactgccactttggcaagacagccatccctgacctcagggctgagtcagtctgccatcctatactctcccagagcctcctggcactccttcacagttctctcatgatggtaaatttacattgtatgtgtaattgtttataaatacctatttcttttttgttttgttttgttttgtttttgagatggagtgtcactctgtagcccaagctggagtgtagtggcacgatctcggctcactgcaacctcccacctcctgggctcaagcgattctgatgcctcagcctcccaagtagccaggactacaggggcatgccatcgagcctggctaattttttgtattttagtagagacgggatttcactatgttgcccagggtggtcacaaactcctgagctcaggagatcctcctacctcggcctttcaaactgctgggattacaggtgttagccactgtgcctggccaaatatctgtttttttcaccaggttaccaagttctgtgattgcaacaatgatgtctgctttgttcaccataatttcccctgtgtttaacagtgtctggcacatcaggtgttcagttaaatattttctatgtgaaacaataaatattgctaatggcaggtatttacattagcttccattccttttcttcttcctaggccaggattatctcaggatttcatgaagaggagaaatggaggtcatttcctagagattaatggataatttgattgtgagaagaaaattgtttaaggagcaggggtgggtatggaggcaaatgtcacacactccagaaggtaaagtgacctggctcttcccctctcactccttggaaagaaggaaagctcatcagagccaggaccctggaaaagtgatgtgatgaagagaaggaggccctgaataccaccatctgaaggcatttccaaggaagccagggatgtgactctgtctcggttgcagagatcaaaaggttttgtgaaggaagcaatggctctctagcccccttctgggtggattctggggtagaaggatccggttcctttgataactggttagttatagctatagggtgaagccaattgagtaacattggtctgggcttccagagacacaaggtcttcttgaaccataagctctcagaacaatgccccacctaggcagagcagagaaccctgaaccttttgcctggagagaacaaagaagcgcacagctcaggagccaccagacctgggactacccattggacccctaatctccactgttcttggcctgtctctctttcccattagattgtgagctctttgagaacagagactacctcttctccatccttgtttccctagcctagtacaccatcaaataatgctgtggaaagaaaaagtaaaggaataaataaataacccttagataagtgggtcatccaccaatcctcaattcctgattagtaaaatgagaataacaatagctactaacaagagtattgtgtagactgtatgacttaatgaatgtgaaagcacccgtatggagtttaacataaaatagataataaaaaatacattatcctctttgtttcggctttaatcacgcatcctcgctttaagtactccctgaactttagtgaccttcatattttctagccttaacttgacagtgcatcagtggttaaagaatcataaaatatcagagcaagagggcaccaaaagtggacatttgtcttgctttgtcttgttttattttcctgctcttaatgtattcccctctcacacacatcattttcctgtattgagcccccagtctcaattccatgactcaggaggagctgactccactcagactgtgggtggggatggagtcagcccaatggtggccaatcagagcactgatatacctctttccacagtgattagtgacgtatggcatatggcccatacctgactcagttttggaacttgtgaaacagggaattacccttatgctgagagggtgggatatccaccaggagcttctggcagccaatttgcttctagcaggggagggctggttgaataatgaagccaatgcccaagaaacagtgctgagcggttgaggacagagagcttcagaccaagccttgatgatgctgagtccttagatccagtaatgcctaaaacaagtatccctttggacttttgagttttatgagctaattaatttccctttttatttaagtcagtttgagttgggttttctgtcccttgcaaccaaattttggctaatacaagatgttggagtttgtttcatcacacctcttaattttacagatgaggaagagatttgcaaatcatatgagcagtttttacacacaaccaattttccaaataagtatattgcttcaattccttttatccttactgctgaccagaacaggggcagattgttcttataccgggatagggtcatagaatattgattttggtcacagaatgcctaatctttctgtaacagagcaaattttaaaattcaagtccctgggaatcagttttattttgcattacaatgtttttatcccccaagcagaactgctgatggctgtccttttccttccacacagtataatcagcagcaattaattataatcacaaggagacagcacaaatgaacagagcattaattggacagaagtaatcaaaatctcccttagcccacagttagtacctgtatgcaggaagatgtgaggaggcacatgcatgtgtacacacacacaaacatgcacacaccccatagtcaaccagacaataagaagaggatacaggatgagcatgctctctcatcagcatggtgtagtagaaaaaaaaatcaaggactttggaatcacaaagatcccaccactaaccagttgcttaaacttagctttgtcatttctaaaacaaggatacacagacctacttcagagtggatgagaatattaaataagagtactgtatgtaaagcactttttactggtatgtagcaggaactctataccttctagttctttttccctccactgtggctgctagagaatgaagatctaataagatcggaaattttagaccctcgaatgttcttaatccagcctaaccaatttgattgtctcccccagaccctccacttaatcctataccattcccctttcccagtctctgccccctcccctacattcctgcttcctcttgcctctttgcctctttcccctcttggttataaattctgggagggcagcttggtatccctgttgcccctcacaggacctgacacacagtaaacaatgagtggacatttgtttaataactattgatggagcctgtgtctgtgcttatgttctcctttcacctgcagcatccagcccttctatcttggtctcagtcttagtcatccttcaaggcttagcctagaagctaccacctcctccatgaaatctttgaaacttgtccctaggacccctatcccctcctctgaactcggaacctctttcatgacacttgcagctttttatcttgtgttataagatttacgcaggtgttgctttttcactatgacctcaagtttcttcactcaatcattcaacctctttgagttagtgtatgctggtaactatagatactgaggcatcagaaagggtatgtgtccttgagatgctcaggttcaaactagtacttgagcacagcaactgtgtctgactcatctttcaataccccatgccttgggccactgtgggtgatcctcaaatatttgataatggcaataggttgcctaggagaaggcatctgagctagaatactggtgagtcttgtgaggttatagaaggccagtgagctccctcaggttggacacaaatgcccctgggctttctgaaggaaaatattttacattatggagagaaatctggctctagatcatgccatatactatgtacttgaatcaaaaaatccctgaataagctgtgacttggtacccagggatatacaccttcaataatttacttgaagaagctctggcctacagtcagtcccagctttgccactggtttcacagtgatgttgaacaagtcatttatcttctctgggtatcagtttagctacctcaactttatgcaaccaacaattatggacacctactgtgtttctggcactgtgcctagtcctggaaatacagaaataactcatatatgattagcaattttgaaggcactaatttagtaggcactataaaaagggccatcaaagagaggtgttgtaacaactctacattgtgtagctctcattcttcatttctttctggataaattcccaagctcctttacctgacatcaagcttcttgtgatttgcccctgtctagtttctcctccatagtgaccctgcaccctggccatactgcagtgctagtcattccctaatgctccattatcatccatatctttgcccatgcagtatcactccaaaattctctacctgctaaatttatgatgatccttcaacaaagtgaaagtaccataattgaggtgtacacagaaagagcatcacatttgtaaaggaagaagaattgtaatattatagctttttttaaagcttcttttattcttttctttttccttctttctctttccttccttccttccctccttcccttcccttctcttccttcctcttctctctctcctttctttcttttgtaaaaggaatagattggattagattaactctaccaacgctgtaccactggatgatcaatgatgtagtaattatgtaatctttgtactgggtctttggaactcgtgatcacactgtctgacctgtgcttccctcatggtgtttgaaaatgtctcaagagccaattaacccatgtgatggttcattttatgtgtcaacttgactgagatgcccagacatttggtcaaacattattctggatatgtctgtgaggatatttctgggtgagattaaaatttaagtgagtagacttagtcaaggagattgccctccctgatatgggtgggcctcatccaatcagttgaagactgaataaacaaagaggctgagagggaatgcctcctgactacttgagctgggacatgggtgttttttggcttttggacaagaactgaaatacagttcttcttgggtctcaagtctgttgactttcagattggaacttgcgccatcagctctcctgtttctcaggccttcagcctcagacatatcagctctcctgggacttcagctcattgactgcagatttgggacttctcagcctccataattgcataagccaattctttataataaatgtctttatgcatataatctctttacatatatatatgaaagcaggaccaataggtgatatatagatgtagatatggatatagacatagacttagatacagatattgatattgacatagatattctattggttctgtttctctggagaaccctgactaatgcaaccatattgcagaccttgggcttggcttcctgaagaatgttcctctcaatcgtgagtaagatgtcaagtctcctcaaccacacccaacttttcatttcctatattcttggctctgctgttgattattgttttctccctagaagaaagatcccctaagatatgggaaagaacgattttgtagaatcctgctacatggagctaacaggacccttagagataattaggattcttatttcagagcagtgaggtgcctgtccatggttttgttctttgtagaaacttgtggaatgccttcctgttcctccaactctctcttctcctcttattgaaggcttaacctcccttttagacccagctcaaaatctgctccatttagaaggtcttcctagattccccaagtttgaattcattgctctgttttctgtatccccacagagttctgttcatatcttttacttagctttaatttgttttataattggagatagatcaagaggtaagttaggcagatggggtacaaggtattatttgtagtgggataataaagcatcagtaaaaacagaacaagttggagaaaatgatatttatcagaattcttcaccaatatgtaactggaagaaaatttgagactcagagagataaggaacttctgctcaaatcattcagctagaaagtagctgagcttggattcgaatccaagtctgactgcaagagccatgctcttgttggttattcatgcaataatttgtgtaaaatgttaactgtgtgccaggtaccatgctagacactgggatgcaaaagttcaagcctggttgttcagggttatggcaggtagtggcagaatacaaccaaattccttgtgttagtctttggtctctaggtctgagactcttctgtcccactgggtgatttcaccactaggatactccacagccagttccacaggcttctttctttccaaaagcagacaagacactttcttagaataacccctttgcctgccccaatatctttggctgtgcccactgtggaaagagagccaggctgctgccaagttcattaataatttcggctttctggaggaaggagttggattgctttgctcttcaaatatcaaaacatccaattaacacagctaattagcatcactagcagcagtcaaaagaatggcaatttagatgcagaatttcaaaggtttcctagttgtaggccaaggcaacccatctcttgctaatgacaagagttactcacttaggcaattctatagcagccatcaattaaccactgggcagagactggcctcatccctgagtcatttgtctaatcagaactgtgaatagagaaaaagaggcagaatgaaaatggagagaggaagagagggagagagggagatgacagaaatggagtgagggggtctgagagaggagagagagagaattaaaagagataaacagagaggaggagatacagagagtaacaacacacaaagacaaattctcagagaaagtgacagagagagagaattagaaggaaaaacaaacagaaagggtgacttacagatagatagacagacaatcaggtaggtacatagaaaaatacatttcttaaaacatacagaaggacaggacaaaaagcttctagccaccagtagctttggaaaggtcggtgatcactgggaagcctcagcattctgatctgtgaagtcaggcctagctgtaaaagtttaaatcaaaagcttggctgctgtagtggaattcaaaagaggaagagaccaggagactcaaaccagaacttttctcttcccttctcacactgacaactggatttcctatgagccttgatttgtctgtcgaaagtcaaatatgcagccagtgctcccacatttgtgtaccttctcctgtaaacgcagtaagctcaatgatcgggcctatgatcagccaggggggtattgttttctccctcaaggaaggaaacaccaatggatctcctactgattccacctcagacatgactttcccatctctccttctctccattgcacagcctctgcccctgttcaggcctcatggtcacttctgtaggttactgcagcagcctctggtctcttcttgttgctatccaatccgttcttatcactgctgccaaagccatatgcctaagatgcagagctgactgtgtccctttctgacttaaaccttttcaacagttctgtactttccctggatcaagtccaaacccattaatcatggtagtcagggcctctgtctaggctcctgctgccttctcctgacccatctctcccttgtccccattcctcactgacggccccaccacactagatgacatgggggctcctggatgctccacactgtctttacctctgggctcctcctcatactacttggcccctgcaatacctcaaatccctgttcatctctgtgcctttctatgtctatgcttttgtttccatacttcccctgcctatcaacttgttctttgaatgacttcatctcttaaccagcatgtataccagtatcacaaattcaaatgtcttcagaggatggattcataatgtaaatatgtgcaatgataagtatgaaacaatagagggagcagtgacaagtgagacagtaaatgccacgctcaaaaacctcaaactcaaaactcaaccaaccaaccaaccaactcaccagacaacaaaacattttccttgccatacccaccatctacaggacggagtcagccatgggccaccagttgatgactgttgatggccctccatctgtaacctgactctaagcttggcttggcccacagggtcttctgcgctcagactctactttcaactcttgctatctccatgcatctggctccctgttcaggggaattttcacagtctgtgctgtctcctcccctttggacctcacagggatgttcactgtgtgtaaatagctgaaaagaacactaacatttacagtgagtaagccaatcccatcatacacctggcccaggcaagacgttattaatcagtatcttaatgaagcctaattacagcagacgatgcctcctaccaggtaaggcaatggttacagatgggagcaaaccaggaaatcactgccctctcccaagagcttgatccactgcagcactggagggttaactctgggggtctgaatggctggactcccagagtccagccgagggccctattagcagtaagaaatgacctctctccctaccgccaacataaacgcagatgggacaggaagtggagctgggcttctagttggtcagtgaccaccttctcttccagctgacattctgtgtatttccagacatgactgggtctccttgtttctagtatctacccctgagtcaggccttggtaaggcattatagtcttcaaaacatgatctttggttcctcaacttcttgtttttttctttattcctccatttacttctcttttctctctacagcactcaagcatccagggtccctcccaatcccaccttctattgcagttcagtgggttaatagtgcaggctgtggaattaatcagctctaaggtgaattctgaccctccacatctaccagctgtatgaccttgggaaagttattttactctctggacttcagtgtctcataagttaaatgagaacaataatctctgtcttgtcttcttcacatagttgctttgaggttgaattggggaagccgtctagggcagtacctgccacataactgactgccctcccttaatcctgcaacttcactgagaagtcattagggaggagaagttcttggcccttgctaattgctcctttcttgactggggaatgaagtatgggcttcacaattctctcgaaatcatactaaggatatcctagaccactggtctaggataactctagctccttctgcatataccatccactcctgttaatacaataatttcctcatgttactctcctgctcaagaaccatctctggctccctgttgcctacgatctaaaactcgaaattagtactatggcatttaaggctttccatgatctgaccccatataactttttcaactttagttcctaagcctcccttgtatgaactcagcattcaggccaatttcttcacatgctcagttctgtcaccgagcctttattcatcatgacccactcttcacaatgttttccctgttttgtaagttccttcactagactgtgagggtagatgttattttttaaaatttcaatatcaatagagctgataaaatgaaactctcaataaatagttgttaaactgggctaaatgccatcacttcaaatacttcttctcttgtaagttccagaacagatccttttggatggtctaatgtagtcaagttcagactctgaaaccaaaagactttgggtcaaacccaagctctaccactgtgatggttaactgtacgtgtcaatttggctgggccatgatgctcaaataagttgtcaaacattattctggatgtttctgtgagggtgcttgtggaagagattaacatttaatcagtggactttgaggcaaagagattgtcctccataatgtgggtgggcctcattcaatcagttgaaggcctgaattgaacataagactgacctctcttgagcaagagggaattctgcagcagatggcctttgttcttgaaaagtaacattggctcttccctggtctccaggctgccagcccacgcttgcaaactgccaaaattgcatgaaggctaggtgtggtggctaatgcatgtaatctcagtgctttgggaggctgaggtgggaggatcgcttgaggtcaggagttcaagaccagcctgagcaacatggagataaactgtctctacaaaaacaattaaaaaactgcatgagtcaatttcttgaaataaatctatatatacatgcacacacacaccctatttgtcctgtttctctggaacaccctgactaatacagccacttactgtctgtttaccttcatcaggtcattttacctcattgagcctttgttttctaatgtatataatgaggatgattgttcctccttcacagggttattgtaacaactcactgtggccctgactgtgtatgtcagagcacctgtaatttgtgagctatttcaccttgctaaatcttattatcaaggtccatcacctccaggaagtcatctcaattgctctagctctcttttcactttgacattcctggggtcccagaggaagctgggcccacaccacagccctgactttgccctttctttcagcatccaaacacatgtgatgatgcccagcactgcatgagcctggtgaggtatggagggactgaggagggggcctagtagagatgttaatacagaataatctaggggcagctctcaaagctatagcagaggctgctgagaaggactcagacacagtgctgcagtcaattgggtcctgaattgaaattcatcccattgctttttgtctcgacagggtaataaaaaaatcctcagacagtatattacgaatgcaaaggtacaacactggctctctgctctccaccactgtctgagagaaggggacctgttgggggcctgaagaaaatgggctttgagaggaggatagtgggtaggagcagatggcacgtctttggctgagcagggagggctggaccctcacagtgctaagccagtgcttcccgacctttcatgtcatgactctccgagaaatttttgatactatttgcagactgaaggaaaaggtgaggggcttccttctgctggaggttattggccctgaggcttgggtcactccaggccttgtgaggctgtgcaagggatgagggacctgtacgttggtacagcagcaacccattcaagcaccgaggctgggactctatttgatatgctttccttccagctggaagcagagaagatgctgaggtcctcacaggtgacttgaaaagctcagtttggaagtcttattcgggccctcaagccccactgggtcttacagttgctgtttttctttttggatcaagcatcctgcaaatctgatcatgtcattcctcactcaaaatgactatcacctacatgcttaagcagggaacataaaacagggaccccacttctccattgcatctcttgcactctctcccctaatgatttcatctatttttttaaacaacactcttctctctctctctctctctctctcaaaccagtctgcaggtggctggtttgactgatctagaatcaatgaccagaagatagggctttaggctagcttggctccaggccacagtggaactcaggtctgcctttctccctgttcatcctggggtagagctgaagtggcagtggctcccgtgacatgctcttcccgtggaggatcactggagtggcaagtgccagcccaaaccacacaggcacatggaaggcctccatctgagttagttccattagtgtccctttggccaaagcaagtcacctaggtatgcccaacattagtggggctaggaagaatactccaaccacagcccttccctgtacttgaagctccagacaattccagctcctgaaaacagcatgttgtgtcatgtctctgggcattggcctagaatgtccatttcattctgtgagtttcagctcacgggctcctcctctatgaagtcatccctgtctaaggcagagttatgtactttctccctaatgtcccctctctaccttatgtgtcctttcagggtactcttattaatagtaatgtttggatgtccgtttctccataagatggcacttttggaatgcaacagcctttcctgactcattactgggtcctcagccaccttgtatggggcctggcacagaaggaatgctcagaaactttttgttaaacaaatgagtgaataattgaataaatgaatggccagtgtctggtccttttgatttcaatgtgctcaccagcctctttacctggacccaccagtctctgtgtatgctttgaccctgggcccattagggtacagctcaaaaccctatgtctaggttataacagacctaagtcacactgaatagagtcgaaggtccttgacccatcatccatacttgtggttgcagtttgagttcatagaatgtctgatcagggaagaatatagagacttcttcattcaactgcaccttaagggaagaagcaatgtcttactcatcttcgattgccaatgcccagcacagggcatgtgacagagtaggtgcttggtaaatatctgttttgtgtttttcactctcacactttcacaggtagaaaagtgaaaacccagagcgggaaaatggagttactgagttacacaggctgtttctggtagtctggattccagcctggtttccctgatttccaggagcccagaacctaatggactgtttctaaggccttatttcttgacacagacctaaggttacatgaagtaggtccttactaacttcttccaaatccttcttagaacaaattgatgggtcactggtgggtctaaacatggataaggtcatgttgctttaaagccatgaagtcaaaaagcagtgtactgtggtagcaaaagagcaggctttggaggaggccgacagacctgggtttgcgaatcaggagaaatacttgctatgtgaccttggacaaatcccctaattaccttgagcatcaatctgccccgcaaccctccgccatcaccaaatgggaccataatgccactcttttggggttgtagtaaagattcatgctaatatgtgccatttacctagaacatcttaatctcaggtggtcaatcacttacaatgaagttgtgttttcaaattgtacttcaaatctggcctgccgcacttgccatcacctttggagattgtttgcccttacaaagacttccagtctagatgccctgccatcctggtagtttaatattcactgtgctgctgctcactgtggaacagccactgaccataaagtttgacattttgaagatgaaagttctttgaattagtcatgcacatgtgaagtcattgttccttcttgtcctgctctggaatctaaaaatgactttcaacagagcccagtaactttccctcaacaatcaccttccggtgaagaggtatggaggagtttaggccaggtagaaactctcagtcactcagaagaaaaccaaagcagagtgaaggcaatgtgcaccacatttggagagaggggtctgtcccgccacagcttcgcagtctgctgcctctttgaggagcagtaggggctggagggctgtgagaggtgggacagggcaggtgaaatctcacaggcagtctggatgtgaggacaggaggaagaacagtgctgtggaatcctggggctttgggttcagagcttggctatgcctcatacaagtttggtgactccaggtaagttaatatcgtgggttaacgttttttttttacttgtaagatatagtgactgcttcataacgctgccatgagaattaaagaagccataaagcacttagcacagtatctggcacatagtaggcaaacagtaaatctgtctcttctctcgagagattcccagctttctaaaactcaggcgccttcctcatgctgtaaatgttgtgcattcccagaatcccagacatccactcgcacatactatcactaaagtgcttagccaaggggatgtgtgcttgagattttccagtctgccttagtgcgtataagtaggggtcgactacagtcacactttcttatgagggaactcaaaagaagaatcctcttttgctttaaaactggtcatctggcttcgtgtgcctctgtagtggtgcagacagttctccatccaggcaatcagatggcctcccaaccacctggtcagcagatccctgacttattgggatccccatgaagcgagcacacagaattgtaaggcgtaataatagatatcatcccttaccaggagccagtcacggtgttaggtactgacatgcattagctcatttaattctcaccacaaccctgaaaagtttgtaccattacttgtattcaacagataagatatatgaagttcagagcagtgaagtaacttgcccaaagtcacacagggcctggaagtggcaaaactaggatctgaaaccagacatgtatgatttctgagtctgagttcccaaccactgagccacatcagctcaaatccccgcattcctggcctttgcctgaccctgcaccacttagttgtcctggctttctccatagctgggctgaaagatgtgatagtctcagaggatggtgtgaaggatgcactttactcacatttgccttggtgtagtgtctagctagacttcagacagctgcgtgcttgcactgtgttttgggactgtgcccttggcattcatcaggggacactatgagaggcatcctcatgacactcatgttggcatctgctgaaggaatgctcttgaagccagaggccactgcctcctactgggcccccacatggattcccaggtgagatgtttctttaagagctcagggctaggaaatgcctttcattgctttattgtggcaggtgcttttgttataatttaccacaagtgataaataaatgagcaagcaaattaaaataactggcccatggacacatccaccaggatgtcatgtgggcctcgggagattactttctcaccacaaacctttcctgtaggacacactgggaacagagactcctctgggcatgctgacaacctctggttgtcccttaactcagttcacagttaattcagcccctcatcagacactcaaacaagaagctactctgtcctctcttggggaggcagaagtgacagacagtgaaccccaaaaacagttccttcaaggtgaaggtcaagtccccaatttatgaaaagctcaataggtattacactatttgaatctgaatctgaactatggtatgaggaatggggaaagtgaaggagggagagagggaaggaagaattggaaaagaacaaaagaaggaggcagcagagtggggctgaaagggatatgaggaaggacagggactaccgagcccctgcccaggtcagaggccactgtaaaaggcactgacacaggtcccctcattcaatcctcaacatcagttaaggtgtcagagcacaaagcattgctcaaggtcatcgaagtggagaatacttaattctccacttaagagaggacagagtggcttcttgtttgagtttctgatactaaatatgtatttagtgcaatgcatttccactattcgccttgagagagggagctaaggcggaagaaaaagagaaaaaaaagtggaagaggtgggaggaaagaagggaggttgggtggggggagaagataaaaagtggagaaggtaagagagggtgtaataaagttatgtgcaaattgtgtgtgtgtgtgagtgtgtgtgagtgtgtgtgtgggagagagagagtcaaatagaaagacaaaaagacaaaaatgaaaacaaaacggggaatgaaagaggaaagagagatgacctatcagggaagaggaatgctatgcagagagagacctgggagaactgaagggggggtgcgtctcctgtctccagccccacaaagatagctcaagccctccagagcataggtcttagccctgacaaaggaccaggctgccttccaatcctcgatgtggaagggagcctctcacagcagccatgcaccctgggggccaggagagggcacttcaacctcaggcaactgcaacaaagccgcagcttgtggtcccccaaagacaagtggcagagggaaggagctggagagagtccagactgttgctcagttcagtgggttaccagccctgtggccagtatccttctgatggagctaggttctgatgcacatccctactaacacaggctgggaattaaactgacttgggtcctctgtggctgcctctacaccggcccagcgcctcctctaggccctgcccctgccccttccctattctagatctttctgtccaatagagcaacatgcttccaacttctccccagccccctcctgctcttccccttcaccaggaatcatcccttctttgagtccagggtgaaacggttttcaaaatcatttctcgcttactatgccatttgatctgcccggatatttacaaggtaggtgcagtagggagagtgggaaactggcacagatgaagtgtcagctgtctacattcacattaaaaaattaaaatcactggactttccagttcttaaattccatgatgagaacccaagtgtcttaactctttatcataacatatttcctcaacaccagactaaggagggctaatatatgctgtttctagcagagcatcaaataccaaatcccagtcacagactgaaccctggctttagtcacagatcttgactgtagactgagtcctgagactaatcctaaatgaatttgtcctggtaaaatttccaaactatgcacgtgaggacagagatttctattggggtatcagagtactctgaacacacctttaagaaagctgttatttaagaatctgaagaacctcttaggaatcttaagaacccttcatggaagtttccatgaaacctataatccaaacagatttcatctcttctgataacctaggaatttattattcagatttcatccaactgggtacttggctagtaataataataataagagcatcgtttattgagtgcttattatgttccaggtaatctattaggcacctgagaatttgttttgcttccatctactcaaaacaacactgtgaggtaaatataataatcattgttacagatggacaaactgaggctcagagagattaggtcacttgcctaagttcacacaactggtaaatagcagaaccgagatttgaacccaggtcagcctggctccaaagactatgcttgcttcattctattattaacgatggcatctgttatatctcagctattagcttctcaatcatatggctgatttcttcaaagaaagtgtcttttagtggagcaatcagaggatttaatatcagaagaaacaagttcaagcttctgtgaggatattgccccaccacctatgcactgttccacctggacaggcttcctcttaatccaattctgagtttctgtacttctagaggctgagactggtcctggcttaggatacgaacacagagacaaaatgcacctccttctctgacccttgaattccttgtttgtaaaatagagataataatactcatctctacggattgctgtggggatcaaatgaaatgatggttccgaatacactttatacactgatgaatgctgtttatttctggatggcttacccaggtcttggcattctgcaggagcttcataaataccataaaaatatgtatatttttttcttttcttttcttttttttttttttgaactgacatccaagcatcctttacctcctctctctcctctccactgactcatggccaaaactgcatggattgagagcagtggtcctgacctcctcctccctctaagttccaacttgcatccctcccagccacaactcccacctcctgtctcttgagacatatcaacaagccaagcacggccacaaccccagctaaaggcccttgtctcagacagagttggcagctgcctcctcttattggcagcacatttatcatcttaaggaaaatattgatggataagaaatcccagacaggcagcatgtcttggctgggcatgcagcctgaagtgaggtatgagatgctagttttagcgtctttctgaaagaaagggagagtttgtgctcctgtagagaatggccctgtggccccaggggtcacagcaaatcctaagatgaccatgtcctacacgtagtcgatgttcaataaatgttatatctaaattaaataaaccctttgaatgagcctgaaggatggaggccctttgtccaaacccttcattttacaaatgggatctcgggcagggtagtgatttgctcgagatcacagcaagtcagcagcagagactggattaataaagtatgtggctcatgaatctcacatcaaaatactgtccaatacccagtattccactaggagatatcccaaacttctggccagacagtatgatctgacaaactggatctgggctcccgaggggaatcaggaggaaggagatccttagatttactttcagagccgatctcccaggaacacatccttttaaagatgaaaagagttagaagggcaggcgggtgttacttggtgaggtgctgtggcatttacttacgatatgttcacctatctccaactgaccccattcaactcatcctgcccgctgctgccacagtgacctccaggcagcactggtgtggttgtgggtcactggtgcttcactagctggttcccatagccttctccggcctcattgcctctcactccctaactcacacccaaggcccagacatgtccacaggaggaaagcagctctctggactgggcacaactagtctctctgcctgcagagcactttgctcccttctcatccttctagacttggtaaaagtgatggtgcttccttcctgcacctcctcccaccccttgatcccctcaaggttaggttagatgcttcttttctccatgtcctgtgttcccatctgtcacaactgtcctgcagtcactctcctgcccatctcctccaccacctgggaacctcaccatgcataggctacagccactcagttctgcatccccagaaaccagcatagggcctggtacagcataggtgctcagtgagtgtagccttggattccagaccctccctgtccttatcttccccacaaaagttcagaatggagctatctcccactggctcttgttctagcctctagagccacagagaacagatctactccctctgcttcatgagagctctttagagcaggggtcctcaagcccctggccatggattggtactgtggcctgttaggaatcaggctgcaccgcaggaggtgagtggcaggtgatggatcattatgacctgagctcctcctcctgtcagaacagcactggcattagattctcataggaatgcaaaccctattgtgaactatgcatatgagggatgtaggttgtgcacttcttttaagaatataactgatgcctgatgatctgaggtggaacagtttcatcctgaaaccatctcccctcctaaccctggtccattgaaaatttttctcccatgaaatcggtccctggtgccaaaaaggttggggactgctactttagagatttgaccaaagcatatatgtagcccctaaatgtcttcttgccaaagaaaatatccccaattatttttaccagttcctcatatatcatagctttgggtagggtgaccaaccatctttgtttgctaagaaatgtcctggttttggcacagagtcctctgttttgggaaactcctcactcagtcccaggcaaaccagggcagttggtaaacctagctttgtgttccctttccaacctgatgcctcaggacctgtgcaccattttatcaatattcgacatagagtaggggccagaaatgaacacacagttcccagggtcgttgacataacagggcaaagaaaggccaacacctccttactccccaaatctatttctgtgaatgcagccaaaatcagcttcaattctggcagaagggtagtgtggtggatgtgggagttgacacattgccctgttgatcaatatcaaacttaatagtgtcagttaagatgcctaaaccattttactgcacaggaaacctcatttccccaaatcattacttccaaagctgctttcgttttattctttttactctaaaggcagaaatgactcaacatctttgttccaattattgtccaattaagcccccctcaaatgttccaggcgttcatgcattcaacaattatttattaagcttctccaacatagcagacagtccctctcattgtccttggactgataaaagttaggcctaaacctgaaactggttggagctaatcttgggtctttccacttttgggctcttcccacacttgtgcaataagaaggtgggaacacaagtattatatgcataagttgaagggaatattcatatagacaaacaggttcaagttacttaggaaccaaccaggatttattttgaccgtaagctaacagccataatcctgaaacaatatcaactctctttatcatcgacttggtttccatggaggcttgcgggtgctgctagtgaaggctgacagttatcactataaagaaactttacaactttgtaatttgtagctctctgctgacagtaatattaacagcatttcaaattatggccataaacttgacaacagcagataaaacccttagaaacctcattttaggggatgagggaggctaggggaaggtaataatgtttaggttttccaggcctgggcaggagacattcagaaatcaggggcacattttgatctggaggtgagaggcagtcagcccaaggcagggctcacaacaggcagcagctcagccgggcactgcagagagagagtctgggcagcatccagcagagctgcaactgggctatcagggattgcaaatcggtcaaactagggacgctgatcagagagaggggtgagagtgaggggtgagagtaagggctgactggtaggtcccaacctctgcagggttcagaaaaggctcttgtccaacaggaaatggatggaaactgggaagattacagagcagggaggaaggttagataaaaacctaacaggcagagtggagcgaacacacactttgagctggatcaatctggattttacattcgcactctaccactactagctgtgcagcctggggcatgtaggttgatttttttgggcttcaatttccctgcttgtgaaatggagatactatctcaaaggtccaaatcaaatgattctctatgtatctggaaataaacttaaagatcacatcatttcatcttctatgctaaagataggaaaattaggacccaaagcagggaacagacctcctcaaacctacaccacaagttacaggcaaagcttatgctctagtgcagggacctgagcctcttcatgaagcacattctcaatattattatttttaccattactgctactattattattagtcattcattcagccagatagtcaatcagaaggattcatatttaaagatcaaactctagcccatgtctgtagggaggagaaaaaaatcaacagacttcagtacagtttagacttcggttcccaaaaccctctgatggaagcttttttcacttatgaatcttaacaaagctttgaccttgggtatgacacacaagaactgagaagtacctaggtatctttagatgccaaccaataggtgaaacttgactgcttcctactcttctgtcctccaccgaaaatttagtgaaggctctctggcaagaacaaatatctaggcagtacccatccccaaccacatacagatgccgatactgtttctgaacagcagagatcacataactcattgccttgttcttgatccaagtggattagcagatgttgggtgaggcctgcttccacttcattcattcattcattcattcatttgcattcactgagtatctacctagtatcaggctttagctagagaggtgaaatgatttaaccaagtccacatagctttatgagggggtcaggggcaaaaggtcatactggaactggggttttaactcacagtctagctttcttttcaccaagttatcaagcagaagcccaccttgactgtgtacaccaagaaaatcttttcttcattgtgactttatagtacctcgtagaaaaatctatgttgagtctatccaaagcccaggcctgtctccagaacgtcaggcctttagagccctctgccaaccaaacttttccatttggattttacataagtcccttatactcaatatattacatacagagctcaaaatatccccctctccaacccttttctccaatagtctgtagctaaatgattggccttaacagctatcatctatcatattgttttttatttttatttttatttttttagatgaaggcttgctctgtccccaaggctggagtgcaatggcatgatctcagctcactgcaacctctgcctcccgggttcaagtgattcttctatctcagcctcccaagtagctgggattacaggggcccgccaacaagtttggctattttgttgttgtttttgttgtatttttagtacagatggcgtttcaccatgttggtcaggctggtctcgaactcctgacctcaagtgatccacccgcctcagcctcccaaattgctgggattacaggcatgagccactgcgcccagccccatattgttttcgaatcaagaactgggcatcttacttgactctttcctctaccccgtatccaaataatcagcaagaatactcaatccggccaggcatggtggctcacgcctgtaatcccagcactttgggaggctgaggcggatggatcacgaggtcaggagatcgagaccatcctggctaacatggtgaaaccccgtctctactaaaaatacaaaaaaaaaaaaaattagccgggcacggtggcgggcgcctgtagtcccagctactcaggaggctgaggcaggagaatggcatgaacctgggaggcggagcttgcagtgagccgagatcgtgccactgcactccagcctgggcgaaagtgagactccgcctcaaaaaaaaaaaaaaaaaaaaaagaatactcaatcctacctgttagatattggaacatgttaaaatgggacttctaaaattgtagtttcgactgagatctcaagactatagacattacagttcagagtgaagtatgaaaccaccatgcaggacttgcaaaagtaacccagaaaaccagtttcaccatctttagctcaccttcagacatgagagccagtggaggggaatagtgaccccaacaggggtaaaccatcagatcaccagaggcttaggaaggaaccataagcaactgaactgagcagacacatctgctcacatcaacagagctcaagcaccaggagagggtgtgtctaaagaagttcgtgagggactgcccatgctgtctcatgagagtactagtcccctaagacctttcctgttccttttctcctctccctcatcttgctcaaccttggaggagtaaacagctactgttacccagattgaggggaaaggctgggaagccaagtcagggaaacagaagtgagccagaccctaaccccttggtcacatgagcagcctatttgagacaggtctgagctagaggatggggagggtttttacttagaagaggtttgatgtttttgattggatcagacatagtcattgctaaactgagactgttttgtgactagaattaattagagaacttttaatttcctgagagtgactggagactcatggggcctgccagagcttttatgtctctagatctataatctctatctatctatctataaagccaatgggagacaaaaaataaagttgtttcataattgcaccttgtgagtactgcctgttcaatgtacctgttacatatttcacaaatctttctctttctctccatggtctggctctgcctatatttattaatcacctgctgcttctggcccagccccagctaccctccaatcctttggatgtagcatcctctctctggcatctgggttctcccctgtacttctccctctgcattccattcatcctagaagtctgagccctagtttctcttcctccacgaagcctttcttccgaccccctcctgcaccaccccagctggtttaggtgactcccactgcttccccaaccagcagagttcccctctgccagaacttttatccctctgtgatgctattgtctctttacctttctccctcccctcaaaactgtcttcatcttgaaagcagagaccaagcttttttcatctgtctttttctagtgtctaatgtgtttggttggatggatgagtaaataaacgatagcttcaatgtgtgatgtaggcttcagaggacgcagtgcaaggcatatatgggctctgaaatgagactaacccaattaactgaatttgatatctcagcatcttctcttgaccacatcagccatacccttccccttaagagccagcattttcttatttcattgtgtccacagctacaagcctgggtggaaaccagtctgctcaggacccaaggtctctgttcccaatgtttttctcatccattatgtcaaagagctatttcttcttggcttgtaaccagactaaaaacaaatgccagataagctctgggttactttatgattccagtttagcctttctctccctctttttcaaatcgtttgaacagagcatatttattacttggcaggccagtaaaatgtaaatagggtttcctgaagaatggttcaaaattcgtaggaatttatcatttcacaaaaacaacaaatgacaggaaggaaaggcaagggacctaatatttaatggcacagactatatgcccggtgatttatctgcatgcattctcccatgcagccctaacaacaatcctgtgatgtaaataatcttcctcactttacagatgaagaaactgaggttcagagtggttaaatatgggattagggtctcagcgagaatgacgcaaaagagaactcacacctaggactctgacaccagcactgtattcttgccacagcatggacaggagagaggccaagaggccaccggccatggcagaagcctctgaggatgtctctcttttaggttctgttgaaagctatgggccttcctcccaaaaaatgaactctgcatatttactcacagctttgcatacattttagatggttcacagggttttgttgaagccatctgtaagcccctcaattaagaacccctaaactaaaagaatgaaggtagctattggttgggcctgactagctgcccgggacacttttgtattgattttacctattaaattagaaactcttatgttcatggaatcactgaatattaaaactcaataaaaaagtatgcattattgataacatggaatattgataatccatggattattgatccaattaatctaagcatggaattatataacttacattttagaatcaggaacatcttagaatgtcagagctggaaggaactagaatagtgatcaagtccacacataattttattccacaaaactctgatgggtaggaagtattacacacacaggctgagagaggggacaagacttgctggaggcaacccgtaatagcgtggagtcagaattcaaatactagttgctagttccaaagccagattgtcaagttaaagattcaaccaacagaaggaaagccatgtagtctgcatggggctgagacaagtcaagacaagaacatttgttgagtacctaccagatgccaggcagtaccaggagaatgcagatatagtgccttatttcaccctcccaataaccatgcaaagtgagtactatttttattttacaaatcgggaaacagattcagagtggtgagataaccagtacaaggtcacacagccaggtaagcaccaaccaccatgtccatttatttatttcccagatatagtagagaagggaagtcagagagcaaaaccctggtcatgtttggctggtgcttttccaaggagaagaactgaaccaatggacacatatgctctggtctgtggagcggcggacactattctggacctagatgaaatatcccttgggattctctgcagccccagcccttcctgatgttatactcatccagtatcctctagctaattagtctggcctccatgatactaggaagggggcaccctggatgacagaaacaagaaactccatcagtggaacggcacatctcccactgtgtgaatcagtcactgttctgcggtcaaggcaagaccctcaactgtgatgaccccaccaatgctctttgccctacaaaccctaacaacagctgctgatttcttgctataacagccctatctatcttctttcacacagacagtggtcctcattcacattcacataaaccttttcaatgtcacttaatatttagttcacagtgcacactcacaaaagctatttcctttaacctcactgcaactcggtgaggttaagtattattatgtcctcctgctacagattaggaaactaatctgaggcccagtgaggttatacaactcacccaaggtgacacatctagtaagtgggtgagcctaggattcaaacccagatatgtctgaatcgaaagtttgttctgtttgcataataccacatctatactttaaataaatatctctatttaattcccacagcaggggttagacaagtgtgaaggtccttggtccctttgtaatggtgaggaagctcacctcagacaggttacaggacttgctgaagggtgctctcacggatgatgttggtgctgtcatcagaatccaggtctcctgattcctagtctagaggacattttctcccagaccatattgcctttcccatcagaccatgtaatttctttttatgattgggacatggagccagcagccaacaaagatcacaatctgtctccctgaagtctccctctgttatgaaatgagagttttttttttttttttaagtatttcaaacagaacccaggttaaatcacccttgcatgcattgaatcggcctgagcttccctggtgcagtttgtttcctcttctcatcctctagaggacagaacaaggcagggtaggtccatcagtatcacgacctgctcagcttgtgcatagcctctctactcaccttaaccccttccaatcacgagctcccattccctgtcgccactcccaaatagtcaattaccaagtcttctcagttccacattctaagtattctacagccaccactctggtcttggcctggattatttctcacctggatttttataacagcctcctaatgcatgtccctgtctacaatactggccccctcgaatctgtccttccattgtctacattcaagatcaaacttcttacatctttccacttcagacttatcattgagtctgaagtccttcagccctaagggaccacttacagcttctgcccataccttctgtactcccctctctgtctaccacatcctcccttcaacaacaccctcacccagtttgactagttcatattaaaaactcagtttaggccgggctcagtggcttacacctgtaatctcagcactttgggaggccgaagcaggtggatcacgaggtcagaagtttgagaccagcctgaccaacatggtaaaaccccatctctgctaaaaatacaaaaattagccggacatggtggcgcacacctgtaatcccagctactcaggaggctgaggcaggggaatcgcttgaacccaggaggcagaagttgcagtgagctgagatcatgccactacactctagcctgggtaacagagtgagactccatctcaaaaacaaacaaacaaaaaatctcagtttagatgtctcttttcctgggaaatcttccctgactcctaggactgcgtgtgagttccctctttcccccatgtaaagacattcttgtctttagtatgttctctgttacattccctgtgcctagaactttacctgacctatgacaggcactcaatatatacttgtcaaatgaaaatgtcccagagccttctggaattcctccaccagaatttatcacatacattgtaattatctcttcccttttctgtctccccaagtagactgaaagttctgtgagtcaggaatcatgcctttttattcagtattttaccctaggtgccttttatgattcctggtatgtactaatgctgtgtttacttttgataaatgagtgttggctgttgaggggtggaaaccttgggcctgaaccaagggtgggctttctactaagaaacacattttcttctaagacagaagcatgtcagaagtgctaagaaaaggtaggagagcctgtcagattggacagcaaaaaacaacaaactaagggcaggcctcctctggagggaccctcatctcactatgaataagggttgcagaatcccctttagtgcacaagctcaaactcttattccaggcagctctctgtccctttgccataatattatgggagagcaaagcaagtacaatgtggaatgaagcatatgcatgtgttataggagttagcagattctggagaaggcataggccatatgcatcatctaaggtgtgtatggggcatgaagaggggcaatgtggcacataacaggtggccaggactttggaacccacagaccctcttcctcagagcagagcctactcccttggccttgctgagtcaggtgggtattaaagcagactgcaagatgaccctcagtcttgatgactgtacatagggaactctcagttccaatcataatatctctgtgtccaacaggatgtggaacattgctctaacacctggcctaccccctgacagcccctccttctagggccattgccctacttccgatgttcctggcaaggtacctggacaccatacccccaaccctcccaaacacacatacaaacagagccactaagttgcagttggctggtgggactagccctaagtcatgccacgttcagaaaagatgttttcctgcacagaggaattccataaacactcaccaagggttgaaaaaatgctaaaagagcacttctacctccagggagggggaatttgcagaaatacagagttcatttcatctaaagttccttcctcctccctccacttctctgagaaaactaagtgttaggaaaggagacatagatcaacccgaaaacaaaggatcaaggaaagcagaatctgccacgatctgttacagctctgatgcagtgaccttgatattaaaatcaacactcgggaaactagagttactacctaatccttaaaaaattaggcaaactagaaaataacttctaatttcatcatggaaggctttggagttttcagagaaattttatgaagaaactaagaggaaaaggaatttgtcaaaggaaatgcaaaggcagagagaaagatgcacagaggatgagaggggaaagacaaggaagacagaagacaggcaaagaggagagaaagaaaaggaggatgggatgagagagaggacagaaaggaggggaggagggggaaaaagaagtaaggaaagagaagcacaggacaggtgaggagggaggaggagggcatagaaggagagggaacaagggtgagaaaagtaagtagaaggggaaatagtgagtagagggaagagaaagtgggagaggataggttagacaaaagatgaaaagagaacatatgtttttgtatgttcagggttagaaggagtcaagatcatcaagctcttcctcagcaaccctggggatggtcatccagcctgtggacttgcatagcttagatggcaggagactcactgcatcatgagagaagagaggggagagagatggaagcagagtaagatatgggcaggccatgggtccggctggcctgggaaagatttggagcatggcaattggggtaggagtatcatactaagggctgaggcaaactggacaatccaaagacgccaccagaagaagaagcacctccatcctcacctgagagtctcagcccttacctgagctgggggcctaattcctgacctgtcagacttggatactctcggctggatgagggctggcccaaggctgggtggggactaaggatacaggcttcttcagtgtagggcacagcagccgtggtgccactgatgatgtagctgtagaaggagacctctagggtgtagcaataggaagtgtggtccaggagtccaccgaggaagcgacggccagttcctgctttcacagcgtcccggttaaaggatgtgctggactgtgaaagacagagtagggaggagagaatcacggcacctgctgcaaattggattgtgggcaaattttacaacacctctgggtctcagcttcactgtctgaagagtgggatattagcccctcatcacatgattattataaggactgattaaataaacataattaatgacagaagcaagcagagttcttgaggtgcagtaactgccactcaacgaatatttgtggaaaaatgaatggagagagagggagcagggaaaagcagacagaggaaaaagaagcaactacattttgatgataatcagaactaacatttggagcctggcatggtggtgtgcacctgtagtcccagctacttgggaggctgaggtggaaggattgcttgagcctaggagtgtgagttcagcctaggcaacatagtgagaccatgtctctattctttttattattattattttatttattttattttattttattttattttatttattttttgagatgaagtctcgctctgtcacccaggctggagtacagtggcgcgatcttggctcactgcaagctccgtctccctggttcatgccattctcctgcctcagcctcctgagtagctgggactacaggtgcccaccaccacgactggctaattttttgtatttttagcagagacagggtttcactgtgttagccaggatggtctcgatctcctgacctcgtgatccgcctgcctcagcctcccaaagtgctgggatgtctctattctttaaaaagaaaaaaagtaaaacaaaacaaaaacaaaaataaaaccctaaaatttgggcagtgctttcaattgtatgatattgtttcccatgcagtatctcatttaggcttcaaaataaccacttgaagtaggtgttcacattttatctctctatagatgaggaaactgaggtttcctctctatagatgaggaatatgagattgctcatagaggtggagcaagtaagtgatacagcacaaatctgaatccagaactaagtgactccagacaaccaaagaatctacttcctttagggatagctgattcatgtccagaatcactagagcatagggatcatggctgcttctttactaagatgttgacagcacccatcacagtggatagagaaatgaacaagcatgtcactctcaagtcctctgttcaaagacatgctctactacccactgagtacatgatgtcaggcaagttgacttacttgtcttagtctcagtttcctcatttgtaacttggaggtgaaaataatatctctttcacagagttgtgagggtcagttcacttggggttagaagggcattctatgctaacccctggaaatttaagcaaatgaacagaccatggttttaataagagaatacatgtcttattcggcaggagataaaggaagaaggaaaagagataaagtaaacaccaatacaagaaaggcacagaaagactgtgaaagaaacagagaagtgtgtgtgtgtgtgtgtgtgtgtgtgtctattttaaggtaaaggaaaaatcagaaaatcatagaatgtcagatctgaaagacctttgaaatccatgtagtaaactccaactctcctgttttagagttgggcattgaggatcagagaagagaagagaagagaagagaagagaagagaagagaagagaagagaagagaagagaagggaagagaagagacagcaattggaccaggacagatgaccttgactcccacccttaaggaggctgcaatgcagaaacatcaggcaagcccagaaataaggctgtcagactgtgccccttttgtagtccctggaaacttcacccacatgaggagggtctctgaggcctatgacccagccttccagggaacttggactaaggaggccacattcttttctgaaattgcagtggtctcaaatagacagggccatcctatagagattcttacagaaaaaggtatggctgtttctgccccacagctgcaaatggggagctacctgctttgattctatcattaaatgctgggtgaccttatgctgaatactcatcttttctggggccactctttactctcaggtgtaaagaggggactggactaaataatctgccaattcctttcctggtttgacattcaaaagttctgggattcagagtgcatcttaacacgcagagaaattcatcatctccactaatgtcctggcttgaagcaatgggcaggtgagttttcagctcatcaacttcaaaaattgctatgacctttgtgggcctctgcccctctggccacatggaaataacaggccccagagatttagtatcaaaacaaaggaaaatgtgcaaaagctctctccctacaccacatactgatcccctccttatctcctcttcctgcccttttccaatattgcttttgctatgagtttttcccaccccacagcctctctagttctcagcatgtgagattggtagtaacagcaaccgtctctggagtttgttaaggtctttactgcctgcaaagaacttttatatcaaaaactgcatttgcccttccaggaagctataatgcagtgaggatagaaattatcgtccagcaattacaaaaaaattgaggctgagaaggagtcatggagaaaagaatggtgggcatacaacctctgttagcagatgtcttgtgctcatacaaaagaactgggattggtaaaagcagaccctggggaaaggtctgacatgtggtaggtgctcagtgagcttccttttcttgttaatgctggagtcaactccattaaagaaggccgggaacagtagctcatgcctgtaatcccagcattttgggaagctgaagcaggtggatcacttgagcccaggagtttgaaaccagctttggcaacatagcgagaccctgtctctacaaaataaataactaaatttttaaaaattagccagtagcggccaggcgcggtggctcacgcctgtaatcccagcacattgggaggccgaggcgggcggatcacctgaggttgggagttcgagagcagccagaccaacatggagaaaccccgtctctactaaaaatgcaaaaaattaggcgggtgtggtggcgcatgcctgtaatcccagctactcgggaggctgaggcaggagaatcgcttgaacctgggagatggaggttgcagtgagccaagatcatgccattgcactccagcctgggcaataagagtgaaactcagtctcaaaaaaaaaaaaaaaaaaattagccagtagccccagctactcaggaggctgaggtgggaggattacttgatcttgggagatagaggctgcagtgagccatgatcataccactgcaccccggcctgagtgacagagcgagatcctgtctcaaaacaaaacaaaacaaaaaccccaaaacaaaaacaaatgccagctcatcagccagccaaaatgctaccttctcaaagagtctcccaccctgactggtgatgagcagcttgaggacatgggcacatcttgtttacctctatcttcatcacccacacaatacctaacacagagttaggtgtcccgtggagcttaaagcaaactgaactgagtgagaaggaagacggggaggcagggtgtggggggctggggctggctgagagagaactcctggcttacataggagaagtcctcagcattctggcagaggagcttgggaaaaatggcctgcctctggaaccgttcctcatcctcaaagatgttgccatacatgaagccattcatcatggtggagtgggcatggatgtcaatataaaactccaggcttgttttctgttgagagaaaggataacaaatgagaagtctgggctgtagagcttgtgtataagggaccagacactacactacacacacacaccccccacacacacccacccacccccccccacacacacacacacatcaagctgaccctgtgtgtcagcagatttagcagccatttgcaatgtgaggggagggtttaagacaggtgacgaccaattcctcctcacttttaacatggttttccctcagggtctgaaagcactactattagcatcccttttaagaggtcttcagaaaaagtgaaatttattagcttgggttaagtcatgatgttacttactcagaacagctaacacattcatgactagacattcgtggaatttatttctctgattaatgagaaataccttccaggtaacacaattgtatttactttgggcctggttgcagttttgccccaacttggccatttctagctgggaagcttggtgtaaatcatgtccccactttgagcctcagctttcttatctgaaaaacgagtattttaattcaaacctcagagcattatatcgggaatcaaacacagcaataataattactatatttcttgatgatgtaatataaataaaaaataataattactgtcttactgtatatataatgcatgcccaacagcattcttggaactttacatatagagtcttagttaactctttgagttagccttgtgtcatgatgccaggtctaccccacaacagcatataaataatgcatgaaggaaaatgcctttgcagtctgtaaagatggcattgaccagtctacctctgctctttacttacacatatttaaggcactttcttggttcttatggtattatttgttagccttccctgaaggtaggaggattgtctataaagagctcagtgcctgtaagtaaaggatgctcagtaactacatgcagaatgattgaagaaacaatcccagagagattgctccacatactgtaatggactgactgaaacagagggtgtcaggggtggggtgatttttagaccattagatcttcaattgccctcaaatccaatcttcccttcttatatatcagcccagcttatatccattaaccctttctgagaataagggaagactcgcatggggaggggacttgaccaagctcacagaataacggggactgacactcaggcctcctgcccccttgcacaattaacttattgtcatcaatggccaacactagaaacagccaaggcaaaatctagccacctctccatcctctttctagtacatagtcctgggaaagaagaaaagtgcacatttagaaggattctccctccttgggatgcttttaaatgaagttaaaaccaaatgaaaaccatgttgcttctagaatgtgggctcaatgactgtcatttcatttacctcagagttggagtgaaaaattatgtcttgccaagctcccagttctctgggtagcaaaagctgtcttttgggagatacaagatgcactgctctgtgtgatattaaactcatcattttcagctttggaggtggaatacacaatgattcaacaggagccctataaaagtcatcttcacaattttattttcttcaattgtctgtcttttcctgtgagcttttgatgagctgcacaggaaaggaggaggtagaaagatgatttaagaaatgtgtaaggaaagctacagcttatatctctcgatgtcagagctagagaggcccttggaaaccagtttctctgacctttctcagacctgctctgagtggggaggttgcttgcttaaggttggccagcaagttagtgaagaagcaagaattagaacctagcttttcttttacttttaaatttttttgaaaaaaattaaatttaaaaaacttattcatataaatttatgggcgtacaagtgtaattttgttacatttttctgataaccatataggtgtggcttccactgtcccatcctgacacctggcagctgatgtgacttcactttaaagaaccagcacctgaattatgttgattgatcatataatctgaaagtcaaatgatataaaataatttatagtaaaaaaatctcccttctaccagtcacccagttttgctccccagagacagctaatgctatcaggcttgcatatatcttcccagagacagtttgtgcatatacaagtaaatatttcctctcacacccaaaccccctgctccaaacacacaagtggtagcaccataaacacaccattcagatctgctgttctctgaatatatcttggaggcgattctttcttaataaataaaaagttacctcattctttgtgacagccatatataaactaactagttacttattgataaacatttaatgtatttccaatcttttcttgttacaaagaatgtcttagtgatgaaatttgtatatatattatttcacacatacacaattgtatgtaaaataaattcctggctgggtgcagtggctcatgcctgtaatcccagcactttgggaggcaaaggcaggcagatcacgaagtcaggagttcgagaccatcctggccaacacagtgaaaccccatctctactaaaaatacaaaaaattagctgggcagggtggtgggtgcctataatcccagctactcaggaggctgaggcaggagacccgcttgaacccaggaggtggagggtgcagtgagccgagatcacgccattgcactccagcctgggcgacagtgcgagactccgtctcaaaaaaataaataaataaataaaataaaataataaattcctagaagtgaaattcccagatcctatgtgcatttgcatttctgatttatattgacagactgaccttagaaaggcagaacacccctagcctattaccttgacaatataggtggaataaaactttttgatatttgccaatttgatgggtgaaaagcaatatgtaagattagttttaatctgaatttctcttagtactgtataattatcttttactgtatagttaagaatcttttcatatgtttaaagatgatttgcagccgggcatggtggctcccgcctgtaatcccagcactttgggaggctgaggtgggtggatcacctgaggtaaggagttcaagaccagcctagccaacatggtgaaacaccgtctctactaaaaatacaaaaaaattagctgtggtggtgggcacctgtaatcctagctactcgggaggctgaggcaggagaattacttgaaccctgggcgcagatgttgcagtgagctgagatcgcaccattgcactctggcctgggcaacaagagtgaaactccatctcaataaataaataaataaataataaaataaatcaataaaagtaatttgcattctcttttctaagaactctgttcatttcctttgaccatttaaaaaatcggattgttgggctttatttcttattgacttagagaagctatgtattatagaaattaacctttatgtgtaatataaagatacttttgtcatttgtctttctattttacttctgttcatgtatttttcatgtagaaatttttaaatttctgatttttgacacagtttatccatcttttcttttgtggtttcctagctgaattattttactgttgcttccattttattattttgttgtttagttttcaatgttttgtttcagtttcaatttatatggtcatggaatgtgaggtaagggttaaatttcactgtttcaacaccatttattgaattgtgcatctcttccccactgacatttctatcccccttgccatttggttgggatcaaatggaatgtgggcaatgacaataacttccagacctgcccataaaactcctcgtacacaatcacccacattctctcttgcccttctgcatgggtagctacacgtaaaaaaatgatgatatcctaagaagaaagaagcctatatcctcgactcaacacttagaggacaacagccaggagagtcacctgctccgcatcagactgatgtaagagagaagtgaatcttcactgaattaagccactgaaatttggggattgtttattatagaagctaatatcattcatcttgactagtacaaaatctcaattcaaaaagccttattttatccctcaggctgagttaacagcctcctctgcgctcttataattcaaggtacagatctctctcatggcacttactacatgagatgataatcttttattttcatttccctccagaatgtgagctctttgagggcaaggatcttatattgctgatttttttcaatccacaggaccagaacacggcctggtatatagtaggtcatcattaaaggtttacaaaggaatgaataagaaaatgaactgaaggaaggataagtgaattaatgagtaaacaaatgcatcttaagttgttccaacagtaaaaccaggtacttttctgtggctgtgccgggccaaggggtgtgtgtcacaaatgtagggccctgaattacaatttgggaatgagaatagaaggtgggggatggggagagcatctccgttctttccttccaaacttaaggaccttaattaaaacagaatgatgaagggctgtccccttgccagcagccagcagctcctcttgcaatcaggggcctaaagagtaaattaaaatcagtgccaataaaattaaaactactttggggcatatttgcaacataatttagtgtggagtttgcttccacctagacaccagggaggaaatgggttttctttctctattctgagctgctaccctgcttcatctcacttggcacaggccaaaacctgagcttggtgctctgatgtggggccgtatccttcacatttcggcagcacttcggagtttatcacaaattcagttcagtgaaggaaggaccatccagggcaatccaatctaggaaggacagaggagttttatctcaggtttggagacgccatggggaagaaactgaagcttaggcaggaataaccgcaagttgagcagggtgagctttgttattatttctgttttacagaggaggaaatggaagctcagaaagctcaagtaacttgcccagcattacgcagcaagatgtggcagagtcgggactgaaacccaggcctctggctataaactctccatgtcctgtaccctgctgtcctcacaggagcttgcagcctagcaaagcaattacttgattatagtaaggcaagccccatgcaggttccttcagctctgagctgaaggattgtggggatctgtgactgagattattgtccttagactctcaaaaaggcattgaggtatgtgtgtgggaggagcaagaagtgttggagaactcccagacacattcctccttcagatttaccccaggaagatgttttcccctgggactgagacaaaaaagccccaaatctattcttttcattattaactaaaatgtctccctgtctgttttttaaggaatgaaagctatttctgtgttctaaggcaggaaggaaaaattttcagaaaaattgaggactctttctttaatatcaaccaagcaaatcaaataaacaaaataatgcaaaggttctttatcattcatactgtatatttatttaaaaaattttttttgtagagacaaggtttgctatattgcccagtatagtctggaactcctgggctcaagcaattctcctgcctcaggctcccaaagtgctgggtttataggtgtaagtcactgtgcccagcccatagcatatacatatatatatttctgaagtggcacagtgaaggctttcttcctcagatatgtcctgaacatggctgggcagaaattcctgccacaaaaaaagggatataataagtcaaggggacaaagaaaggaacaaccacgtaagaaatccagacagccagctcaaggaaccaaggggatgggccacgggcacttcacctcctgcctctctccatcctacactctggccttctagaaccgccgtaacttcccaagcacactggtgttctcgtactctgggcttttgtgtctattcctccaggtgagaatgcttatcctcttcctttcaccttctggcaacatcttgttcaccttttactgcttatcccaaatgggcccttgacagagaggtcttcctggacgctctcagggatagcagctcccttccctggaatctcacagatttaaaaaaaatatccttctgttaaggtatttatcatctagcttattcattcatccattcatctggcaaatatctactgtgaacctactatgttcctggtgctatcataggacttcagggtgaacaaaacagataagattcctgcctttaagtagctaacacccaggtggggtttacaaactataaacatcagataagcaaggtaattgcagattgtgaaacatgctagaaatgcactaggataaataacatgatggtgaataacacagtggatggggggaaagtctactttaggtagtgtgatcagggaaggcctctgacatttgaattaagcctcaaaagatgataagaaccagccattcagccaggtgtggtggcatgcacctgtcaagcaagaatactcttcctggcaaaattgtctttcaaaaaggaaatggagataaagattttcctgtacaaacagaagagaacagggagaaggagagggaaaggaaaggggagaggagaggaggggaggggaggagagaggagggaaggggaggggaggggaggggagacagaaaaggaaagaaagaaaaggaagaaagggtggaaggaaggaagggaagaaagagaaagaaagagagagaaagaaagagaaagagagaaaaagaaaggaaggaaggaaagaaaagaaaggagaaagaaagaaaaaaagaaagagggagggagggaaggaggaaggaaggaaggaagaaaaagaaaaagaaagaaagagagaaagaaagggagaaaaaccagacattcaaagaagtcagccaaagaatcctgggcaaaacaaaggccctaaagcaaggatgagtgtattgttttcaaaaaccaaagggaaggccagtagccagattgtgacaaacactggagctaagcctggacaggtttgcagggtccagatcacacagggccttgaaggccagggttagaatttggagtttatcctatgtacagtagaaagacattttaacaggggaatactgaaaaacataccttgcctatcatgtagataatggattttaggggggcatgaatgaggcagttgagacagttcccctaagcaatcacagtacagtcatgcaacacttactgatggagataaattctgagaaatgcatcactaggttatttcatcattgtgtgaccatcatagagtgtacttacactaacctagatgctatagcctactacacacctagggtatatggttatagcctatggctcttaggttacaaacctgtacagcatatgactgttttaaaataaatttaatgaggccaggcatggtggctcacacctgtaatcccggcactttaggaggccaaggcaggcggatcaattgaggtcaggaattcaagaccagcctgacctacatggggaacgcctgtctctactgaaaacatgaaaattagctgggcataatggtgcacacctgtaatcttagctactcaggaggctgaggcaggagaatcacctgaacctggaggtggaggttgcagtgcattggcacaatctcggctcactgggattacaggtgtcagccaccacgcctggcctcattaaatttattttaaaacattttagttcttcaataataaatcaaccttagcttactgggacttttttactttataaacttttaattttttaaactttttgactcttgtaataacacttagcttaaaacacaaacacattatacagctgcacaaaaatattttcttcctttattactccataagcttttttttctagttataaattatgggtttttttaatttttaaacattttttgttgaaaactaaggcacaaacacaaacatgagccgagagctacataggatcaagatcatcaacatcgctgtcttccacctccacatcttatcacactggaaggtcttcagggacaataacatgcatgaagctgtcatctcctatgataacaatcccttctcgtggaacacttcctgaaggacttgttgagactttttagagttaactttttgttttaagtagaagtacactctaaaataacaataaaaagtatagtatagaaaatacataaaccagtaacatagttacgtattattattaagtgttatgtattatacataattgcatttccacctttgtatatgactggcagcacagcaggttggtttaccccagcatcactacaaacacgtgaatgagtaatgcattcccctaggccttacaacagctgtgatgtcaccaggtgacaggaatttttcaagttcatcataatcttatgggaccaccattgtacatgtggtctgatgctgaaatgtcattatgcagtgcttaactacagcttaagtaagagaggtggtggtagaggtgagaaggcatatttaataaatattgtggccacatctccatagaacctgcacatagattacatgtgggaagaatcaaaggtttatgacttgaacactaagtagatggtggtttcatgtacagaaatggagaagactgggttggagcccagctgggatagtggttaggaaattgagagttctgataggctcttcacagtttgaaatgaccactgaatgcaagacaggaagtgtcaagtaggcagttgaattcatgaaagaagaaccctgggggagaggactggactgaaggtataaatataggaatcattatcattgaggtgtgtgtaacacctctgggagaaagcgtggaccgagaggaggtcctgggactgagtctggaggcctctaaagttgaaagtttagctaaaagagaaggaaaggagaccgtggagtggtcagagaagaaagaaggtgaaagaatacaaggaaagtgtggttttatgaaaaccatgaacaacaacagaaaaaaaattaagaaggagggtgtggcctgtgaatccttcgaagcctagaactgcatctggttcacttccatatccacaaggtatatcatagggcctgacacacagtaagtactcaggcaacaattgccaagtgactaaatgaataaataaatgaatgggccagctatcttagactcagagaaaggggtataggggtgtgggaagttcccagggcctagatcctatctggaagagctatgggggaggataataataacaacatagcccttactttatgccaggggcaggcactcattaatcctcccacaaccttatcagatagaaacatcatttacaaacaagaacactcaggaatagggtggttgtgtgggaacccgagatcacacagtggtaactggcagagcccaagcagtctggctctgcaatccatgcacttaaacatgacaccataaaagctgttgatatttatgcagtacttcttaagtatggttctgtaattataacaatcctataagggtaataacatcatataaggaaaccaaggcaaagagcttgcaagtggtagatcttagattcaaaaccaagtgtttctgacctggggctaagctctattcagaatagcccagccctgtatttgtggcctccttgacctcagcagaatatatttcaggattattctgagactaatgcttaggtgtggagaaaatgcatcagaagcagcaagatgagaaataaaaacgtattttttttctacttctaattagtctcttacaatctgactctacttgcacataaatggaggcatttctgcatctcctagagatccaggaagagccaggtctggcctggcaggaaggagccttcctttgcttccattccctttctccacgtctatgcctggaaacagagagagatgagaggctcagcccaggaggtttgggtttataatagaccttcccagggcaaatgatgaactcctgacctctgcctcctgctcccttcagtgactggtgatagccataatgactatgataatgataatggtgataaaagggtactcatgagagtagtgtggtttgggggtctggtagacttggcttcaagtgttagtttcaccatggttgagctttaagacctgtagaattcactttccctccctgagtttcagtttaatcacttgaaatttgaagataacaatcacaaattcacacactgtcatagaggtaaatgaagtaactggctttgtgcctaccaaaatgtgtgacagcttatacactgtcaatatattcttttgaatcacacaatgacactatgtgtaggtgctgtgcttggcactggggatatggacctcctggagctcaaaaccttgtgaagaagaaagacattttacaagtaactttctgtgcaatgaggaatgtgaagaagtgcgagtactatggtagcatagagttaagaggagcttggggacaagcttacatatatgtacatttcttccttgttcaatatgaaatctattgacaataaccaccatcttgcacatttatacagttataaaccattttcacaccaatcatttgattctttcaacactccatggaagtagataggattatgatcttagtttctcagaagaagctcagagcctggcttatcaagatctcacaacaaattatgagttgagatgggattcgagcttacatctcaccactccaaaacctctgcttgatcctcaacttgggaagtcatcctatgtgctcagttctgtattgaaagtgcacacagatacaagtagaaaagccaggccttccctcagaaagccccagtctgagcaggaaaacaagacaaaaaaatcagggagctctcaactaagaagaggactgagatacaatttttaaggctgtgagagctgaggaacattttaatttgataattaaaagttaatgttgcttccttataaatcaaaggctgataaaactagggcaccctcaggcacatatttaggaactcagtaaatagttgtggcctgaatgcttggggacacctatctcaggagattgctagctggctcatagaggtaatgatacatgtctaaccactcagctgcagggacaggagtccttggtctatgccaggatttttcttcctaggaaactcatcttggctctctactaagctgctacgtgaccctggagaagtccttctctctctctggacttcaatttccccacttagaggacggattcagtgacttctcagggctctttccaccattatatcctgagtcttatatccttccaaaatctcatcttcctgctttgcagtattcctgttgttgttgttttctctttcatttggcctctaattgaggacagatcttgtcagtctttctaccttatctccttcaagacacaagtgcaaggtcattttccttggcatggccctgtggggagagcctgctgcgagacagcagttcaatcattcccctacgctaatgcagtctttccacttggcagagtgcacatcactacttttcaaagaagtgttcgagggtgccaacattcatgctgaaattatgtactttatcctagggaaaaataaaatggttcctatctgctttatttggtgtaggcagctggaagagcgaaaacaggaagaagaaaggtacaggcaggcacttggcatctctcccttcattctttcttcctctttcttctctaactctctcatcttgccccttttctcttctccctcttcattccttttcttcttctgttccccctttcccacctctctctttcttcactttatagtagggaaggcagacaagggaacagtttaaatgtacatatgcctttcaggtgctgtaagagacataagtgaagactgggtgaaagtatggctgaaggaaccattcaattagtggtggtcaggaaagactttacagaggaggtgactattaagcaaggtcttgacagatgagaaggtgttcaccaagggaataaggaaaggaccctccagtggagagaaagacagtgtaggcagagggagcctgtgggcaaaagccccaagcctaaaaccactagcccattgagggaacaatacattggggcccagcgcagtggctcatgcctgtaatcccagctctttgggaagctgaggcaggtggatcatgaggtcaggaggtcgagacaatcctggtcaacatggtgaaaccctggctctactaaaaatacaaaaattagctgagtgtggtagtgcatgcctgtaatcccagctactgggaaggctgaggcaggagaattgcttgaaccagggagtcaaagaatgcagtgagccgagattgcgccacagcactccagcctcgcaacagagcaagactccgtttcaaaataaaataaattaaagtgtttagcacagttgaagagcaggggaggggacacagaggggggtgaggaaacagactagagaggcttccaaagacccttacatggaaggccttgtaagtcactaaggagtcatgaattttccctataaaacggaaatagagagccacagaagtgttttatgaaattataacaggattacatttacattttagcaagattgttctggaggctgtgacgagaattagtggtcataagactcaaaggcaggtagactagttagaacatttttgttataatccaagtgagaactaatttaaaaatgataaggtcctcaattaaagcaagggctagctaggactgagcgcggtagctcatgcctgtaatcccagcactttgggagaccgaggtaggtggatcacctgaggtcaggagtttgagaccagcctgggcaaaacactgtctctactaagaaaaacaacaaaacaacaacaacaacaacaacaacaaaaaccaaaaattagctgggcatggtggcacgcctgtaatctcagcaacctgggaggctgaggcacgagaattgcttgaacccaggagacggaggttgcagtgagccgagttggcaccaccgcactacagcctgggctacggagcgagacttcatctcaaaacaaaacaaaacaaaacaaaacaaaacaaaacacaaagcaaggcctgggaggatgtgaagaagcatccaaacatgagacccactacaaagcaagattgacagtttgcaatatgggacctaagtttggactgattcccaggtttctggattgagggggggcatccactgagattggagatgtcaccatcttataagtttgagctgtatgtttgcctccttggtacgtgttcccagttagagtgagatgctatcagatgtgctatggttatgatattttgatccaaacaagttgattttttctaaatatggctatttgaatgaaaagaacgtttcccccatgtaatcatgtgttttccgtataaatagaactctttattaatataaattaagcataagtgactacagaggaggtctaccaaaaaaaaaagttaagtataagcattgcacacttttgttaggatacagaatcaaaggtttttttttaaaaaaaattcaaacacttacatacacataatcaaatacttaggccctctattacaatgtaaatgggatactggcgggcttttctgtagctattgctctgctatagacattcactccctccaaagagaggacttttgatttttatgaactgcttcacttagccagaaagcagcaaggagtgagggagtggttgtgagagttaagcaagggttggacaaggaggtgtgggtaacaaacaagctttatgtcttggattgaagggaagtcccacaacaatgcaagccccttcatccatatctacataaaaaccttcatcaaaattagacagaatgaatttgtgtcttttctggctctttgaattgtttggagttttgctctcctagcccctttcctttgacacatgaaatactatcaacaacctacacaacttgtttatagtcattatctcattcttaatgtacctgttttacagatgaatgcattgcttaagtttacacagctagtaagcgtcagagccaaggataaaatctagatctatccataatacaagttcttaccactctatcactctgtcttgattcctttatctttgggtttgtcatggggagccaagagcatgaattattggtaggcaaggaatatattttccacatgtgaatatcaggtcctcaagaatctgccttcgtccccaacctcatttcctactctctgctgataggcaatctatgctttctccatgccaaattgagagcttccagactgtgtgatgctcctctgtgccctccaaggctttgctcattttgttccctcaggcaggaacaccttgccctgcccagccttcctccaggacccaatataagcatcccttcctctaaaggcttccctacgccatgtccttcttcacgtctattgtcactcaacccttcttttttattgtacctatttcactgtttcattattattgctttgtgtctctatttctcccactggaccaagcactcctcaggacctgaaatcacattgtcttcattttaataggtccaacatctagcgcagtgtctggcacatagtaggtgctaaggaaatccttattgaatgaatagatggatgaactaatgatggagaagatattatctttgagcagagactctctccatcctttatcttctctgagaaatgctattgtttaacagggagagagaaaggcagacctcaaagtgatacaacgggtaaaaaattcttccctattctctgggttctttctctttttttcttcttcttgctattggaacaaaaataaagagtacatcataagcaaagctgtattttctgtttattgccaccaggttaataacagtaatggtgtgagaagaaaatgaggtgttacgtaaaaccccgcattgcagattttgctgctgatgtaaagaactcaataaagtgtaacactttaatcatggagataaaaatcacacagcaacttcccacaggctttcagagccttaagacaaaatagttgtggggaaatgagagatgagagaagaatattatcaggcatcagaaaagttgtgcttgggctttttttttttccttctctaaaaaatggaataagctttttatatctacttccaagacaccttgcatgaatttctgtattctctggaggacatgctcaaacttctggaggaggatttgctcattctttgtaaaaatggatttgtttacagagaactaaaattcctgtctcttagttgacttcatggcattttaggaaaacagaggcagtctctaaaaatgaaagaaggatttagatggaggtaaagaggctggtgataataaagtctcggtttctatgatggtctggaattcaggaaaaacatcatagtagaagatgggaactcttgtgccaactctgacactttggagaaatcaccttcttgcctctgttcctcagtttcatcattcttcaaaaaaggatctccaaagggatgcactacatgatctccaaagggattccagatctgacactccatagtctgtgaggctcccagcaagaaggccagttggtggtttagctcttggcatttgctgttgtggttctggactactgcagtaggctcccagctggcctctctgtttctactcaaaatacctccttcctttccccatcacctaaatccattttccatcctgcagccagagtgatctatgaataacaagaggaaactatgcatacaccctggaaactatatgtgcactgctgtaagatggcacgaggaggggtcatgcagagaaggggtctaagattagagatctgggctcaaacactgaactgtctgtgtgactttaaaggagttactttatgtctccaattctcagtttctttaccagtcaaaagaaggttacaatgagatcactcatgtcaccaagctgacatgggttaaatgagctagtgcatgtccaagtgcctgaaacataggaggtgttcagtaatctttttcataccataataattatttcaggtgtaattaaaaatgagggcatattctagggctgtgctgtataagtagtcatttgtgactacttaaatttaaattaattaaaattaacttaaaaaatatagttcctttgtcctactagccacattgtaggtgctcaacagccactgtgatagacaacgcaaaggaaatctaacaccatcatagaaagtctattgagcaggccaggtgcggtagttcactcctgtaatcccagcactttgggaggctgaggcgggcggatcacctgagttcaggagttcaaaaccatcctgcccatcatgatgaaatcccatttctactaaatatacaaaaattagccaggtgtggtggtgtgcgcctgtaatcccagctcctcaggaggctgaggcaggagaatcgcttgaatccaggaagcagaggttgtggtgagctgagattgcgccattgcactccagcctgggtgacaagtgcaagactccatccccccacccccagaaaaaaagagaaagtctgttgaacggcaccattctagtatcttagccatcataaacagtggattcaaatgtaaagcatatatccatatacaactatgcttacacaaacacatctacttttatacacacaaactcacacttgcatacaaaaccacaaaacagggtgttaaggaaaaataatctaagtcctgactccgagtcaatccatcaagcatacaaaaaatcaggtcctgtgtaaaacagctcacattggacatcatttaatccttatgacaactttagtaggaggtattatcctcattttgctgattctgacattgaaactcagagtggttgaataacttgattgaagtcacaaagcttctaagtggcagaacaggacttattccccacgataaaatactgcttctgaaggggcatttcagaagacaaggggctcagaggacaaagtcatcacaaactctttacaatctttgttcaagatgccaatgattggaactgcctggggactatctggcagtcccaggttagtcacagagcctatagaattcagtgaaattgactctaattctaggttgaaagctttcaatctagttttcttggcttatggagtgtggcagtgtcagagctatgtgagattcaagtcttcagaagaggcctgggagcacatgagaaaggtgaagaaggtaataaaactgtaaagaagaagggatcttctaagccatctagagacgtgttcttttcacaacttatttttcctctcttattttaaagacatgggctgtcaaaaattgcatggtgaggggtggtctatggtggagaggagattgcatgtgaggattatggtaacttgaatggctctatgtcagtaactgcctgtgaatacagacaagaacagctaatgagtcagagaagtggatggatggatggatggatggatggatagatggatggatggacggatggatagatggatggatggacaagacaggcaactggacatataagcagtaagttagaaacacataacagagttagaaacacataacagaggcttctattctagctttttgtgtacttctgctacactctgatcctctagaaggctggtattgtttctgatttattataaactccctctttcaccagatatagcatgatatccagcctagagtcagcactaaaagaaagtttgttgaaaaaaaaccaaacacccgagagatcaatagctagataacaataatccttcacatttgtatggtactttgtaatatataaaaagatttgcatgcaatataacacttaatcccaaacctaaccttttgaggttggcgttatgatcctcattttattgatgagggacccttggctcagtgtggtgaagtgacttgcctagggttacgtagggaagccaagggatcagataaataggccagatagaggctgataaccaggcagacacaggcagacaagacagaggaggccaagatgtggataaatgacggagacaaatggagatggatggatacatgctgagagagcctctaatctcttctcattcaatccatcctctatgcatggctggaaataaatttccgaagcacaaatctgagcatgccactcctccacttaacaaacttctgttactctcctgaagcctgaaggataatgctctaccacaaaaagccttcatgatctggccctacccacttctctagctttatgtcttaccacttttctataatgtttttcactccagtcataggactctctttaattcccaagaaagtcatgccatctttttgttttgagacacatggtctcactctcttgccaaggctggagtgcaggggaaccatcacagctcactgcagccttgacctcctgggctcaaacaatcctcccacctcagccttataagtagcttggacctataggcacatgccaccgcacccagataatttttgtattttttgtacagatagggtattgctatgttgcctaggctggtcttgaactcctagcctcaagagatcctcccacctcagcctcccaaagtgctgggattacagacatgagccaccatgcttggttgccattttcattacttcatgtttatttcatgatcttctccatacctaaaattctctccccactgcatgcggatgtctggccaactcctatttatcctttaagactcaatactggcgtcgcttcctttcagaagcctttcctgaccattgtcctagatttggttcattttctgtcctccgaggtcaccctcttctttattataagagcccataggatgggaataggaagaacgcagaccttgaaataaaagagaactggacttgaaccctgttcccccacttactagctgcatcatttggggcaagcattcaccctctaagacttggtttcttcatctctgaaataaacctgataatatctgctccagaattgtgtctggattagagataatgtaaaaacaataaaaaataaaaagagcacgtgcctagtggagaagctgctgctgctgctgtagcctgactacgttgtaccacaataatccaatattggctttgtctctcccattggacagtgagctgcctgaggatggaagctgtgtctaactctgcatccccagtgctcagtgcctaacacatgaccggggcttgctgcatgccagtatgaattatcccagctacccacactgggctactggttaggatgcatttttcaggcactagacagtagagactacagtcataccacagaatcactgccaggttggtggggggcattgaggaagtagggcagtgggtgcatccctaaaggtgagaatgaagaaatggatgactgaaacctgttttacaatgtaagattcaaataatttgtataaattctgaagataaaagatgatatttaaataaatgttgttaaggggccactttgtcccctcccctgaaaacctccagaattgctatgttccatcttccttgtcattatgcacatttagatggaaaggtctgatattcagtgcctaagatattctatgtattttctttcactttccaagcttccttcatttccctctaacttttactttcccagtggaatcacagattccttgtaattttcctcctgcactctccctcttcccacactccctgtctcctgcacctcaggaaaccagcttctgatgaatgaggagtctctccctcctccttccacacacacacagcctggaagaaggggggcatcaaatacaactgaacagcattcaatatggttgaggacaaaaaaccatcaaaatacagaagggcaggggctggcagctgggtcctgagccagtaatatttattctcctccctgactgccagggcagggccttctagggtcattaacacccactacaggctgggccagagccttcattgagattctgctcacagctaaagccatttctaagcctgcccagctctgtcagctgccctgatatctgtttgtgaaaaacggataggccgcccagccctctggcagcctgacaaatggattagaagcaggcttgaggcttcctggcagaggcccacacctctgtgcttcaatgaagggtgggagagaaaggtattttcctgtcagatggcctgacttcccaggcagggagtatggagagcaggaaagagtaagtggagggagaaagactcttcggggagggtcatggcctgagccaatgctgatcttgccctgagggcagagagatgtcaggacccagtacactccctgggtacaagagctgcctgtaggactgcagggacaattacttttatttttttcttcatccttaaaatggggataataatatctactttgcagtggtgagaactgagttaatacaaataaaggacttttaaaaatagtacccggctagctgttagaactcagcaattcttaccatagaatgagaatgtcgggcatctcatttaattttcacataagccagagttttggccattatcctcattttaaagatcaagtttcagaggggctacctcacttgcccaagatcacacagctgagtaagagagagaaaggatttaaaataaatctatgtgactgcaaagcatatgcctttaaccaccaggcaacactatatataagcactttgtgtgccgcttcggatctgtgtgagactatccctatgggttttaagaaaataagatttttaaagctccctagtctgaaacaaacaaacaaaaactcaagataaaaatcaatccatttatttttaaagttcaaatcctgccacatttcataatgagaaaaggaacataaacagctaggctcagacacaaggagctcttctggccctaggaagtggaggagagggaggaagtgggagctgcatataatgcaaacctgcacaggcagtactgaggagcagtcactggcttttctaactgccagtgcggccaggggcctgctgccagagtgtgctcaatactttgtgggaatcaactgcctggttggacagaatataaccacatttattaattcattcaacaaatatttactaagtacctaccatgttccagatcttacgctaggtgctggtatcaaagaaattaataagcccaattcttacgtcagaggagtttacacccttggtgaggatacaggcagaaatcaaacaactcccattcagagtgattgatcagtaagtgcagtgatagagaccagcacaaggggttggaaagttcaggggaaggaaaactggatggctggggcagagaaggcatcctgaagaagtgctgtctacatgaatggttcagaatccattgcagttatagagatgaaggtcaagaaaggcagggaggcttctttctacagtcttacagccaaggcctggacattgtctcagtacaaagatcaaagttaaacaaatctcttgaaatcctacagcccagaaacaatgaccattaacaatatcttgcacctacagacagattttagtatagctggttggcagaatagatggctaaataaaagtgcttttaaaaaacagaaatacactataaatatttgtattaaaagaggtgttgaattcagtttttcttaagtttaaaagaacttaaatgaattacatctttaaaaaatgttttctcacaagagacttttttttcccctaaaagatatttctagggttaaaaacaaaatgagggccaggcacgatggctcacgcctgtaatcccagcactttgggaggccaaggcgggcggatcacctgaggtcaggagttcaagaccagcctgaccaacgtggcaaaaccccatctctactaaaaatacaaaaattaagcaggcaaggtggtgggcacctgtagtcccagctactcgggaggctgaggcaggagaatttcttgaactaaggaggcggaggttgcagtgaaccgagattgcaccattggactccagcctgggcgagagagcaatactccgcctcaaaaaaaaaagagagattatgagacactttaagaggtatgtgtgttttttaaaactatagtttgaatttttgaagaaaaatgaagaaatgagagaggttaaataacttacctaagatcacacagctagtctgtggtgcaactggaatttgaacttagatatatctaattttttcagaatattaatttgcttccctaaagaggcaaagtttctcattttaaacaatcagaaactggggtccaacgagggcaaatgatttccctaaactcatattctgattcagcaataaagtaattttggttgattagatcattgttcctaactattcttccctccctgtaataagaaatctcctattgtcatttttgtttgcctaagaatctaagaagagtatatatacccaccatctcactgactttggccttggcttgaggacacgctttggctaacggaatgtgagcagtcatgatatttgccatctctgtgtggaagctttaaatgagattgtgttcctgttctctgccataaaacagcaggtcccagataggggtgacacctttagcctgggccctagatgagggatacatacagctgagcacagccagcagagctgtggctggctcacttacagcccttatagagcatggacatgaaataaatgtttgctgtggtaacctaccaagatattggggttgtattcacagcgaaagctaaccacaataatacagcacagtttcgtgcagaaatgtattcttcatttttcccattctcaaggttgcctccagttgtgcaataattatgagttaaggccatgagataaatggctgtgttagtgggcattttaattttaactactaaatacataagaaataattagagaaagagttggaaagcataaggcacaagaggaaaaaccaggtgtcaaaggtttagatttccaaggtcaccctctgatgaaaagaaaactggtagaaacccactttgttgacagagaaacaagggtgagtcaaagaattgaggtttatttcttattcttctgctgcacacagaactgttggcatcaactaaaatacacattcacccagaagcaccttgttcagaaatggaagatgctaaggaaaaaaaaggtaataaatgccaaatgaatctctgccaccaaatcaccaatgaccttggggaagtcattttccttctagcataagttttctcatttgtaaaatgaagaggctgagcaagaatctctcactttccttctggctccaagggtctgtgatttgattgcatctaactcattaatcctaactaacttgaataggacccagtagtattgaggctgatcataggaatacatcaaagtgtagcccaaagaaggtgatcttgagaatcaaatgaggataatctagagaaggtgcctgcacactgcaaagggctctcttgtcgcttttccattgaaaagatgtgggcaaatatgccccttatcccccagtttgcattacccttgcagccttccccctcacttttaacatccagcagtcttttaggttgttctatctacctcaccttcttaacccaacaaaactacattctcctctcagcaaaagagaaaaataactctaaaacaaagaaatatgtgattataatacaagagacatacaaacaaagtatggggggagggtaaagaaggagagaagaaatcaagacttcagagttcaatagatctaggttggattcccaatgtctcttattgttcatatataaaatggggatgatatggttattcttagaaaataaatgatatacaaaatgtataagcctatactatgtgctcatttacagctgtgacaatgacagaaggctttctggaagcaatggcatgaacatctgaaggccatatggaattctgagggctagagaataagaggggaggggtaaaagtccaatcagaggggagtttgtgggggtgcaagtgcagggatgggtaggaatgcaacaggagtggcaatatgaatgtgggcaggccagaagtccttctgggagaggaacaggcatattaggataaaagtaaaggttttaagcaaaggaatgtagagagatgagtctgaatctttgaataccaaactgggaagtcttacccctgtatgactgggaagccctgaaagcctttaggcaattatgctttaaaaagttgtggctgtgctggtgcatcttgggaaggaagctgcatcttaccaagatgtagggagggaaaggagatagcctcctccccataggagagtagttgttgcacctgcctgagatagaaatctgagctacaggggaaacaccagattgaaacttgaattaaaacagatgtgatctcagtataaaaagttcttcaaaaccttaaaagttcagttttcttccctttaatctcttaagagaatcactgcttttaaacccaagaaagtaaaatttccaggtaagaaaatgaacccagaactctatttgctgaccagatctgagtaagattgcttttcctatttgcatttatttcaacaatcttaaatcttacatcctcggtagttctaccctggacccaaaagtttgcttctgccatcggttacaccgttgctactcaaaatggggtctcagtttgtttgtgctgctatgataaaatacctgaggctgggtgatttataaataatataaatttatttctcacagttcttgaggtgggaagtccaagatcaaggcaccagcagttcagtgtctggtgaggacctggcatttgcttccatgatggggccttgaaaggtgtgttctcacatggtggaagtaatgaaagggtgaaagggcaaaatgttcttgctagttcccttttataaagcactgaccccatccatgagggaggggccctcatgatctgatcacctcctaaagggcccacctctcaatacaattgcactggggattcagtttcagcatatggattttggaggggcacatacgttcaaatcatagcagggtacttgaactggcaatatcagcatgccctggcagcttgtcagaaatgcagattctcagaacctcactccagacctactgatcagaacttgaattttaataagatatccaagtgtttcctgtgcattaaaatttgagacgcaccaggttacaccatgccctcagattccaggaggcctctacaaccagagacgttcagagctcgtataacctctccattgaacaaatgagaaactgagatccagagtgagaaaagaacagggttttctaaggttatacaaccagtaagcataattggtacagaatagttcataatagtaaagtacaattctctatagctagctggagatgaagcacagcgcactgcaagccaccctgattctggagtcaactctatgtataaggtttacaacccaattgggccaaattacttcatcccccgagcttcatattcctcttttgaaaaaatgggaaaaataagactactttgataaaggtgtgagcattaagtgagataatgtgtgtgaaatccttaccatggtctgggtgctctgtccctagtaattactgtctaattaccagagatgggagtagaacccaaagcttcagaatccttagtgtcttttctccttcacaaaagtcataacccaagtcctactacagggcatagtttccaactttaaaggaggcctttgcctctgcaggataaacagctcctctacatgctccctgggtccttcgttctttcctcttgtggcatttagacacacctccaacggctggtttcttttctgcctttcccactagagtgagtgttgcttcagagcagggaccatttcttttatctctctacccccaaagcacatcatagtagatgtgttggcagatggaaggagtgagggatggggagagagaagaaagaaaggaagaaaggagggagaaaaggagggaggggggagctgagaagatgctgagtgttagaaagcaaccattgcacagcatgatggattcattcaaagaaatagcttgacagaagagaattcatctttttatgactgtgacaacactaatatatttatttcccttctgaaattaactttctaatattaaaaaaggtcaaaatgaaccgcagcaaaatgagacattttgtcatttttaacaaattataccaaagcagactgtcagattaaaggggtcactgttttgaggtctaaacactggtgctgattgcataatcagagctaatgcttgtcagtctgcccttttcctgcccacaaacctctaacagttgcctttggccaaaatgatgaaattcaaatctctcagtctggtattctgaggtcctttagaatctgaccacttttctttttttaatccattccttccccaaagggactctctaaactatgcagacccgcctccttcctgctattctcttcctacgtgcttctgttcatgtgatggctcttgttttaactgcatccctcctaccatatgcccatggggattctctctaccttttttctgtcctacgggctggccgttgtttctcagaatttgacttactgtggccttccgtctgccacttctgccttggggcggcccttgggccggccatgaccatggcttggacccttgagtaccctctgcttctcttacaccttgctctgctctacccttcattccctcagagacatctgggaaaggtatggtggtctgagaggggacccgagtccaggtgcttttttaaaaaggtaaaagagggaaaagcaagagatgagactctaccttgccactcctgttcctctctgcctctgacttatcagtgggtgtgctcacctctgggccacctagagtcagaagaaccgagattcaatactgactctgtctcttgggaaagttacttaataactttaggtcttagtttccccatctgtaaaacaaaacaataggccagccatggtagctcacacctgtaatcctagcactttggaaggctgagatgggaagatcgcttgagcttaggagtttgagaccagcccaggcaagatagtgggaccttgtctcttaaaacaaaacgaaacaaaacaataatccctgtctcacaacgttgcaataaagggtcaagtgaatgcttgtatgtgaatgtgctctgaaaactatacatctctgtgacaaattagtgaaaatagttatgacaagacccacgtgctagtgattcatccccggggcctggagtgcatgtgctccaagtttggtagaaatcctgggaacctgagtttgattaacaattctatagtactacagtcccactgtgtgacctggagcaagccattgccctgccctgggctgaagtgttctctctatatgaagggttagtttggagcacctctttagttcatccagctctgaagttttctggctccacatagggcaaaatgatctctgagatcctagaaggccagaattacattattaatccaaggtcaaaagtagccaagttggggatgtgtacatcctcaggctatggcaacaacctgtggaggaacaggagacatcctaaggtcaaaacctcttgcctgtgttagtattagccagcccctcttaagatcccagatcctaatttacctagcatgctcaatctttggagttcattctggacttttcgaaccaacgtttcttacagtggtcgggggaggagtggggtgcccaaggtaatggaataaatctatttataatatcatgttaaccaaaagataatgggggtaattctgaatttttgtgcttaaaagatgtcattataccaagaaaaaaaaaaacgggaaatcaatagaatttctcctttctaggttggctgcttccatgcattttaaagctaaaacaagagactctgagaaacaaggggcctctggctgctgctgggcccctggtgagcatgcccaccctgctctgcactagggtcgtgggccttgggatcaggcagatctggcttccacttcaagtcctttgactaccagttgtgtgaccttgcaggtttcaactgcttttcatttgttctgccattcatctggcattttactgatgtattaggcgctatgctctgtgcaagagagtgcagaggtgacggaaacaagagtttcatccctcagggagtccacatttgaggagagaaaacaagcacgtaaacagattagtgtggtgtggagtcataaatgtgtgcagcaggagagattacggttaggggagggacattcacgccgagccttagttttctcaccttagaaatggggataataatgctcatttctagaggttgttatatggactagatgaaacagtgcctggcacttaatggatgcttaacaaatatcagcattttcccccttccgctctgcagggtcctgaagccctgctttcattcaccccacccatgccaggaggccgagtcacatagcaaagatgactaataaagattcgccttagcagttggaggctttttcaaggttatagcctggagctaaactctaagaggaaagaagttttcctcttgtaactgggagcctgagtaagtcaatcctcccgactgctgagtctgcataggtggtgccaggagtttaaagcaaagctttgcccttgaagtgccctgtaggatcagccggtgggggctgctgtgtacagtggccttagctgccaatcagcgtacaaactccgcctccagcctctgtgagagaagccccgccccaagcctctcctggtgtctggaatcgcccttgggggatctagagtatcgcatttactgataattcattctagaagcatcctggctgtcgtcagcccttagggattatggtgaattgcccccaaaacacacatgcacacatacccaaactctcggaatgaaggaaatcggcttgccctccgaaggttaaaccgtaaaatccactcggaatgaattgaaaccgacaaatgcaggaaaccctatgaaagaaaagcttctggaactgggctgattgtaacccaattaaagatattagcacagctgtaaaaagactttgcaaagatggggatggggagtggccagagcatttgagctaatggctcaaacttgcttctaatctgtccttatttatttacgtatttaaatattttttaagagacagggtctcactctgtctcccaggctgaagttcagtggcatgatcatagttcactgtagcctcaaacaatccccactgagctcaagcaatcctcctgcctaagcctccctagtatctaggactacaggtgcgcaccatcatgctcggcttttaaaattttttttgtagagatggaggctctctctgtcttgaactcctggcctcaagcaatcctcctgcttgggtctcccaaagtgctgggattataggcaagagccaccatgcctggcccagtctgtcttttaaaacctacttgcattgctatttcaataaccagagctacagctgtttttaaaatgcttaagtttaaagatggtgataattggtgataatgaaatattattcagaagattcctttgtgaaatcaacattgaaatagtagctattgtatattactaggtttgagctgataataaatgctaacatttattgagtgcttacaatttaccagccttacaaaagaccacactatataagtgcttagtgggtttttgtgtgtgtatgtggtgtttttttaatcctcacaacacttttctaagagatggtattaccccattttgcagatagggctatggaggctcagaaaggtgaggtggcaggtagagccggaactggaggctagagacaattttttacttcagagtccttgctcctaatccctatcagattaaagagtctgtctccagtccttctggctgacagggcagtgctgggaggccaaagacttagctgaccgagagggatcaaagtaggaaatgtgaggtgtgctctagggaagggatagggaaattccctattgtacttacaaagagggtgaagagttagaaaatttcctaggacattaggagcctgaatatggggagccttctgggacaggaattttgagcagagaaagtagagataagatagatggaaagagagatagaaggatggctggttagacagacgagtggatagatgggtactgaacccagttttcttctatcatatgggttgggctggattcaagaggcttttatcctatggactgacctagaaccaggcaatggactctaatgagttttgttctgttttataaaataaagctcctcctcatatgtgggtggctaggtcccctcctccttccataatttttttctagttataaagttaacatatacttgtggaaaattgttggaaagtataaaaaagcagaggaaaaaaagcaccctaggacccagaaataccactgctaacatctagtttacatccattctttttgcgtatgttttaaacctagttgttatatatgtcttaacatataatacataagcaactttgtcttctgcttttttccacttaaaattatagcataagcattttaacaataatataaaactcttcataaacatccattatatgaatgtatcatgattgactcagtttaccactgttaggcatttagattttcctgggtttttcactatttttaaataattattctgtggccatttttttttttgcataaatccttattcacacttcagatttttttgaagtctaggtttctagtactgcaattgctggctcaaagctttaaacaaaacaatatattttacaacccagaaactcatagtaagatttttttttctctctctcttttgaattctgtgtctttctactccctgaagtgttgtcatccatggctcccagggtcacatccaagcttcctggggtagcccacagggctctctatgaatcatctctgcctgccacccagccttgcctcctgccccttctccacatgctctcctggtccagtccagcaaaccaaactccttgtaattccctaagtatgttcacctgcctaatacctgtgtcctcacatatgctgcttcccctgctgtaatgcttcccccagtctttgtctaaaaaaatcctacccttccttcaaagcttatctcagagattacctcttccagaaagccttgcttgacccctaagtccagttcagatgaccctactttacccacatggtacccggagcccttgtctatcattaacatgtgctaccctgtgcttcaatcattggttgatttggtttggaactccagaccagaagtttgcaaactttctatgctcaaggaatcttttattcaaatacatttttttttttttttttttttttttggagatggagtcttgctctgtcacccaggctggagtgcaatggcacaatctcggctcactgcaacctctgcctcccgggttcaagggattctcatgcctcagcctcccgagtagctgggactacaggcacccaccaccatgcctggctaatttttgtatttttagtagagatgtggtttcaccatgttggccaggctggtctcaaactcctgacctctggtgatccacccgccttggcctcccaaagagctggtattacaggcatgagccactgcacctggcctcaaatacacttcttatactaataatagttaaatttttttgagaattatgtgcctggtacaatgccttaagtaagtcacaggcatcacctcatttaatcttcaaaacaactccttacaaacaaggacactgaagctcagaaaggttaaggaacctgcccaaaggtagcaaagttattgagtcaacgttgaattgagatttaaacgcgggcctgagcctgagctcttaaccacaaacttatcctgctctgggtaaaatggagagaagccccctcagaccccttgcaacttttctaagaacaatttgaaaaccactgctctaatctagatcatcagctccttgagcaaagggactgttatttgccattgtgttctagcatacaatgcctgcactcaggaaatctttaatgggtaaatgaatgacttttttcttttgaagattactgtttagggaagattatctatacactttagtagccttcaagtgaaagcaagcctagaaagacttgctgagtggtagagcatcaaggctcattggccagaaggccaggccatacccaagctgataaggcttcccacagtcagacacatgggaccagtacaggagttgggagatgggcattaggacttaaagaaaataggggcaatttcctgatagaaggttaaacacttcagttcttgctggaaggagtgattagcctggtccttttcttatcagaattcagctgtttccaccacagtaaataatggacaaattgggcatctggcttacttgatttcccatggctaaggccgatttctgaagtgcaatatgctatttgatgtaccacagtgaatttgtcttgggcttgagagcctctcaatggcaacaagcaaaaataactcttggagaagttccacacatactgaacacaaaacaccctaaaatgtaacctgtactctgcagcctgctcagctgagtccctaatggggtagcaggctatatgcagataggaacctgctcagacgggggcatggaaagggaggagtatatgggaggagtaacaaatggatggagtgggttaactggaaaagttcctggaagagatgacctggggtaaactggagtagtttggtaactgagaagaggttattgcaggagtgtcagactacccacagagactcttttttagctcatttgtggcctgggtaattgagtgaccatgggacatagaaaatggagaagcaagtttggtctaattttgaaaccagtgtaaattgaatagatatcagcagcagagagggagcaaagaagaaaactttagaatctgtgggtttctgatggagattctatgtgggtggattccaatgctccagaatttccaaatttgtgagcttgagaagagattccatatgtgggagctctttgtaacagaggatcagcaggggcaaaatatgaaggaaagattagttaatggaaatgcaatacagtgagagagaattatagaggtttgaaagttgagactgcaatgaatttctctgggatgtttcagtgctgtcttgctgggaaatgatgggtcagataagggagctaccaagatttccctaaacacccattgagtgcctactaagtgttggactctgccaggagatggagaaacaaaatgaaaaagacacaatttttgtatttgagaagctcaaagaataaaggaggcagacaggaaaatgatcactaaaacacagcatgatgtgcaccttaaccagggggtttacccagctctgtgggatgcctgtaggaatccaaacaactaccctctagagagacggcattttgatcagtcaactgctcaagaggttctcactgagctaccaataagcatctggccctggccagggcagcagggaggtgaaggtagatcctttgcactggagggatttgcagaagaacaaagaaatgagggttcactgtggaacaaagtatacagggaacccttgaagatgataggcttgcaggtgggttctaaagagtacggaggattttgagagtgtcacttggcttggaatgtttttttctccactttactcagcgaatttgtattttcacaagtctgttcagatgttaattccaggtgtgtgtgtgtgtgtgtgtgtgtgtgtgtgtgcacgtgacagtgtcttgctctattgcccaggctggagggcaatggcgcgatcatagctcactatagccaagaactcctgagcttaagggatcctcctgctgctgcctcctgagtagctaagacttaaaggcctgcaccaccatacccagctaattcattttttctttctccttccttccttccttccttccttccttccttccttccttccttccttcctttctctttctctctcactctctctttctttctttttctgtctctgtctctctttcttttttcttgttgtttagagatggggtctcactttgttgcccaggctggtctcaaactcctggccttaagtgatcctcccacctcagcctctcaaaatgctggaattatagtcatgcatttccaggttttaataagtgattttcttctttcctgcctgccttttctccctctctcctaacacacattcattgagggcctgttccctgtgctgggtgttggggatataaaaataaccaatgctaaggctaagcccttaatagagttacagtgtgtagtggagtatgggagctgcggctgggggacagtgaggtaagtgctgcaatagccaggtacgtaaagtctattctcatatacctgctactaaaggttatgtatatgcatagtatctaatcctaacagaaattccaggagacgagcattgccattcccaatttacaaacaggggaactgaggcatagagagtgtaatgggctggactcaaagagaaccttctagaaactctacaattgaagtaatatgtatctagtcagtagttgagaggtatccagagtctttcgggatgaaaaggtgttacagaaattgaaggaggcaacctgcttgacaggaatattattctgaagcatgaaatccatctctaccctgctttctgctggagtcaaagtgaaaatctagagttagaaaaaccatgtcttttatcacaggtgggagaaattgcccttcagaaaagtaatgatttctcttaaaattccttaaagtttcataaaccatctcgaactgctgtaggaaaaactgtaaaaatttcatgaatccaaagcaccctatgttctcagagccccctgtacaatatcacatttacttcaagtctttatttccatattgaacctttcaccccagtggctatttactgatttcctgggccacgtaggtaggagtggaaaactgtttgagcagacctaagagtgcaacccatggtgctggtgtgggtgctttaatctatccctcatggcacctccagcagctggctgctgtctgaacatttcaacaggacattcctctccacccaactccagggcaagaatccttcctcgcctttagaaaacactttccactcacatatattggatcttgctctacaactggtgaggtaggcaggtcagaaattgttcttttcttttagcagatgggcatactgaggctttggaaactaacgtttatggagtatctgctttgtactaagcactttcattaagcatccaatcagtctgtccttctctggcagcagccaggacttttgtgccttgtggaagttctgcccatcagtggatcaagagctatacccaacagatatctctatctggcacagaaagctggagccagaggggctctttggagaccaatcttcaacctctactatgtgtagacaagggggaaagtaaagtcccggagagggtaagagactcacctatgagcaccaagcaaatgagtggttcagccaccctggcagaggacttcatattcccaaccccatttactgccacacagtttcagctgctccctgcagggaacctctgggataatcaagtcaggaaacatggggatggaacaaaggtttggggacccacagtccagttcccagagttgctaaggcctcagtgacacagtcggcaagtgccctagggatgtgatttttaacaggggtggttctgtcttttcctagggagtgataaatatcctgccatagggggtaaagaattacctcacccagaatgccatggctatggcctcctgtcctcctagtttatttctgatgtgtacgtggggtgtatgaggggtatcctttacccctcaccctccacaaagtgggtttactccttccacaaaaagactctcctctgggccaatggactcgaaagcctgtcaggtatggacactcgggtcccttggtttctagtgaggagttgccatccgagggccttctaacctggtgacccagtgggacccctgcttcccctaagaacagacctcggtttaattgaatggtgaaactgcgctgtgtgtttttgtatgtctccttggtgtaattatgtagaactgcatacttgtttatgtgcctgtttttatttaccatgtttatgtttttatgtatacgtattttctgtttgatatttgtgaatgtatgtgttttctgcatatggctatgttgcgtgcttgtgtgtgtgtatctgtgtgtgtattttgtgggttggtgtgaatgagtgctggttctgtgtgtgttatttgaccatgtcaccagctgctctgtttgtcaagtaaatgtgttataatttatttatttatttgacagaaagagagcagcttatcttaagggctgcaggaggcaagaaaagaaaagaaaaaaaaaaagccagccccgtgttgctctattttaaaaactgctctgcgttgttatggcagctaattttccttaaatgatttaaggaaacggatctgtctaaaagagctgcagccaagttgttatagcaacacaggcagcagctgaggagggcctttctcctctagtaaacggggggaaatcacctcggagtgtacaaacctctcaaaatagcaactttgggttctgagggactctggaggtaaaggaaagggctgctggaaacccattcacctccccagacagaccctgggggattcttcctagcaacagccttttcacttgagttgggatctcatcattcttacctcggctatggcagtaagcacctacctggtctcccttcttcccacgtagtctcacctcctttgatccactctccacactgcagccttagtaattttctaaagcatgcattgtttattcatcagtgcattcatcattcaacagaatattctctacagtgccgggttctgtgctaggtcctgggagtacagaaaggtgctgaatgaaatgaatagggcatgtttttgagcagcatgccagggaacactagcctttattccagaagtaatgcaggcccactgaaagaatttaaagcagggaagacagacccaggtggatttaaattttagaatgactccaagatttctagattgaagaattgagtggctggaaatgctattcattgatctctctttcccttgctccagcgtttttgaggactctccatggactactctgattttcaagactgagagaggatatatgctggaatattcctaacaagcggcactttgtttccttgctttgattttttttttagtcgtgatatttaattcagctaaaaatcaatttaaaagtgggcctgagaccttgattttagtaagaagagagcattgggccataggaagaagccaaatgccttggggcagtgttcaaacccatccatgggcttcctcagcctgcacctcacatgccctcctcacagctacctgttataaatcctgcacaccaagcccagaagctgaggtcttccacctccattccattgctcagattttcctggaatgccctctcccctttccctataacttcccttctctccaaagctcagccacctgatgaagtattaccaatctccaaaggaccagtacaaatgcagatttctcaaaaaagcttccttggatcacccaccccccacccccacatggattaatctctttcagccccacgtttccaaagcactgtttgcttaattatagcacaccttcctaactgcctggaattaaaatttcataagggtctggccttctcatcagattgtaagcttctcccgactgggactctgccctattaatctctgtaaccccagagatagctcaagagtcttgcaaatgggaacattgaaaaatgtgtgctgcagtcaattaactgaggattttaaggcaaacactactttgttatttagcttcatcaaacactgggtgcacctgacaagtacatagttagatgctagtggagttgcaggtggatggtcctgggaagcccattcacatatgggcttagctttctaagatcataactggatatagctgtgagaggagggccctgtctgtggccttgtgggtgagtgactctggttgtgtggctgattgtgtgatgtgaagtcactgtcatactctgtggtgtgtgtactaggagaaagccaaactcccatggacagcgggtaagctctcgcctgaaaggtaatatcatttctggtgctaattagatctcagatctaaaatcagaattggaaagagagacctggattacagaacagttagaactggctcccaccagttctaaaactgatatctttaccaccactaaagatatcaaaatgtctaagtacagctcccaaacaagacatggttagatggtgagggcaggttagggactgggaagacaagggatctgggatctgagtgaacccttgatggccatagagagctaatttcagtggggggtaaaatggggtagatgccgagtccaggactgaagcaagtatatgaagatgatcagaatcctctctcatgggaatgggagtgggtgatgccatctcaggttctatccttgggagtgttggacaatctcagcaggttgcagggaaatctctgtcaccagatcagagccttcattaaaggaggacacagtgatggtggcagtgggatcaggggatactctgagggagagataagattggggaggggtttgtggttcaattcttccttttatcaggaaagtcttctaaaaccaagtcacagaagctctaggttcgcttcatcatttgctcaacatttatcctgagcacctgcttacagccaggtccctgctgggcgccagagaccctgagatgagttaaccagaccctttccctgggggacaatcaatcataactggcaaacaggggccaggccacagtgtccacaggcagctatcatgagagtggagaatgaaacactatgtctcagatcaacggtagtcctcttggttaaacactttgttttcaagatcatcatttaatacccaatgtccccaagaggggtaagattttagtgagcacagggctaggaaagcagcctttgaagtcaatgtcatcactaatacaaggacagcaggctcctgtttccaggttaggaacacatagaagggctcattccagaagccttccagtgcaggccagacatatcacttcaggtctactgtacactgagcacctctaaagatgaatgcatcacttggccctgtactaactgttcctcctgggttcccatctcaggaaaagtaccacactactcggctgcccaagtcaaaaccatagggatcatgcaagactccttcctctcccatcagccacagtcaccatgtcccttaggtctggctccttattacctctagactcctcttcttccttttcaactccacagcagcaaactctaatggtctcactgtctctagttcggcaccgtccgaatttatttttctaacaggcaccagaggggtctctctgaaatgcaaacctaatttgtcaattccctgcttaaaatcctcagtggctccctattcccatgaaagtaaagtccagattgctccctgtgtcataacaacctcttctgtctgcccctggtaacagccacactgaatgacttccagcctcctgagtaagacaccctctcagggcaggtgcacatgctgtttcctctgcctggaaagttctccctgacctgagcatccctcatgtatcagcccaggtgttgcctcctgggttgggttcccacaacccctgtgctttactctataaatgcacctagaataactgtctgtaaatgtctgtctccaccaggctgtgaactcggcacccagcacagggcctgaaggaatgacagttgatattggagggtcttgctgattctctgcttgttgattctgtgggcagaaggcaacctggacaggaggagtgagactgtgcatttagaaaaaagcccagaagttgtcctggcagttcagatagttcagggttgagtgactatgtatgtgacactgaaattcaggagcagaaatgcacttaaagctcttagggcagatgcctcagggaactgcagtgtttgcaactgggcacaaagatgtctgaagtcaaatgtgaatttgaatcagatccaggtaatggttgttgagggtctgctgtacaccagcactgtgctaggtgtttttgcatcattattattatactttttgaaaaggagtcttgatctgtcactcaggctggagtgcagtggcgcagtcttggctcactgcaacctccgtctcccaggtttaggtaattctcctgcctcagcctcctgagtagctgggattagaggcatgtgccaccacacctggctaattttttttgtatttttagtagagaccgggttttgccatgttggccaggctggtctcgaactcctgacttcaggtggtccgcctgcctcagcttcccaaagtgctgggattataggggtgagccaccgcatctggcctcgcatcatttttaatagacagagtgtacaatttatcatccaaatcagaacaatttcgggagtgaaaagagggcattgttaaaagatactccaggacagtaggtataaaccagaactcactgtttagttagttctaaacagttagtgagtgacaggacagtaggtataaaccaggaaagccaagacttatgaccattctacctagaagtcatactttgtgcttttgttcttggtaacccctgacatatcttataaatacatacttatcagtatttacttgtttaaagtctatttccccactatattgcaagggttagggtttttctttttcactagtagaacctcagtgcacatagaaagcccatatataaataaatagagaagaaaggaaaaaatggagtaaaagattgagtgaggagagagagagtggggaaaagaggaaggaactgagggagcggggatgctattccaggccagcttgactcctatattagtgctccacacccttgcttgaggcataaatgagtagcctttcagtaagaaaatggcttatacaactagctcagcacccaagatgtacttattaagatctaaccagctgatgatcaatgtattcatgacgcaaatcatttcctaacatctctgtaactcactcttgctggatctgtgttttgtagcatgaatgagcgcccggttgtttgtgagtaaatcaataattaatgacagcaatggtatgccgaagccttttcctctttagcaaccctaacctacttcccttgtgttcctcccccaggctgcccctaaactcccatttctctctttggggatttaactaaaataccactttgttcaatggtttccactctgtcactccttctggtccaatgccatttttttgtttgtttggtttgttttttactgtgcctcatcattctacctgggaataattgttttgtatctataaaccatattgcatttggcataataggattttctgtgttcaatccaattcaactcaacatgcagttattgaatatctattatcagccaaatgagaaaaaaaatgtaggagcttgttctctttgagaaggaagtattgctattctatcagggaaactgcagtcaacacagaagcctgggagggcagaactctgcagactacagattcttcctgagaaaatcagaagcagtttctctctgcaaggaaagctgatcaggatgacattgagaggtcagggacaagttcatgtctgtaagaactaggagaagacagtggggtttcaaatcttagagaaaggcagcaaaccacaatcattctatctctgcatatggatttggtgagcacagttcacaccttcttttatagacaaagaaggatgagctggcgaaggaagcaaatatcctagggttatggttatgcaagacctgacacagaaggtatactgtgaaaggacctaggaaagcaaaatttacataggaggaccaagataacagttgagtttcatagccaagaaaactacattgcacctcaggactgactttttcattaatccctgctctaatatatcgcatttgtttttaagcgcacttttctatctgatcaatacctatgtcgctctttaattcaggaaattttcactggcatcctcaatgagggtaagtagaatgggttacattggtgcatctctgaagtaccccaactgtgtgacttttgttgtcttagcaatcaccatctctcacctgacagcagtcatgggtcataaaatcagtcattgaagttggaagggactcaaatggaatttcactagaatgtcttccaacaattgagtctcctctgtgcacccttttggactaaaagttgaacacttttagtaaagcaaagctcacagctcacacacacatactccattcttaggcagctatagttgttaaaaagttctatttctctacctcttcccatatcctccacctgaaaaaatggtctgtccccccattctgcgatagctcttcagagacagaataccgtggtttgcttcatttctctaagctatgaaaccctgctgtcttctcctgtttcttacaaacaagaacttgccccagggagcaaacttggtgtgaacacccattgttctgtctgcctatgtccccttctttcttctgaaatggtaggccctcttttctgaaaacaggtaccaacccaccctccaactccatccacatggttccagagaggctgccttgtccttgcatattcttgtcttctgagccagaattgacttgcccagaagtgggcctgtcctcccgactaggtcaatcacaatccttttggaactggaactggaaaatgagcataagttactgtagtgttgagaacctttggatgtgacactcagcagtcaagttccctatgtgtagaagaagccaggttacagtcttcaattacatgacatgcccttggtattcttctaataaattctctatttttcttatactaattcaagtcctatttctttagcttgtaaccaaagatccctgacaaatatggatacactccaatatatttcctttaaccctccagacctccaaaactgaatccactatttgtgagaggttgcaggaaaagagattgggagaaggtccttgggtctgctggattcagagaagagcaggcctagtgcctccctggttttagctatgtattcctaatttgcagcttctagtggactttcccaatacaatgctgccctttcccagatcaagccatagatcagcagctgtggagggcattcagttacttactgggtcgttgtacatctggacgatgagttgtttcactccatgcagggtaggatggacccatggagagggatccagccagtgacgattcagatcaaatcccatcagagaacacctaggcagtacccaaagtaagagtcaatatagacaggataagctgagcttctcacctgtcaaaatatgcttatgagtaggagcagtgattatgtcacttacctagcatttatcattttccagagactgttctaagtactttatatgagttaattctttcagtgtcatcaacaaccctgtgaggtcactactattgcaattcccactttgcagagtaagaaactgagtcacagagagattcaaaagtatttctgtggtgtagcctcatgtcagcatccatagacacatgacccatagacacacatgcacatcttctccacactgcagctgagaaaaatgctcaggccacaactactggtgttcccattatgcctctttgctcacacctatagctaattcattgtctctaccttcaaaatacaccataacccaacacctttttaccacttcctctggtattaccttgagtgtgggccaaggtccagagaactgtaatcatattttacctggtcttcttgtcttctccttgcctcctcccacctcaccttccatgacagggtacagcagaagactgaagatttccagacattttaggcttggacttggattcaagtgctccagttacataggtttatgttctttcccttccttagctgagcctggacagctagttgcatgtgtggatttgaggagaccagggcataagctttctctttccaaatgcctctttcctcaatgcccctggagggactgggagaaccccatttcttatcactgtgctatgctacttttgtctcagtgagaaccagagaataatgtggaaacttccaggaacttcctttggctccacattcagattttcactagcgtcctgcctagcctctctggcaagtccatccttcgtgagtgtgggataatgcccccatggtatgcagaggagatatcactgagttcagtccccctgttctgtggatggtgtactacgtgaccctgggcaagtcccttgctctctcaaggcctacgtttccccagctacaagtagagaaggagcttctacaaatggaccacaagcttttcaagagcctctttcatcatggactgcactctccctaccccacatcctcagtggagaggaccacacaaagaaatgtcctctctggtccaagatttccataagagcagtgatgcctagataccaaccattctctgtgctctaaacagaggggatcactgatgctcaccttctaggccagcaagttacctcctgaccttgaacttgcaaaggagtcccttcttcatttgccattacaacatgagcatgtttctttgttagaaaactctttgtaactaacattgtaatagtgttataacatgacatatcatcccattatatgaacccccataattcatttagcatttccccactgtggcacatttattttgttttcagtgctgcactattttcaaaatgaactgatgaatactataatccctaaagttttctccacatttcagaatttttttcttagaacagttcccagaagtagaattgcttggtaagaggattgactgactgtaaaatcactattaaaaatgaaaaatggtcctcaatatagaaagcaaaaaagaaaaaaggaacatcaccttcctatcactcagatataactcctgttagcctttgatgtagttcctgccatcttttctttctgagcttatagtggtaagtgcagcagtagctaacatttaagaagtgcttactagtacctttacatgaattatcgcatttcattttcgcttttatgccatacaagccctgtattaacattttacagaggagaaaacaaaggcttagaaaatgtaaataactttctctaaggtcactgagctactatgtaatggagttagaatttgagctcaggtcaacctgattctcagagtccaaaatcttaccaattgctctccttactctgctctcctctgactacattaaattgtctttcagaaaggaaacattcaatgctgtgactagtgccttgatctacagacatattcatgcagttcttaaatattcttatctgacgtattgctactcatgaaagtgattaaggacagagagagagccccacagccacactcatctgaaacctgctcagggtaattcggccagcatatggtggagcaggcttcaaacccaggactatccagctttaatatctatgctcttctagggaacaaacagtttaagcaagctctctgcttttgagaatgtataagtaaattaaggaggagagactggttcagggaacaaggatgaggcaagagttaaacacagcaattcatcacggttttattaagaaccttctacacaccaagctccatggtagtgttgctgggatagagtgattgataagagatattctctaacctcaagaaatgtataatctagcagaaggaagaagatatgcttacaggtttatatccatttataatgcaggacaatattgtgagtattaaatgagctaatgcataggttttggtacataatggtaactcaaaaatgctatattgttgtttttattggtctgtattattattttatgctatgttctatgtgaatgacatggactaatagttttgcagtccattggaggctggaatgggcagcagtggtcagggatgacctcttcttttccttcagtctgggaattaggcagatctgagttcaaatccatgctctgttccctcccaggtgaagtgggcatttgtccatgttctttggggaatgcccagcatctaaccctgttactagatggggggttgaatgtggtgagtttgctcctccatcattacaagatgaggcatgattttgccccgtctccctccacggaagccagatgagccagattctatctctttgttccctggaagccagggcagctataggaaacccaggctcaggcaccagccactcctgcccaggacgtaaacttgggactgggtgatgcgaggcagcagggagtgctgtgcagcagtgctgctgtggaacagaggcagagtattctggcccttcagagctgctcggttaattgctctggttttcaagtctggctaccagtttctgtgtgattctgtaagccccttcgtataaattccctttttgcttaagtggctagagtcagtccttgttaattttagctgactgcacccctaatcagatggccctatgaaataagtcatagaaaattctggcaggcccctatattgtccacttcccaatgactagtcaaaaaacagagggaatcactggtctgggtgctgtgctcacaaagcttttccagccctcactgagcatctaaatatttagaaaggtacattacccttgacaacaggatgtaatcataaaacaattgtatccttagagatgctcagttatgtgcctctcctctgcccccaaataggaatgtcctcagcactgtcttgggcatgtcaccagcttgctctaggatacctctatgacctaaaactcaccacctttccagttagcttatctcattcttgaatcttccattagaaaattcttctttcctttttagctgaatgtgcctcccagttacttcctccatccttctcagcgttgccccacggagttgcacagaacaacaggtttatactgtggggaccagcagctttgggacttacagttatgtttaagttctggctgtgttcctcaccagctgtgtgatcttttttaaatttatttttttaaatgcacctgtaggcttctgttttatcatatgtataaagaggataaccactctgactttctggattgcatacatgaattaatgtctataaatggaccaggagaattctcagaaacacataaacattgaacaaactatagccagtgatggcagtgaagtggtgataattgtggcactgttgaaattgtctaaacttaaatatcagctcctccaggaagtagaggaggattttcactccctgcacatgaggggtaggtgcttttcttctgctcccatagcatctgttgctcccccagcaaagtggctataggacaagatgtaattgttgagtccgcttctccactggaccatgaattcctcaagagcaaggatgccatcttattcatgttggtattcctgtgcctgacaaagagcctggatcatggcagacatcgaagaagtagttgttgaacaaacatttcattcctcctaagcattttcctgtctcatattatatagttctcatgaccattcaatcacatggtaaacctcaattttctagtgggagtgttgagggctagaaaaggtaagccattctttcgaggctacataacaagtactctaaagggcccagactagaactcaggtgtcccgttctggacttcatagtctccccagttggctatgctgcttccaggaaacctctgattcaaaaaagaacttcaaaactgaaggaaaattgttagaggtcagagatcctgaaaggtcaactcctagatccagcctgctaataaaaatagaatgtaactggtgattcacaggcatcttcaatcctcagagagtctagagctttttagaagctaaagcatttgtgatattcttcagtgagtagtacctgcatgggcaccttttgagctgattttaaatgaatgcttctaatggcactcaatctatcagtagataagtatttactgaacaaaacatcttagtaaagatgcaggatccctggctaggagcctggggtacaggtcccacctccaatgtctgtgtcatcttggaaaagtcacctcctctccctaggctcaatggacttatttgtaaaatggaatgctatacttcactcacagagatctctttcggctctctcaatatatgattctaaagcatcagtaactgggctttttacccccagaataagggactttggagaaagcatatatttccaattaagttaaagttcaaagaaaacaaaatattcgaggaaaagtgttgatacagttttaaaatgaaacaccaactagtcaaggatgaccaatatcttaacattaattgcatgcattgctcaacatttgagatttgtgggacacaaatgggagtttgccaagagtcaaggcatgagagagcattccaggcaaagggtatagcatgtgcaaagttagggaagcaagaatggtcagcaattatgcatatttctaacaggctgctagtatgttctgcttgtgtccctaactgactataagcacaagaggccaaggctggtacaggctctttctctttagtggtttcaggaccaaaaagcagctgcctaaagacagaggaacgcataagatggcctccagatgccaggctctcactcctatgactgccagtttagagttactgaatgcaaaatcctgggtccctgccctgagtctctgtctccttggtgctcttgtattctattatttgtttttaagatgaaaattttgcatgagctcaaaatcaagacctatgttctgacaagaaagaatggggctatttatggcaccagtgggaaagaatctttcacattaggaccattctagaaaatgcaaatatatgggggccaaatttacatatgactgcataatacataatgtctttattttgagttggagatactcttaagtatcttttctttcttcctctaatctgtgaactccatgagggcagggataatgtgtgagttatctttcccacccccactccaacattgtctactataaacccaggtgcagagaagattcaatatatttattggatgaatgaatgagtgaacagattaacaaaagcatggatgaataccttgcaggtttgcaaacatgggttagatagttactttcagatatattttgaaaagtaagcacctactaaatgctagactcattcacaataatcaaatgagataggtattattaatcctcatttgataaataaggaaataaaatccaagaaagatttcatcttgagagggtcacttgacaattagtaagatatagacctgggatttgaacccaggtcttgttgatggcaggatggttcacagtcacctttgaggttcccagccatctgtgagtgtgtgtgatttataaaagagacactaagctactcatttgtctgatcttcctatcctgttctctttctcgtttgcccaatagcagagatataatggttccagagaatgttatacaaatgccaaataaatagccccatctcatgaaggacatcatgccttatcgctattcgcaataatggcagctagaatgagagcaatgatttcaattcccctccttatgatttctttttcattctcctctgaagaaggatagagaaaaaggcagcttggcggctccagatcaatcttgccctgagcaccgtgaggctgctctaaggagcagtggcattgacaagcagagatgtatgaggtatgccagcaattgtcccccaaacacagcagtttttcagcattaccaatgagctggattggattaagcatatttgcaccaaaagcaaaataaatattgctttatttaatgccactaaaaggttgggattcaattgcccttggcctgaggcaccttccagttctattgattgggccatgtcagaatgccagataatctgtcatcaacagcccctgaaaaatgcttagcatgtgggttgggctctgctgttgtgtagatggaggattgcaggcagtgtcctttgtcccaaacacaagggataatcataacacatccacttcccatcaccaccaccaagatatttaaagcattctcctcacatcccttcttagatcatcatgacgaggagatgtctgtgaccaagactgtgaagacagagaggagggtggataagaacataggcttcaaaggcagaaggacttgggtttgagtcccagttctgtcatctagtagctttgtgaccttggacaaattcatctgtttgctcaaagacctgaaagtgctgagagggcagtgactgaatctatttcatttgccactgggtcttcagtgctagcacagtgtctcgtacacagctgactctcagttgaactgtataaatagaggctcagaagtggtaatttgaccatggtccagcaaggacaagtgacagaggcagagcttgaacccagtctgcccaactctaaagcctatgttcttagccaccattatactctgtcttagcagtcctaggagtcaggtaagagcctaatagagggactgtccctcatgtgcagtgagaggtagatgcaatatctttatttttttaaatggggaatctaagtttcaaatgagggactaacatgaaaggttcctttacgcaaactgacgaaaggtgctaccccctaccacccagggtaataagttgcaatcaggtgccatttctgggtgggtaaagtacagaataatgccacttggtttggccagactttggattgagagcagagtcatagcccatagcccccattgaccccttgaccactgaacatttgtacagtgtacaaactgcacatccatatggagcagacttggatgtgcccaaggtttatagcaaagccaagattagcacttagtttttcttcttccaaggttcattcagcaaggtctttaccctataatggtggccttttcggcaaggtggtgtgactggggacaagggcgctcagatcacatctggaaaagagattatctccaaccctaagaaattcttcctagtgggtaatgagaggctttagagtgccttctcccttcccgtacagagcatatactccagggattcatcctctctcctgcttggcagcaacaaacactgggttcaggtggatttccagcattgcaacttaaaactaattcttagagccagtgaccaactggaaggacctgagatttcataaaacccaatccccacatttcaaagatggggaatctgaggccgagagggcagagagggtctgccaaggttacatggctattcaagggtagagtggaaagtccattccagaaccaaaagattatttttctctatataagaacaatgataaggagtttactcctttttgaaaggtctgagggaggacattttctgaaggaatacactggcccttgaggctaggaattcaccatttccgtttcttaagtgaaaaaggacagaggaaacaaaaaagggggcataaaagtctttcatgtgttcacaagacctgggtgctggcaaggctctcacctacctgcaccgagcctgagaatggctctgagtcaagtgtgggctctggagccacacggcctggataaaaccctggcttggccaacacatttttgtctttgtggctgaacctctctgtgccttagctctaatctgaaaagtgggaattttgtctacctcagagggttgttttgaggactcaatgaaatcatacaggtaaaatgccaaggacaccatctagattgagataagtgctacacatgttagctgttcttgtggtttgctcttggtatgatgttcaggatccttcacaatctggtccccagttattcctacacttcttacactatgttgtcaatctgtaaaccatacaagggtagcacatgatagggcctgtgagctaataacaaaaaggtgccccctctgtgggctgacgcatttctgccaagtctcaaggcttgtcaagcctgtgctgcactctaccctccacctacccacttagctggcacctttgtgtggtgcacagactgtaccctatgtaggatgcagcctagaccacatgcaacagccacaccagagcacttggcattcctcaaggatctccactcactcaggactcaagcagtaagactcaaagggctctgaatcaaatcactgggtgtgattcctggatctcctactattaaaggcagtacttgggcaaatgacttaacctctctttgagtgtcagtttccttatttgcaatatgaggataatacaagacctatctcgtaggttcatgaggttgttgggaggaactccccattgctttcaatcccaatggtaactttcagccctcaggaatgaaaagaatgggtcttcttctccattccctcgttttctcttcccaaggaaggagatgaaacttatctgactggtcagctccggaaaagaagcagagcccgtttgggcctagcccctcctagcatgtgtttttgggatctggaatcctgaagggtctattctggtcttctctctgccacatggtgtgctttctaggaggcttcttgcctccttttctgcttgtgtctggtgggaaagttgaattttgaagtgaagtaaaggaggcaagtttggccacagatacagactatgcctcccaggtcctgcttttatcaataataaagctaatattttgactcctatttttctgatccctgtatctccttctacattgcaggaatagaatgagagtaggagcaggagtatgactcattatcactccaaatctctagtggaagtactacatataaaacacttagaatagtgtctgacagctatatacattcaattaatgtttcgtattattatattactgtgttgttatttattataattattcctttggtttggaacatgctgccattctcttcccctggccaactcccactcatccttcaagattcatctcacacagcttttccttcagatattttctctgactttccctatcccaaccctcttggctgggttaagaggtgcctcctcagtgacttcacaacctgggaatccctgggcttccctccaccagcacagttatctcttctctggactgtgaactccttaagggcagcgcgggggccaagcccacctcatattccccagtgcatggtacaaagtatgcgcttggggatgggttggtgacttgggagggcaggagagggaaaaaagaagagagggaagaaacagttaaaaggcttctcaagtggaagcagagtgccagcaaaagcacagatgtgagcaagagcaggctggtttaagacaatggaaagagcccaggaaggcaagaggaacagatgggagtggatgcaggaaggggcaaggtggacagttggagaggaagctgaaaagaaagtttgaggccattgtgcaggcgctgaataccaggctaaagagctttcgttctttctgagggtcaatggggagccgccgaaggatttttacacaaagaactggcactattcaagcagtggtttaggaactaggaccagaaatggtgaagttcttgattctatcacattgttttgctcctccagactccctagctgctaattctgggttactgtctcctcagaggcctgtcttcactgtagaatcaattattaagatcaacttgctatcaactctaactttgaaatgctattcagctgcttgcagggacagagatgaggagctgcctccacagacatctagccatctggccttttctgtggaacctggctgggaagctcatttgaataattggttttggcggtgtgcacttgtgggttagacacctgattacactgccagccccagtgtcctttcagcctccacagaaacatcactcaggttacataaagcaggagagagtccctgggaggtaagggtctgtctggcccgtgctgtcactctggctttatctgactgtgtggctcactcactgtgtgaccttgagcaagttacttagcctctctgtggcttggtttcttctttgcttcaagaaggagagtgattcctgccctgcctacaccacaggcttcttgtaaggatctaagggaagatgggggagttgcagcttagcagaaatgcaagtggaaaaaattaaagatttaggctgaggagagctcaatgtcagacagaaatatatgcatgtgggctgtatcagaagaagcgtggtccccagaatgaggcttctgatgacccctttctattcctactccataaattaattagttctatgaacttgaaggggggtacctaatctacctgtgtctcagtttcctcatctgtaaaatgagcataatgatgcatttgttctaaggattaaatgaaacaattaatgcaaaatgcctaaaatagtgccaggttcagaaggctcagtagatgttagccatcatcatcactattaccattataatgatatccttcagtcgtggacaccccgcctcaaagacagacaatgacaaacatctggagcacgttcagaggacagcgggaaggacagggaggggaatggatttcagattacatatgaaaggttggaaggctttggggatgtttggcctggagcagtggtgggattgagtggggagtggcgaagggtgggaacacatgatcttcaaatggctgaaggctaccatgtgaaagatgggctggccttgaataatccttcagagggcgaggcagaagttacatgctggcagcttcagcctgaaaacaaagtgctgtctcacagtcagaggtggcatcagcacagcatgatgccttggaagggagggaacaacctgtgcctagaggcaggcaagcagagggggcatggcctggatcgggcactggattgaatgtttctcgtgatgctgtgatagggcacccagcagggaaatgtgactggggcagggaaggaggctcagagtgatgacgggctggcagatctctcaacagggcaatacttgctgtggatctttgttttctgtttctagcttgatgaaaaaataggcagtttttatgctgttacagaacaaatagaacattgacatgtatttatattttacatggctgattttaggttctgttctatttttggatagtttgaaatgtttcttcctctagattttgaggtggaagaggtaggtagaccagttataatgtgtgtgtgtgtgtgtgtgtgtgtgtgtgtgtgtgtgtgtgctggtgctggaaataccttccctggtggtttaccctctgctatggttaatgaagttttgttgtgtaaatctctacctcctttttatgtctggtgaacttatatattgtccatccatcaaaaaccctccttcatcactatgagtcagaaggaagtactctctgcttcaggagacagtgtatcaagaggttaaaactggagcagcctagggtcagcaactagggcaagttccgtggtaattatgtgcttcaacctccccctctacttaaagtaggagcatcatactacctccatcatggggctgctgtgaggactaaatgaaacgatacctataatgtgcagtgaggagacacttacatactagctcctcttgtatctctcagcctctactgcatcacacccatatttctagtggaaacactggggttcttattggcaagaactgcctctgatttccttctgcttccccaaggcccagcacagggcctgacacccagcaggacctcaacaaaccttagttatactggatttactgcactggagcatcctttgctacataaggattgccaaggccaagagacataatgatggagagagtctgcagattgtacagcatccatttccaccatggggtctgcagttccgtgctataacgcagaatcatttctgtaccacccatagaggtccgttcctccccaccccacctccacactcccaagaaatactgaggttttccaaagatgagaaatttcacagcattctgctatcttttgggtaactgcgtattttatgatgactaataggcaattactatggtaatattgcaattcagcatgtgtgaggtttgggaaatgagaaattatgggtaactactttggactcatttctatggtaacaaaaagtaattgtcattaaataccagttattctgaggctgtacctggtaattatagatttttatgcccagaaacataaataaaaccaataaatttattcaaaggtctatgactgtttacttatacgtggctctatggaatacacaatgacaagcacctaattaagaaatgcaaacccaacacagggtttcatattgttgtacggagatggaaagtctgtttttcaaatgcaggcaacttctgcattacctatgctcagaaagcgccgtggggtataggtgggcgtgggggctttcttctctgcaaaagaagtgacgaggaaggagctggcagagagagtgtgcaagtgctgcagtgtgtgttgtgggcatgctttctgtaagacattgagaattaccaaccgattctacactggttcagcccatcatcccccaactccagttgccttccaactaggagttgcttgcagcttcttggctctgtaatacctgaagttacaatattcatccctcaagactcctaggtcccagatccttccagaactctctgaaaatattcccattgtattgtcagtagccataccattgttttttgtaacacggtggtaaatacacataacataaaacttaccatcataaccatttttaagtgtagggtttgatggcattaaacacattcataatgtgctaccaacaacaccatccatctccaaaattctttttaacttgtaaaattgaagccctatgcccattaaatagtaactccccattttctccatcctcccagcccctggtaaccaccgttctgctttctgtctgtatgaatttgatcacttgaagaacgtcatgtaagtggaatcatacagtctttgtcttttgatgagtggcttattacattagcataatgtcctcaagtttcattcatgctgtagccatcccattcttgatagagcctctcccccgcgcttctactaaatgatggaaggtgcctttcatcccacttccctcttccaagagagtaggagggaaataggccaggcgagagaagtgtcttgtccaaggacaaataagaatgctcaggagagtagtgaaaattagaccctcagttctccacttctgcctatagcttatagagcaaaggcaatgtgcgggagtgtggcgagtccctggatgtaccctatggccttgaacatggctcttcaccttctcagcctcagtttccccatggctgaaatggatacagtaaaaactggctttcctttcttggtcactgttgtatgaccaaatgtggttttgtaagtgcctttaaaagtaccatgctccgtgcaataactaagtatggctgagaatccagtttgttaaattataacagcagctcatcaggttaaagcatagcagtgttcctgtcacaacaacatacagctaaaacaactgggccaggaggccatgcagatgaaggtaaagggctgggggctgactgcatctggccctagttactctacactgggcactgtagctttgtgccatcgtacaatcactaaacactgttgtttagttcatttgttcattctggaaacatgtatgtgaacttcaggtcagtgactagaaagataaaatatatatcaagagcccatttgccaggtactggggatacagagaacaaggtaaacaaagtcctgacttcacggagtttatagtctaaagtgaagacaatcattaaacaaatagtcacataaataaacacataattacaaattagggcaagagccataaagggagagtacagggtgctataaaagagtgtaatgggagacccactatatattgcgatccctgggaaagcctttctgtgaagtggcattaaacctaagacctgaaatgaagagaaggcaaatgtaactgaggtgcagtaagtaagacagagtgtatagttgctctgtgcttttactgtataaggtaactgttatctattgttatatcatccaacataattgttaaagatagctactatagcgtatactatagttactatatattgctgctataaactttagtataggctctatatactcttactgtaaaccatagtctggtatcatatacagtagtctagttagaaaatgttgctgttctttaacataaagagcttgatctatcatggtatagtggccatctattgctattaaattttagagtgtactttcttcagttcactataaataccacagaataggtacttgtattattaaatctaaacttagctgatgaaatctgggaaatctccctgaccagccttcctagattggattatatgcttctttaatgtggaggagtgaggaggaggaagagaaggaggaataaatgtttatttataacttacagtgtgcttagcactgtgctttaaatgcattatctcactaaaagcctcataactctatagtatctccattgacagatgagaaaaatgaagcttaatgaggcaatgtaatttacccaaggtcatatagcaagtaggcggtagagcagaattgaaatctgacctgacacccaagtccattttctcaaccactgacctttactccttccaagctcctgccttcccttctcacactgcagggaactggcctgttgaaccatctctccagccagcagagtgaggtgcctcagggcaggcctgtctttggttctcctcccagggtctggcaggcttggtgctggctatcaggggagtgtgggactgcagagaggagcagggctaggtcaggcacacctgcatccctgcccgctcctcacaggccacagacctcacggggatgacttaacttctctgaggcttgagagtctgcacgtccagagggagatgttgagagaatgaaagctaaagagcatgagagagaggcaaagacctggccacccgtcttccaacatgtttccagcaatttgatcagttcctgggaagtctggctctctttactgcactagaattctgagaaccaaccttccttccttccttccttccttccttccttccttctttacttccttcctccctatctccctccttgcctccttccctctctccctcccccaccgccaccttttctcctgtactcaagctagatttagtagatttttattatttgaatttagaaaaactttaacaaagttaaacaaagttcctccatcacagaattatgaggattaaatgagatcagtgtgtgagtgcttcacaggccattagattggcaagtagaattcttggaatggcatttcccaaaatgtgtttcagaaaccataacactggttacagggaggatgtggaccccctctcacttaactttgggaaacactgagtactatttcccctcttagattccctatgtttataagcatattcaaaattttgaaaagtcgtatgaataaaagaacatgtttaactttgcttaactctgtgtttcctaaacttatttgaactctgaatatttccccccataatgccttggcaagtctcaccaaaccatggaagtactgctgtagagagtagtgtggctggcctaggggacctctaaggcaccttgaagttctcaattctgagtctttattatttttttatatattctctaaagctttaagtagagaattctcatgattgataggctctttgttgtacagttttagcaatagcattaatgcttctggttagagttgctctccaagtctcataatgagaatcacatattctcactaggagaatgttgggggttgaagcttcagggtgaaaccacttctgagggttggaaatcttttatcacggagtcctcaaatcacaaaatctctggggcttgaagacatgtagaaagcatgtagccctcatcaccatcccagtgtccatctaaagccctgagaggggaggcattttggccaaggtcactgacctccttcaagctagtccttcccgagacagcagatgatgacataaataaatgtgtggagagaagtattgacctctctctctgaccgctgctcttgtaattaaacagaaacattagcataaatcaaatggtctttctaccactattatcgctaacagtacactctgtccatggaaggtggaaaagcatcactctcaggcctgcaacaagccataaaacttgcgaatgctaatgaaccatcacttcagccaattaagagtggaagcaaaactgtctttaatgaaggcttcaggcatctcatgggctctctctaactcacacccaagggtaccaggaagcccctctggactcagttgccatgctcttggaaagcagtaaaccaactctgtgtaaaacaagcctggctggctgtcaggagatctggttccagtctgagttaggccacggactttgagtaagtactatttcatctctgggactcagtttcttcattagtaaagtcatccttctcatctctcatattcatcaaacactttttaggcatctaccatgtgctgatccctgctgctaggcatgagggacacaaaggccattaaggttcagtctctgccctccagtagctttaagtacagtggaggacatgcaatggaataagagttgttcgataaccaggcctgcttggtacagtggctcatgcctgcaatcctagctacttgggagactgaggtgggaggatcgcttgaatccaggaggttgaggctgcagtgagccatgactgcacaactgcactccagcttgggtgatggagcaagaccctgtctcaaacaaataaacaaatacacaaacaaataaataaataaccaggcctgtgagaactcagagaagagagtggccaattctgtttagggtttaaggggatgttttccagaataaggaacatgaactgagttgcaaagaattaatgggatgaagaagggatgagggatttctgggcagcaggcagcctgtatcttcatacataaggtagcaggaaccaataggacatgtctggggaactgggctttcctcaacgcagctgcagcacctgttctaggaggagaggaggaggtgaggcaggatggtggacacacaggcagcagggcagacaatgccttgcatgcaaagctggggggtctgaatgtcatcttgaaagtcgtgggccgaacgagctctaaaactgtataatttggatggcgaagttagtcaatgatttactggctgtgtgactttgggcaagtcagcttaatgtgaaataagggcaataacactatctatctcaaatgagtcggtgtttttttggcagataatcttctgggcagtggaattttaggctgtaaattatggtgctaagccaggagaaaaggagttcaagatttgagtgcgtgagtgtggggctggctggtgtgcccacactgaagagaaatgtttttcagatgacctgggattctattctcattgatattctccaagaggaaacacaacaaaacagtcatcattataactaccccacgatattctgcaaaacacattccttcccaccatttcttttgaagctctcacaactgccctttcaggtaagtaattattgtctccattatgcaagagaaactgagcccagagagggaaaagtggactccccaaggttacatggaaagtaggtgccaaaactgagactaggtctcctgattcctggtccagtgagctgtctagaaaaacccagcaagtgaccttaggtggctgtgcatgaaaaagccaaagctaattaaagaaattctcaagagccagggtgaaactttctctaatgaactcatgggcagcctcaaaattcttcctcaaaaaatatatcccgtattttttcttgcttccatactaccatcctataagtacttgcttccaagcattctccccaattccttacctgtaattgcccaggtagactccatcaggattgagcattggtgcgatcttgaagaccaggtattcccggaggacacaggcaatagggtgctggcttacaaggaagtcaatgatccctagggaaagagaagagcccggtttaacaacaaagcatttcaagaagaaggaaacacatttttctcagcttggaaaacaagaagagctcaataggtgattttggcctgtgttgttattggccactgtgggtgtgtggttatagactacgcgttatctgtataaactgtatttacaaatacatttgtatttccaagagacagttgaagacgtaacattgaagcccatgggcaggagggagagagcatttcctgcggtagagaactgggagggcttccgagaatgatgatatttgagctgtgctttcagagcccacctagtttcatcacaaagagatggggagaggtgggctagcactaaacagtaaactaagagatgctttctaataggcacacttagttaaacattgacatcagatgtgataatcacagggtcaaggccttagggatttaaatgctcatgttgctgataggcacaccaagaagcagagaggaaaagcattttagccaaagtcacatgagcagaaggaggtttctttcatgtactccaaatgtgcttctttccccattttgaggatcctctgttccaggactccagggatgattgccttcccggcttctcactggcactaaaatcaccctgccttccggtcaccaaatttagaaaatttgtctccatgacatttttcctactgccaggcagtccccatgtccttttcttgaatggagcaaatcttcccctcttctccatcccactgcctgtcttctaacccaggctaccatcacaccaggcctggataacagccaccacctatgaaatgagccctcatcgctgaagccagaaggatcttctggaagtgtgaatctgatcctgtcactccctctttgatatctttctggtgacagcctgcatctacccatagaagagggggtgagaaaacaaacaactctgagccattgtccctctccttatctcccccatatttctactctttcatcagagacctgaaaaagaaaatgggcaaaatggtgctctagcattccatgaaattactataatgccagaaagtgataggagaatgcaaaaccctcccacaatgcagaagtggggccccgttcctgctggagagagcaagaaaggcgtcaaaaggaagcctttgagctgagccctgtcagaaaggtaggtttgatagatggcaggaggaaggcagcagggtgactaagaacaagtgcccagtgcaggcactcagctcttggaatgataactcgctccagagcacattccagagctgctgtgaccagtgagggacatctcagacttttcattaggccagggctgagaatccataggcagctgaaagccagttggacatcatttacttctcggctaacgcggcagtagaccagatgccctaatttatttgttggtcctcatattaaagctgcagtttgccagtaaacaggcagggtaatgatgccaggcgcccttgttaggggctaataattgcttaatctgtccagtaattgaccccagctcccggggcggccctccatcaaggagccagcctgtgctcagggcctggccacaccgcctcagagaatggcttctggaaatggagtagctcattgtgatccatcctccttcacagatgagcagattaattgggctgccaattaggcagctaataaaagaatgagagaaaacaaaggcagaccagaggctgcagctgcccagagctccctctcctagggtgggtgtggggcaaggagaggggaggttttaagactcatctgttggtttgaggtcagatacaatataaaatcattcccattcatcaggaaatagggagatctttcttttcttttcttttctttttttcttttttctttgtggtgagagaggagtatggggaagactgagagggcatgtaagagtggagagatgatgccatcctggccaaagaccaaaagcactggatggaccaagaaaaaagagggaccaggggagcagaaagtctcaggacctgagtttgaatcttaactgagtgttagctacagaagttactgactagctttccctgactagttttctcatcttgatatagggatagtaatacctaatctggaagactgttgtgtacctgtatcagagatcctgtgttagctgcctgacacagcacctgaaagttgtggcatgcttcaataaactcacttagatcaaaggttgaaaggcagtgggtagttaaaaacaggattagttttagaagtaggtgtcctagtctgtgaagttgactaacaatgaaatttggagacaaggataccgaatggtggaagccaacaaatcaaaacagaacttgggttctagttttggcttagttacggggtgacctgtagaaagcctctgggtctatgcttatctttaaaattaggagaaagaattaaataattctcaaggatacttcctacactgacattgtatgattccatctattttattcctctccgccaaaagtagaagaatcatctgtcaagtgaggagaataatctccctcctgctggaagacaccatcaacctccttgagatcagccttgttccttctgtaaacaagtttgccaggtcctcttcttcaagctgatttaaccaggaagctggaaaaaagcaggatgacaggaaggctggaagctggagaggccagaagagaaggaaaagtggtagaggatttgaaattaaagctggaagttagagatcactgccctgtcccagcttccaacagaccaggatgaacctctctagccaaacctcaactgagacatatttattgctgatttttttctcctacagtgtttggtttagggctgggcacatagtaggtgcttataaacgcctattgatggattgctccaggaattcatacaactttgactgtgtgggattagttgaactgatcattgctcattctacaaacattcattggcacaccaaattctgggcatttcaaaatgcctaagatggtcctgcctcagaggggtgcacagtaaggaagcaagtccccactggttggcaaaggctctgatgggaacagcacatagctgtggggactcagcaggggcctggggccccagaagagatattggaaaggggacttaaaaaatgagtagagtggagccagatgaaaggggtgccaggatgcagccataaaaagaataaaatcacgtccttttcagcaacatggatgcagctggaggccattatcctaagtgaattaacacagaaacagaaaaccaaatactgcatgttctcacttataagtgggagctacacttggggtgcacacagacaccaagagaaccataaacccgggattcataaagaggggcaggagggaagaggcaagggctgaaaagctacctatcgggtactatgttcactacttgggtgatgggatcattagaaatccaaacttcagcaacacactatttacccatgtaacaagcctgcccatgtattccctgaatctaaaatttaaaattaaaataaaaagaaaggagtgccagcggaaggtatccaggctggggtaggaagagatggtctgttggtaacggaaagcctttcaattccagggccttggcttcatggttaaaagcgcagaccctgaaactggacaatctgggtttgatgcctctctctgccattcatttgctgtgtggccttaacctcccagttccccaggttcctcatcaattacaaaggggagaataagaattacttgtgggttcttgtgaggatttaagtgagttgatataagcaaagtggtacacagtaagaatatacaagtattgttttcatcattgctcttcgttggcttgctgtagacatgggaatggagaggtgaacaaggatttgctgttccagccgaaaaaaacctgaaggcaactatagagctattgccaggttttaagcctgggtcagatatgggctttggagagctccatccggctgcagcgtggaatgctgctaagaggaaaggaatactgcagggcagggcctcctgaaggcaggacagaggtggaggtagggtgcaggcatagcagagagagctggcagaggtaaagcagctttcagtcaggaaccagggtggaacatgatagtgacctgcaggggctctgcagcggccaaggttcagagagtcatgaggtgcagtgggtggacagcaaacagtgtggatagaaggtggcaccaatgatacaatgatttgcctgcaaccccgagagcatcagaactctttgctgaaagcacccaaccttgaggaacataaatgagattaagtttctggcccctggcaggatggggcctcaaaatagaaactgaattcagttatagaaaaataagaaagttacatttcctgcacttcttttttgagattgaggcttacttaaacttacattgtggtttaagtctgtcttccctccaggccatgagctccaagacagcaggaagaggtctcctctctttgccactatatttttagtgcctagctcagtgcttggcacagggaaaatactcaagacctatgtatgaagtgagcaaataaagatcgacccatgacaactactgtatattcattagctggactgacttgtaattctattggctccatttcacagacagggaaagaaagtcagggtgtggcatcgcttgctgagtgcctcacaagaacctagttgggattcagacccagttctgctggcttcaaagcagtgctctttccatgaagacaagatgcacagagcaaggagtctatctgcatgtgatttgtggaataatttgcatatgcctgcatgattttctctctagagaattctgtgcaaaatttattgtttctgttctctgttcagaggcagtcctctgtagtgggaagggccaaggtttgaagcaagacagtttgaggtctctgcttggcccagtgtgtgatgtgcacaacagcagccactctaggcccttccttgacctggcaccagacccctgtctgccctcagctgagtccaagggcctcgaattatggactcacaaggagtctggccctgatgaccttaaagttcacggagtataagtcctcaccctcctgcccccaactctgcccatttcacagatgaagagacagaagtctagaaaagtgaaaggccccgtcacaaacgcttagtggatctagcaccacacctatagtgggaagctgtttgggatagcgagaagaggaagaacaggtgaagaagagaggtgggaggaaagcagaatgggggaggagcaaaggtcactacctcattgacaggaagtatgaagctgtgcttggtcccggtgcctggcaatattggtgtttgtgagagcatggtgtgtgcatgtgtgtgtgtgtgtgtgtgtgtgtgtgtatccacatcctcctccctcttcttactcccacaaaataaccctgaggagtgaacttcctgggagagggctagctctttgtctccatagtctaggccctgatgggcaccttggcatgtagcagcagggctcaggctgggaggcaggagacctcgatctagtccccactccaccaccaacttaccaggtgacatccagtgaatccctggactattctgaaaagaagagctgagagctgcccagtgacctggtggaattcctgtggaagagtgaaggtgaagaggggattgtgggtactggtcaggcacctacctgtgcctggggctgacccaccattgacctacaactgtctcattaaaccctcacagcagccccttgaggaagacattgctgcccccattttgcaggtcaggaaataggggctgtgagaggcaaggacttaggcaaagtcccctagctagatggaaatggtaggctcaaactcaggcccatcaaactccaaagccacagctgtgcccactgcccctgctgcccttcagagcatggcatggctccccacagtagcatttcataagtgctggtttcattaattcaatgataaagggtctggagaggacaaagtactctgcaaatggaaattttcaatgaaagttggccccagagtcccaggaagagtcagtgaaagaacatacacttgaccaagagtcagaaacaaggtcaacaaggtctaggtctggttcaggccaagctcctggcttgcaaagtgaccctccaggtgagcagagctcagctagtgaccctctcaggaaggcgacgaggaagagctggggcccacagtctgggaggcccacacctgggtttggttcacagtaaggattagaggaaccaggtacaaagtgcctcatggaggccctggcaccggccatgtgctccattagtgctagctcctcccctactgctggcacttatttagtattttctctattccagaccatcctaaatgctcgatggatatgaactgtgtcagtcttcacaacaacgctgtgaggcaggatttctattattatttcccttttgagataaaggaactgcggcataaggagattttgtggttttcccagggttacattgcagtaaggggaggagctgggattcatgcttcgcagtgtagcagcttgagggatggcgctctcacatggctggccacagggccacacaggagctcctctgacctctcccgtagtcactggagaacaggatagtttggcctcacagaggtcatgggcagggtttggagtagcagagtaagcatcccaccaacaagcagagtcttgaggaatctgagccctgctacccttgctgccaccccttccagagctatgtggtgacaggacttcactctactcccagcagcaggtgcatcagcagctcggcggtgagaactgtggtcccagccagatgggcacaaccggcttcacatgcctgttccctgctcaaggtcactgagccagttaatgtggaagagttaacagaactgaaggtatgtcagcatctgtccacaccttggacctgcctgctatccccagaagaaggtgggctgatgggggctgagggaagatggacacatttagggctatgactgaggaagaaactcccagctgtgccctgtggggctgtgatcgggctgtctacatgtagctgagacacccttagaaaagaccatgcctcagttctgtattggtaaagtggggtaatgatgcctcttacactgcctcaaggaagtatgaattgtgtgtctcatggggcagatacagagacaaggaaagatgagaaacaggattggggagatggactccagaaccacacttgtcgtgaattagccgtgtgactttgggtaagccattgtgcttccctgaggctccgcatcctgatctgtaaaatgcacatcaattgttgtgggtgatcagaactcagttctttcaggtataagacttcaccttctagtagttcccatccctgagtgggacaagggaacatgtacaggcttgggagttagctagacctaggttaaaagccccactccgctatttaatgactgtgtaaccctgaggctcctctttctgagttcaacgcagcattttttcctcacaacagccccataagatgaacaagaaaccccatttgacagatgtggaaaatgacagttggagaccagccctagaccttacacagctcgtggtataaagagggaaaaacaaatatgagtcaagtatatgataataaatcagggcaatagagatgaccgttatcaataaagatgatggccatctttagatccacaatgcaggcacaaagcaggtggcaggagggagtgggccagggaggcccacagtgggggcactcacaatgagccctgtgagatggatggggcttgccaggtggcaaggagcaggcacagggcctgccaggcagagggagcagcaggtgtaaaggtgcactggtcaagagaagaccgcccactcaaggtttcagctgtgtggggctgagtgtatgaggctgaggccagagaaccaggtgagagccagatgacagagggctgggaatgtcatgccagggagttgtagtttattttgagaagccagcgggcaggcattgaaagactctgtcaaggaacagacatttattgaaaacctacagaacgccattgagtgtatgaactcagcaccatccaaagattcccttttagtaacagggtcttcagagagcacctgagatccattcaattcctctctgcctcagtcgttacctgtgaaatgggatggcaaccctgctctctgtctactgcccacaggggaggtgagcacaggggtttgggctcccagagatgaacatattgatggtaaggctactgtctttttacaaacaaggacaaagcagttacatccaatcagctgggggaagagatctgctgccaagtttagtaactgacagatggcgcaagtaaaggggttggtaaacccaggagggacctcaagaggttactgcaaggacaatgctggggaggaagaaggccaaagtgagaatgctaaggagtcagctatagtgactggagcctcagtcatgcatcatacaagctggtcggctttgggcaagtcactgcctccctgaaactccatcttctcatctgaaataaagaggaaggcaatcgtgcctaactaaagcattgtaagaatacgaactgggaaaataaagcccatatttatttgcacagtgcttgatagtttacaaagcagattacctgcttcatcttctcagattcccacggggaaggcggtaacatctgttgagtgcctgctgtgtgccaggcacaggactgggtgtgctgtttatattcatctcatgccagcttcgtaacagcctgcctgggtagtatcattttacatttgaggcaactgaagtcacactgctggaaagtggcacagccaatacttgacctcaggattgtctgatttcaaatcctcagaggcttccactgcagtgtgccacctcccttgagttatagaacctacacaggcgtttcatatctctttgacctcatggtcactttgagattaaaatgagataaattacttaacttctctaaacttcagcttgctcaacaatatacatatatattgctgactatagctgactaaatgtagtatgggtgaaatatgtaataataagtaaaagtgcaattataaacagaaacacttgagaataaaaattatgacttatttgcctctggttgtctgatgccaagtgtgcttactcttggcaggtatttcaaaagttgtttaagtgaatgattgaatgaatgagtgaagagatagttttcagtcattacctcccatttcacagctcttctgccaacatacacattgacctggggccagatttcttgctgttgtaaaccactggaggcaagtaaagctagggagtgtagatgattctgtatggctcttcctcaccacagcacatatgagataacttcgttcagccctccctgttcatttatccatccatccatctatccattgattaattaattcatacatacgtctagtcaataaacatttattgaaataaaacctaatggagatcaggtaaaatctctttaaagaaatgcattaaatttccatttaagataatggctctgcatgtggccacactgttccagagatcatcacagtgtcccagttggatgtgggtataggatacctatgagatcctgccactcaccttggcacacaaatgatgagggtgtttcccctgggtggactcgtcctgtgatgaataccaccttctgctctgccccttcccggagattgtctgtaagataaaatgaaagatggttgctaaggagggcaagaaaagctgagtctagtggttggtgtgtggcagggaaccccagagggaatgggctggatgttttacatttacctcttaaaccactgggttagaatcattaaggtccagccattgctgactaatttaattatgtccctacccaacaaaagactacattcccttttgttggtacaactgatcatattatattaatatgtagtatttataatcatccaaggaagccatatgagtgaatttgaatcccaaatccactgactgtgactttaggcaacttgtgtatcctttccaagtttccattttctaatctataaacaaggatgacaatatatccttgtttataggttataaacaaggattttaataggtttgttgtgatgattaaacaggcttacacattgcatagtacacagtaaacattcagtaaatgatggagtagagaaggtagctatttatatattagtaatagtagcatctgccatttaattagctccttttgtgtcaggcacattatacacatacataatccttacaggaacatgctgttaatgtgtttttttaatagaggcagaagtgaggctcatggaggttatataacttgttcaaggtcacacagctgaaaagtggtggtaggagctgagattagatcccaatcccttgtctggccttcatttcccttttatcttaaacaactaaaaaactggacaaaatattcaaaacaagtattttcagacattgaacaagagccaatgcaagataatcaatgagagaaggaaaacaaatgagatatgccctatgattgccctggctttttgcctgatgatcctttccagaccaaagagcagagaggggtatcctgagcaaagcaaagaagcctcactgagattcaagttcagcaggtagtagttgggtaactgtgagctccagagagggggaagcactgtagaaaaagagttccagaaatctgtacaggaatcctcttgattctttgttggatgtgcatacatagggtgactccccatgatgtcaggaaaaaatgatcaaggagctgtgaactgcacagtccttagggtcacacagggctaagaatcatttgaattcccacaactaaagaggaagtcctcactgatcatccaaggagaatgagaattcagacgggcaatgtcttagtggtagggaaaaactactctagaccaccacattcacaaagctttaaaacaagtctcaaaaggatcaaactgaacaaaagaaacttaaatgcttgatgtacaaagcccaactctctttaaaggaaggcaacaaaatccagagagtcaaagcaatgtataatttgcaatatccagcatccaataaaaaatgattagacatgcagaaaagtaggaaaatgtggctccaaatcagaactcaagctctttttgtctctgcagaagtctaatttgtataataaagttgaactattgtgcaaagatatcatcagacaaaagcaacagccaagggtggcattcccagaaagaaacatctggggaaggatactcagcagtgggcagacgaagggctgattgatacagagcacaacaattacctgaaggaaatttagaaagaacattgagagaggttgaattgaaggatttatcaatgtttgaggatgatctggagggagagaatagaaataattaataggatttctccttctgaaatgctggagacatgctattctgaacgtggttctttatcccaacagtcactgcaccaatgtcagagatgaaactaaaaatattaaccctattaaacctggttctaaaggcttgggacttgcttgtccattgggatgatcagtatgggtggagtcactgcttcccctgaaaggcagcaagaaatatcatggaaccaaaatatagtcttgagaactcactctgctcagctctgtgctaggcacctttaggaacaaagggagagacagaaggctcacctgccctgaagtttattatttaaagaggaattcaacacctaagcatttcctggactgaatataagctcctcaaggaagaaactgcaacttccatgggtgtatggctaatgtctttcccaggaccccctgcatggagtaggtgctcgaggactggctattgaattaataaataaaaatacttgtgtagaagatggtttataaagaaatatcgactcatattatgttttttaatctttatcatgcctctgtgaggtggacagtattaactccattttatgggtgaggaactgaggctcacagaaggaagggacatgcccaaggtcattcagctagcagtggtagagttaagtcccagcacccagccagtgcccctttcactaccctgtttcattctggatccagtaaaaacaatataagattccacttctgctgcatttccatttacaatttacacaagagaatttcattttatcttattgtgatggaaactgagccgctgtcttagtatttatattgctttttcacttaaaaaaaaatcaccaagcccttttaaaagacactgtctaacactgaccccatcttccagcagtccagaaatgataaatggcactaaggaggcccttggtgaaggctaactttatggatgtctcccctgaccccgtatcaagtcaattgcattcagcatttctgctgaccacagggaaatgcaaaatgggcattctatttgcacactaattttactgagcccttgcgtcttcataaaatgataacatggggctaataaaaatcaagcatctcgggtgctaatataagcaaatgttgatgcaggcaggtaacaaattgctttgtcatttagaaggccgtaaaagagcattataatcatctttaggcaaaatggatgggtcgcctttgcttagcttttagctttcatttgcaaaatcaatttaaggtaatgcagcagctctgaggtggtgactaccccaccccctcctgtcaccaaatctccagactctgtgcaaagccaattaaacatattcttggtggaggcaggacagatgaagaagaaagtatgcttgaaccaagccagggtggaacagaatgcaaacaatgagaccaagaacaactcataagagatagaacaactaaagagctcatgtaggctgacatgctcaagggtacaagggcacactcaaaaaacactgggcagctacacctggctccccagttaaacagcaggtgtttgaagtaacgtgctttgtgtggcatccttagcatgcacgtgcacacacacatacacagacacacctttgtcactataaccctctatcatctgctatttccttaatcatcacatatttattgaatacctattagatggccaggcactagctattattattttcattttacagaaaaccaaggccaagagagttaagtgacttgtcctagttcttacagctaatttggcagagccaaagtcccaagccagatagcctgactccagaaactgtgttcctaacctctatattatactgtcttctaggaaggaggacaatatcatcccattgcaatagcaattaagtaatatttatgtagcacttattctttgccaggcactttacatgcatgatcttatttaattctcaaagcaacccaatgaaatatctactattcttagactagactcttttatagattagaaaattgagatccagaaaggttaaatgacttgcctaaacttgcataagtagcaaatgtgggagccagaattaaacacaggtctttatgattctcaaatttgtgcttttaactactgtgtcatattgacttttggagattaaaatcaccctatatggtttttaaaaaaacatcgacaaattctttgttcatttccgcctttcaagaggtggagatgtactcctctgtccttcagtgtgggctggacttagagacttccttctaacaaatgaaatactatagaagtgatggtgtgccacttctgagattaaggtataaaaagactggcttccatcttgggtgtgatatctctttcttgaatggctcacccttggggaagccaattgctatgtcataaaggcactcagcctatggagaagcccacatggtgaggtactaaagtacccagatagcagccaggaggaactgaggtttgccaaagccatgtgagtgcatttggaagaggatcctgcagtgtccagtgactatagccctgactgacagcctactgcaacttcacaagagacctatgccaaaaccacccagctaagctgttcccacattcttgacccacagaaatggagacataataaatatttgctgtttcaagatgctaaattctagagtaacttgttaggcagcaatagataatagacatctccctgaagataactatatttctcctagttgctatgtagaccttaagtaagtttgcatcttatctattgatgctgactttcaatgaggaccaaagccataatctcggagccaagatgtggagaatctcaatctatttggccagttattatggatctgttgctggtagaggtagatgccaagaggccccaaagagccctaggtgggtctctgaggacaaaaatctcccagaagttcatattgtcagttttgtttccccattcctccagacaatgacttgtcatggggattgagatgctaatgcgaaggaagaaggaaatgctactgggaggggaatgtggaatgttataatgggggaagcatttgttgttgttgttgttgttgttgttgttgttgacacctgagccttttttatttccttgacttgattggtgaaggcatgataaagtcaagaaaatgccctactatgggtttctaaaccagacaagtttcagccttttctccagtactccagggcccaaacaggtccatagtactcttaagctggagaaacaagacatcgctgtagcaacagcagcatggttggctggtattaatcagagggcttgctcaggactggaacagccctggcactggtctccctgtgccagcaccaccctttccagtgcaccctctgcctggataccaaaatggtctttctaaaatgcaaataggagcataccacttcctctgcataaaacccttcagcagtgctctattgtttgcagagcaagtccagcccccttagcctagaccataccatccctgtctctggtagctggtggctgcctatctctccagtcccttccacaggccccagccccagctagcactccatggttcccaagacacgacatgttctcccacacctccacactgggcacatgttctgttttcttcctaggatgccagcccccatcttggccgtctggcttactcctactcagccttcaagacttggttcagatgcacctcctctaagaaggaaaggaggaaactgatgttcatccaggacttggactgggccaaccttggtgttaatgttgctgtgttttatctgattttatcagcaatgtgaggatatcactgtgttgatgagacagacaataaagagggaatggatgttgtgaattatagtaagaacatggccatagtatagacatttattgagtataattttatgagaatatataggtttaggagatatcaatagagctttcctggaggcagcggagaagcactaaatgcatttgggtagatatgtgacttgatgaaattccagacattcagggttagctctgcctcagtgtttgatgggtggatccaacaagaggaaagggctaggtgagggacactgaggaggaccgtgttccctgtgtttcttctgtaccctgagggggtcaaatgaaaagtcagctgacttccctgggtagatggactgggtctcataaccaggttccacagagtattgactgtgagaccttgggccaattatttatccaccttgagcctcagtttcctcacttataagatgagaataataatctctagctcacaagacaaacaataagcaagagactttatatccctgccacatggcttcacctataatagcaggtgccatttactgagtgacaagccgtggaatggggttcctcagcatcaaccctacaggtatgttgagctgcagagctcttggttctgcgggtgctgagctgtgcattgtaggatgcccagcagcatccctttcctctatcctctacatgccagtaacacctctccctccagttatgacaatgaaaaacatcttcagacgttaccaagtgtcccatgtctcctcagaggcaaaatagcccccagtcaagaaccactctcctacaagaatattatacttgattcaaactggcctcatcattaactctccaagcaaaccttcagtttcccagactttatatatattttcctaactcctccccaaagcctctccagatatctccagaccactgtgtcctcaccctcctctgaattcacagttcactgtctggaccctcatctggtcataaatcatttgctgccttggtcaagcaggaccaaaagccacaactcagatccattctgcctgatgcccagcatctgctctgcacttctgagcctctgggccgtcctgagaaaatagtggtgttggcaagatttattttcagttcccgactcgttagcatcctccacacccccattccctcccgtaggctcagatctcccatggcctaaaatctcatatctaagtagtagactcattatgcttcagggttagggatcaaatgttctgcccttgatgagctggaagaagagaacaggaattacctttgaaaagagtatgtacatgacaaagaaatactcctgaaaaaaaatgaagcattgattctggaatatcaggcgctggggacaggagcctttctggtgtacctccctatcttcacaaatggtgtcttaatatgtcttggacatattaaactgctcttttgtctttacaaagcagtaagggtgcctctgacttacaggagactcacagaggccatcagaactgcacagcctgtgagatcaccgagttaaacaccctcactatgaagaagaagggcagaggaccagaaagaacgagtgacttgcccctggccacacagctagagagtagtccaggcaggtagcagcctcctctcactacactgggctgcctggggcaatggccatgcaggctggcacctggaaagtagccagtggattcctgccagagaagtgaagaaaagctgaaaagtgatgagatacagatctgagatacaggcggcttgggccaactaagatgttgtcaccttgatggtcacaggagcagcactgagttcttctccccagacaggctgctctgtgggctctggcagtttctaaagcccccttccttgccatagggctggaacctaggcctgggagcaggtaggcagccttccagggcaggctaatggcaggatagataaataggggcaggctccttcctcaggcaggctccctacccctatctatcttgatcccagcaccctacaaacacctccagaaaggcagagccagagccacctactcagaatacctgctgaagttagggttcctgggaaacagactcagaggctctgagattcccatacaggagctttactgagattgctctcgggaaggcttgtgagaggtacaaatgaaatagggtggggacagactcaacagggcctttcaacaattccacgaggagctctgggccaggagggccctgcctggttgtttgaggaggcaagggggctggccctgtgtcctgaatcaataggatactggatatggcctgccatcagggaaggtgtaaccccagtcaggactgagtgcaagtcccagggaggaactcagctgtgtgctctcagctaccaatgctcctgggaactgaggactcaatcctgaagatctgagcagtgcatgcagcatctgttatgccagccagggttgctgagaacagagcagaggctcaagatctgaggtttcagacaagaaggctgaggacaaaggactttcttttctgttaaattcagttcatattttcttacactgaccacatgccaaactttgggctggtctctgagaagtcagacactgtccctgccatccaggagctcaactgctctcctgcaagaatactttattcaaactggccagtggaggagaaagatcaagacttgtggttataaatttgaattctagaatcagacagaagaagcattaaatccaagtcctgccacaggtacgtatgtgactttgagctctaggatctttcattttctcatctgcaaaatcaggataataatagtatcaaactcataaggatcttgtaagaattaaatgagacaatgcttcaggtctatgtatatgacttgatgcatagtaagtgttcaaaaggatacttacagacactgagaggtgacttggtccaaatgcctgaccttacagatgcagaaagtgaggtcactagacagtaagcaacaggaaagccacaactttgcctctttcacaatttgtattcccagtgcctggcacacatgatgttctcagtaaatacttgtgaagtagtatttgttgccctttggttgaatgagtgtacccagctagaactgagtgcccaggctttccccaatgtgcgctctgctttttgaatccaccactggcagaccccagaaattcctcaccaggtttagtttcaggcttattagcaaatgcaaattgaattatgaagtgcccttttgcaacaaggacaacaaaaacagtttccctaggaaaggagggcatggagaggtgaaagctgggatgaaagtctaagacaatacattctaatcaaacttgataaatatgtaaattaaagcagctaaacagttggctttgacaaatgacttctccgtaatggatttttccacagtaaaggcaagagttcagcctgcctgctagtcacaataagagccctctcctgctttcctggcaatgcaggcacattgggcaggcactgggatgctaagaggcagagtgggaatgaatccttcttttagtagatgccattggttgagcatcagctagctgctaggcatggccttcattggccctgcaagagacatgggaatccctgtctcatggatgagggagccaagataaaagtcagtaaaggctggattcaccagactccaaagcctgatgtcactcgaggagccaacacaaccacttgtcaaggaacataaattcagcccctccaatggttttattgtcacctgagggtctcaccaactcaaagtcttacagctgtgtttcccctcccaggacctggcccagtggaggtgttcagaaaagatctgttccttaacttgccatgcagttccagtgggccccttccctatgcccgctctcaacctgttttccatccttaaaacgagctgttggagtcatgccagctgaaggcccagacatcacagagtagaaatgtgtggtcagattgcagattctctggaaatacatgacaattgtcattttaagccactaaattggggagtggaggaggttgttacgtattaataactaagaacaattgttatgaaattgatgatgattctaatgggttacaatacaacagtcaagtaagaggtggctgaagaggaaccgttttgagcagttactgtgtaccaggcactttacatacatcaggatccaagtcttgccaggccctttgaaatttgtattgtgagggctcagtacgttgcccggggctgccaggctagtaagactctgagctggaatttgaaccttctctatctcaggagactagtctttcttttgacattcccaaggggaaatttgattccccagctatactaaagagatgttattctgtttgtacttatgtgcaggcacctgcacacatctgcgtctgactgaaactcctacaaatacctgaggttttgtacaaagttattagagttgaggtgcaaacagaaattcaagttaaatggtttgtagccttggaaggacattattaatacaatttccccaagcagagaactgatatatatgagcactccaagagcttcaggaaaagtttccttgtaggcctgggagtaatgtgatcctgaccctgagtggaagatctgtcttgcccaatgctggaggaactcagatttgaagagtgttctttctttcctattgagatcttcattgagttgtataaaaataccactttcaatctcaaatccccactggcatttttatataagcaccgaaaatgctactgggctttggagatttcacttaatgaaggaaaagtatttctattaaagagtgtaatttttttctctctctcaacatgacatcttcagaggagccagagaagctgaattgttctgggctgagaaaacaaaccaattgttctgggctgagaaaacaaaccaacccatgccttgcccacgagtttgttaaacagactatggaatggcgacagccaaggaaggcaaggaagggtcagtcatgagggagaaataagagtaatgattctgaaccaactcccatatgcccaggactatacagtttatgaagcattcaggtactcaacagggagattacttctgttgccactgcccaagctcaacaccgcccccattgcatgttgtctgaacaaccacagaagcctcctgctgcttccttcctcccctgtagcccattttctggcggatggatctcactcccgtactcccagtcctgcagcggcttccccatacactcgaagttaacccaggcggtactccctagcccgcttgtcccctgcccacctcccacgctcgcctcttactgttgtttcacctactcatcacacctcctcacacctttctagtttcctcacacctctgtccagaggacgctcctgggtcctcggagctggctccttgggggcattagctccatggcaaagggaactttgtcttgttaatggctgtgaatccctgccatacattcacgctggccgcatatctaccatgtcaataaaatacagctatcggttattgagtgatgtctgctggggagaatgaggaccagaggaataagactcaagaggtggctgggatcagcaaattgtccaaggtcatatagctggcaagtgatgagagcagagtagacccaggtctggttaacgttaaagctggtgttccttctccctcaccccaagccgtcgttcactcacagagaggccacagaatgctgtaggtgggctgggggtgttgggcgcgttggggcggggaggggggggatgggtgggtgagcatgaccttaggtatggctgtgcctgatttagaattctagctctgcgacttactagctgtgttgtcttgggaaagtcactcaacctgtgagtgtctcagtctcctcatctgtaaaatgggaataataatattcatcttattgggtggctgtgaggactagatgaattaaaataaagtactaataacggtgcttgtcacatggtaagtcctcaattaactgtggctattattagtcattctacatgtgtttcttgagctcccagtcactccctcccccaggaagcctgcttcacccccaggcagtgagtcactctctgctctgttccctcccagccccttctgctattatagcaattgcccagcagtataatagtaatttgcttctctttctgtcccgcttttcccctctggtgactctgagctttttgggggcagaagccctgtcttattcatatcttcctggcactcattttctttgtctcagacagagaagggcattttgacatggttgttttgatgtaacggttttgaaatggctgcatctaaatgtaaaattggtttggaaaattactaggtactgtgtgaaacagacccccccgccacacccatcgcatgttggatcttcagtgtccttcactcccaccaattccttactgttcctgccatcctcatccccagccttgacccagagcccaccctgagcccaatctcttccctctctcccctccctagacccccttgacagaagcggagctcaaggatgggggaaattctgggatgagaagaactagcctgaaatgtctccatgccacattatttgctaatgtttttttaagaagttgaaggtgtgatggtttattttctcagctgtgtcaaaatgtccgcatatcaaaataggtgagtcagagcagcctcatcaacgtggctgaaacaaaaggacaatgtcaaaaagatatgaaatctgcatgggaagccacctggcatgcaatagtcctcaataatggattttaaaacatccatcattgtaagtggattaacaagcaatcagctacacttaacaccaactctcctgtagcaattactttttgttccagtgaggaggattctaccaccataaaaatcagaggagttaaggatgctgtctgatatcacacagcagtcacagaacagtgaccattagagctgagtatggtctaattaatgtcaccatttacaaccaagactctaagacaaaaagtgatttgaccaaggtctcacagtgaactggatttttacatgttagatcagaaacatttgagcagttcttatataacttctccaccctgtgccctaaattctaggccatgccatcaccagcgaatggaatctttcttgaataaaataaattataaaaatttaattcacaggatatgtttccagagggtgtttttatagaatgccattatgtgctcctcgaaaaaactcctaggataaacctggattctttctacaaattctacctcaggttatacctggggtacatggaagtagagctggacagacctgggtttgaagctgtatggcctaggtaagtggctccgccatggtttcatcagaaactaggtaaggagagatgtataaatcacagtgctccacaaaggtagctttcagtattactgatttcagaaaccttcagtcctaccttccaccttctggcagagccattcatttagaaaggcttgagtggggggtctgaaggtctgaaggtgctggcaggtgctgcaagtgtgacctgagaacccagaggtgaatgagcataatggtaacaaacagggactcaggcacaagcgcagtgactgcgctgctctctgagtgtgtgagcccaggcaagttacttcacttctctgtgcttcactcttcttgtccatagaatgtggatcatagcagactgtctcacaggaacgccctcaggaggaaatgaggttgtatttgtaaagcacgtagaatagtgcctgccacataggaaatctgatataaatgtttactgactaatagaaatacctgattaagaacacccagtcaggtgctctgcgtctgcagaggggaatgctcatcttgggccctccctggtgaaccatcctgcagaaacaggctcctgtggacagttccttcacgctttcccctaggtatgtgaggctaatacactggcaagaaacacggtttattttctgtttcttaaccctggctgcttattagaaccatgcagcagctttgtaaaaatactgatgcccagaacaccccactgactgcccccaccaagattctagttcagtgttctggggaagaactccagcaaactgttcttctaatttgcattgtggctgcaaattgtgcagccacaaggagaagaggaccagtggtctagtgtgagcttggcccaggctctctgctccctgggtctcggtttcaccatctgtcataagaaggggcggagctaggtggtctctcagtcccctccagttctaaaacacttaagctcaagaggatcagaagccccagtaagtggctggggctggctctgataacaccactttggtcagaacaacaggcaagggtgtggggtgagtagacaagagaacatgcctacatcaagcaaataatttttctcagacacagtcttttccttggaacaggacaagaagtaccaatataatagacgtgcagtgtctcagggaactcacaaagcttcctgcaagtagattggatttgtaagaaaacgtaagctgcatgcatgaggagaaggagaaagacatttttcaaaggatgaaggaagaggattaacatattcgccaccacagcaaagaaggggtccaaatacatgcatgtcagggtacagatccaggctcctaggagggtaggagaagggaaaggaagggaaatctcggtggttgagcacctgctctgtgccaggcgccagggggcgcattacttatataagctcattggatcctgccagccttgcagaacggctggcactctgatctctgtcctgcaggcaggttaaagagctgtgccactggccccagtccacatgatgagcagctgcgacgtcagtctaactccaaaaccctgcgctcttccctgacagcttgatgcctcacttatccagagcttcctgtccttgtaacgtcacacacccagatcacagcaaagagccagaaggaagcagaaaagcccctagaacagtgcaagccagacacacagggaccacagtcagggtcctgtcaagcctcaggagaggcctcccaactttttggggacactagggtgatggggagatacctccggatttctggaaagaaggggcaaagctcattgttagagagctggtccacaaacacagagggatgcagaatgggaactggtaggctactaggagacgggggccctcccaggacacagtttctgactgcctgacactacgaacacgtcatcgaaaggaagcaggtgtcagttggctgtgctgccgaagtacctcgggagctctgatggggcagtgacaagcccagcctgtctgtcagggacagggcagcctgacagcgctaggatggtcaggccttctcagcacagccagcaccacggtggggtaactgcacagctgctggccacagccaggggacctgccctcacccatcccgccgcccccgcccttctgccccacctttgctctctccagttgccttgtggatgtcactcagcttcccctcagctcttgatttgagagaagggccagggatcatgcttaggaccaaactggctccacagcacccctctctttacttaagggactgagggggagaacaacacctgtcagaaaaatcccagtcccttccactcacacacatcttgagaatttccccggaacccatgccctctctttgctcaaggtcagagccctgaccacagcccacagtggactgagctgacccgggccagattgggatcttagctgtctccctccacacatgccctcttttggcacatagtaggtaccccatatgtgaatgttgaagtggatggagaagcccagcctgctcactttaaagccatgccttcaaatagcacccagtgactagctcttgcgttttaatggtgcaaatgtggcaataacaaaggtggtaaatgtctatttgtcttcccatcttctagcaaggccattctccagttcctgagttccccatggtgtcctttcaaagcccttctctttaatgccaagtggaggagttccagacagcaatttgcattttcaattctagaaatcattaatattttaaagctgccagcaccatggtttattaacacacatttcctacctgctactgttaaagggaaactttctgtttgagaaaatttgaacatggggtgatttcccaactttggttcaaactctgctctcaacccctgctcttaggaccacatggtctagtgtgggagatggatatgcaagttgacagtggaattctgagtgctcactgagttgattgagggaagcacggggtactggggagcccagagggaaccccctggctcagcctgaagggtgggcacagggttcttagaggagggcttctgattttagggtaacatttgtacagattgtggaaagaatgtaagagaatcagaaggcctgtgcatagacactggcttttgcaactactttgagttgtcttggcaatagattgaggttaagatcaagggtctctgagtcagacaggcctgggttcaaattccagctctgacaccactggctgtgcagcaataatcatggctaatattatttgagctgttactggggtgtcagagagaaggctgcctgacaggcctaggacgatgaagcctgctcagtacaaccagggccacagtgggggtgatctcaatgggtgaccacagccgtgggaacctgccttatctatcctctccacctctccctcccagcccacctctgcactcatcagtgtgggtgatttcttttaattctcacaaccaccctgtggggtcattcttgtcaccctcatttcacagagcaagagactgataatcagactcacttgctccaggtcacatggctagccagtggataagccaggatttgatctccaagcactgagttcttctgctccttattccagaggtggttgtgacattaagtggcacatctacattagcacggcactggcacaggtcatgcagtcagcaatggtagctactatgttgcttttatcaccttctaaagcccaatttgttagtcgcttttccaataagcccaccctgatctctgcggccagaggccgccgtgtgtcccagctcacggtgcttagtaactgctgtcctctgtgtgctatacctctcctgtgccatggccacctcccctggggagagactgcatcctctccctttatgttcactcctggcaaccaccacacttcttggcacattgtaaggctgcagtcagtgtttgctaaatggaattgagagaaaacactgtcagccagatcaattcccagaagaaatgttttccaaaggtctttagtctgggcacatcaatataaaaatgacgcagctataatttgctttcagattcagactgggaagatgaactttaaccctgtcaaaaaatgagaacaaattaaattgaagcacaaagtcgtttcccttgttccagggctctggatttctaattaatgtgcagcacaattctgaaggctgcaaggggatcagtaagatcgtgtccgttaccttgcaaactgagtagagctcaagatagagctttttgtttgcttatttgttttcctttcctgggatgtattgtgcttcttgtggtacaggttcatagatgagagcaatcccaggcgatcagaaaaaaaatgattgctagaagctgaccttgtacaaaagaacacacaacaaaacagctctcaacacaatcactccccgaccctgtcccagaggatagcagcttagccccaggaagttagaaaaaccacaacgaatttcagtggcacatgctgaaaaggtgacggccaccttgtggcaaggccgaagaagaattccctccgtgactaagtgctgatatttaactcagagttttggcaaggcggctctggggatttggcacccaaggctctgaaatatcaatatatgttcggagactgtggtgagtgacaaggatctcattcaggcaataaaggggcaatcaaattaagttaccagctaggaaaggaaactgaccttgaacaaagggcgagagtgcaacctggggcagagctgtttccaggagttggccactgctcctgcttgcaggtaatagagaatggggcaatgctcttcaacccgttaatccccaaacttgcatgagtgagagtcacctggtgtactcattaaaattacaggtacaggttgctgggccccactccagacccactgaattagaatctctgacacagggcatgggaatctacacttttaaaactagtgccctggatgcttcctgtgttgataaacctgtggaaattactggctagaacaccaatactttccttattggatcctctggtatactatctggccttgggcaaattttcccttctccaaactttcatttctatatctgtaaaatagggatagggaccgctgcctctcaaggatatattgtatttgaggaagaaataaaatgagtaagtcggggtgcagacagcacctggcacttaggagatgtgcagtgcatgtgaatcctgcccttgtaggtgtgaagaggccactgtcttccacatcaggcccccaaagatgccttaaatttctctttctgctttcaaatttttggcccagagatactgagcatcagcctcaaatgctcctgcccatcagggaggattactggggtgagggggttgggagctgtgccctttctgtggaaccagtaccacaggactccagagccctcagtggcagcaggatatcatgacggtttctttgggaagctctgccaggaaaagccagggtcgagttaacctcccaagtccttgatggaatcagcccaggctgatgactaatcttctaggtttcttctccccactcctggctcctgccaggtctcttaacaatcccaaaacagtagacccggtccagggacaggggctctcagctcagagtaaggccttgagggatgcgttacctcactcttggctcaagtctgccaagagataggattaactggggagtgggggagggcctggcagtcaagagacctgagtgaggagacaacaggccagagacagtgtgtgataggctgaactgtgtcctctccaaattcatatgtggaagtcctaacctccattatctcagaatgtggctgtatgaggagacagggcttttaaagaggtagcaaggtaaaatgaggtcataattaagttaaaatgaggtcatgaggctgggtcctaatccagtatgactggtgtccttgtaagaaaaggagattaggacacagacttgtgtgagcacagaggagtggccatgtgaggacaggggaaagatggccattacaagccaagggctgaggcccagaagaaacagccctgccaataccttcatctcagatttctggtcttcagaactgtgagaaaagaaattcctgttgttgaagccatgcagtgtgtgtatttgttatgcagaccaaagtcatacagagggccagggacttaggctttcatgctggactcttttccctggctctctggcttggattttgggaaaagactccctcagttttctcatcggtaaaagaggaaaacaatattgcttacaggttaacagcacatctcttttttttttttttttgagacagggtctcactctgtcacccaggctagagtgcagaggcatgatcatggctcactgcagcctcaacctcctgagctcaagcagtcctcctgcttcaacctcctgagtagctgggaatacacctggctaatttttaaaattccttgtagggaggggccttgctatgtttcccaggctggtctcaaactcctgggctcaagcaatctgcctgtcttggcctcccaaaatgctgggactacaggtatgagccacagcgctcagccaacatagggaaatctcagaggagataatactataggtatggcctggtatacaataaatgcatgatacatgtaatctcccttccctgtttaatcgtgtcaagtttggccagccctgtaagcactctgaaaacctcagttttatcacataggatatgaggatcacaacccttgtctgcctcatttaatggagctggtgggaaacccagtgagataacataagggacaaggtttgagaaaatataaagtactttatggatgagagaaaccatggcatccaggaaaagcaggatgtcaccttccccaagagatgctttaaaattgagaagtatagaacactaaaaagaacagtgggtttagacacaggctttgggtccaagtcatagctctgccatttctgtgaaattttagacacctcactcaacttcagtttcctgcctacaaaacagggatgatgacagctgtgatggaagatgctaatactttgcattcaaatgtccaccaagtcccaggtggttctgcggacttgtccaactcaagaagttttccctcctgcccccaacagcatcatgctaaggcaatgtctgaggaaccactccagctccggagagaaactctacttctttccattcagaatcccattctgatactcacatcgggggcttctaaaatcctaacatagaagaccttggcattggccttcctcagctttcaactggactgacagagcccagccttctgccactccacatgtgcagtccacacagagtctcattctaaatcacagttgacctctagcttctacccgccatccatcatgactcagaatcaggatgagggagagtatttgggatgaggcaaaaccaccacaaaaagcgtgttcaaaaaaaatctctttccagcaacttgtattcatgggaggttgtgtgtaaggctgggcctcaaagagggtctgagtagaggggtggatttgctgtcctcaagggacttcctaattctaggtcgtctggctccattaacaagcaaaaacattaagttgtcaggacttgaaccactgatcagaaggtgaggtcagagcttattgatgagccatggagcattagctctgtaattacctaccagtcaacagctgacttgtcaaaaccacactgaatgtaattactttccactttgctagactggagaatgaatgaggaagacggcctaagtcatccttccagttttgaggcaacattttgaaaatctaataagaaagcactccttggcagtcatatggcattctaaaaatgtcctggaaaatgtgcccagagaaacattatttctctggctctgcaggcattcagaatctggctgcctaggccactgcgtatacagtcccagagacccaggcttcacatcccagaaggaattgggaagagatgagggattttcctttccatgcccaagggctatcactatgactacagttaaagactcatgggtgtgtctattctgtgctgagcatcacaaagtgctctcagtcttcactgaagtcaaacggattggctccttctcttaagccaagtctgtgaagccctggacagtggtgaagagaaagcttgccaaagaggtctatgttagtgaatagtccaaagaagaagggagagaaggggaaagcaaagcagaagcagagagaatccaaacattctctgtcttcagcccccgccagagcactaacgtagtcataggctgagttctgaccccagactcagctgacaccagggctaacctttgactgggctattcaactaagctttgcctcaattgtggtttggaatgtgactggtagtatgaggatcaattagagttcagggaagaaccctgcttatttggccgtccacttggaagcccggaagaaggagtcagcaggtaccttaattcaagtgccacttatgcctaacattgtgaaaaggcaacatgcatctaacagtttaaagagggtggcctaaaaggcatcagacaccagggttaatccaaaaataaaaacttttttttttctttatagaatgccaatcagaaaacaaactttgagatccttatccattaaaaataaggaaaagagagaatccaaggaaaactactttggtgctagactataggaaatctaactagggcagaatcaatctagacttcctacaaaatgttctgtataaagcaccttgctgtggtggaaagaaacaggtaatcagagggcccagttcaattcctgccttcacttctcaggcctgagaaaacactgtgcaggaggagctctgaaggcaaatgactcctgaggcagggcaggtgagtaaaggactggagcagacactctggagatataggctgaggcagagacatggtgcatggtgcacacggcctgtctggaggggccagccctcctcagcaactgccaggaactgtctggtaggaatgaggccccaagttccacgatcctttcatagaatttttcaaatttgaatcagtcaaatgagaccttgacttctatataaaatctctaatttctaagtattggaaactaactttttaaattaaaaaataatgtccatggggctaatacatttttattgtaagccatggagccttaaacatcttacagagatgttttactatctcattgtgtcagtataattcattctttaggtctcacttgtcccttcttaggaattagacgagaagacttctcttcagccttctgcctgtgccattccaggagtcatgacccccccatagccatcatctcaggaagccttgtcagaacaagatgccttgggctccatgtgggcaggcgggttaatcttccacccctccatatcaccaggagtggaaaactgacagtacttactcctagctgtgcagcctttgaaaaattagagtctattgctgcatctttgaaaaaagacatagaaatgctaccttgaaggactcttatgagcattacaaggagatggcatatgaagaactagcccacggcctggcatatgggaaactcttagtaaatggtgtctcctttcttcacctaggaagtaggggtgcaagcaggaaaatgaaaactgaattaccaaaataattaaataaaatctacctcccatgaagtcagagccagtatctcttgatcaccagccttaagctctggatcatgatggcaatagtcacaactaaaattgttgtggagcagcatcttagaatctactaagctctgtcatgcatcatttgcctttcacaaaagccctctgagttaggcttgttgttgcccccattttagagatgagaaaactgaggctcagtatggtcaattgacttttatgtaactgtttcattgaatcccctccaaatccctatgagatagccattgtcatccccattttacagatgacaaaactgagcatcagaaaggggaagtcactcagcttgttaataacacagccaggatctactggtccttcatatcttagcttagttattaccgcctccaggaagacttacccacagtctccttgccctcaccttggttaggtgccctgcctctgaatccccacagtccacgcatggcttacttcctctgctgaagcaagttcacatcaaattgttaatgaactctttacctccctctctagatggatgctctttgcactttgtcttgctcaagtttgtttagagcagtgcctggcacatagcagcaggtaaggaaaatgtgctgaataaatgcctaagattaggactcccacctctggcttacccattatatcgttcagcacacagcgcaatgctttgaacatagaaagtgttcaatgagaatgtgttgaacgagtagaaagataacagaaaggaagacaggaggaagaaaagaagaaacaagagaaaaaagggactaaggaatacaagaaggacaggcaggtctagctctttctacccagccagggcccccaaggagctgtgacacacggtggggactttcggccatgcacagtttggtggacatggcctctagaagtcctgagatctgccatggatcagttgcttgatcttggtgaagtcacgtcctcgctctaagcctcagtgtcctcatctagccacacagtgtaggattcaactcagcaacctctgagggcctagtcagtgcccagactctgccccaaggccatcctgagtgactctggagatacttccacaaggattgggggtcgccctttgcctgtctgcattgacaggcccctgggtgtgtgtatatgtgttagggctcacaccaggcttagctgtctggtcagtaccaggtaatacttgcaggcaggaacagtgaaactcatagggaggggggaccaacacagaggggcagggggtggggcagcggggcagtcaggtaaaggacagacaggcagggagacactcatgaagtcagagacagacaaacagcggcagatgaagcacaagaagagaaccagaccaatgtggagaaggtgagagacagcgccgcaggcacacagagagcaagggaaagagaagaggagggggcaaagagaaagggctgggaggcaaggccaggggagctgccaaccactggcatcaattaaaaagttaaatgggtatccagagactgtgaggcttgggacagagcagggctgcttaatggagaggagaggcggtggagaaaaggccccggtgggccgcgggtgggcgggtgctcttgctagcaggtgatgagtctgtgctgcggcacccccacaggctgacgcagggaggccctgtgctcacactttccttcacctctcagagaaatcgtggaggcagggagcgaggggagaggccatccatgcaaatgaaatgttctggtctggtgatctcagatggggctgaccaggctattgtggaaaaactccacagaccaggctggaaacccagatctgctgaccagcagctgtatgaccttgaggctacttcctgacctctctgagcctcactgtcctcctgtgaaataggggcattcgtgtgatctgctgcctcagtgctcacagagtttccagtgattacacagggtggtctgtggcaggccctggaccagcaccctcggctggcactcctgccttcaggtcctgctcctgcagacctatccgcaggtctggcaggcttccctgaagtttctgctcaagcatcagcttgcagagagccgtccctggccacccttgacagaacagctgctcctcctccagctacttcctttgttgtcttttctccatagcactcattaccccctgatgtgtatatatttattttcttttccttcactagaatataggctttagaaagatgtaactgtcattttatttactgctgtatcccccaaacctagaacagtaggtattaaatatttgtggaaggaagcaaggaagaaggaagggagggatgaagggagagaaggagggaggaagagaaggaaggaggcaggaaggagacatttatgccactgcattcacagggtccctcagtggatcgtgagaaactaaacatgttggaaaagatgatggagttgaggacctctcactccactcagtctgggctggtcctcctagtgggtgggacctagagctctctctattctcagccctccctaagcttccagggcgctcctccttcctgcttcctcatctccatgcctccacccttggtgcaccacctgggatccagaatgtatccaactgcttcagaatcctgaagatgtcttgcctgtctttaaggcttaactcttgttccatttcatgcacccatttattcaacaaagacattgctgagtgtttgttgctgagaaatgatactatgatgttatgcagtccttggcctctagggacccagactcccccagtattagaagacaagcctcgttccctttgcttacactgcaggaaaggtctgaacattgctgagccactgctagcatcttcacagaagatgacacaaagagcattcctgagattaaggaaggcctcccagctttggaccaaaagcaagcaaggtcttgtgggtggaaaatggtttggtcagagaaactccacagatccaggaagagcattgcaaagctctttttttttttttgaatttagaaattctaaaaaggagacacaagagggaaggggagcctgtggccatctgtgggaagaagtgggggtgtcagttgcagggagcaggatcaggatgaaagtttctacttttgagcctcaggcccagcttggcatctatcaggcagtggacatctagaacccactagtatctaggacatttaggcaggatccccattcagaaagaagatccattgtggtgaaaccccgtctctactaaaaatacaaaacttagctgggctgtggtggtgcacgtgtgcctgcaatcccagccactcaggaggctgaggcaggagaactgcttaaacccaagagatggaggttgtgccactgaactcagcctgggtgacagagcgagacccggtctcaaaaaaaaaaaaaaaaaaaagaaaagaaaagaaaagaaacaagatccactccctgtcatggagtccttatactcagaaagcccagcaacatgtattaacaggaaaaggactgggcccagacagctgcaacacaagccagacagtgaggaggctgcattatggatgacggtcacctacctacctacctacctacctacctaccttccttccttccttccttcctttcttctttccttccctccctccctccctccctccttccttccttctttcctcccttcctccttctgtccttcttcccttcctcctttgtttccttcctttctttattttaacaagtattgcccaggcactagggctggggtaatcttcaatgaagagggtagccatcactcacagcagctgggaaatgggtatatctgcccattaaagggaacttatcacaccatgttagaaagttttttcattatcccgaaagtactgtgtgtgttgggatgagatggcctgtgacttgaggggtgaagaggctagtcagattttaaaaaataaaatttagccaggtgtggtggcatgtacctgtagtcccagctacttgaaaggctgaggtgggagaatcacttgaacgcaggaggcagaggttgcagtaagccgagattgtgtcactgcactccagcctgggcgacagagtgagagaccctgtctgaaaagaaaaagcaaaatcactcctgttgtggaggagaggtgacacctggtctggaagcctctgagccaaccctccttcctgagtggttgcatgggctgcactgttataactcgttatggtttttgggggtctccccaccacaccatcagcacctcgaggtcaagagggcagcaagtctgttcctgcgccatggagcccatcacatggcccaggcctggttctcagagtgtttgctaaatgagtgattgtatgctagttgaataaatggagaaagtcagggcccatccaggccccagccttgaagacttgcattagtttcactggactggagggtcatgagcaccaagtgtgtactgagctggaagaccaagtttgagtcatcagttcctttgattcccagaacaccctttgatttggaggatggggtggggggcgcagagactctcagttttatcatgtaatagatgcaaaaataaggaggcaactttcccaaggttttacattaaaccaggggaaagattaggattcattaatcctaatctgccatcagatgtcagagaaagaaggaccactggagaacaagtgttcaagcccctccttttccagatgagaaaacagattgctagagaggggctgagtcccactaagggtcacactgacattagtggcaagtcacatataagatgttttcacatataagatgtattaacaggaaaaggaccttttctacttacgtcctatttttccatacaaaataggacgtaagtagaaaagcctcatttgaacataatcaatgttggaaatctatcctagtcaggtaggagagtaagcaaagggcttaaagccagacttggaccacccagcagaagaaatacacatgtcacaaaatgtactaagtgtggcatctcacattttctaatagccctcttaaaaaagtaaaaagaaacaagtgaagttaactttaatatattttattttaggccgggcatggctcacgcctgtaatcccagcactttgggaagccgagacgggtggatcacctgaggtcatgagttcaagaccagcctggccaatatggtgaaaccccgtctctactaaaaatacaaaaattagccaggtgtggtggtgcatgcctgtaatctcagctactccagaggctgaggcagaagaatcactttaacctggaggttgcagtgaactgagatggcgtccctgcattccagcctgggcgacagagtgagactccctctcaaaaaaaaaaaaaaaaaacacatatatgtgtgtatatatatatattacatatatagaaaattttaccaaatgtatctaaaatattttaatatataatctatattaaaatttttattagtgagatagttatatttttttataagcctgaaattcagttgtatatttcacacatacagcacatctcaattggaagaaccacattttaagtgcacacacggctagtggctgtgtattggacagcataggattagagtaatcagggaagactttcaggagaaaggagtcctggaggaaggaagagtattcagaaaggcagaaaggaggcagaaaccacgacagatggatgtaatgtcatgagcgttaagaatgagaatgttcgctcagggaggtactgggctgtctggagttgagtcatgtgggtgagaaattggggttggagacctctgagtatctcctcccttgttctacacagttcattccaactgccatgatcatttgcataactctatggggtaaaaagcacccttacactcaccatgcatttatatcttcacaccagccctctaaaatagacccagagcagaagacagctgcccagcctcacatagctgttagtgctggaacccagcctccctcctctcccctgctcctctcagaataccagctctgcctagaagccaagggccagaggaatctctcatctgagccccacaaaagcccgtgccttccacctctgtgcctttgctttgccttttactggacctaccttctctcaccctccttgtggcctgatcctcccgactctgcccaacttgggtctttcttcctttgggaaactcattccaacccttgtcatatcagaatccacaccatttttttctcttccatgcaattctactaggaagaatctgaagttttattgtaaaacaagtttctaaagatttttctaatcaggttgttacctccctcccattcaaagtctaagagggaggaaggagagaggaagtagagatacagggggaagggtgtgagagaccctttaccaagtccctgatgtgacagcacagaagcaactaatggcatagagtggtattttcaaaaagaatgaagcaaaatctagccaggagtccagttaattacgagctctaaagaggcactgacagcttccagaaccagtactgggggcggcacgctggggagctttggaagtctgccatgccagcctcccacttggacctgcaggtaatgctggggagttggaaaggctgtgcgcgcctgtctgtcgagtcacccacacagagagcaatgcaggaggcggaaagaagtctgggagaggagcgtgggctggccacccccaacggaaccataaggggagtaaacagtctgtttgcaaacacaactaggacccctcttcccatcaaggcagagctggatccaaatcctgattctatccatgtgaggactgtgatattcagcaggtcagggcttcagcttcagtcagcttgtctatacaggtgatccaggggtgatccaggaagtcaaaagagcttgtgtttgttgtagagcttgacacattgcaggtatcagttgtaggctagtgaccacctctttggctttctctctccctccatcctctcactctctcctcttcttacacagggaaatggattaggagggaattataatgctctctgtaagaagcccgcaataccaccaatagcagctgatacatattgagtgtttactctctgccaggcactgttgtagtttcttacctggattacttcatataatcttctgaataaccctatccaggaagagtaagaactcttattaactggcccatggtcactgagttggtaaaagaaagatgcaggattcaatcctaggtcacctggctttgcagctcccactgttgatgtagcccaccagagatacctactcatttctttgtatattcaaagctcttggttgctttcttaaagcgctgatactaatccttatctgtttgtccttgcttaatctcctcagcaagtccccggaccctgggcagggctgggtgtagattgagtgcccagtgagcattggctgggaaagggagtgtatctgaagactatttgcacaggaaagatatttagtccgatctcaccatcaacatgacagagaggaagccaggctaaaccagaggttacatttcttgtcccagttgcttaacacggtggtggatgaacagagaattgctcccagagtccttgacccatggctgacctgctttccctgtcacagagcccgtttggccaggtggtctccgcgctgacctgtcggctgactccacaaaaggaaatttcacggtggcgtgtgtgcatgtagacaggtcaaggcgtgctttcgtgcaaggcagcctggaatcagcaggaagctctcctgaactcatccctgtgccttgccagatgggcactctgctgggcaggtcactgcacccacactgttcaacttcttcacaagaccgctggccaaaaggaaggatccaagaacaagcctggtgacatccatttctcggtcacttcacagaacagccgtggaccccaaaacataaaacccctttctaagtctgcaggaaacctggaagggcactgacagccttccgtgactgcaggctctgccctgatggaaagtgggaggcagcctggtgaagtgagccctcctgccgggtactgggcagggctccagggggccacggaattgcgaggatctggatctggcttctgagtctgacttaccctgacctgcatgggctatactcaaccaaccccagtctctggacccacaagcccttcttacgttccgcctttgtacctgctctgtcccctgacctgattttttccctattcaaaaaaaaaaaaaaaaaaaaagcggcagagcctgtggtttggggtgtggcagctctcactggcactgctctcctggactcttgatatactaacacatgtacaggcagttgtcctcctagtcctggtgcacaaacgagcgtacctcaccccttaggaatcctacagcagcagagaaacggtggtgggtaggaaaggatgggtgaggattgagagagaggatatgaatatctgtatctgactatcactggagatgcagaactactgacaatgttttaaaaaaagcatcatggatttagatgccaagttcactacttgctaggtgtgtgtgtaatttaacttctttagctatgtgtgcaaattaacttctttaaagtattgccgttcttgatcacaaaatggggataatcatcctatcttcctcataagactggaagaaataagatgagatgctgtatgcaatcctggtactttgcacagtgcccaccacaaagtcagcccatggtgactgggggctctagtttcctgcaatggtcctttcatgtttctgagactaacagttttcctctaggagcaaggagaattgcttcctctttccctaatatcatgcttaggcattcattcatccatttatcctaccaatatccatcagcttccactctgtgccaggccctgggccaggcattaggggtccagaggatgataagacaccatctagcaagaccccttgaaactttcctgactctcctcttctgactcagctgcccgacccccaataaccccctctagcaaatgaaagtcattttttgaattcccacagcagcctcttgcacacacctctgtacagccctcatcccaccattttataatcaccaatgtgcctttctgtctcttgaccacattaatttaaataaatctcacttggttattctaacctctctccagttacactcctccccaccctactggctcttttctgttcaaggattacactatggaagattcaagagcacgagattctgtttttctcagagtccatgactgtgtcactcagagaatataggactctgtgacggggctttaccaagattctaaacttcaggttcctgactgggagaaagtcccctgctggaaggtgtctgcttcaattcccctgcatttgcagagacacacagagccctgagagccttccagttcctagttccccagctggtgaaagatgcccacatcagactaatcaccttctaaacaaatggcacagtgacaagcagggttgggggagagctggggccgcacaagctgatgttttcaatttagaggccatgcattatttacactgccattattcccctcaatttgacttcacgctttagccctaatttcagtataatcaaagccaatgaatatttaatcaggattgcttccagaaattgagtaatgccattaacacaatggcctcaggacttcaaagctgctttccttcaaatgcatctgacttacacctttccccaccccctcccctttaaccagttctatttcggaatggaagggagtttgggacagcggaccggcccgttacagctttgcacagatgtcagaaaggtggctggtacaggggagcagtgctggaatgggagtttgaacactggcctcagtgagagggactcagaggaggacagctaaattctgtgggtggacccattttaaggcacccccatttatgaaaataccaaactttaagccacatccccaaggtgctgcaaagacagacttttagtttctaagcacagccaggtttggtaagtactagcctagaccaccaccaacccctaaacctcctacacccccatccccactcttcaccaagagtggactccacttgacccactggcctgcatggccagggagttcagcgccacctggattcatctttaaacatctctggttgaagggccttctcattaggagcagaagcccgccttctaatgctacaggctgtctgcgctggccctgaccctgtcctggccccacagagccagggtgcttcttctgtcccaggacagctgggaaaggaggtattcgaaatattagagatattttatctctctctgtgtcctctccctcaattagccagctgccaggtgcccagctagggtctgtgggggatgcacacacatctgaacctgcctccacttacccccaagaggccacgtgagcaatcaggtgatcgcacagatttttccaaagcactattacacttgtcactcacgttgagcttggaaggatccacatcatcgagctggtgaccttcccaaggtcactcagccaggtggctctaggacctggaaggatctatgggtgttagatgttaaaactaggagctttcttaggacctttaggtcaaccttaccatacaaaaagggaaatgaggcccaaggtcatacctggacagtgggaggatagggcttcaaatacagttattggggccttagattccttgcctgatgtcttttcctttataaaaccacccccaccactactaccaccacctgtggtcaccaatgcaggaagaaatacccaactgcttgctcacttgaaaagcgggacacaggactgaggagatgcaaatatttccaggaggggcttcactcagcatctgttgggagatcaggcatcaccggagtgagaaagtgagagagttgaggagtttatagaaattacagcaatgtggcctacagagatagcttggtctgtagtgaaaatgagaggtagttgtgcttcaaacacgcagaatcaagggtagcccttgaaatatcttagccacctcccggtgtccctgacttccttctccgtggcccctcctccctgaggaagcccttgctgacaccctttgcactggtgggtgtccctcacctcactcccacagcttgtgtgctcaccttctccccctctattgcctactgcatgcacccaggcctccctccctagactgcagactctttgagggcaggggtgaggctgacatgtttctatatctgggtaatattctgtagctgtcaccaactcagcccctgccagtagaggattcagctgctcttcaccaagcaagacagaaggttgtctaagctttactattctgaagggccagggagcttaccacggcccgggttcatctttggacatcaccaaagcaccacctggttcattaggagaggaaggaatgaaaatgccccgtgctgccacctgctggtgacttccagcatggcgccctgagaatccactttgttctttctacagaaaggctagggaaaggaagggatgtttatggagcccctgccaggtgccagtgctctactctctaggtctcacttaatctagataacaattctgaagggcaggcattatctttcccattttacagataggtaaagtgaggctgagagaagtgtggtaatacaatggtaagtaggaagcaaagatgagacttgggtccccatctactgacttctggtccagtgatttttccagtgcttcaaaaactaatccagatgaatggatctatagctgagagatttcagtactgaccagaaagatagaaatagcattacgggtttctagcaacttccttggtatccctgaaatcacactatgtaaccattcacctactccattaattctggcccttgagacatacccagaataaagatacagaaagaatggtgacagaaacctctctagatctggagcctgaaatcacttaaagaagtttgggcaaatgtcctgacacctgggttgatgcaagaggctaacttcctggtggtttatggaaaaggtggctgaatatttgagaaaaaaacgttatatgcagcttctgagcctcagccacccagcctgactctggtcacaactggatccctcagccggattccagaccaaaccccaaggccagttaccaaatgactactgtcacggaatgactcctaaggctgggccatggctggactgagcctggaatagcccaggctctggactgtgttctccctccactgtacccaggccatggtgaccctccactctgggaaatctgcctccatacacacagctaagccttggtttgggggtgacctcagctaggccatgggcactgaggatggttaccaggcttggggccagtccaagaaaagatcagtgggatgcagggtgcagggaagcatagagaagcagcaaagaggctggagtggacagggaaaggtggtgataaaccagagcatgggcctggcagggagatgagaagaggaaggtcactacggtacagtgggagagaagcccaatagctcagagccttcaaagacctccttacccaacaccaacattttgactcaaagaaaaaggaaactgccaaggccacctgagatgttggtggccgagaccagatcagaaccaagtgccttttgtcctcatcctgagctcctccactgctcacatggggagctggatcactgtgatgtttctgtcctttagtcctgcccagctcacagcagccctgtgtacttgtgggccacagattcttatctccatttgatgaattgggagaccaaggctcatacaggagacaaaccttgcccaagaagagggcatgaaactgagcagtgtctcctggcctcaagtcccacctactatgtgcccagcattgggacaggtacgttacatgtacaccatcatttcattttcacaacaccctggcgaggtaatgctgttgtcctattttatagatgagaatgctaaggcccagagaagttaaataactggtcacagagcaaaaaaataggaaggagagcagtgtttaaacctaggtccagctgatcccaaactgctagctgcccttagaagctggaatcacctccccacatctttaaaacaatttaactctcattggtgctagtaggttggggatcctctgtggaccatatatttctctagctgcatctctacatccaaagattttcctggtctctcatgcctgcctctaggaggaggacatccataattctggtcctacagccagacattgtcccagcatgtggggctcagctttcatttctatcctgtctcagggggagctctgcataggacccaggctttggagtcaggcagcaagggtttgcctactggctaggttgcttaatgctctgtggtcttaggcatgatacagacccttttagcccctgagttttgttctctgtaaaatagggacaataatgcctactttgtggcgatgctgtaagaatataaaattcttggcacatagtaggcactcaattaattatcgtttgaatattatcatttttacatttatgtctgtgtctttctctgtacaagatactgtttgctgtcatgcccatattccatcagcccacctcatgcaacctgatgttcaactaccagcatctgtacctgatgcctctctctggccattggaatccactctgtccatatacatggcaagacaaaggtgccaaagaatttacaccttcttccccaatccaacagctctcaatcaatgactgatgagaatttgtgaataaattaccctggctctcttaccttttgttggggataattgcaaggcatattctacactgtctcccagagtgagcagcattgaacctcagttgtccacaaagggtgaagttttcagtaacttacccttgattggcttccttcccgtttctatcttatttcccatttcctcctggtttttctcattttccaaaaaaattacttgcattcagggtcttgtctcagggtctgctctgggataacccaaaccatgcactctcatgatactatttttattttatatacatacatacatatacatatataaatatacattatatatatatatttagagacagagtctcactacgttgctcaggctggtctcaaactcaaactccttggatcaagcaattcacctgccttggcctcccaaagtgctgggatcataggcatgagccactgcacccggatgttaatgacactattaactcctctgtgcccctttcccttccccttgcctccacctagaaggtgcccagcagataatttcacacacaatagagtctatcaaatgcctgcacattgctcataggttccctccattttggctcccaggaatccagctatttggggcaatgtctgtagggcagttcctgaagctggagcaagttatccagcacatccaggctccctctgacagtatcctgtccatgatgctccttgtgctcttcttccaggatggttagcaaggagagggctgcacagcacaattgaaatgcacagcatttgcatggagcatggggctttgttctgacagcaaacaagggaagtctgccatatgtggaggctcagctatcaagggcttcacttaagaggaaattagcctcaacattcagaggagggaaatgtaaaatgatgtccccttctgagaaaggcagtgtgtggacctgacaggtaggagggcatgtgtggtctcaactggctgccacactatctgcatgtccctctgctgtgttccaagattatttcagcatcccaagtgcagggccatctcttatctacccacaaaagagccaagaaggaaaggaagggagctaagaagttttgatcacccaccatgtgccacagacctcatatacactacctcatctaatccccagaaaagtcagcaagtctgtaattattatcccatttatacaaggcaggaaactgagtctcagggaggtgatgaatactgtccatggcaggtcttgcagtaaatggaggagtcaggcttcaaagccaggtttgtctgactccactatctttgttctttcccttctcctcccaccccaacgagaacacagtgccagtgaaagggcttgtagcatcagagataagctgagatcaaaactcttggctgaagtgcagcgtgaacattctgggggatttttctgtttgcactaatgcccaagcccaggagtggtgggaaagagcctttggtccatctccccatgaccctctggccacacctgcatctttgctcaagctgcctcctgcttgggatgctcctcctcagtccctcccctttaagagccagccttagtcttccaggaagccttctcctgccccttcagacctctcttgcttctcttttcatccacacattcagacctgggaagaggcagctgatccaggagaacacccaccctgtggggtggggacactgcttcctggtcctatctgtgactctgtgtgaccataggcaggtgtctgcctcattttggttctcagtttcttcatctataaactgggaagaataatacatgttctacctaataccagattggcttttttttctttttcttttcctttttttttcttttcttttttagagatagatctcattgtatttcccaggctggagtgcagtggctgttcacaggtgccatcatggcgcactgcagcctcagcctctgagtaactggagctacaggcacacacagccacatccaacccaggttgtttttagcatcaagttagataatagacattaaaatgctttaaaattgttaatgtataatacactggatgatgattaacagcactgggtgatgattaataacttgattcatactgagggtgtgttttgtgcattcaccaaatagtttttgagcacccaccggatgccagttcctttgttgggttttattgttgaataaaacaataaaaatccataattctgaactctcagtctactagaggaaatagacataaatgaatgaatgaatgagttaatgaacgaatgaagcacataaaattacccttcattgaatgttatactattggtatagtagctgactagtaatatttaacatggcatctcccatctttccattaaaaatttcatgaagacataaaataacacaaaatgacaatagtcatatgaattgtctaatttgggggtgggtaatttcagcactccacctctgactattcacccccatgccaaactgtgtgaaaacactttacttcctgcatgtcctgtccctaaaccttggatgcattgagcaggaaagcaggagtccaccggtttagacgacccgccttctgctttctgagccagccagagcctgagtcctgcactgccctccctctccctggccctatgttcccctcttcttcttctttgtttttttttgttttgttttgttttttgttttttgagtcagtcttgctctgttgcccaggctggagtgcaatgacacgatctctgctcactgcaacctccacctcccaggctcaagcaattctcctgcctcagcctcccaagtagctgggattacaggtgcccacaactacgcctagctaatttttatatttttagtaaagacaaggttccaccatgttggccatgctggtctcgaactcctgacctcaaatgaaccaaccgccttggcctcccaagcaaaaacctgggattacaggcatgagccaccgtgcctggcctcttcttttttaacattcactcagaaatggcaactctaagcatgcagcacaacaggaagtaggggataggctggcatccaggaacacctggacacttaaagaaaagcctggtaaacagggatgaaatagaaagtgcattggaggtagtgcatgctgcagggaaggagggtcttttaggtactattctgggcaaggaggaagtacaaattgcatttgattccgtagtcagaaaatctagaagttgaccctggagtaaaaccaacttcaggcaggcaaaatcagcccacaaacagaactggggcagggcaccttgacttgaatttcaggtctaaatctggagatgcacatcccacagtgaggggttaacagtgctttacttttaagcttcctttttgcaaatgccaggtctgcagagactctgctctattcaaagatgattaagcaaaacaaaataaaacctccaagaaacaaaaaatgggcctttaaagagatacactacagcaaaaaggaaacattgccctaaaaacttagagaaagagaaagttgaaagaaaatcgagaatgcttcagagaccatctgcttggtgttcttcaagagatgcaagaagacttggcttctaagaagagaaggaaggaggataagataaaggcagagatgcaaaggaagctgaaagtaagacaatacggcaagtcgggacaaaataaaataccacattaaaattcccatggcagtgagaaaaaacagaattgacactgcagaaaactgaaacagtgatgaggacaaatttgagcaattctcaacgaatgcagaaaaagaggtcatagatgaagataagaaaggagatgatagatacaaaagaaaagaataagtctagattcgaattatcaatattcctggtagggatggggtataaaataaaaaagaaaagtgacaaatacataatagggaaaaaggactttcagatacaaagcaagtatctacttgagtcaaaagccgaaaagagatcagtgttccaggcaatgttaataataataaccaaaaagacatagttagctagatcttggcaaaataaacctcaagggttatgtgaacacacaggtaggaaaacaggtgggcaattaagaaacaaaaacccatctctgaattttccttagcactagaatcagaaaaaaagagttatcaagcattgaaggggatatcaagaaaaataaaaacatataaaattctatgttgtataaagagaagtaaaaaattattgctttgttgttaactgataattagagaaatatagatacacacccatgcattgctaaaggatggggatatgttctgggaaatgcctcattaggcaattgcatggttgtacgaacagcacagagtgtacttacacaaacctagatggtatacactactatatacctaagctgtatggtgtacctatggctcctaggctatgaacctgtacagcatggtactgtactgagtactacgggaaattgtaactcaatggaaagtatttatgtatctaagcatatctacacttgatcttgccaaaaggccaaaaagtgatctatctagacatgtttaaacagaaaaggtacggtaaaatatagtataaagatttaaaattgtatacctctatagggcacttacagtataaaacagagcttgaagaactggcggtggtgagcgaatgtgaaggccttgaacattactgtgcacgagtgtagactttagaaacactgttcacttaggctacaatcaatttgttaaaaatatttttctttttcaataataaattaacctcagtttactatgacttttttactttataaacttttaatttttttaactttttgactcttaataacacttagcttaaaatacaaacacattgtactcctgtacaaaaatactttctttatatccttattctataagcttttttccatgtttaaaattgttaagttttttttactctttaaacatttttgttaaaaactaagacaggaacacacacattagcctaggcccacgcaaggtcaggatcaacaatatcactgtcctctacctccacatcttgtgacacgggaaggtcttcaggggcaataacaggcatggagctgtcatttcctatgataacaatgccttctggaatacctcctgaaggacctgcctgagggtgtttttatagttaacttctttgtataagaaggagtatcctccaaaataataattaaaagtatagtgtaggaagtacataagccaatcccacagtcattcattatcattatcaactatgacgtcctgcgcatgattgtatgtgctgtacttttatatgaccggcagcacagtagctctatttacaccagcatcactgcaatcatgtgagtaatgctttctactacaatatagcaatgtctgcgctgtcactaggcgatgggaatttttcagctccattataatcttatgggaccactgttgtacacacagtccatctttgaccaaaacatcattatgtggcacacgactataactgtatgtcacacattttaaagcatgcattagggaatgaatttacaaagagtactttaaacttctatattaattttaaaaataaaaaacagtttattaaaaaaatagagaaaacattaagagcaaaaaatgtataaaaaagagaaagtatacaattgggtgacaaagtcaaacagcagatatgaaatgatggtaaacagtctgaattattctattaggggacaaaaattcccaagctaaaatgaaaacattaaattatgtgcaacttacaagagataaatctcataaaaattgttaacatttattgcatacttgccatgtgtattgcattgtactaagcatttcacatacattgtctcatctaattctcccaataaacatatgaggcagaaatatcattacccttgggtctcaggtttggcaactgcagcatagggggctaagtaacttgcccaggtcaaacagctaacttatagtagaaatgagatttaaatccagtctgatctcagagcacaacttcttaaacattaccttcttctgcatctcaggcaaaattacacagtaatgttaaaaattaaacttccaaaatgttttaggcacacccaattaaatagaaagcagaggtgacaatgttaatcacaaagcagaatttgaggcaaaattatttaacaaggaagagattgatggtgttaagttgataaaaagcaaaatttatattgaagattgaacagtgatgaacctattgcacccaacaaaacattccaatttaaagcaataaatattagaaattcagggagaaagcaacagaaattgtagcaggaggttacatggcatacatagagaacaataaaaagtgaatttggttgtttccagtttcagacattcctacttaggcaattaaaaagtatatttaaaaagcaaaaaaagagcaacacaaaactgatgatgtgcttaactccagggtaaacaaagtgatagggcattgagaaatatgttggtaatgttctaattctggggttgggtagtgagtttgcaagtgttcattatatgattatgctttataacttatggacctatattattttatatgtattagatattttaaaagatgaagaaaaatgccaaaaggaaacttaagtaaggaaaaagatttgaaaaataataaagtttacttaatgacatgtaacaatttctactctacaaacataaatgaatttggtaaattccaaatgataaaaagatatacaattttcattctcaaaatataactgctaaaaccagaaataaggaacagtgtttcaacaacaggaatagctgcagctaactgccacatggaaattgaaatcacttttctaaaaaatattatgtcaaagaataaaaaaatacaactacaaaatatttagaaaataatgaaaataagaaaacaatttatcaaactaatggaaagctgcaagtacataatttgaaaaagaaccaaaaagaaacctgtggaaagcagtaggaaagaagtagtaaaaatgtaaataaaaaaagttagaaaacagaaaaatagtaaatttgacgacaaaatccaagagctaactccataaatttttgttaaataaatgaatgcatcaatgactaaatgatgagtgcattaataaatgaagtgactatctggggttcccacatctgaatccagagctgttacctggatatggtatccaagctgtctatgctctgagggtcagcctctgacatccggaatagtcacttaaagagaaaactttgagccatctggtcatgttcctgaggtcgttcttgagtgaagcaccccagctaggaaatcagtcatctcccaggctctccttcctgtcctgaacttgcctaaagagttaacttggctgggagtggtggcccatgcctgtaatcccagcactttgggaggctgaggcagatggatggcttgagtccgggagttcgagaccagcctgggtaacatggtgaaaccccatctttactaaaaatacaaaaattagctgggcatgatggagagtgcctctagtcccagatacttgggaggctgaggtgggagggtcgcttgagcccaggaggcggaggttgcagtgagctaagatcatgccactgcactccagcctgggtgacagagtgagaccctatatccaaaacaacaacaacaacaacaacaaaaacagaaaagaaaaagacttaagtcttggcctagtaagaagaaattaaccagcactgggcaattgtgggaaatggcagctcagagccccactcagagccataacagcattgccaagggatgagaagagagagcttccattgacactctgccatgtgcttgggctaatcaacacatgccttgggcatcattttccagaaagaatttctgggctgctcttgggcatcccagtgctctgtcaaaatagcctcttgaattataaaaccaccagtgacaaagactaatcttcagaaaaactcccagaggctcagtgtgctttgtggtgaagtctatcattacataagcccaagctccatgggctgggaattgggtgtttctctacagcggctgatgggaactgccaatgtgaggtctcaggtcatgaagtccacaccagactctggcagtgacacacttcagctggtgtttaagtaagggccatgccaagctgtctatcaggttctcacatgcctgaccggggtgatttctgttgtctcatttgagtttggggccacatttttggcccctataaatattttactttgtgactctgagagtgatgctctctgaatggaaaggggcaggggaggaaaagaacattgggtgggcactttccatgtcttaagtgtttcctacacattcactcatttaaccccgtgatgtgggcagtattgttgccatttttcagatgtggaaactgaggcttagagagaggtgaaaggattttccaaggtaacatgggattttccagggtcttggataaaaatcacacatttgtgttctttcacaaccgaatccagagtgagggttacctttggtgggaaaactgcctggatcttccagcccacacccaggctcaaagagttgccctctgctcagcctgctacctcaggtgcctctctgtgcatgggccagataacacccagggcaggtgatgtgagcaatgaaggagagctggggctggaagggttgtgtcagggactgcagggaccctgaagagggattgaccattgtgaatgagaggagccgttggggcttgatgaaccacaatgattctgagacaaggcagggatgtgggagggcatctcaggcagagggcagcatattcaagggcccagaggcacagtgagaaggacagtgggatgacagggagagccatggttgggtgggtttctaggaagggccctagagaagatccctgctctaaaacacttcattctgccagcaatggcacctactgaaatcttctaggcagggaggtcatgcttacagccttgttttcaagggattatctgggctaccaagtgtgggacagaatggaagggctgagcctaaagctcattcccttctttcaggaagaaaagcctccaaaatacgatagcctctgagaggtaacctgccaccactagtgacacagaaaataagtctctctggtgccagtgacttttccccactggccacctccctctgcctcccttggcctccctgtctgggacccaatcaggggatggctgctccagcctttcctgcatactcagtcctggggaggctgcaaagtcaggcaggaccagggtgagaaagttggaagggaagaggggaaggatggccacatattgcctgaggacaaagacacaggcctggctggactcttatctccttctcactgactggccgagtggcctcatggaagtcccttctcctctccggcctctgggtctctatcactaaaaggaagggctcttacttggataaggttcccctccacagtgatagctactatgctatcagtgactctctggagtgcagctccaagcctgcttcactgccacttcacctccgcctttcctttcacgaagttcaacgaaatgcctattcttgtactaggctctgagctaggctttgtggctacaaagacagataaaaatactacttgtttaccaaagtgtttgtatatgttgttaagtgagaaaagcaggctactcaagagaatgtcatatttatgtgtacatatcttgtgagtgtgtgtatacaacagatatgctacacacctacacaccgaatagaaaaccaaaaacacatacactaatctaaatagttatttgagaggcagtgatatttctttataactttgggcttccccaccccccaaatattcttgcattgcactttacttttcaaattaaatagcaacagctaacctttagtgagcacttactatttgccaggcattattattattattattattattattattattttgagatggaatcttgctctgtcacccaggctggagtgcagtggcatgatctcagctcactgcaaggtctgccttccaggttcacgccattctctggcctcagcctcctgagtatctgggactacaggcacccgccaccacgcctggctaatttttttgtatttttagtagagacggggtttcaccgtgttagccgggatggtctcgatctcctgacctcgtgatccacccaccttggcctcccaaagtgctgggattacaggcgtgagccaccatgcccggcctgccaggcattattttaagagctttgaataattaaccaattgaatctttgcaagaaccccatgaaataggtcctgttgtacacagacccactttacggatgaggaaccagaggcacagagagattaaataatgttgccaaggtcaaatagctcctagggtgatgaagacagcattcaagtctccaacagtggcaatccgactggaaagactgaactttcactgtcaccacagggcctctcacaagcagcagttgcaactatgaagaaatgcggttcccctgccttggagggaggagaaatatgaacactcattcacatcaacagggagggcactgaggtttacctgaggcacagtggggttgtgtgggactctgagctctgaagttcccctgggaagggcttcttactgtacttacagtgccatggaggatgtattcactggaggaaactaactttcccagctgagaaagaagcagagagaaaagcctaaaggtgggaactgtctggggctgcccaaagaaatgcaggagccagagcgtggggtggtttgcttgtggagaggaaggcgggcatgagagggaaggctcacaggtgatcacatgccagatacaaaggccagattggataccagttgagctaagaggccaggctttgtcctagtacagcagggagccatggaaggtttaccagcaggagaaagactggttagactggatttaagggtccttgttaggggaacctccattcattctccatccctgctcccctctgtccctcttttctttcagtgtggaggcagggaaaccaggagccttcctgttcaacatgctttcataccttgcctataggccctgcgctgggaagacctaaagatgagtaagactgggttctccctaccccattacagattttacaaccagatataaaaccattattaggacataaggcagctctttgaaagatggctggaattcgccaccccaccagcctacctatggagcttctgcacatccgttaagatccagctcagacattacctcccctaggaagcctccagtgacaaacctctcacatggatttctccatctctcctctttgggacacgcctcactcctggcactgtgcatccttgtctgtctgtctgcccctactgctcacccctgatcacccttgactggaggtcctccagggcctgaccgcaggtgatccacctccaggtcccagggtccagctccagcccagcccatggtcagcatccacagagtctactgactggaggatgacaaaggctgggctgcactcttggggggctgtggaggagcagggatcagcaaaggaggagagccctgaggttcagagatgctggaaaatgctacatattggaggtgagactagcttgggccttgagtgatgctactaccaactgaacaagtgctttaatggcctcttatgcttttggggtgagcctgtcagttcccatctgtgtgagtttgtgggtcccagcattccttgtcttaccagggaagtcattaacctttggtgttaaatgtgacttgtctgcatacaatcagggagataagcaccaggcaccgctatgtcaggaaagtcccatttgacattctgtctgttcctgctaattaacaggcccaaagagcacacggatgggcttatcccagcaattgctgctcacccccggggctggatctgcacggtgttgcctgcctgggtcgagtatggaaccaaccctctccccagcccaccgagctccaaagcaagctgtgcccttgcccctccattcctgtcacccctctctcactccctctctcccttccctttccccataatttctccctctctcccttccctttccccataatttctctgagagtccttatttcctcttgcctggaccccagaagcagcaccctaacaatcttcttgcttccagcctgtcctgttccaatcctccacgctgaagccagaatgaactttctaaaatgcaaactggagtacatcctccttcctggaaacctttccacagcaacccaaggctcttgaggatgtggctcccattttgttctccaacctccttttcctgaaccacctccttttctcagtcatactcgctctggccccatctgtgctactccctcctcttctttgcttttctgcttcctcctttctctctgaatcctaaaagctccaatccaactcaaggctccccttctccccccaggaaggggcccattccctttcctgaggctctgaagcaagctttagtgtgtgtgggctttccacacatatcccttccttcttctgttccacaaacctgtgttgagaagtactgtgggccaggcactgtgctggtcacactcaaccatccttccctccaatcctcaacaccacgctgggaggagggagacaggctcttcaggacctggcccttttctaacctgcttgccccactctttgctgcttttttccccacgggtaggaccctgagcatatcatttcccctctctggcactcagtttcatccttagcaaaatgaggcctttacctctcaatgttgttgtgaattaaaagtaataataataatagtgataataataacatagagctctaaacacaggccggatgctgttctgtgtgctttatatatatcagctccttacccccacagtgtggtctgcagggttaagggacttgctcagctgcaggcctagcacccaggaagcatccagtagctgttggcatcactggacagtcacacctggcctagaggaggcgtgtgagatgggaatacaccaggcacgttctggggatggcacacagatgagcctggctggagctcagggctcatgtttgataaaagattaatgaaattatcaaattgaccttgtcagtgtctgctcaatccaattacatagttgtggcccccgtgaatggggttaaaacaggagtgcacatgagagacaccaaaacagcagctatgagggagatggcggccacccaggaaaccctggagggaagtcagtgctgcccatgtaccagtacctgtctaagaactgcttgtcactcccaggggtgcagcatcctgttactttggagagacagcagctgagcatccactagacagggatgcttggtaccgtcaactgatgcccacacagtgctgggctctgtgctggcacaagactcatggtgagcaagacacagtccctgctcttgagcagttcttgtctggtaggtgagacagggagggaaacaaagagaattcagcaaagtgagcagtgccctgattgatggcaacccagagaaggcacacagtgatcaacctggactcagggagtttccagaaagatggttcctgggctgagaagtaacccaggagctggcctagaatagagagagatggggagggtgggagaagggagagccattcttaggggacagccaggtttcagtcaggaggactatgaagcaatgctgtgtaaagcagctgaggttgcggagttcattagtggtggaaaaggttggggtgggggtgctgcgtccgcagtgggaagcacagagcagctctggcactggagaggagaggttagggcccattggggtcacaggatgaagggtatggtgagttctgtgagggcagttttccagagaatgagccctagcagtcctctgcgtacggggcactcagccctccctggaacagtctgcagagcctggatcatgtggacatttgaggaagacagagcatcaactacagcttgaccaattcaaggctctaaggaggaccctaaggaagaggctaggtgcagagctgctcccctctctgcttggccagtagcacttagtcttagcatcagggcctgcctgctattccctctcatctgggataatgtttcctggaatctgtcagctgaatagcccttttcagtttactgagtttacttacatccctttgacaactggatctgcaacataagactgtgcaatagatatcttcattcttcccattttacagctgaggaaactgaggcctaaggacaccaaatgcccctacccaaggcttgctcataatggaagtacgactcatgtgtatttattctgaatttaaatcttgagtacatctcattactataacatgatctttagagaaagaaggtcgaaagctggatgtgttggcatgagtcgtcagtggagatggacagaccctgagaggccctcacttcataggccatcacctgtcttactttgagagacaatcctgccaactgtatttctagggctcaatgggggccccaaaacatgagaactacatttggatgttgctttcaaagtaactcatgtttggccaaggattcctatcagaacaaatatttctccatggcccctccacagtgccaccccagggaggacaaatcttcagtcccctcccagccaatgatatcactgtccacccactcagccaagccacaaaccgtggagtcatcactgggtcttccttttctcaccttctacttctaatcagcaaaccatgctggttttaacccaaatatagaattctgctttcatctgtcccatccaccccttcaatctctcggcccctgcctttgctccagccttccacatttcttgccggactattaagccccctcgtttctgttcttcctaactccagtctcaccccttcccattcatcatctacgattccaccagagtggtccttctgaaacaccaatctgaccatgccgcttcctggctcaacactcttcaatgactccttgttgccacctcaaagtgaagtccagctccttagctagcctatgaggcctgtgtgccccagcaggtcctagccccgaccacctgtgcaggtcctccagcaggccctgcttggaacccatgctccagaccctacactgaagctctcatattgctgaagggacactgagattttttagtcgctcattcatcgattcaacttttcagcccctatgatatgctagacaattttctaggccttgctcttaggaaacttacagtttagctgaagatggaatgagacagtattcagataaacacaacaggatgagaggaaaataaagcaaataaagcagaggaaaaggacgagagagtaccctgaggtggggtgggtgccggttcagacaatgtggacaaggacaacctttctgaagaggaagacagaaacaaagaactgaaggaagtgggggtagcctgaggactgctgcagggagaggacttgataagcacataccttgcctcatactgctccctctgcctgtaatgccaccccatacccctcctcgggcccagctctcacctgagaatcagcacagcagttgcctcccctgggacactcaaggagaaccaaccagtccttcttgatgtccctgagtgtcccacatggcttcaatccagcccagtaacacccatcccttcaatcattcattcattcatttcttgaacaaaaactgcttgactagtccctgggtgccaggccctgtgctatgcgttgggatgcatctgtcacttccccctgccctgtgcccacgagctcttgggaggcaagagggactttctctgctctaccccattatcctggtgctagtgcagcacctagcccagaatggcttcaggtgagtatttgctgagtgaataaacatttgagatcattttattgaaatacttcagagtaaatttggagacaggcactcctctactcaagagtaatttaataaccacaaatgcctttaacacagtggggagggaaaaaaatgtgtttcctttattgctgctgttaaaataaatggcattttaaataaatatagcatatagaatgtggccacatgacgaaataaataaatatctggtgaaattatgcattgcaaagcagacttttctggtcttttggttattaaatttaatcacttttgagctgtgcctctactctttttttcctagaggcaggtatgcttttgattaaaatgtgggccccagagcattttcacagggggaagggtgagctacatcccttgaggaactgcagtggagcaagccaacgggataacagggccaaggcaacagccatgatttgcttctaacttgatggacatgtttatccccagatagagtgcacagcagtcacggggcatatggaaatcttgcaattaaagcaaactctaattagagactacatatttaaaatacaaaggaagcttggagtggcagccactctggttggctctgaaacatgattatcctacttcagtccctgcactgactggattacgaggagggaaacgcatcatgttgccacacatggtttcttgcggttgaggagggggagatctctgacttcccagtccatgaagttttggaatccaacagacttggatttgaatcctggctctgcccattattaccccactggcctcagcgtccacatcttcataatgggaatgatgacaactatatcatagggccaaagaaagatcaagtaaaggctttgtggggactcagttcagggagtttattgaccagttaggtgacttacattgcatttgcccctgcccccatccatccagctcaagagtgtgccttgcttaagagccataggggagagactgggagggatgaattcttattatgtcattcatcgtgcccatggggctgaaggaacaggcttcttctcgacatttgtaagtacctgagcaatcaattttatgtgtccacaaggggtgggaacctgggataagttgtttctccttaattcaaatggtcctcaggagcaaggcggtgggtcagtcccgggtcagtggaaggcttggggcgaaggtactgatagcaactctggttagctctgggattctggcctagagctggcatttcctgagcttgggctggggtcaagagatgaatttggaactgtccctgccttcaataaaaagtcacaatctagtcaggaagacaggtaagaaggggcacagaagtgcgtagcaccaactcacattcctatattttacagttcaaaaagtgccttcaaccgatccccgatttaatcctctcaagagcctgtgagggaacagtgacccgcttctgactttcagcttcaggccacgtctgtatttcagctacacagaagagcaggcgcggatagtgcagtgcagtgccccatccccacacacccggtaccctcccaggtagaataaatcagaacctttttgctttttgcctttttttcttctggcctctttttggtttatttgtcttaaacacttaaaacattactgaagcctcttttgcactcttccccacaccactcctgataaggactatgccaaagttggcatgtgtccttcctgcctgagtgtttatactctgactgtgcatgtatatgtctataaacaatccataataggttttgcacatttaaaattttacatacatagtcacagactctgtttcactctgccacttgctttcttactatacattatgattttcagatttatttatgctgatacatactcctctagttcattttttttgtttgctgtattgacatttcactctatgatgaaagtcaatgtgtgtgcgtgtgtgtgtgcgcgcgtgcatgcaggtaattttcctgttggtgggcattggcttccacttttccactttttctaccatcctgcattgctttacatgggaaggaggattcaaggtgaatcttgaaatggctagaatccaaccagtggaagagaaacacttctctttgccatatagcacagggcctggcacctagctggctctcagtcattgctgattactagaggcattgaggctttgatgaaaagaacagtggacctggtctcagaaggacttgcttttgaatcttgaccctctccctttttagctgtgtgacactgggcaaataatctaacctctctgggctacggtatcttcatcaggagaaatatagactataatgctaagtcccaaatactcttgatatgattaaatgtatgaattatttgctgtagcttctgacatacaggagttccacaaggctaactgaataatttcctgattctaggctggggaaaggatgtggggaaagcatcggcatgctcctgttggctgcccttctcactcaaaatgaacgagggaatgaaagaaaaagagaaaagaagaaaacaaggcaccttataagcataattgaaaacctaggacagcaaaacttccctccaaatctggccatagttccattccatctgtggttttgattggccaacactggaaatcccagtagggtctacttggcactggactgggctctctgaagggcagccccaccctgcaaagcctccacctgccctcctgggccctgtggagggcagcaacaggctgggctacacagtgttaaatctcttcctctccaagagattggagccaacaaggctttctgcttaaatggcctataaacacctcccaaagctccctagctcagaaaagtgcatgaatcagcaaaatgaaaataatttaaagacccactggaaaaaagaaccccagattcttttctccaccagcaatgacagcctctcagtagtgactgtcattcttcatatccagggccaggtgcttcccactagttttggaaaagaatgtatcaggggctggaatctgcttcctggtgggagggagaggtgggggcagaggaagaaggaagactaaaaatctacttccccacctggagtgctctgaggtttcccaaccctgatttgggtcatgggatgctgtcagggccacaccacttgtggaggttgtggagtagggacctttgcacacatattataattgagcctgtataactgaggctcataggaaggaagtgaccagcccacaggctcccacaggtggagtgtgacaccctaactaagtgctcatgctccctgcttctatcactctgatgggagggcagtgcctgttagtgagctccgactacatacctgccgtgggatgggcactttagcaacagccttaaatgttgacattgttattcttgtactgaacgtaatacatcagctccttgttgctaataaatctcaggattcagacggttgtatgacttagccaaggtcatgttcctgaaacccacactcttttactccacatcccatgctgttcccacagtattaaggaggtggctcaggaaagacctgacagagacatgtacaaacctgaaatgcgcccccttcccccaaacacgtttgatctcccctctggacatagggtggatgctgtgtctgacacacctccatgggctgagtggttccagggtccaggagctgcatgaaggaggtgctcctctggacatagttgccctgggcactccccatctgcaccattgcattgtggtgctcatagtcaggttcccacctggcagtgccagcacttaaggaggaaggggggtgggcatctgcccctcatcatctctcacctgagttattcccccaatagccttctcaactcctccctctccctccaaaccattcaccattctgatgccagcatcatttttctaaggcacaaagccccacccttcagtgtgtccatggtcttcagagtctagcagctcagcctggaaccaaggccctccatgactgggcctctacccacctctccagcctcatctcccactaccagcttcactttcataccttgaaacatctgaactcatcctatcctcttccacctcttgcctattgctcacaataattataaacacttatgtagtgctttctatgtgctaggtatagttataagtgcattttagatattggcttaatgctcacagaaacatgaagccttccattttatggaagaggaaactgagtcccaaaccaaataagtaacttgcctgaggtcacagagctggtaagcggtgaagcccatagtcacattctgacagtgagaggtcagagttctcaaacttaactatggccaaatcctttacttctttcttgacttggtgatggcctatcaaacttcaacccatgagaacaagagaagaaggcctcatgacctcctcatggagggctcccttgatccctcaaggccttatacccctaggcggaaataacttttttggtatttatttcccatagcatttcctcaccaggaaccaggcttctagggagaggtccatgccatccatactggctctgtactggccctggggactcagagatcaacacagggtggtccctaccttaaagggcttagtccagggagaaagacagacacacaatgatgggacagcttgatgaggctctaccagaggtcacaagaggtgccacagagcagggagaagggttccaacccaggctggagatggagcacaaaagatctcctggaaggaggagaagaagcaggtcatagagcagaggaggcaggagaagtttcagatggaaaaaacagcttatgacaatgttgagagatctaaggtagcatctagcatgatcattaagacaccagacattggagtcacacaggcttagatgccagttcaggctcctccagatcacagctgtgccatcttgggcaaattactcaacctcattaagtcagtttcctcatttgtgaaatgcaaatggtaatagtacctgcttcacaggtttgtgtgagaatgaaaaagtgaacagtgctaccacatagtaaatgttcaataaatattagttaattaaaaaacatcaccataactatatctcttgcacctagcacagtgtaggggttcagcaaacatgtatagagatgaattaacacagtcctgcctgcagttcactgacagccttgtgagaagagggagctaaattaatattacaatacaatcctctgagtgttaaggtacagggaagactggggctgggaatgaaggatggaagaagatttggaaaactagagaagggagggagtcctttaggaatagatggtaacaggctcttagaggaaatgatatttaatctgagccttcaagcccagagaggatagtttttttttttttctcccaaggttaatgatctaaaagagggacaaggatgagttagagccccagactgagcagggccaagcagctgaaggtagagaggcagaggagctgggggaaagtgtaaagcttgagggtgctccacaggggaaggagagtgtggatagtgcaaggccatttataactgggctgacatatggctgattccagaaaatcatttaaattgagtcactcttttcccagaggtgggagtagggtaaggtttatgtgaggtggaattagggtatagtgtaagagaccctcacagtccctgtgatcactgcaattcagaccctaaagtctccagaaatgatctcaacatggaaaccacatttctgctgagtgctggccatagctgcaggtggccatgaatgagaaatgctgaggaaatcaatggcagggaaccaaggacaatgatgcagggaatgccaccttgacatttgttccctgtgtggcttctctgatggctgctgcaacaaggccggtggggtccagtgtgactgttggcaatacgggctcactaaggatttctgggtaaactttaggtgcctattccaggggtgaggagggtccctggcccggactcctcacagaacaatcagtgtgggggtgacccaggccctggatatttattaccttcctctccccatttcagcactgcccagatcagggacccctgtggtctgacactaggcagtggccaaggcctgggctgcctgagctcagcaggcacagagctgtctttccagcactgggactgagttgtggtgaccccaggtttgtctctgctccgttgctctccctccatctgtagggtccttcactgtcatccaggcctggattgggccccagtctcctaataggtctctgacttttgtcatttattcattcaataactttttaatgagtgtgcactatatgccaggttttgggaatacagcagtgaacaaaacagaaaccaagaggctaaagtggatggtgaatggaattatgttacagtttgtgaattattcagataattcacataagaagaacagagaaattattcagataagaggaacagagagagagaaaattgacaacttggcataagtactggtcaataaatctggttattgtttgtttatttggggtgggtgggtgggtgggcattggtgaatagggagggactggggggtcttttgtattttaaacacaacttgtaaagaagatctcgaccagctgaaatgttgggctgaaaccagtaagatgaaatggaacagggacgaatgcaaagtcctgtatttcatttaagaaatatacttgaaaattttacaaaattaaaggatggggaggactaaagagctgttaagattaaaaaggagaggaaaataagaacaaaaagatttcacatttactgaaggctggaactggggtcgagtggggactgcaggtgtggcacagtggcaggtcagtatgactacccaacaactgcataatgagtagggggactggggttgggagactttaagaaacttgtcctatttcctctaatctaataaatagtgaatgcagggtctcaattcagtgtcagtctctctggctccaaaactgatgctctttccattataacacggtaaactgaagggacaagtatcgtgttagccaaaaagagagaatagaggactggtaacatttccctcaccacatactgtcaatattaccttactgagccttattggctcaatatgagacaattctattgctaaagatgctaattcgaagtcggagagtaagaggtgacatcttgctgaccaaactcttcctggagcaccatgtccagtcctgagtctcatctacaggggcagatccgtaaaagagcaaccaggatggtcacagttctcaggattagggaactaagataccgaatgcctagaatactttactcacattatcttacttaactcttgacataatcctgtgagatagatattactattcccgttattaaaatgagaaaactgaagctcggagaggttaagaatttgtttaaggtcacacaccaagtggaagaaacaggatttgaacacatggctgtctaaatccacgctccccactctttcccatgtagcctgccacacatgcaaaatggtgaagcagaatttgagctatttattagttggtgaggagatatgacagccaccttcaactctacaaagggctgtgagtggaaacattctgtgtggcttgaaagggaagaatttgaatgactttgaaagtctcagggaggtagatttttagctcaatggaataatattttactgatggcaataactggatggactcttgggtgggaatatgaattccttgtgcttggaggtattcaagcatggtttggaatggcatttgcttataatggggaggagattcgggtggaaaacctcaaagttcatttttgatccttagattccatgagcctatgaagctgcctggcagaaagggatcaatctcttcaaaagaagtgaaaatatctattggtttgtctatttgcagacatacaggcgaaaattatatgcccaagttaacacattggtccataagaaaactaaacacagaaaatgaaatggattctgctgaaactacttacaggttttaaagttttccttttctacgaagaagtagccaaactctggagagatatgcagtcttggctataataaaagaaaatataacaagggtgctatttttcacctattaagtgggcaaaataatttaaaaagtggtcacacccattatatatatcaagagtgataaaatgtcattccttttgacccaggtacaaccacttaagagaaaacactgtgaaacagaaaaatcttcatctgggtttaatttataaagagtctaaaaatccaaggaagtgtaaatgggccacttgggtggcagtgagtaggggctgaggtaggtgaggggagctggaagccgaggagcgagctagtcagcatgcacgggggaaagcccccatgtatggagaactatgggataagcagaagatgtccagagagccaaaggtgggtatgaaagccaaggtcactgcatacggggtcagcaggttaggaggagcacacttcagtaaggaatgaacaggtgtagggagagaagagaggagaggaagcccaacattaacactgacaaccatttagcccctctcttggggggcacattaattacactctcattactcctaataaccccataactagaccttatttcctccattttgcagatgaagaagctggtgttaagaaagatgaagtaacttgcttcatttgttggtaagtgctagagttgggaactaaactcgcatgcatctgcctcctaactctagctcactttacccctgtgtgtgatgaaaagtgtgcagccaggcccttcacaaacccctgatctgtgggttaaggcttgggcagctgaccaggtggtttactcaattgcagctttatgttggtccactttgtggatgttagaattgatagttatgaattttatggagcaatggtgaaacatgttaaatgcaaagggaaggatacaaacctaactatgtgctataatcataggtatggaaaatacatattttcacccttggaaaaagactacatgagatacatcagagtgctttcagcagtgcagtttggggggtatttcctatttttggcaataatttctataaagtagtttttctctataattacaaaaaaaatcgcaagttagaaatgcctacaggaagcatacaagcacctaaaaagtcaccaatatactttcctaagcaaggaaataaagccaagccccatctttctgtttcatctggtatcagaaaacttgttgccagggcttctgaagacagtgcccaaacctcattgattcaggtcctgccaattcagtattgacagtcttcttctacacaactcactggcctggcacaagaatccaaagactctaagtgtacaagtgagggaaaaatcatttgagcctagacagaaagtcaccttctgattgtgtgcagctgaacagcatttggtggccatgaagaggaattctaaacaggtgttagggcagagtctcagttacttaagaagaaatttactctcaatgtcaaatatcctcaggcacattagaaagaccatcagtttgttggctccccatccatttctttttaatatagggaatactcttatcctttattttaatgaaggtcttctaatgactttaactgatatttttcgaaagtgacatctgtgttaaaatacacattcccagccttatcccagacctaccgaatcaggctctccaagccaaagcagaggaaatttgtattttaagcacctcagccaattcttaagattgggcaagtttgtgaaacactctaccaaacaaaatgaatttgagtttttatatgtatttgaatgtaataaaactgcaaatgtttataagcagtactatcattcccagtccctccaaatggcctgaattaataagattgttttccattgactaatacttaggttgggtttcccctaaacatgtcctgagattacgtgactagattctcagcctagaccacaattttccactcatctttcagggaagaggtaaaagggcaggtttttcacagacctgagttctgatccaggtccactgctgacagacagctccaggaccttgagcaagaaattatttaaccttttttgagcccatttcttcatttgtatgggtgtaagaatgatggtcttgccctcatattacaataacaaggcaccatgtacacaacagaggccaaaccgtctcagcctaattagtgtgtgaagcctcccgattacatcagaattggctcttacaagcatgattccttgttgcatctacttctgatttcattctgccttctacgctaaggataataacgaacatctgcaagggtcttttttatttatagagcccttttttcagatattatctacattactctccacaacaaccctgaattagggatcattctctccacaccagaagaaacaaggcccagaggtcaagtgacctgcttggaagtggcgaatccaggatttaaacccagatcccataatcattaactgccctgttctcttgaatatatgcatcaaacattacgcaaagcactttcaaaaatatcatagcatttttattgtagttatttccacaactattccccccttaacctaaaagcacttgtaaagcaggtaccatattttattagtctttaaggagaaatgcagggcctctgggtgttagtgtctttgttactcacagagagaaaaggggatgagctcaacaatgatgcaaagtttttttccagcatctcacgcaatccacacaactcatgcctgagcttccccatgcccttaaatgaacatatcttatcaaatatttattgaacatctatctactaagtgtcaggaactttactttgtgaaatgagttaacatactatgttaaacacttagaaaagccttggcacatattaactatctgttattattaatattattaagttatccacacggcctatgaggtaggcattattttcctccttattactgataagaactctgagaataagtttagttaactgaaagacaattaaaataaaagttctcaaagtggcagccacctctcctacttactccagagaccctgagcttttggttacagactaccaattaatggatgacccattagagaaaccagaggccacttttctaaccaacaataacagccaataatcagaaatgagtaacagttgccaacatttattgaacacttatctctaatccttgtagcacctctgaaaggtagctattatctcctttttgtgaaatagaaaatggaaactcagagaggacaggttaagcccaaagcaggcaggggagccaggcttggaatctagacgcatcggcccaaagcccttgccctttctaatatgccatgcatacttcacaggcattacagaaagcaaagtgcaaatcaacaggaagttctaatgtggtttgccagaatgtgtgccaggcaccttagagactcagtaacagaataaagaatgagataaaaattatgtaacttgaaagaacatttgagatacaagataggatgaaagaaccgataccaggtaacattgcccctagttcctgaatgtaaccctatactcatctaacattatcaccccgtcttcacccctttacaaagatggattcaaattattagggaagctgaatctcagatcaccttgagtgagaaaggtgactggtccaagatctggcctttgaagtcagagaaagagatctgcttttgagacagcccttcagatctgtagaaagcaaccacatctcttaggaattttctctccttcagccggaatattccttccctgaaaggaagggcatgccaggcggcacaacactctggtcacccccactgtatatgtaatatactaaagaaatgaggataaagactatctacatcaaagaattaatgaaaatttattatagaacaaaatagagcaacaaagaagtccttggatagtaaaaatatccattcaaaccccagtcaagtgacaggcaactcaggcaaccttatccccctccaagaagagtgttttccccattcccagaaggacaccagtgccaggctgctcctgagtctcagcaaagccatctgtcgtctttggagtgtccacattcagaacaagccgctgaccccagaacccgatggatccctgcacacacaccaccatgcacggtggggtctgatttggacggcaccatcgctcgcaaatcacatgccacacaaggaaaacacgaaagctttatgaaaaatccaaagtttattgcaaattgtattttgcttcccttcgttcttcatttttacaggatttattgatatccatgattttttcacagatgtacttgttgactttggagagtctctgtgcaatttcagtttcatccacagtttcttgtgctattctgtcatacaaacactctagacggggagaagaaacaaggccaaggattaatggtgaattcaagtaaaaatcttttaaggagggtaaaagaaaatgtacctcccaacatacttcccaaataccagcttatgtatctggcatagctatattttaaaatttgcatcatagaatgtacttagaaaagagcagatatacactgtaaatgtactctttaaaagtaatgataaagtgtccacgtgtccaccactcagtggagcaggatactattggttcctcccaagcacctgcaggcccctccctaattctttcctctccaccagagataaccattctcctgaacttttgcctttttttttttcttttagtgttaacacatgtatgtatccttaaataaaatagtttattttccattttcaatctttttataaatgtgcccactctatcattctgacttgcttttttttttttttttactcaaatgttatagttttgagatttactcatgaaaaatacatttgtaggtcattcattttcactgatgagtagtgttctattgtatggctctatcacaatttgttttatccattttattgtcaatggatacttggttttgcaattaaaaacactctggcacatgcctctggggaagacatgaaagaaattctccagtatcagcctaggcgtggacttgctgaatgttaagatgtgtgcatattcaactttattaggtgatgcctggtaaattgctttccaaagtggttgtgctgactggcactcctagcaacagtgtatgcaagtagtactggttgccccatttcaatagtacttgacattgtcacattattaaggttctgacaacctggtgggtgtgaagtagtgtctcactgctgtgattactaatgaggctcagtacggccactctcttactgagtccaccatttgctgtgataaagcaaaaagccagctccagacaaggtctggctggagcccgacttcaattgactgcctagcctggggacctggtgcaactcactgccctagattcctcacttcataaataaggataacaaactacagagcatttttttttaatgctgccatgaggcatgtgggataaacatgttgcctttttcaagttgtaaggaatactacacctgtatggggttgttctgagtattttatgtatttacaactattaattcctagggcctaacacagtgtttggcacagtggcaaacttaagtaaacatatgttaaataactgaataaatgcttttccagggatacctaagggaacacaaatattctggatggaagaggactagggcgtgggtggtgaatgtaccacgggaatgtgtaataatgggcaaaacccttggggactctttgagcctgagttttctcaactaaataggaatgacaattcaaccttgaggaattgctatggagaacaagcaaaatcttgtcattaccaaaccagctcagaacagggaattgtctcagagatgcagaatatcaacactagaggggattgtgaagactaacttgtgctaacctttccactaacatatgagaagcccaggcctggagaaagggagtaggtatggggcagaatccactgctacctgcccatatgctgagcccttccctgggcacagagccagccagtctgcctcctgttgccatccatgctgcaggtgcacctgctataagcattctttctctgaggcacccttttctttccaccgagaagggttttgcaaagagaagcctttaaaagcttttaattgacctcgaccagtcacttcctgactattcccaagcctgactaatcctcacttcatcttgtcttggcctttccataaggactgagagacaagaaggtaggaggccctgtctctccagtcccacctctgctatattcatcatccttttcaacctattccacctgtcagggaccttgctcatctctgcttaagtcctcacccttcacctgcctaagctctactcattcttccagattcagctttcttgaaacctagtatcagactgagttaggagaccccactctacctagaactctgtgctcccacacctgtctcggtttttctctctgtcaaagcacgaatcacaatctaataaaactgtaaccacattgtttccccccaacagactgggacactcaggcattccctctctaccccaggccaggagaaaacaaacacccatagtgactttgtaggaacctgaaccaaatgagggagacaaactgtgatgagaactgcttagaagttgagatattcgtatctgattctaaccctagatgctgtgcaacctctaggggggacttctctgggtctcggtttcactatctacgaaagtagcatttcaaaccagagaatctaagaagattcccccagctcgaagtctctaattgtctgcaaggtaataatggcaggtaaagtggcaaaggagacagaaggagaaggcaggagagtgggtgtggtggcccttggagcccctagcattagtcagggaagtggtagaaggagaaaggtgcaaatggaggaaggtttttggaggagcccccatagaatttcaatcattctcatttcctgtgggtaacagcactgaacgaaaagcttctcaggttgattaaaaggctttcgttagactctagatattaatcacctgcagttgccgggaatgtctccctctgcgagggagcatttgagattattgcttaattaacaaggtttataacagtgctaatgtgtcctattaaaaaagttataaaaattaaccggaacgcaatgctgaggctcatttagaaaactcagacactccacaaaaggtcatttgaccttaataggtttaactgtcattctggagcttgtcattagagcaagactctgcttcagctctcctgcttttgtctttccaaagcagcgtcaatgtttgccccatccctctgctatcgggtaaggaactattttaaaatcaaagagaagaagaagaaatcctcaccaactctgtgagcataaaggcttttctatttttttatatggcaaatgtgactacatgtaacaaaatcagacaaaataaatacaaacaatctcaatccagcagacagcttgcatgggaagaaccaaccaaatgcaatctggaacagctcaaataattaggctaaaaacagtggttatattgtgggataggagacagatgtcaaacctgcctgtctttagtaaaaaaaaaaaatcaacattatatttcagtaatacaagaaacctctggtgacagcaggtagcctgaaagcccagttcagcttggctgtctctaatcagatgtatggccttgggcaagttaatttccttctcattcacgtacaaggcaagcatttataggcaataagggttagacaagtctcctaggaggcaaagatacagtaagaagagaactgaggtaggcactgggtgctctaagatgaatgacagcagcatccacccaccccaaaaggtcagagatgatttcctgaaggaaggctcacctaagcagatctgggtggtaagcagcagttagccaggcaaagcagcacagatggaaggtaggtagtgggacctgtgttccaggcatccggaaaagtatttgcaaattccccaaggtgacagggaacaaggcttgttcacgaaatacagcagttcaccatggtaataacttaaagttcaaggggaatactgctgaaaaataatacaggagatatagccagaaaccagattacacaggtgcttctatggcatgtttagaagcttacccttcaacagtgaacattctgaacaggctgtgactgggtggtggtcaagggatatctggtttctgaagattgctctggttacataatggagagaggagtctggaagctgccagagtaatggaggggagaaatgagtgtgggctatgagaagggcagtactgtggagagatgcagatggttctctccatatttggaaaaagtagagaaactttaaaatggcttagaaaatgggggagtggatcagcagtggtttaagagagatttggggccaaacagatgggtagtgagggatgtggaggagtcaaggatgagacctgggtgcctggctggtggtactattcaccaagacagggaacatagaagaggcaaaggcttcacagagaaggagaggaagaaagagagagaagtgagcagtgcagttttgccaatgtcatgtgggcatctgtgaagagataaccagtgggcactttgatcatagatcaagaaatcagaagtgtgaattgagtcaaatacagatttgggaatcatcattcattgaatcaacaaatatttattgagcacttactataggctagccctgaacaagatgctcataaagtttaattctaatggaagtgggagaagaaagaaaattaacaagtaaaaaaagtaaataggaaatgctatgcagagacttggagtagggtgatgtgacagacagcaatggagaggctactttagactgagtggctggggaggcctctctcagtgacagggagggagggcacgcagatcaggagcaagggagtagcaacagaaaggacctggaagaaggcctccagggctacagcacaatagcaaatgggaagtgtggtataagatgaggtcagaggcgtcccaaaggcagatcatctgtaacaggtgaggagtacagatttcaacccaaagtcaagggcacactgaaggcaatgggaacaataggaagtgaggagagaagctgaggagtgcttggtaggatcagcgagaagatggctggacacagaggagagggcccatcaaggagactgagaaaccagagagatgggaagaaatccccagcgtgcagaacaggtttctcagtgaaggaggaatgatcgtgtcaaacagtgccagtgagactgtgagaaacacacaaggatttagagacgaggaagtcactggggaccttggtgaaaacacattaagcagaaggctgggaggggaaggcaaatggcaaaggcattaccagggaacacacacagtgggtgtagctcgtctttccaggagcctgcatgtgaaagaagggagatatgatagcagctgggtgacagagtgccctttaaggagggtttctttgcttttgtaagaaatgagtgatcaaatatatttacatgatgctgggaaggaaccagtagtagagcaggagcataactgaaggaacaaggtacttaggaaggcaggtggactgaaatccagagcccagatggagagaatcaccagccccaaataaggaactcctttgggacaggaggcaggaaaatggaggacatagttaagtctgtaggtgtgatgcctcaaaactgtggaaattcctttattttcctctgtgaaagaagagacaaggcctatctctttgattgatgcgaactatcatatttggaaaaagtaaaaaaatttaaaaacggcttggaaaatgaggtagtagatcagggagggaaactcacacaacttggcagatgatgctgagttccagctggggttggagctaaggagtgtgtaatggcccaagccacatgcatggctgaggtgtattcttctacattgctgcactgctacaatcctaggcagccctgactatcttacgaggtaagatgatttcagcttagttttcagctaagaaatctgaaacatggagagaaagtgatttacaagaaatcacacaaaatttggtcaggcgatcagcttgtgggtctctgtgtttcttctgttcaaccttcgtttactgagtgcctactatgtgccagacactatgtttggaaatgaggccacagagatgaatcagatacagtccccagatccctgaaggagacacacagcagatgattttataccatgtgataatggcaggaatagacagttatctgaaggcacccaggacctcctgagtcacgttccaacaaacatagcagaattagaggtcggtcacctaccaggcagggcagggcagggctgcatccccaggatggcctttttctcagggtgacctcccaaatcaggctttaccatttcagacagcagcaagacgaaaggttacctctgattatccaaaaataagcggctgcctaaatcaattaatccggagtcagccaggcaagggaggcagctatgttacagcagaacaagccccagaccagagtcggcgggtgtgtgtttgaatctaggctctgaaaccttatagctttgacctcaggctggttgcttaccctatgtcctgccaccttgaactccaaaatacaccctacacttgggcatatttctccacctccactgctgtgcccttagtctatggcagcagcatctctcaccaagagcactgtatcagctttgtaactcatctcccatgtggtcactccatgactggaagacctccattgccctttgactccagcaaatccaagctgcttactgtggccttcccagccctacaagacaggctctcgcccacctccctgacctcactcttccttctacatcccagccatctggggcttcttcacacccggagcatgccagccttcatacctgctgcttattctgcctgatttgccacccctcagaccattataaagatgcttcttccacatccagattgcagctcaaatgtcacctcctcaaacagaccttctccaactaccccagtgaatgcagccctctctgtcctaccacatcatatgagcaagctcacagtacctgaagttatcgagcttgttcctggacatatttgttgtctgcccccagagtctgctgaaaacatatgtgttgactgactgagtcttactttctttatgaagacatggcagacctggacactagtcagtggttaggagcacagattctgaagacagcctgctggctcgggttcctggctctcctcccactagctgtataacctggtcaagttacttaacatttctgtgtctcagtttccttgtccgtaaaataggaattataatagtagccaacagtagggttgctatgaggataatgagttaacatacataaaagtgttttttaaaagagaaccatttaacaaaaacccctaaatcctgaaacacagttaagtgcctaaaataattagcaactactttattctctttgctccctctacaccatggtctgtctctatagtttgtgttttctgtagagtaactagttgtttttgtgtttatcttccctgtgagaatatgaactccttgcagatgaaggctgtgtcttacccctctttgtgtcttcaatacccattagagggcctggcaaagaatggatggatggagggagggtgggagagagggaggaaagaaaaaagacagaggagaaagaagagaggaggaaggagagaaagtagaggaaggaggaaaggaaggaaggaaaaaggaggaaggaggaaggaaggagggaagaaaggaaggaagtaaggaaggaagaaggaaaaaggaaaggagggagggaggaagagaaaattccagagtccaggatacagccctatctttagggagacaaatgactccctgtctctttgcctgccctccaacctctcccatataccagaaaggaaccagaaaggaagctgaatctagtgactaccagctggtcttcatctcattaactgctccaggcacaatgctagaaccaccaagaactgcgtcccctagccttgacctttcctgctctgggtacacagcagcattcctttcccatctccatgcctttgttcaagatgcttctgcctccagaagagcaatacctcaccatacacatctgtgtctcctagtctgccgtattcttcaaggcccagttcagtgacccccgtccccaggaattcttccctgattttccagctaagggtatcctcccctcctgagaactcccttagcacaccatctgtccctttctcatgctaattccttgtggaatataatcgtacttgtgtccacagctcatctgccctggtaaatgtgagctcttctggggcatttgggttatccgcttggtgtccccgggctcagcccagggtctggcatgcagaagcttcataagtaatcgttgaattgaattgtgcctaacacattcttgacagagtaaaagacagaatcccagccattgtgtttccactcagtgacctacctctgacgatgcttagtttgtgaggcgagaggggtggtttagggactgcatctttctttttttttgtggcgacgcctgtgacgcttctgtttttcagaacatctgttccccaaatcataactgccaagttcttcgtgtacttggaatctccttgggttacttgtagctggtgccatttctcctcatcaacccaaatcccgcttcccagatggacctgagaggaataagaacaccagcacctgtttagtccgacaggagggcagtgggaggcttctcttgtcctttaaaaagcattgctgcacaactgtaagagattcatgtcataaatatgaaattaactctctttaagggtaatcgtaatagctatcatctactgaatacgtgtagtgtgccaggccttattctagggctttatatttgctatcttaaatcttcatggcaattgtggatagaaggcattataacaccattttcctttcagatggaaacaccggttcagacaggtgaggtgacttgctgaacatcattcaactagtaagtggcagagttgatattctacactatacttagtttatcacaaggctgctcagagccttaccaaatctcaggacacccatgcttaacttctttctgtgttacactatggaaagacccaccttcctttaatgtgaacattctgggacatataccttcctagtatggtggttctcaaccttggctgcacacaggggtcacctagggagctgtaaaaatcaccagtgacagccaggcatggtggctcacacctgtaatcccagcactttgggaggcagaggtgggcggatcacgagatcaggagattgggaccatcctggctaacatggtaaaactccatctctactaaaaatacaaaaaaattagccaggtgtggtggcacgcacctgtagtcccagctgcttgggaggctgaggcaagagaatcgcttgaacctgggaggaagaggttgcagtgagccgagatcgtgccactgcactccagtctgggagacagagcgagactccgtctcaaaaagaaaaaagaaaaaaagaaaagaaaaaaaaatcatcagttcgtgggccccactcctagagattctgatttatttgggctgggtgtggcctaaataattccagtgtatggctaagtgtgaaaacctctgccagctcaagtaaggagagcagctgccctgccaattggagtagggctgtgccagtcctttcccacctctgagcttcatttccctacctatgaagtggtggagctggatttcatctcaaagttccttctggctcaaaacacctatgattttaaacacaaccacaaggtacccagtttgattccgacggcacaaagaacaaaacacaatcttatgctccctatgagtttcagtgcagagccaataagacccagaatgttccagcaataagctataagattttaatttgttctcctttctgcatctttagtaaatctaaaaaagaaaaaagagtataaaatttagatctcacaagtcatttactaacattaatcattaaaaaaacagtgttcactttgacattgccatttatgtcatgcttctgctgagtctgtgaagggacgaaatggcctctgtggggacagagggcggcagctgctaatgagctaaactttctaagggacatgagaaggacctgccaaaggtccttgttttcagaaaggcctgcagtttgccaatatcacatggtcagagacatctctggagaggtccctggtctaagagactggatgcatacccaactaatggcagaccagcaagatcaattgttcaaaaaacaattaaagatctttctactactggagcttggcttgggaaggaaggtgaatacacatagttaggcagtcaggtcagccagcaaaacttcttcctttaccaattactgaaattttccaaccatcaagaagaaaaaaaatagcaatgcagcccacccatgaatgtaagtcaacaatctacctgcacgtctgacttcacctccttttgctcaaaagatcagtcagactgctgcaggcaatcagataactagatccacctggcctctctgtgctgtaaacttcagtactgcaaatctgttcatccgctcaggaaagataagcagccttggagtgagatgtactacctggctgctggctaggcaacacggacaccaaggtcaagtgtggccttttctccgcagttcgaactgcaggtgggcagtctgtgtgccagactgggcatgctggggacaagttccccactgctccctgctggaccctgcatcacttcccttgatgacacttgaagccacccacacaagcttcctgagataggagaaaaacaaggaactttgaattacattaaattctgaatcagaaaatcatagagatggatgccaactttacatttttcaaaaatctctgcttttttcccccaccactgatccttgctttcctgtgatcttttaatttgttattcttgaaagggagatgaaagtccttttagccaatgttctacaagagaaaaggggtactagtattttttgagtacctggttcacgtacaatgaaccaggtattgtacattcaatttatttattcctcataatgaccttaagagatggaaataggtagaaattattttcccattttacagatgtaaacagagattcagagggactatgtaacttttcctaaggtacacaatcagtcaattttggaatcaagattcaaacccaaatcctgaagcttctgctctccctgtcttccttgctgccaccacggtggtactgatgtagatcaaagacagcagacctaacacatcaatgttcagttagttttccttttgagtttcctctgtatctgcctggctacttcccacaccagctcccagtgcagttcaccactgcagacagggaaaccaggaaaacagccaccgactggcctttgcctccagtccttgctcccttcaacccgcccatcctataatcacgacagattaagttccctaaaatacctccttccttatttgactagatgacttctgcagtctttcaactgtgtttttaggtaaatcctctggaattttgaatggctccctgttttctatcacatttaatccaacttcctcagcctggctttgaaggcccattagaatccattctgttcactactacttcatttctctactatattcatctacatagtccatctacactacaaaattccggaacttgttcatttcccgctacttccagtgtgccgtaacatcaagaggatgggtgctggagctgccagcctgggtgtaaatctcagctattctacctgcgtgctggttaacttgggccagtcactttatttcctgagccttacttttctcagctatacagtcagcagatcagtgctacctcagagttgctgagagggttaaatgagaaaagatgtgtaaagtgtcaggaggacacagcaactgttacatcctttaccctctttcccctccccatgtttccgctcctgccattctcttgtccaggaataaatgttttccctacgttttcttaagcctgctaatctttcaagtcccagtctaaaattcaggaaacactccttaattactgcagagctaagttctatcctttatgaatttctagctcacttagagcctttgccacctgattcagtccttcacagtacatgtcagtggggagggtcaaggctttgcctcttctgtcccctacaaagtgataagggctagtctgtacacaaagcagtaagaaattgatgggcatatttaatgtctttatggaactgtttttcacttctgatgagctgctgttccttggagatgaaaatattttctgacattcactcaagtacaaggccaactttagaacacagaaagaaatgggctttgctatgaccaatcacaggtataggccggggcatttgagacaagggcccctgaggttagcaaggctcaaggtcacctggagcaatgttcagttttcagggatgtagcagaacagactggtgagagtactggcctgggaaccaggaggtctggctttcagttcctgcctgcctctaacctgttatgtaattatagaggagtcccttctctggatatgtttccctacccatactatgtataaattaggttatttaaaatttgatggtctttgcagctttatgattcaatgagtttttgaaataaaacatttagacaaagaaacacaatgcactttacccaaatcagaaatttgtgtggcaagcctgattcatgtaaaccacagtatactatttgaccaaagtgttagtgttatgtgtcaaaggaggttattaaaaatatggcatctggtaggatggaacttgatcaaaatatatttatgtgaaaagttttataggacaaaaatcatttcctactaggaaatgtgtcccattccagtgctctaagccttgcagagattaaggcctctgatcgtgcagacagaaggaagggtcagacaagacagcagagccaagaacaatgagggctacttctgggatgtggagatgctgttctgggaagctgccatcatttccagtgcgtccacttcctttcctctgcatttaaaactctctctgcctgactaccaattaggtgcaaataaaaaccaggttagtcttatagcaacatgctggcaaaaaccaatgaaaaaacaaaataggcattttcaagatttgctgttcaactcacgtgtaaaaatattaaatgagatttgagagactcattttctgggggaagaatgctatctttgcaaaagaggccccctataatgctctgaaactatccatcagccttcaaggcaagggagaaatagatttctcttggaagctactttaagaaaaactctctagtcactccacaatgtgttcatgactaaaaagaaatcaacaaacatagcatagtcctatcttttatctttgattggggaaggttcaccaaacttagatacacagtttgaatcagaaaggcctttggagagcatcaatccaatcccatctttcacagacaaggatgccgagacccagagaagtgaaggatctttgcaaggtcacacaggtaggacagatgtagagctatgctaagaactcaggctccaggctgccgacttccaacttgtcatgccacctctcctctgcaaagctgacgtttcaagcctgctgaaggcagcaaggcaaggcagaatgggcctgtggcctggcccatcagctttgcctctgcaggggaggaggcgctcagtgggagatgcagggaacgacaccacatccaagagagtcctgaaaactaatacgtttcatttcctcagcttgacaatatttgctttggctcaggttggccagttgcagagacatatctggacaaacccaaataaaacaaatttttctttctcatcaacctaacagagaatgatactaaataaacagagaccttttgaagcatgaggcaagaaaaatgaaccaacacatgacgcgttaaggagaacgagaggcgatgtctgtaatgcatgccacagtggcagagaacataacgctaaagctgaatttcaccagtgccaacacaaagggctctgatgtacttcttcaaagatcaattcaattgaatgttagaagaatgtcagaaaaatttcctcccctgccctgctggtatatcatcatgtgactttaagatttttcacgagcgattccattactaataatcttaagtttttgtttatgatttgttttcaaggtcatataaataacgctgagtagttctataaggtcctaggactgtgcgctaaccactgctgcatacacagcttgaaggaggcttggggataagggagtatgtcttgttcttccctgtattcctgttatctagcacagggcttagaacatacagatactttctaagtggtgaatgaacacaaactgagttgttatctgtaaataagatacttcatttccagttcacctgataaattttaggcatctggttacataggaaggtgggacaagtttcatcaaactatcatgggaattaagaaatatctttgtcactagtaagctattttaaaatgtcaatttacttttacagttgctttggatcaatattttttaaaaaaagaaagaaagaaaaaaaaaaggaagaaggaagagaaaacgccccagcaaagctacgctactgatagtatacaaattccagaaacagtcattcagggctaggccaggaggccaaccagtcaagctgcgatttggaaagctcccaccatactctccacctttactctgactaacaaacacttgcagggaatggatattgagcttaaaacactaccttgccattgtctaggatatacttgtccatgacaggcgcaggagcggggtaataggacgacgtatttgcttcctcactgaaagtgctccgtaactccggctcgggctcgagacattctgactttactttttccagatcaatggcgggacctaggcagttaagaaaagaaatctgtctagaactccaaggaaaataaaaggcaaatatttttaactaggcatctatcagcacaccatggcacaaaaaatttgctagcttatttttgtccattgaactacacttaaacccagactcgaaaataatgtgaggtatgaatgtcacaagggaaaaggtggaaaactggaagacaagagtggactagactctaatcaagtttgaatgaagagcactcttccagggtgtcattgtctaaatggaaaggcagggattcaacttcctgcataggaaagaggttctgttacgcctgggttggaggagaaggggtgggaattactgaaatatgcaaatcgtgtatttgccaaaatcctcacctcagtatcttacagtggagaaggccgtaacagaagaagggagcttaggaaagtgtgggcaaaaatgttaaggcctccccctccccaagacctagtatctagactggagcatttgaatcaagaaattaaaacacaatacacattaagcccctgattgcctgatccagcagctactctgatttttattttaatgcaatcaacacaaattacatgcagtttaaacagcaaaaaggaagctagataaatggtgatagtttctaaaggggttattttttctccattagcttttaaaaatggactgttttataaaatcacctattgtgtgttgattacttaagggcagagaaacaggatgaaaatgggtaaataaggccaaatgacttgattaacttttgtgggagaacaacttcaaaggcccacataatttaacatgctggaaattctccccatgcaaacatttcaggagttgactaagatcagagatgtggctactgccacagcagctccctctgtctgtgcatgttaacttaggtaacagatgaactcacagaccagccttctcttatcctagccatgtggacaactgggtacaaagctctttatatattaaagccctttgtaacaatctgcttgccactctgggttcagttaacacatcctagactttggttggtggcagtgaaggtcctggtgaatttgttactaaaattcttcatgatacagcttcccaggagagaatctcaatcctgagttgctggcagctgctaactgaaagacgaagtctctgtagtatcataaaatttaagaatgaaacttgcacaaagctgaatgcaagatggttggggagcagaacagtgcaaataaaagagctcaactcatcctggtagagatttcaggtcccattcctggctacactatattttaattgtgtgaccacaggtgagtaaattacagatatagaacctggcagagcgaaggaccaatagcatcatcatcgttctgacagcacctcccaattagaggtgcaagacctattcaagggctgggcctaggtcttattctttcctttgtccccagcacctggggctgagtaggcactctctaaatgtttgctaagtaaataaaacaatgacaacaatgaatgagtaattctaaagtttcagaagcaaataccaaagtttcttctctctgtgtgggatcacaggttaaaattttgagacataaacaaattcaagtggagcatttgatcttttctcagatctgggaaaaggtaattacttatatttcccctaaagcacatagctgagttggcgtgtgaagtctcttctagctctgaccttcagtcaacagaaaaaaaataataggctgaaaagaggaggtccatgaaaggcactcactcacggtcatttttagcaagaacatgtctttcctctaaagcctccttttccttccatgagaggctggacaacagaatgaatccagtacagccgtaacttcagttgattctctcccatccatctctataaaggccatcaaagggatcttccacatgaccctgtctttccttgcttaggctgcccactaccctcaaaattaagtcccacaccatggcctccataaggcccagaacaaccagcctcctctctaccgctagggttcatttcttgccccccaccaatattcacctctgctcaggtaccccaaatgctatgttgttccaggcctctgtgctgtttgtcttggcgctgaacactacctcatctgtctgccaagcacccagttagactttcggacatagctcaggtgtctcctttgtgaggcttgattgtcatcactcccaggtagggggggtctctacattgtgactacttttagcaaattatgtttgcaatcatctgcctgtcggttttcaacattagactataaagctcttcaagagcaaagttttactccctttagcatcttggagcgtagggaagcgcctggcacatggcaggctcttagtaaattcttcatgacatgagaggggaggaagagagggactttaatgggctgggagaaagattctgaagtaaagtcctgctgctgagtagaggtgcttgagggtagaggcatggacaggtgggaagctgttctgaatgtctgtaatctttcttggagtccgagaagtagaaatcagggctgttaagttgaaatcagaagcatctagttagaatggacaattcacatggcacagttacagacaaagggctctgctatcacactgtctacagagggacagctaacggacatcagagggagcaggggttgaaagagtcacctctctggctccatcctgttggtcccctcccatagtcagactccactctaggcaaagtggctggcctaaccctctccacacatacaccattctttcctgcctcctactctttgcttatgccattccttttgtccagaacattctacccctagagatgtccacctatacaaactccaccagtgatgcaaggcctgactcaaatgccatctctccaatgaggctgccctatcccctcaaagactagtaaataattatctctagcccttggcttgggatttggagacagagctccaaatactgggtttaagtactgggtttgccacttactgtttagttgacttgtgaccttccttgggtagtagagcttcctttgcactctccccacccctctgcccctactctaccataataatcagatgtacttgttcgtctctatatctgtctcccctactaaaggaggagggagcagccaaaaacggtgcctttttatgtcagaaaggaggcttgaggacagccaaggaccgtgtctttttatgtcagagaccaggtctcacctggcacagtgcttgattcacattctatcctcaagagataatgtacacataaataattgcttaacctctctgatcttgttgtgtcacctgaaaggaggaaagataacagtgacttggcaagactgaggattaaatcagataactatatatatatattcgtatatttatatgaaacaatgatttcagagtctagtacagagtgggtttttttggtaaatagtcattcactccctctccacccactcccacacaagttacacttgtgcgcttaagttcgtctctactaaagcataggttctgtgaaacagaggccctgctgttctgcttttgcccctagtgcttagcacaggcccagcacagagcaggtccttgtactccacagcccacccactctcctcaaggttcacgacggtcccctcaaggctcacgaaggtgtcctaagggactgatagacttctgtcaaatattgaagctactatactgagatcttggctctcaagaaaaactattttctaaatttctcactcagcaccatttgcttaacacctggtgaaagctctccgcaacagcctcctccttccaggacattgtctacagaaggtcggcttgaaaagccaaccaaaggtacatcttaaaagggaatgttcaggagacctgggtgtgaatcccagctcatgactttgaagtcaggtcatcttaccctctctgcaactcagctttcctacctgcaaaatggggattaccaaaagccaccatgcaggctgctgacgtctctggaagagcctagcactgaggcaggcacagaacagacagaagctggcaaaacggcagatgaatgaaggaatgaatcaatcaacagagcgcaatgtttagcattacaggatcagaaagaaaaggaacaaaaaaagcatgtgttttcttcagggagagcagggagggcccctagtgcttttaatttaagaggggagaaaatcacttcattgcaaattttagtcggcttcactaccgatgttggcaatttacatctcattacaacaaatgcttcagattgctgttttgcttttaaaaaatttctgaggcattgttctccctcaaacacatgtgaccaaattagccacaataataagcacttgcgttaagagacagcattgtacaatctggcgcagatattttaggtaacaaaagaacttttttcactttgtgggaagagtaggaatttttttttaaaaaagggctttgatccatttgcattcggatattgacacacacttgaggtttattttggggaaaatataccttccatggaaagaaaactctcagctgggtaaaggaagcttttaaaaagtatgaaaggtagtacttgtcttttcattcaatcattcatgaacccattcatcacacaacccctgactgcatatcaagatctaggctctgcaagaggcactggggacccagagacaaagtatgttcctgttctggggaagttcagatttaacatgtgaaacactattatatagcatacaaataactctgatttaacggataagcaatagatttagtgttagaaaaacctggtaaagatcctggttctgttatttactttacctctttaagccctactggctttttccctaaaatggaaagcatgacacacagttacggtctttgtaagtgtttgctggggcaacaaatacatgaaattacaccattttctattcttgttgtatcgtaaactggactaatgctgttctttctgattaacacaaatgtttatgtttgtgtgacttccgggtttagaaatcacctattttttcaaacatgtatgtgtttggacactaaatatcatttctgatttcagctgaaatggaaaggttaataatattcgattcttttttctttctttcttttttttagaaaaaaggactaaatccttttacttctgtaagtagataggaagtttctctgttacaagtaccatcctattttcttcataaatgcatagcaaatcaagtcaaaattcctaaatgcgtacagaacatctgctgtggcacacagaaagtactagatttggcagaatagagatgattttactgtcgagaagtacctgggcaggggaacagcttcataacaatgaaggagttaaacaaaggccttggaaagagactagggaagatgcctccggagctgggtaggaggatccccctctgtggaccttctcagaccctctcagaagtcatcagctgctctcacctgctgctgtagcgtgcctctgtttcttagccccattagtcttccagtgaaagcagagacaaatctggtttcattcctttggtgagaatctactaagtacctcctgagtgccagccctgtgctaggtggaactgagtgcttcactgtccagcagtggaaagagacaggcagcagactaccaccagccatgtggctaacaagcattaggagaaaaactggggcagaagcaaaggagggggtgctgcctctggaggagactaggaaatcttcataaggacggtcaccaacttctgtgttggggcttggaggatgagaggagcttgttgggtgtgtgaccctagggtggggtagttctcataaggtgaaggcaagtggcacaaaccacaggctcactgtgcacaaagggtgcaatgtgatgatctgcatgaatttggggagggggagatcactgccggttaagggatcctagaaggcttcaggaaagtggtgatctctgactggggctttgatggatgcgcgacatcttggggaggtgggggagtagtgaggccggggttcttcaggtcctctctctctccattttctgtgagtgagggcaggagcaggcttcgttgggcagaggcaggagaaaaaaattctagcatgaatcctggattaggtgagatcccagcagctgacacagatgcctccacagtggggccataccctcggggaatctgaaccacagagcagcagagttgaaatggatccgagagagccccctttccaagggggagaagcccacccaggaagaaagaggtgaaaaaagcaggcccaggtccccagtcttggaggtcaaggttctccccgactttgaggaattgcagatgcccatttcaaatgacatatttgagaaggaaaggtggctgaaacctacaaaagtcttctttgttaagtatcttatatcaaatgtatctctctttttttctctctgtagcatttttcagcccactgtcacgtgattgtttgtttaacagctccctgactagaacataaacaccgaggggatgttcctgctatatccccagcacccagcgcaatgtcctccatacagaacactcactaaacacgtgtttagcgaaagaagttaatccttatggtggtcctacaaaatcgatcttattatctctgtaaagactcagagtagtaaagtaacttgccagaagtcacataggtggtgagtgctcaaactcagggttgtcagattccaaagacagctctttccactaccctacccctcctcaatgaactgtactttccagagcttcttgcctaatgctcactctgtgggaccctcagctcatctctgactttctctgacattcctagggggtctgtgaaaagccccacaatcatgaggggtgcggtggaaggggaataggttgtcacctctagaagctctgaacttatcctctggtggccagggaaaactggactggttcttcatctgtggttcttctacttctctcctgcccaactatctgtgcccagagagtatccaaatggcagggtatgtgcagaacgccctgtcaaggaagcattgaaggcccacacatgtattcaatgcatgtaaaatggaccacagttggctgggttggggggctaaggagttgtggtgggaataagtggggtgggcagcataagggctgctcccagtttcctgagggaccactgtgggcacagtgagtgcctgagggtaggagttatgaggaggcaaagtttgatcacatggtggatgtctgcccaacaaatcaatccatgaccctgacctctgctgatactcccttcaggccatgagcccttccagagtagggaccatatgggattcatctttgctaaatggctgttgattgatttgcctgactcagaggaaaatagcaactcaggagttgaaggactgcaccccagcccactccaatggggaagtgcccccatgaaccacctgtaggaggggctggggtagttctgcttgctctcatctatgtctgcaacctcatctcttcctgctacccagcacttcactgtgccgtccaaccagaactactttcagttccttgaataagccagcctctcttgcaactccaaacctttgtttaggctctcctgttgcctgagatagttccttaacttggggcctcctgcagccacccacaactctcctaccccagccatgtaaggagctctcttttgtatcctttcccaacatcctgagagctcgggaccaaagtaaagctcaccctgcatcccaactgtctgctgttgagactgtgacttctttaaggtggcaaggggggcttaacaatttgatttctccgtgcctagcacagggctcggaacagaggaaggatccaataatgttccctgcacaaaaacatttccctacggtcagagctatccaataatgagataggctgcactggaaggcagtgagtgagcttcttgtctctagtggaatgttactggaggctgggtgattgcatggcagggagacagcagaaagcttcttgtcctgtataggaggctagacgaggtgaactctggggttccttataggactaaggtcctaggactctaagaattaccccccacactcagagtaccccctggagcagcaagggagggtatggccagcctctgggacctgctgaatcctggcatccaaacaaacatccatccatgttggctgaacacaaaccttccactgcttcatgatatagcattcatgaaatcctatatattctgattccacatggcatagatatgtcttttcccctctctgggcctcagttgtccatctataagataggggtgaaaggctgaactgggttctctctaaagagacaatttctaagaaaactccaggaattgtccaattggtatcttgaggccatgttgcctggtaaggctgaaactatgaagacatggtgggcttttaaattaagcaggaaatattcatctaaaagctcaagggtcctgcagtcacagaatgcactgcagtactggatggtctaatggccagcaatgaaggcctaatcaggaggcaggcaaaagggatggtgccacagaagcacatggctaagggactctgtgatcagactgcctgacgcatggcaaagcaagaggggcctcagttttgaaacctggttctaccctttcctgggtgtgtggcctcaggcaagttacctaatctctctgagcctgttttatccactgctgaggttgttttatatatggaaagtatttagtgtctggcccaaagcaggtattcctagaaaccaggctttgcctgtaatgaacactttcccacctccatttcctgcctggcaaatccaaaaaaaacataagcttgtcacatggcaatatggaaggcaaaaccctgctctaatggagaaacacactgctattctgacaatggggaaaagcctaacaacttcctctggatgttctaaatacctaggcagttgttagaaaagggacagcctggagttgtccctcaaccccatccccactgcccccaggaaaacggagtctagggagaaaggggaaggagggtcctgaattgttcggccaccctgaaatcaacttttaaaataatctgggattattttaaactgtggctacttctgatttgggcaacagttcaaaaaaagtccttcaaagtagaagatgactgatatttttcagacaaactactccacttcttattactaggtctcttcctgccatctgaattaagcaggatacaacagtttttgaaactgccccaccactaactctaaaccggcaggcagactgtgggcctcttaggccttacctccacaagggagatgtaaacatctaactagacaaaatggctcttgtccacccgctttgggcctttctcaaagcccaacttttttatagtactcctgctcattgtgaaaatgaactgaggctgaaagagacaggaaagagctctgagataaacaggccccaagaagagagtcctggcaaagagaagactgagccacaactagtgatgtctaaaaaaatctaggaggtcaaatggggtggttgagagctagagatgggaagatggaattctgcccaggaaaagttgggcgtggtaatggacaaattctataagctacagaccagtgagtttgaaatcaagtccaggcatggttgtaaaacagagtgttcaaatatgatttctaaggacttacaaggggaaacaggaaatctctaggtgtcatccagggttgaccaaagattaagacatcccagaccgtcacatctgtgttctgctgtaggacaatgggtgcctatgatgtgccaagtgctatatacacattttctcatgcacatcttcaaatgattctatatcttgatgcagtacctactgagcacctactatatgccagcctccaggcagatgactttactgcatttattcatttactccttttttttttggacagagtctcgctctgtcgccaggctggagtgcagtggcatgatcttggctcactgcaacctctgcttcccgggttcaagctattctcctgcctcagcctcctgagtagctgggactacaggcacgcgcccccatgcccagctaatttttgtatttttagtagaggcggggtttcaccatgttggccaggatggtctcgatctcttgacctcgtgatccgcctgcctcggcctcccaaagtgctgggattacaggcgtgagccactgcccccggcccatttgctccttttaagaaccataatagctgatactatcattcactctcttgtacagatgaggaaactaaggctgaggaagttaagtaacttgcccgaggcaacaaaatttgaatttggaagagctggggttgaaaacctcagtatttctgacctcagagcccattagggctcttaatcactgagctggttctcctgtctgtatgtagtgggctttaagatacctagaggagaaaacagacacctgagaagggttaaacaaatgtgtatgaagttacacaggtaataaattaagacagctgagattcaaacccaagtagtatctgttgctgaagcccaggttgtctccagtacaggagaaaaccagcaagaagcatttggctgacatcagctgccttttctaaggcaccatcagagacctgggcttaaagaaaccagttcagactgcaaaggattttaaagatcaaagctggtattttagcggaccttggacagcacacaaggcacaaacccagagggttacagaggtattagtgatccagctctaaaaagttgaaacagatatgcaggccacaatggctttctcctttttcaaaactttcagccagcttatgatctagccaacaggacattttctcttctttttgcattctcctctctaaaacggagataataatccctacctggcttgcaataagactatcggaattgtccaatgagataaaaatgtcaaggtgctttaaaacctgtaaaatgccatgcacatgtgaattactgttattactctagttatctatgcctcttctggttagaattcatcatttttgcctatattccctgacaaagcacacacaaaatctaaaaccatcatctgcctccctcctgcaattagagcactgattttatttgcctggtgtcacactgcgtacatatttgtgttccctgtgagacttgtgtgcatcctgaaggcaaggattatgtctgctcctctttgtattcctcacagagcccttgagagtcttatttgaactaatgttacccgagtcacaccacaatgaattatactgtctaagtggtacttacagtgtaacaaactggggaggacaccgtagccttggactttgccttctaagaacagggaatctagctgaggagaaaccaagagagaccctagaatttactccattctcacacatgggggcttaccctcccccaactgggtctctattgttctgcttcccttcatcccctaaaattctctgtggctgccaacacccggtttaaacacaccattctaatctacttgtgcattgttttttaaaaaggcactctgtcttgttcattacgttattcccagcacctaacccagtcctggaacaaaggataccctcgataactgttcactgaataaaataaataatgaatgaaggaatatacatagaaaaacatctgtaccttgtacattggaatgtcaccatgctttttgcatcctcggcatttacttatttgggggaggaggggcaggaaagggagaaaaaggaaaaggggactggcatttattgaacacttacaatatgggggtcacggggcaaaagtttacatatgcaaattacatatgcttccttatttaattttgacagtggaggaaagtgaggttccttcccatcagaaagggttgtttaccatgctaagatcacagacaaggaaagttctgttttacagagagagatgatatcctttgtggggagtaaaggggatggaggagacacccccatgttgggaaaaatgaagtctaagagctaaagaaggccatacgggtgagggtctagagagaggcacgcaggaccaggggtcagaagacccttaggaataagccagtgacactttttgggcttgtttcctcatcagcaaaatgacggtgacagtctatagcctaagttctttcacaactccatgcctccatgttggaatacttcctgttaaatccatcttttcttgtgtgtggaatgaatgaaagaatgaataaatgtacaaatgaagacgtgtacgattcagtgaagcctctgaaacatactctcttgctgctatcccccacccttgggtgtggctccacctttctgaccccaacctttccaaggtgcgccattacaactcctggctgctgacggacctgcttcccactctgagtccccatcagtctgaaaagaccaggcggctgctctccactaccatctaccattcgtaggaccccactacctcggtgagtaaataatgattcttccagacaggtagatttcttttgaaaactgagcacctcctgacctgttggcctccctcgtctctgaatttgtgtgaatgatccagcacccaagctagacaaaggcctttgagctaggcccctagctgaggtggacaaaaaatgaaaatactcaaggatatgcctccaggagcaacactcaaatgaggcccagggggcagagaacggcaaagcctgggccctacatcaaccctaacccaggacatgtttctcagagggcaactgaagccgagagtcaaacaagggtctctcattcgctttctggttgttctctgccttcttagtggtgtttatagatcaggatctgttacagcaaggggatatcttaccagactttccaagagagacttctcccttcagacgctaatctctctcccagaactggcactctgcgttttaataacatgtttacctccatcactaccctctccctacttcccaatgtcttaatcttctttgtatctccctaagttcctaggctcagaaagcatttggtcaatgttagctgactgattgaataaacaaatgaacaaacatatataacccctcttatcttcaatattgtaagaggatactgaggcagagaagttagttaacctgcccaaggtcatatagccaactactggctgggggtgcccgagttaaaagccaaagttaaccctgtcttagctcctccattacatgatgttgaacaggagctaacagtaatcaagcattaacagaatgtcaggcactatgcggtgtgtcacaaggctgtaatattatcattcccattttacatatgagaacactgagggtcagagacatacatgctctttgcctaaattgctccttactctccccatctactgattcctgtttgggtaacaaaaattcatcattcaggcttcagcctaaaagttgtttccttcaggaagccttccttctctgacccctcaaaatctggtgggtaatcccctctgctgtcccacagtcctctatggttttgtccctatgatggcatttatgtactgtgctgtcattgattgtttcaggatctgttcccctcatcaaactttaaactcctcaagggcagagggcaagggctgtattgcaaatatactgaattcttacactaggctaggtccctggcatgtagcaggagaccagcaagtattcatggaagaaaataaggtcataggaaaggaaggaagaaaggaaagaaggacatgagcttcccaaagccacagagttgggaagtagggaagttgggatttgaatccaagccgtgaaaacatacaacctcctcttaagggtagagatccttttattttattcttgcggatttgtcttggaagttggcacattagcatcctcctattaacatgtgttaatcaatagacttttaagctttcactgatgagagacagtgggtgtgattttccaggatgcctgtagccctgagaggatagggtgggtggtctatgcatacttggggctccagttgatttatgttgagtccaacccattgtaatgatgatggtgactcagatcagggaagagctagccactggcctgtgcaatggccttcaaggcctgtgggatgggagagcctagaaagatcaagacactgaaactatgcttcaggtcaagtttttctacatgttttaggactaaaagaggcatataatgatgtaaaatgcagggtgtcttaccaccccagaggcttaggagtggtttctagagtttaaactcagttcataatcatgaaaaacaggtagtttccctgggagttgaattaagtaccaagaatttctgtttttggtgtacttccccacaagcccccaagaagttcataaaaggcatagcatacaaagcacactgaaaatgcaaattattcactttaagattgggaaacattttttctctctgaaaatttcagttatccccatcccccatcaccactacaagaacaatacagcttttacaaatttttacatttatgatttctctttgagattttattttaataaagaactttactaacttttgaagttgcaaaccatatgcgacttttcgtgtcactgtgaacctctgtagactatgatttgggacaatggccaaggcaatggtagagttggggagtggacaaagtccagcctatgaattgagtgactagagttgagacagaactctacctctgcctccctaagtaactctggggaagtcccaatgtcatttccttttctatgacaagggcatgaaaggcctctctgctgacttcttggaccacccaaagatctactgagccactaccttggggatatactttaagaagcaaatgacacctacaaatataagtaaattagggtaagaataaatcaaagaagaatgaagcttcatatctaaatatattatctagataatgaaaaccttcacaagggcaaaattgtattttatttaaactttggggatatttctagactagattaccaccttcttcaagcaaagcacactgactcagagttattaattactgtcttcaggggctatggaggcaaagaacttgtgttataccgatttcctcaatattgactgggctctatcttttacagttctggattcttatattctaaaagcatttttctgtctttttctctctggtaagcagtcatttcttccggcagtcaaagctgctgcctttcaggtttctcgatccctgcttctaaaccactttagatcagaaaacctgattagttaaaatagggtgcaatataagaacctattaagttctatgagcaaaccaaaggagttttatacgtctttatattcatcttcctaaggtcatgtgcctccctgctcaaagctttctaatgctttccattcctaccaaaacaagtccagacatcccaggctggtaaagttttcaagtccttccatcttctgtcctcaaagcacatttgcattattcctcttagtgtgctccaggtatttgcccatgctcaccagtgctgctcagcctcctcttgtgccttgaaacactgcccaaccttcaaagctcagtttcttactgaagtctctccatgccctcagttacaaataacctctccaacccctgaattctcatatcattttgtcagcattctcctttggcatttatcactttctgacttaaactaatacatgttgttaggatcatgtctacttctttttactatcctgaaacctccttggagaggttccctacgatccctgttactgcctcctgctgaatgaatgcataagggactgagcagtgacaaatattttgtcagctcttagtctctgacccatgttcgccaatgttcccatagctgaggctgctgcatacataagctcctaccagattcactatgagtggggagtgactcttccttgaggtaactggtaagccaagagtctgtccttccctagcctcagggcacttggtctccctctcccctttcccttcctggaagaggatctgcatgaagtatttcacccaagtggagtggtaggtgacctgctggggcactcaccgctgccaagccgcaggagcagcacgtcctggagcctccggttaaggtcacggagctccttcatttcagacacaagtgccccgtactccttgagcttcttggcctgttgtaccagctgcctccgagtccgctccagctcctgctggaggtggcgcatctcttcctgttgctgctggtagttgcgcagcagctcctcatacagagcccggggcaccacagcatcttctagactgtccatgtcctctgtgcctggcgaggcctccacgaagacctcttccggacacgtgctatggcccaggctcaggccgttctgcttctctagccgagccaccactgcctcgatgctcttgtgcgccacttcgctcggcttccgcccctcaggtctctgtgtaggacaacgagaatcagttcaggcaagggcagctgggattttcttggactgcagatcaatatttccccagacaatcctaaaatcacagaatcacagaacatcagtgcttggagaaacctgtgcaaacacttagtcaaagcccttcattttataaatggggaaacattttataaattttataaatggggttccgagtggggaaggggcttgcccaaagtcataaccaggacactggtttcccaggcctgcactttttccttttcaccactctgcctcctggatgcatataccatgaccacccttcccaactccccaggccccagcccacccacaatgcctaggcagtggcttgctcatgggggtgttcaatatgtatttgtggagaatcagggagaaatgaggccaggccaagtgatcccagaggactcacaaatgtcttcaacaacaaaaacataaaattcctcccctaaaggcaattcaccatgtaaacttttcatcgacaatgctttagatggaaaggatgttaaaaactctaatctactctaatctagagcagaaaacatgtcttattttctctgtttctcctctgcctactcactcagaactggcactcagtaggggcttgaaaaatgtttactcaactgaaaagttcaaagaattctagcattgaaaggtactttcagtttaactgcctcatgttacaggtgagaaaactgagggtcagagagttcagggaaggactacacttagggtcacatagtgagatacaaacagagccaaaaccagaatttggaatctaacttccagtacaaggctccttccagactctcctcagcaagacagtggatagagagaagaaagttcatttacaagagaattatccaggaccccctccagagcttggggttccactgcctaaggaaattctagctcaagtagctacagcttctactgaggggcagtgagagttacaagatcaaatgaattcttcactcagggcaggagggttaggagctctcctgactggggcatgtgtaggaagtgcagacaactgaggacatgagattccaggcagttctaagtttcaggaaatttaaggaaaaccaaaccaaatcaaacccagcccaatgaaaccatgactctgatattgtgttacatgacaaaatcgtaagtcgttttatctgctgagataaggtgctactagtgtagatgaatttatcatttatctaaagtgatcgttacaatatgtctgcgtcactataatgtgagacccctggaggcaaggaccatgtctggctaatggttccaggtacgagcacagggccaggcgcatagcaggagtacaatgaatgccatgaactgaactcagctacattccttgggaacaccctcaaccttgtgaccaaaatcagaccatggtcaatgcagaagacatcccacttccttatcgtccttctcccttcctctcaggtatctactgcacagaaaaaaacagctagcttgccgaacaagattttcagcagtttccaaagtgaaggctggagaccaactggggcacacagcaagaaaatgcaacctcatgcaaatgttttcatctaacccgaggtctcacaaatcccttctgtgaacctcgtgcacttcccaatgagtccagccttagctatctggggcactctgacagtgactggccctaaacttctccccaagaacatctgtttaacgttcttggagcttagcagtgacctctccagagctgtgggccaaggagaaacacaccgttccaaacctccaacagcgatgacactgcacagactgtgcaaacaggaccaagcttggtggcacagcatgaatcagggctctctagaaagttggccagcaaggcaaatacacacgagttgtcccacgctttcactaccctgaaaaaatcatagcctgtgataccaggggacatttacatggggagaggaagccagactgaaactctttagctacgagatatctgaaaatgctccagcatacctccaaagaaaggaaagattttgttaccttgatgtgtctaagctgtaaatcttcttccccataatctttaacctctccatcttcttctacatgattaagagaaagcttggggatttttattttcttctgcatcacactgttttcaaggtcagatttgtcttctaaaatgcatatcaagagaacaaggttcatcatgagttaaaatgagtcattatgagtttagaatgcccaaaacctcaaatgctagaaaataattgaggccagaccagttaaaaaggaaaaacaaacagactcaaggctggttccctcttgcatgcagggatcctaatagcagtgcagatctaggaacaagggtgtttgctaaaagcactgtcatacaaagtgttgaaatagcagccagtgaatttgcttaggggtttctctaagtacatcctaaagggtggccttttatggaattctagaatcttgaattggaacagcccttagattgctatctgatctaaactaaaatggcacatgaatccctcaactcaactgagatctttctaagccaagtgtcttcccaggagaacttggtgggtttctgtcagctcaagtgccaatagacatgagagagcttatagctgatagggatgtaaggaagggcaggggtatctccacagccctgacataaggcaggctgaggtaaggcagacgggagaagaataacatttatcccctttttactggtatcaaatctcagcatgactgagtttgagggacctcagtgaacaagtggtccaactcgctcatgttacatgaggaaattcaaacccagaggatggaagaggcttgcccacggcatgagtctgaggaacagccgggagtgggaaagaggcctctggcacctcgcccactgcttacgtgtgctcacgacacatactgaatgtaaagtgctacacaaatataaaaggatattatttctactcattttctcattctttaagctcaacctaagataatctgtttctttttctgcacagatttcaaactggactttccagatttgtctctcactggatatgttcaaaaataaaagttcaaacaagagggctccagaggcaaaaatctgaatcatctctggactgtccccttgtggtaaaatactttgtgttcagggcttaaactgacactttagagattgctgtttctcatagtcctcaaaggttcccactggtgtatcccaaatgcgttttgtagcatgttgcccaatgttggatgtagcatatggccaggtagttagttaaatccagtctttaagggttttgtgtgtgtgtgtgtgtgtgtgtgtgtgtgtgtgtgtgtgtgtgtatgtatttgcatgtgttaaacatgctcttacactgttcccaggccaggcttctctcctacaacttgttagtaaagctgagaatgcagcttataagcacataactattccagaatgtactcaaatgctgaatcttctcaaatgctcttagggatgaaggcccagctggtcagaggtaggagtctagtatcagagacttaagtgtgaacctcagcttttctatgacaggatgaggacaggtaggtaagggccttaatctctctgaactcaagtctctcctcataatggaggttgtgaggatgagagcaataattcacgcaacccaccgaacagtgcctgctacacactgaacattcaatggatggcacaatataattggtattatcaatgtgttctgaatcattttcttctcttaagcataaagtgaatagagatttaattaaaacaacaacaacaacaacaacaacaacaacaaagaaatgatttaagtagggtaaggatgataaatgaactgctcagaaaaaaaagaggtggtctttgttaataacccctactgatgaaaacggcctttcccactgagtggaggagcaatccttgggttcctattttcacaatggctcattcttgcactcattgtgcctataaaacacatccaatgggttaggcatgaacaacaatagggactcagggttttctaaaagagcaacagtttccctcctacaaatcattgctgacttctaagtcaaaaggctgctaaaatgtaaaatctaaagaaagtacttcagatgaaattatcttgcaatggtgtttttttgtgtgtgtgtatgtgtgtgtgtgaaaaaaacagacaaaaagagagaaagagagagagacgatgagggtggtattaggatttctgaatgtgttggggcaaagctcctggactagtcttcagtttgacaagttgagggcaaagtctgacatgcagagccaccaattagaaatgacaagctatgctatgccttcctgcgctgaaactctgtagctcaggatcatgttagtgtggagaaaagcaatcgttcggactcacaaaaccatgttaacatctggatggagaatgaacctcagatcatccgattctatttttcaaaatgcagatgagaaaaacaaggttctaaatggtgaagtctgtgcatccatccatgcaactctcaggcctaggaatacaggaggggcaggatgaacagggtccccatcctggagagctcactgttgtgcaaggtcacagaagttactgtcataacatgaatgtaggagaactctgaccacataatccagttccagagctttgccttctatgcctcgacttaacctttactgagaatttactctgtaggatctaaactggcccgggggacacagatgaacaaacatccagttggggatacaagataaaaacacaagaaaagagaacccaagatctcaaatgctgaatttgaataagggagaagtaactgctaaaggattttaggagcatgggagatcacttccgtcagtgtaaccctggaaggcttttgaaaggaggtggcatttgagctagactccttacttgctaggtgatcttgagtaagttaatttacttctctgagactatttcctcatctatgaattgaagtgaataattcctactcacgttgcagaactgtgaagattaccaattctatgtgttaaaaacttgagcagagtgaatggcacttcaacagttggtgctcataaaaggatagccatttaaaggatggtaagaatctggactacacaagaggggtaaagaatagaagccaaatggggaagggggggaaatatttggatcaaaatggttatgaaagatggttcagttataagcaggagggagaggtgagaaggcaagaaaaggtggttggaactagaaaataagtggccttgaatgccaagttaagaagagctgaggctcagtgtgcagatgtggaataaactaggcgtcagacaacctggattccaagtccagttctgtcgctttgtaggtgtgagatgtcaggcaagctgctacctcactgagcataatttttctctgtagaaatggagatacaatatctacctcaagtaggatcaaatcagctcagtaaatgttccttgaaaacaatagagccccgtgcagacaaaggtgcagcggatgacagagctcagcaaggactgcctgctggcttctgctggcttggggcttggggcaggcttgcttctggaggtagagacctgcttagctgcctaagatgggtgacactccccatctgatgacaggaggcctcattcccccaccagctatactcaaggctctaagctcttccatctaattagaatgcccttctttcttatgtgctagacaaactctgcttagcttccactcatctcctccctccctctcaaagatgcattacacatctacacatcctacctaccttctttgtagtctattatcttactatttgcaattatctgcttaaagatcttatccactggcgtatgagtaacctcatcagggcagggcccatatcatagaactatccatacaatagagactcatcaaacaaaaatgtttaattaaagaataataaaaacaggctacaccaatgagtatatgaaaggagctcaacatcatcaatcattagggaaatgcaaatcaaaactacaaggagataccactttatactcattaggatggctcaaatcaaaaataaaaggaaaataacaagagtaaagaatgtaaagatattggaactctcatacattcctgctgggtattgtagaatgggcagccatagtagagaacattatggcagttcctcagaaaactaaacacagaattactataacccagcaattccgctcctgggtgtatatgcaagataaatgaaaacatatacccaaacaaaaactcacacacaaatgttcataacagcattattcattaacagccaaaaggtggaaaaaaacccaactgtccatcaacttatgaatggataacaaaatgtggtatacccatacaacagagtattattcaaccataaaaagaaatgatgtactgactcatgttacaacatggatgaatcttaaaaatattatggaaagtaaaagaagccagacacaaaggccatttattgatttcatttatatgaaatgttcagaatgggtaaatccatagagacaaaaagtagtttagttgttaccaagagcagggggaaaagggcaataaagagtgactgctcaatgggtaacacggatttattttctttttgggtgataaaaacgttccggaattaagtagtagtgatggttacagaactttaggaatataccaaaaaacactcacttgcacacactttaaaatggttaaaatggtaaaattcacattgaatgaaatatacctcaataaaaaattaggttaccacttgtggaatgtctactacatgtcagatacctctataaagatcttcatataaattatacctcacaacaaccttgcaagtaggtattataagccacatttttttttccaaaaaagaagaaatgaggctcaaagaaacaaaactctcctcctaaagtcacccagctgggaaggtgcagagccaagatgtgctatagatctatgtgcctcctaagcctatgctttaaacacattcctggaacatggtagagccagaataaatactgaatgaatgagtgaatgacagctacagttgaggacatctaaattccccagcctaagctcaaagcagaagaccacttgactcccactttcttgccagaccacgtcctctatcctcagtaagtctccagaaagcagcaaccatcaccaggcacaacagaaacaagttgtggccaaccctcagggcttgaatgggttctttgaaaaggtggctgaatagtccaggaagctctgaggtgtcaggaatgagttcaggaaagggacagaagcagatagcaccttgattcacatgcctcttgacctggatcctggctgcctccatgcttggccagggggatttcgaggctcctctgagagttaaccacctcctggctccatcctaatacttaccagtctcttcctggacccatgttcccagagtgagggtcgggaagtcccaagtcctctgctcattcttttctgcaggcagtgaacatttactgttcctgttttgatttcagcactatgctaagtagtccttgtgtttttggtccttacaacccagtatatgataagaacccaaccaaaatgcaaggtgtgacttcgtgagagacactggcttatatagtgcaaatatctgctctctatgccatcctaaccctaatcctgagttgaaggtatagatacctcacatccatagaagattactgaacattcagtgtcatcataacaaatggaagaaatggttgggagagggtggcccagtatctagcaaaaacagtgcagtcttttgaatcaggtggtcctaatttggaattctggctttgctacatactaactgtggcagcttggggtaagctagttaacctgtctgagactcagtttcattaccagtgaagtggggataataaactcttttccaaagagatagtgcatgtaaaagcaccaagcacagtgcctttcttgtcatagatgttcaataaatagcagctgttaggctacccttgtgtattacctgtttgccttttgtcccaaggcaaagagaaccactgcaggtatctgacacagactgagacatgatgaaagagatgttttaggaagattaatgtgacagtggcaagcaagacggataagacgtgaggaggagacagaacacagggtgacaagaagctgtaactcttgactggtcacatgaatgaaggtgaatggtggtgtggatcatgtaagacagtaaatactttatgtggcattttaatgtgactttgggatatgcttctggctttgaattccaagaaaccacagaagaaactaggaaggatgaaaaagctctttactcagccggtctgtgcaactactctaaccttgaggccaaataatcagttttagtgtaaacaaaaataaatgtgcagcctctgaagataaaatcaccaatcttcacttctggactcttttatgtccagggcaagggaaaccaccaaagatttgggcattatccttttcctcctcctttctagctactacaatgtcagctaattacattcatccattcaacaaatactgagtgagcacctactatgtgccaggctctgggcaacattccttacaaactcactatatttaatccctacaataatgctactgaagcagaaactgaggctcaaagaagtgaagtggctttcataaagacataaatagcagagccaacatttcaaatcaagtctgtttaatacaggccctgttcctatcacctaattatcctacagcaacaagagaaaaataaggaagttgctgtaacttcctcaaatgaactaaaaggcacatgtaacatgagtatgtcaatataacttcctaaagtgcctgcctttctcccaagatcttgcctacaccctaagagaatactgtgatgaattcccaagttgaagtaaacactatataaatatgacctgttgccaaactcctgaactacaaggcttatggaagccacaaagctctaaataatgcccaaatagggtctctactcaaagccacaaagagctttcttgtaaaaaaaatggtaaaaactgctattcaaaaatatagaagaacttggtgttattaatctgaggaggataaacattccattaaacttactactggggaaaaaaggaagcatgctggtaataggcaaatggtgttttagaaaaaacaagcaggtgacaggaaacccaatgcaagtctgtattcaaaagtgaatttacccatgaagaatttacagtattattaaaatgggagaaattttgtcttaacttccatttgacatataatcaggctgggcaattaaaataatccaatgtcagagagcctaatttggtatgagtttgttagccaggatgaaattctgaaaggctacacataaaatgctttgtaaaggtcttataaatatctatatataagtttaaagtttttcatctatacaaaaatcctgtgcagttttatgtttgcattaaaaacagatatgccacagaaaatacaaacacagtgcattctctggccgatggtgtttgtttttataaaatccaaggcagacaaaattctcaagtttcaaggattgtacccagccaagactacaaaaaaaagagtgccctgctgtggtgttgcagaaagacatcaggagacaccaaatcgaggcctgcctctctcattaacttgtttggtgattagtcctctcttgattttcttttctgtaaaacatgaagactacagtagaaaaccttaacagatccatccagctatgtgaccgctggccagtcacagggacttccaggtctctttctcagctgtgtaatgtagggtaacagtagatgagctagaagattcttccacgtgggcatgtttgaagaaatgccctactgaggccatccacatagggagagaaggaattgctagccaggtttcagtaggtctccttgttctcactcccaccacctctctggccttggtacaggactggggcacagaaaaaactgggaagttcattctatggagccatttgtctagctgcctccatgtgcctcaccagggctgctgccaacacaataaatgcccccaggatagggtcgcagaggaacaaacagggagggaaatattaatagtaagcctttcatgcttaggtcaagtcccaggaggatttaaaacacacacacacacacacacacacacacacacacacacacacacaagttaaattttaaacttgtatgctccttccaagtgctcgttcctctaagtcattcctttccacagtgggcagtacccacaactaagcaagtcactgttcttctctcagcacctattagtccactgtagttcctaacagttatctatatttaatgagaacctactatatgccagatatttttccatattatcctgctaaataacacagtgggcaattactatctccatgctatagatgagcacctggaactcagagatgtgaagtaatctccccaaagccacacagcttctaagtagcacagtcacaattttaacccagactatgtaacttcaaagcctgtcctctttcagctctctaaaatttcctcttcagtagttaaggaaatgatctagaagtcatctaaccaaactctcccatagtgcagggttccatcctaaaatacccctgacctgcttgccacctttagtgacagggagctcagcaccatgctagaagccctttccattatttgtctgctctctctgctgttatattgctcccaccaatgcctgtgaattccattctctgaccccaactctgctttcaagagcaaggctgatccttcctctgtggtgcaaaactgagaaaatgaaaattaccaaaatatcatcccattcaaatcttttcttttcctgcttatgtatttagctgtcctatcctatgtctgaccaatgagtgaaaaggaaaaggtagctgctatatagttaaaagaaacccaaacaagcctagttctaggatccaaagacctctcttctcatttggtttccaggacacctatctctgctggttatcccctgattctaagtccatctgttagactaggaaggctgtttctccccagtcacttttttttcaggctcttctttaactgtgcctttaaaagccgatgttctgcccttgcacgcttctctcactctgcactctctcccactgtaacttcaaaccttccttagttcatgacttccagattgagatctttgacttggaatgctcttctgaacctcagaccacatgcctacttgctctcctgacatatccacccagatgttccatgggcccttaagattcgacaggtctcaagctactcatcattttccctttcaaccagctacacttccagggttctcctcgagacagggaggcccagatcaccacatcatcatcatacacattattacaaccagtcagttactaagtcccatgaattagtccctccttccttaaaatatctcaggtccaccatgaccaccaccaccttagtttaggtctcagaattttggactgaactgactcatatttatccacaagtccagtccatgtgggaagacttagcccactgcctggcacctacagtgttcactaaacaactgtttgaatggctctcttttcttgggtaaaacaaaaatctctatctcacaaggatgtagaatatgtgcactgaacctggaaccaggtgagtatttataacatatttggtagggaaacacagtgcttattcctcttcctgcatttccctggagtataagactgaccacctagtataactcaatacttgtggaacttaaatcaaccagagaaaatgtctccagattacgaatgttcttctggtagaaagagtacacacaacttctgtccctaaggagcttataagacaaagcaggtaggcacactagaaagagaattggtcttggtgtcaaagaccccaatctgaattctgctttctggatgtgcttttaaaaataaaaactggtgtgctcttgaacagcaaaacaccacataaaaagcaacttgcctgggacaattttttatttctgcttatgaaccagaactctgaagcactctgtagcacatactatttagctgtaaaaattggtggttgttgaacatgagaaatcacattagactgaaccctcaatggttaacatcccagtagaatccgcaacagatgacagcaggcaatttccaatctttgctccaatgtatatcagcaaaacatgtcaaaacctaaattaaaagttttcactcacttttttcaagaaaataaatccttttgttggcagtttcccactgatgacacgcaacaatctttgcatatgaaatcggctagtcctctgcttcactgctaactttgtagaagttccaaagcatttctggagcaaatgatctatttggactaacaatgccaagctgggacctgagccctgaatgagctaaaattaccaaagcaataagaacatggctttggaagctatttcccccaagtgtggggtttcttctagctagttgagggagtgataaagaatgttgacttcttccagatgaacaaagttgaatgaaaacttaaaatcctacggcaggtttctgttctgaaaaacaagctgctgctgcagaggttcctatctcccctatttccctctcctcaagcacaaaaatgcacctgtcttcccaaagttgatgagttcaacatgggcacaccagtgcagactatatgctgggcactgaggatgcaggcacaaggaagccaggcccctgtcctagaggagttccctgtcaggcaggaagagaggcacattcatgactaataaaaacaagacataaaatgctacaatccataagcaaggcaaaaccaaagtgaaaagagagttctgaggagggagagagtctctcttgggcgcagagggaggaatagggactaccactgaagcaaggtctccaaatgtactttgtccactcctttatcacaggtggaggggggctggaccacaaacttctgtcacatgtctaccttccccacctgtaggtgagctccttgcaggcagaggccccatatcagacaatgattaatccaccttggctggctcaaaggagtgcgagagagtgtgttcacagaagagtaaaaaataccataggtctcagggaaaggggaagagagagtgaggctggagaagtaaggtggggctgggatagagctggtctaaggagggctatgaatgccaggctaagaaactaaaacttttttcagtaggcaatagggagctacagaaggttctaatgagagcagtcaactaagactgtgttttagaagattattctaaaagcaattgggaaaatagatcagagacatggtaatcaattagaagactgcttcaatagtttagataagagctgatgctgacctgaatgcaggcagtgatggtggagctggaaaagaaaaacttaaaagataaactgcaaagcccaccttgaattggtccattctctgtgtttccccagtgcctggcttctacctttatttagcacttactttgaggcccccaaattacacactccctgaggatgatacccatttcttttccatcactccctcccccacagaaatcctacatagcaggacatgaaaagtcaacgcctgccacccctgggtcgtgctgtcatttcaatcacagtacctgagatgcataggtgcactggtatattcacttaatacagcactgggcctggcatacagaaagcagtaaggagacatctgaaacaaaaaaattcagcacactcaaacaacagtaacagagcacaggtgcctagatagaacaacttaaaattttagggctctaggcacagagaaaccagtttgagcctcctaaaaaaaaaataaaattcaacactatgagccccagtagcaggctggattgcagttagatgatggtgagctctccaaatgagtagttctcactttcacaacctgcttggcaaataaatgagagtaaagagagaacagaggtcaaaggtgagtcaaactttgagttatgtggaccctccaagagggacagccttagtgaagatttattcaagcaaatgccaactgaagagataggcgggtgggggacagctgtgtgtgctctgtaagagggaggatggtaatggagaaagagcagaatgggcttgaaaactcagaaactaaaattatactctggcttgaaaacttgccttgagctgtaagcttcatggacagtttttccatttcctttcactccttccaaatcatgctgtgtagctgatgggaacatcggctactttacaaaggagactgccaagtgggggcctggcactggaagacctgtgttccaattccagccttgccatttattagctgtgtggctgtaggcaagtctctgagcttcggtgtcctcatctatgaaatggaaatactaaccacagcaatacctaccaaaatgtcacttagaggactaacagagataatgtgtaggcatatagcaagactatcaggaaagaaggagttttgtttttccttgaactgggattgtaatttgataagtagtggtataaaccacctactatgggcagtaaaatgtaaagtcccacagcagtcggctttgacatttcctgagtataaaaagaagtatacttcaagacagctctgggctggcttgggccaacactcagtatagcaacatacttctcaccaaaagccagaaagctgtgctgaaactaccttggaaaccattctatttgtgtcagagagattaattaatcaattaatagctaatccacaaacataaagccacctctgcttcccacttgaggggattcctcctcacacctggtgccatagcacagtggtatttacatataggagatgccagatgagctctctgaagtcactgtaagcaattctcagagccaccaagtttaagtcaggaaggggtttgaagatacataggagttattccagggtaatgaattcccgaactcaccctggcccttcgatcaggtctctatgcagggcagtgggtacccaggagatcaaaattcaaaatgtggtttggccaacttcaagttgttgtctttttttcccctttctcctcccaagaaaaaaactgaagagaggtaaggggaagtgtttttcaactaattcaaactggcacacttctttgaacctactctgccagtttccaaatgatgcttgggttttttaaataaccatacagatttatcaacattctaacttggaggatgaacagtctacaggttcaaaattcatggttctcaaaccaacagctacatgtatcttgcttctgaggacttgtgtcgatttcaaaatcagagctggtgggagctgccatctgcctaagtggcctctctgcagtgcctgaagagtcaagcacagtgtatatgtatgtttgctgaatgaatgagtagatgaatgaaacaatctccaagagaggaaaacagccattacacactaagaaacttatcactgactctctttaacacatcacttctactctcctaggacccttccagatctaggagtacaatacaatcgtcaagaagcatgcatgcattttcttctagcaaaagggaagctaaggttacaacctagttataacttcctcaagcctatcgtcttgggaaataaattcctaatcctttccctcaggtaattaaaggcaagtaagcaaacaaaataaaacctaatcagctatgaatggttcccttttctaaaatctgcttcccctccctcagtttctttggccctaggtgtctggcagtgggtgggcctacacttcggtgtgccagggcttatcagggaggtggtatggatagagcctgtcaaaaagggtccaagtgctgctggtcagtttccagttcttccactcttcaacttctgcaaaccgatttttcagaggcaacatgagttgtgagactgagctaacttgccatgagaccctgggcaagtctctatgggttgagagaatgttgggttcatcttttaggctaaatgtgaggaagcaaaggaacttgaaaaaaatagagaaggtctcaaaattacaaaacatcttcattcagtcactaacccttcgtgttctttctggtagaaggcaggaacactatttgcccactttaaggttcattctccttaccagcaggagctaaaaaggctgctccccaaaacggagatgatacttcccccttccttgcttgtctagactcaaactttctggaactagctgggaaagagggccagctgtcttctctttacaaaggaaaaggtgtctcagcatggcaggaagaactggagcataggaggataaagggctggtttctttccctatcaccaactgaacctcagtaccctcatctacgaaatggagatgagactagctgccttagcccatctctcagggccctggcagggcagggatgagaggtccagtgttattctgacccagaaactctctcctggccctcaactctctcattcagggagccttctgggagattcagaaaggggtgtggaggctgagggatgccttagggcctctacctccttacctctgccacctggccagggaggggcaggagagtgtggtgtggagcccagtgcactgaggttcatggcctcctcatcctgtccaatgttggcccggatgggacaaggatgtcatagcttccctctgtgaggagggactcccacctagaagatctgacaatatccttcttgctcctcactccaaggaggtaccaacagcctttaaagggagagagacagacagcttgagaaacttaattcttgacagaaaagaacagagggaaggaactgggagagaggtaaagagaaggtgagagagaaatgacggtacaaacaggtagggagaaaaatggaaagtgaaggaacgaagaaaacacaaagaatcagaaagaggaggacagacacagatgaagagatgaagacggactgacagcgcgggagcttcggggaagcggggaagacaaaggggaccatccggtctttttaactggcctggcctcttagagacaccccgttcccaaatgaaatgcccagaggacgggagaaggaggcaggaaggagcaagcagtggctccccccggtcccctccgcccgggcccccggcccctcccggggtcccagcccccgcccgggtcccaccgtccctccccgcccgcttgctcacctgccagcgccaggatctgggccttgtggagcaacagcgcgccccagtcgcggggggcgcgcggggggctctcgggcccggcgcccaattcctccgggccccggtacacggcgtacaccttctggttgtcaaaatccagccgcgagcgggggctgaagtcgcgcacgcacgacacgggcagcgcgtagcagacgttgtcctccaggaaccgcacaaaggcgtacatggtgggcgccgggggcgggccccggtcgggcagctcagcccgcggggcgggcgcggaggtggggatccggcggggggcgcgagtctcgctacggtgctggggggggcgggggcggctccccaggacccaggctccccccactgttattgttcctgaaagcaccgttctgccaatcggctgctttcgcctgggcgcggaaaagggagggagggggggaaagggggacgaggggcggatgaggggggtttggaagcgcactgccacttgcaaagtcagacccgagcaatcacagccggagcgcgattcgaatggggagggaaaagggttcagagattcagttgcaataaaaataataacaagagcattgcaggaaaaaaatgcattgattaaaaggtgcgctgcgtgcaggattatattgcttcaacaatcgcgctgccaaattgcattgcaacaaaactgcattgccaagtagagaagtgtatgagtgagtgaatgcgggataggggtgggggcaatcttgattgaatctcaaagtgtaaacttggaagccagcagaagtttggagtgttttaaatgtagccaccctacccgcgcccccagccccgcaccctccccgcgcctttcccagcccttagtttggccccgccttttctttgctttctttctttttgtttgtttgtttgtttgttttgttctgcaaaactgccagctccctctgtggaaagggtcagtcagacagaaaatttcccctagagctgccaaaccagttctgaccagaactggggcttatctgagatttccagttgtgccagctggctggggaggtggaaggtttgtcaagggctgctctcatctgagggagcagtggcgcccctctcctctatagtctttctccattgagataccctctccacagcacgcccaccactgagcagggacaacttggaatcgcggagggagttgaggagcgctctgggtaacacaggcccaaggctagggatttctggagcactttgaagagtacaggaatagtactccatggaatagcggtctttgctctgtctcttgccaaagagagcctggaggggcttgggtcccctccaagacaagccgtgaggaccagccaaagggggctgattgggctctgtactcataggaaccctatcccacatcagaggaggtcagtaccttcacagggatgcctcgtatcaaatatggctagttatatttctgttgcctagccagacctggcacttgacagggagttaatgaattttgggtaaagaagaataaataaaaacccacatccatccatccatccatccatccatccatccatccatccatccaaccatccatccatctgttcattcattcctttattcaagcaaccaatattcactgagtttacaccacctgccagattctgggccaggtgctggtgatagaaatgaaaagataaacacctggattcttgggccttgcaaagtcagtgtaccagaacttgaatctcagttttgggttcctgtgccaaaattaggtaactgtatgaataacatacctttcccatcctcacaacctttacaatctagtctaggagtattaaagaagtataagcaagtaatgacagtataatgagaaaagtattgtcatagaggaatgcttaatggaggtgttggactcaattaaatgttatatttttaaaaattcatcttaataaactttagctgtaagaaaaaaacagaataagtgcaccaaaatgttaatagtgatttttttagcttcttagtagtggtagatgattttgtttttccttgtattcattgtgtgtgtgtgtgtgtatgtaactattttccacaatgttttattactttatcatcagaaaacatcaaacattataaaatcaaagcactgtgctcatatttcacatcagctgcactgacaatgaggcagatatttatttcactgtgaaatagacagtgcgttatataagtgaatcccatcaacatatagctctcatatccaaatgtgtaggtcagtacaaatttttttaaaccaacccactggttatgtggtacagccaaaaatgaccaccacttgtcctgatgcagctgttggtcttatcttgccccacaagcttgtggaaaaaaaaggagccactctgagttgttccagcacatttactgtcatgattatgatttctttggactgatcctcagtgagtttttattttaagaatacattcctatggtggtcaaggggaagtaatgtgcagcaagacttctgataattcacaagatggatcatgcagagttggccgtatttaacaaaagtccttgaagctccggactatgttcccaaaatgatttcaagtagccaatggccaacctcctctctgcatctaaatgggggtgaccacaaaacattaccaatctcatctcttactaccttcccagacacagtacactccagacacctaaactatttgacatttccaaagatagcatgttttagcaggtcccaagcttttgtgctttttctgccttcatcctgggaagttcttccttcctcaacttaccctgaaaatcagctcaaatgtcattgcctttgtgaagcctttcccaaccacccacacttttcaaggatagcctatctctttctactacaatattttgtcccagcactttttatcttccctcactagaataagagctctttgaggggaggcaaaggctgagtaactttagcatcccaggtacctagcacagggctggggagtaaatgtttataaaacaaatgtattaaagaaggacataaagagagcatgaataacaaacctcttgcacattttttcttgaaagtctgttcctctctttttttttttttttttttttttcttgagacggagtttcgctcttgttgcccaggctggagtgcaatggcctggtctcggctcactgccacttccacctcccaggttcaagcgattctcctgcctcagcctcccaagtagctgggattacaggtgctcgccaccacgcctggctaatttttgtatttttagtagagacgagttttcaccatgttggtcaggctggtctcaaattcctgacctcaggcaatccaccctcctcggcctcccaatgtgctgggattacagatgtgagccaccgcgcccggcctttattattattaatattattattattattacactttaagctctggtatacatgtgcaaaacatgcaggtttgttacataggtatacacatgccatgatggtttgctgcactcatcaactcatcaactacattaggtatttctcctaatgctatccctcccctagtcccccagccccccacccccctacaggccccggtatgtgatgttcccctccccgtatctatgtgttctcattgttcacctcccacttatgagagagaataggacacaaacaaatgaaaaaacattccatgctcatggataggaagaatcaatattgtgaaaatggtcatattgcccaaagtaatttatagattcaatgctatccccatcaagctaccattaactttcttcacggaattagaaaaaactactttaaatttcatatggaaccaaaaaagagcccatgtagccaacacaatcctaagcaaaaagaacaaaactgaggcatcatgctacctgacttcaaaccatactagaaggctacagtagccaaaacagcatagtactggtaccaaaacaggtatatagaccaatggaacagaacagaggcctcagaaataatgccacacatctacaaccatctgatgtttgacaaacctgacaaaaacaagcattggggaaaggattccctgtttaataaatagtgttaggaaaactagctagccatatgcacaaaactaaaactggaccccctccttacaccttatacaaaaattaactcaagatggattgaacacttaaatgtaagacctaaaaccataaaaactctagaagaaaacctaggtaataccattcaggacataggcatgggcaaagacttcatgactaaaacactaaaagcaatggcgacaaaagccaaaattgacaaatgggatctaattaaactaaagagcttctgcatagtctgttcccctttttaagggttgatgctgaatcccaactctgcctttcccattcccagtgatcgaagggcagaagaacattgattctaccacttgtaagacagacacattcattaacatattaaatatcactgcaccctggggttcaaattccctacccatgtcactgtaaatcattcctataaggaggcagttccattttccgataacccagaaagaggaaaagaacagacgatggacccggatgctgacagagtaaacacagatcaaaacacatgtttcatagatccacagaatcgattctggagtagtcatgactggcacgggatgcttaaagagatacccttggacggcaccagaaagacgtcagttcctgcttcctgtgtgactcacacattcagtctatggatacagcttaatggaaaacctactatgtgccatagggcgcctcttccaccctactgaaaactgagcaacagtactttgacctggagaccatagccctgggctttacacataccagatactcaagatattgatgattcattgactggtgagcaaagatagtttaaatacagatttcagacttaaagaggcaactgcaaacttcaagtttaaccaaatcattgttgaatcccctcttcaatatttctgccaaatgggcatctagaacaccttttatacagttctaatgccaggaagcttactagctccccttaacttttatacattaccaagtgttagaaaggtcttttttacttgcactgaggtagaatctttaaccttatagcagccatactaggttcaccaagactctcacgcctgcccttcagacatggtgaaacttggaatcctgtctcccagctctttgtcttctgcccaaacatcttcatttccttcacctgtctctcctcatatgacctggtttcagtgatgataattgtaatacctattttttctctaaagcttataaatcatgcatgccaggcgctgtgtatacatgatctcaattacttcacaccaaattcttcaggtgggtgttattaaacacatgatagagttgagaacatggagaactatggcaaagcagtttggctctggggagccctggaaggcttgtggttatatttcaattttagacagtttgctctagaaacattgtggggaaggattggaggggacgcaagtctggggagacagaggcctgcgaagacgctgactgtcctgtctcacccctcccccgactctctttttctgtgggccaaatgtgctttgcctttcatccaagtcattttaatggagcagaaaatgtacacatctggggcagctttgcaactgcatctccactccactctcctgttgagttttgcagagccttgggttaatgtcaggctcctttggtttagccagctgaagcatgttcagtggcagcagtgggacttatgtttcatattactacatggaattctcaatgtagtttgcaaaactatttttaaggagacctgggttttgtaaatttttaaagcaattggagcgtgccttttcaacctctctgctaatgattgaccacattttttcatgattttgccttttttccctgtgatgtttgattagacttttcaagtctctgctttttacatttttgaaagactttttaaatagtagttttaggttcatagtaaaattaagaggcaagtacagaaattgccttcatacctcctatcacccacacaggtatagcctccttaataccaacatcccccaccagagtggtatatctgttgcaactgatgaacctacattgacacatcatcatcacccaaagtccacagtttacatttgagttcactcttggtgtacgttctatgactttggacaaaaatataatggcatgtatccaccattatggtatcatacagactaacttcactgtcttaaaaatcctctgtgttccacctatttagcccacctcagcagccccaacccttgcaaccactgatctttttactgtctccatagttttgccttttccagaatgtcatatagttggaatcatacactatgtagccttctcagattggcttcttttacttaataatatgcatttaagatttttccatgttgtcttatggccttttacattttttaaattttcctattttgcccagaaaagtaatttgctgtgctgcaagctgagggccactgtcttctcaggttgattcaaggaaggaacgttgatacatggccaggaggatctggagctactgggaggcctgtagtgggcattatcctgagctgtgtagtcacaccataaagcaggggcatcaacccaactcattcatatgcactcctgctcatgaagtctgattgagtctgcttgtgggattttgggcaggggaagagaatagcaatgcagagggggaaggaagcaaagagaggagctgcatgttgggtacaggcttaaaggccaatgaacatcacctggataagttatccaggtgagacttagagggaatgtaaacttgtcatgtagatgacagattggagggccaaagaaatgtgggcttaggaatcaaaccagtggttaaaacctgactttgttacatctttgctgtaactttaggcaagacaattcacctccatgagcctcagctttctcacctgtgaaggtgttgtgagacgtgggccaggaattttccaccctttctgtgtataaggatcaccttgggaattaaaaaatattccatccccaggtcctatcccctgagaccctgattcaattggtttgggatggggcctaggcattgattttttttgttgttttttaattcccagagtcttctaacatgagacgaagttgagcacctctgagttagaagatcttaaggtaacatgccaagcacacaggaaattctcaacaagtcataaatattattattttcaggaaaaatatatagggatcctaaatgtctatctaaccttggggaagtcacttagcatctctgagttatgatttcttcatctgaaaaatgacatgccaatgtaaaaagaaaacagtatatttagtcttaggctctgggtccaaatcctggtctgataagtaacgtctattcttatggtgtggccttgggtatgtttcttaatctcttcaagcatcattttcttcataagaatattaattcaacttcacagagatgttctgaggattaaatgagataatctatgtaaaatgcttggcacagtgcctgacactgtggtgagttctcagtaaatgattgctgctgttactgttaaaataattattatagttataattataagaacacatatccccattctgacacagagtgggggtgtccaatatatttttactgaatcaaattgaatataacagactgaacaatgctaatgataatccaacaagcatcctagaatgattcccgccaaatgctgtccccttcaataaaactctgtggtcatgggtcacagtcactaaagaagctctctaatttcaaatgttcaagagcctctgaggccacagggcttgcccaaacctgcagcaaatacttctgaaatactgtgtttggggccattcattctttcaaactgactttgttgagtatttttttaagagaagaaataaaaacttctatgcattatataaaatgtaaagtgtagaagcgtttacagcaatctgaagccttgtggatgtgcacattggcttgaagttcagttcaggcaaactgcagtcaaattcaaccattcagatctcagctatcttatgagctcatgtgggtcacaaatggaaatcattggtcaaacaaatgatctgaatcccagcattttactagtagtataatatactctgcataagcaacaaaaagtaaatagattccctgtggttaaagatgaaaataaatttattaatgtaaaaaattgtcacaaagaaccaacatttgaattcgttttgaaaaagaaatgaaaagattgacctacctcggaaaaatgcaactcgcttcttgaaattatgaatttcaattaggggccaactagtttgagaagttgcctctggtttcctttattaaattaactcattctgtaatttttcaggtgaaatgtcacttcctcaggaaagtcctccctgactcactccttccatccccctccatagactagctccagtccttcttacacacttccatggcttcttatagttttcttcatggagtgtatcttagtatgtaattatgtgtttattctattatggtctatctctgcctatagatcaaagctccattagagaagtgaccatatctgttttcttcactgttgcatccttgtgcctaacctggcacatgagaaaccctaaacagacacttgttgaatgagtgcatgtctgaaaggcagaccctaaagaacccccctacccagagatgagaggcaacaggtgtacgaagggccatattctgtccctctaagtctcattttcctctctgtgtttctgtgcttccaccatgtctggctcctatctgactggaacatcaataaaagcctatttcccattttcccttagcaaccactggatagttaacattttcaaaatgtttttccaaatacgaggagagaacaaaatggaaataaatagaaaaatgatgtacacagaagaaaaatagtcaagttgacagtcacacatggtggtcatacactaatcctaataataacataatagtagcaggaacctcattgacacagtctctgggccttccgggaaacaagatggtgattctgccttattccacaaggctagagttctttcttatcctgttgttgttggctggaagtcactgactctctaaccccctacttagttaaggagaaccctgcctcattctagtcttctgatgattccaacatcatttttgagacaatagggcaaccttccttcagagaccacattagttctctggttatcatctctgctcatcccaagcacctggtggttcaaaatgcctgcccttcacaagtcctcatagggccagagtgtacccctagacttaaaaaaaaaaaagacaactctaggttaccattctgagtcaaaggcataaaggagaacattcgttcagaaggttaagtcatctcagaagtatgcagcaaactgtgaactctgattttcttaagaatgtctctcaaccacaccagaaagtcaatacaaaatcagaggagagaaatgaaaacagaactaatgattattgatttccatgataggaactgtactaactgctttacatatttagttcttttaatcttttcaaaatatcccataaagtcagtattattaatatctccatttttctgatgaggaaactaagacttagagagatcatagaacttgtttatagttacatggaaaagacttcaacctgggtttctttgattcgaaacttaggttgtgatggctgttttgatataggccttgcctcagagtttcctgaagcaacaaggagctgaaatgactatgggatttaatccctgttccctttttcctagaggctgaatccctacctagaaacctgagaattagaccctatgggaaagtccagtatctaccattccaatcattcatgtcttaagtaactaataattttgtaaacactgaagatttgactacattatctgtggtttcttaaatcatggcttccttacaccagagtctgaattttttaagctctttgaggttaccaactgttgaagcagatttctactggcatatatcctctgctgatggccaaggcattagaacctgttggtaatcacctcttactgccggggaagagtggaggattatctgagccaaaaaaggagacaactggatagccccagtcagagatatctctgtgaaaaatgtcagcctccccaataccccgcaaaagtgttttcttaccctattattgattagaggaataagaataagaatagagataatagtagcaaacctttcaggaatgcttgccttgtgctaggctttatgtacatttttcatttaatcctcaaagtagtcctggacgtaggtactattattattagcctcattttaaaggtgaggaaacaaggcatagggatgttgggtaattttcccaaggtcacacaggagtaaatggtagacacaggattaaaacccaggccatgtgactctagagccccagccatggacttctgccccaattctggctcccactgagtctgactctctagcctcattgacaggatttgtgctcttctggtcaggatggggagatgatgaaacattcatcctcaaagggtcatatacaagttctccagggatgtccagatgacccctattggtccaggtgagatcctgacaggcactatcatccaaatgtcccaacaagcaccctggagttcatttatattttcattctatgttgtggtgggtgggaatgtactagatccaatccacaggataaagatggctttctttcatttactaacacaaatttctttatttagtagcacaaaggaatacttattaatgtcaaccaatataaaaaaatcctttccctccaagtttttatattataatggaaaactgactcatatatacaacatacaatacattttcttttgatagttcttttcatagattcttttaatgctggcaggggatgtattggggtgcagaatattaaaaccccacctccccatctttattatcaggcacacctctattatcaaggaaaagaaatggcaagaatagaggaaaaagagataatcagttaagggcgaggcatttttttgctaacgtaaggatggataagagaaagatgcacacaggtgcatgggactctggatagtggccaagggaaggtttatctcaactggtaggtctagtaggtaactggaaaagaccctacctcccaccctgctaacatatttggccacattgctgggccatcaaatggtctccaaccactaagctctgttgctggctttgggacccattctggagaggcagcatgtcacgagaggtatatggcaatatgaaaagtgaaaagtgcacaggcttttaactcagttttgggctcaattactgctttatcaccaaggtactgtgaaaccttaggaaaatctatgactctcagtttcaggtttttcaactgtcaaagagatccttataaggttttcatgtctaactgagacaaggcatgtaaagtgcctggcaggcacagtgcctgtcacacagtaggttgcaaaaactatgagttgcctttttcattcttaccttctgagataatttctattactctttcctttcaggaggtcacagggtaatgacaaggatgggttcctggagccagttcattttgggtgaaggattttcctcctccctgaaggctgggcagtattactgtagatatgccacccaccatcccttcctggcaaacaaaggcagtctgccttgtttaagaaagctggaatcttactaaggtctgtacttttataaattgtaggacttaagttgagtttggggttttattgtctgcttttaaaatcatgatcagatattatatatttaaaacatggcttcagaattgtgaaacacagtgttctcaatcataaaaaaggatgaactatgttatgcctttctgtttccatttctgggttctctttttgtctccttgcatgaatttttctgtgatgccctgccttatgtcctaattcttctgggacactaactgtgaaaatgtaggcaagattcttaactcctttaagactgtcttatttgttcattcatttatttactattgaactatttggtgagcgcttataatgtgccagaatctctgattaatgcttgggatacagtagagaatcagacagacagtttcccccatttgtgaaacgggaaaatgaaacgcatattttaggattttcaaatggagtaagtgaaattttatatatatatgagaggaagagacaaagaagaggactaaaatctattgaaccccttacttgatccccagtaatgctaggtgctggatatgcaattctgataataaacttggaaagtgattgttgttatccctattttatagatgtagcaactgaggttcagagagggagggtgaaggtccaagtcacacattggattcaaacctggtatgaagtccatatggttctcactctgctatgttgcctccagtggtcttggaacactgcttgtcatccactgggtgtgttaattccccatcaccaactccacatagaaactgggaggctgtactattcttgctgcgtggatatatatatatatatattttttttttttgagacggcatctcgctctgtcacccaggctggagtgcagtggcccaatctcggctcactgcaagctccgcctcctgggttcatgccattctcctgcctcagcctcccgagtaactgggactacaggcgcccgccaccacgcttggctaatttttttgtatttttagtagagacagggtttcaccatgttagccaggatggtcttgatctcctgaccttgtgatcctaccaccttggcctcccaaagtgctgggattacaggcatgagccacactgtggatatatttgatagcactaaatgtggtctgggtagagtaaggggtacttgaatggaaaatccaaatcatgttccctgattctttagggacaagatgtaaagaagactttatgaaaggaaagggagggagacatacgttaagctcactaactccaagtcataggaagaactttaaggtcctctggcagctagactcaccagctcaggagacagctgagacacagactcttggcgagaggaacactgtctttcccaagccaacccgtctctgctgcagtgacattaaaagataaaatgttcaaaactctctacccctctgactcttaccacttcctaggtggaggcagacctgaactgcataaacaacgaggtatatttttccacttaagatgttcagtgcctatccaaggaagaaagagtctgtcagaaaacattcacttagggcctgcacattttcaagaagctgaaagcagagtaggaagtgaaatcactatgcttacatttggcaagaggactgcaaaactgcccccaagctaaacaatttggacctgtgcacccttttctcttccatctctttgtttggataagtcacagcaagagcacgtaacagatttaccagcactattcatgtgtttttaactttacgagcaaagccttctctttggtatcaagaaaaggaagggtcggtcatgccagagagtgcttgttgccactgagaaaacttgtgagggttaccagaatgaaaagacagacacaaatgaagaaaggcagagttttgcatgcaaaaagggggaaaaaatcttttccttggcatagaaaaatttcatcctgaaggttcttttttccctttttttggcaatgtgataaacaccttaaaatagagttatgaaacagaaacagattctatagaatgaggaaaccaagactagtgacctcagagaacttatgtatcaaacctgtcattctagagatgataaaactgaggccagaaggatgatgatttccccaaagtcaaagagtttgtcattgactgctatggtttgaatgtgcccctcaaagttcatgggttggaaactcaatctcaagtacaacagtgtagagaggtgagacatttaagaggtgattagatcataagggttctgccctcatgaatgaattaatatcattatctcaggagtgagctcattattgcaagagtgagtttgttataaaaacgagtttgagctgggcgcagtggcacaagcctgtagtcccagctacttggaagtctgagacagaggattgagcccaggttcaagaccagcctgggcaacattacaagaccttatatctgaaaaaaagaaaaaaattattttgtctctctctctcatctgtcttgccatgtgatgccttctaccatgctatgacacagcaagaaagccctcaccagatgtagccccttaacttcccggcctccagaaccatgagccaaataagcttatgttgtctataaattacctagtctgtggtattttattatagcagcacaaaactgattaagacatgaccaaatcaataatgaagctcagcttctagtgggccttatcgctgtcctccattgctcggcattcccttgattacaatgaaaagccttcagtaaaaggtaatctcattcatcctcgggcattagcttacctagtcttaagtaaacatatcccagcattttccaggtttagcattagaagaagccttttagctgaggaggggggtgggagaggatgaattaattctcttctctaaatcaccttccccttggagtctatctatagtcctgctgccatttccatgctgccctcccccaccactaccctccattcccccatccccatcaaggggttctgttaattctctaacacttgagccaaagaatgagcccaacccattttgggggttgccctaagcatagctgaggtagtctgaacttacaaagagactttactgaaacagaggtaagagaaaaggcagtagaatgtagtggagcaatctgaactttgaaatcagaaaaatcggggtttaaatctcagctctactgcccattagctgtgcagatctgactaagtcacttgtcttgttaagttttctcatttgttggatatggagacaaaattagggcatttgatacaattaaataagagcataaggcatctacctcagatctttgcacacagtaggcactggtgttcataaaacataaaaaaaagtttgatttagaaagcatgggtttatggtcaatcattcaaaaaacatttcccgagccaccttatctgtgccagactctaaattaagtgttgggacagaaacaaacaagaaatggtccttaccctgcaggaaataatttttaatgggtgttatgggtttcactgtgtccctacaaagatatgttgcagtcctaacccccagaatttgttaatgtgactttatttgaaatcaaggtctttgcagatataatcaagttaacatgaggtcattaggctgggccctagttcaacatgacttgtgtcttataagatgagaaaaataccatatgaagacagagacacataggaggaatgccatgtgatgatagaggcagagattgaagtaatgcagctgcaagcaaactaaggaacaccaaaggatcaatggccaccaacagacactagataaagacaaggaaggattctacccagaatctcagtgggagcatggctctgcaaacaccttgattttggacttgtatcaacaacagtgagaaaataaattcatgttgttttaagtgacccagtttgtggcatccctaggaaaccaatagaattgggagatatgcaagggagcaaatgcaataattccaacagaataaatgatgtaacacttaatgagttccctgagctgtgcctattacatttattaaattatgtaatcttggttaagccaggaaatcttgtgagcctcgatattcatggaggtatgtgtaagtagaagtagtttgtccaagaaaaagacaggcagtccatgtctgcctgaggaagctggggaaggttttctaaaaaggatagttggagctgatacctcaaggatgagtagaagcttagcaggtgtgggaaagagcagagggaaagacaccactcaggctagagagcctagtgtagaagcagaaaagtgtgaactagtttttaaatttttagaaaactacaaatatttaagcattgctggagtatggtgctgatattcatcagccttctagatcccttcttcaccttgatgtcccacagacacctcctattcaaaatatcccaaattgaaccagaccgctctttctacccccattcacactccatatatgttctccttttgcattctctgacttggtgaatggccccactacctacccatgtagcccagctaaaagtctctaagtgtccacatgacgaactcttggaaattgacttcctttttatatccaatttacacaatcatttttgagctttactgtctctggttctgatggcttctcacttggcacaagctctgaactctccagctgtgtctctaggccatattccttccagctaagcctctctgccagataattaatgatctataaacaaatgcttaattgtactaggggagcacatatttaaagaaactttatgataaagcaaaggatccttttcataacatgaagagcatctctctcacaaactcccccagcctcagtttaacatttagcctgacttttcatttcacatattaaatctaaagctctcttatagcagcgccccaaaaataaaagaaaaaaatcacctaagagacagatggtatatcctaaggtttatccatgtcaggtacttcctgaaatacctctcttctctctaagtccagcccctttggccctcagactcaagactttggcacctgctgggaggaagaaaacttcagctcctggcaagaaggggaaggagatgtgaatttattaagaatgtaatatatgcctggctcttttatttatgttctctcattttactcttcacaacaactccacggactgttgccacccattgataaacaaaaaagttaggtaccttacacaaggtagtaggagcttataaaggggaatgactgacattgaaggggtatctgaattaaatataataacattattatctctaagcacactctttcaagctgtttaggttatctagtcagcctcaatgccttttcaaagcgggtataaagtcatcagttagagaatatgcctggccatgctgattcctcaagagtgggccaggcacatcgaccctggtggtcaagaagccccattggaaacttttctgtttgttgctgctttggggatctacccttgtgctgggagccagggttaggtgctgttggaggaggggccaatccagccacataggcacttcagagaggaagcaccttggctgggatctgaaattgagccctctctagggagtttgaaaaggtggtttttgtgcaattcttaatgtcctggctgtttcagaaagaggaagcacagcaacatttttagaacagttagtggggtgtgacaaaacccagagactgtacccacaggaactttctccctgctcatttgtttcagaaaacatttggtattcaaggagcacctgccccattccaggccctatgctctcccactggatcttcaacctcttatctttggcaggctccttcctatatgcacttacacatgcccaagcctttcccagcttcaaaaagcaacaatggccacctcaaaaccctcactcatccctgcctctccttcaattactaccttctctcctcctctgggaaagcagaagtttttggaagaaagtgctatgcatagttattataaacatccactcacctcccattcactcctcaaccccactgcagtctagcctttgcctctaccgaacctactctccaaagtcaccaatgactaactgattctaggacactttgcctcatttggtctctcaggagcattcacactgttgaccttgcctttttccagaaaatgtttttcctcttaatttcagtaatctttaagttcttttgacctctttgataatcttcagtctccatgtaggctccacttccttgacccccatttcagatgtcaatattcctcagaattttactgtaggccttctggactttttcattctgtgtatgaacacacctagtgcagacttctattctgaactccagttacataggcatacagctgcttactagacataccaactttaaggtcttaatggcatctcaaatatttcaaatccatctcttcaaacttttgagaagcctgcttctcctgaactgtttcctattttagtaaagagtactatcatccacccaaagatcaggttagaaaccagtgagtcattcttgactcctactgtcctctcacctcttagtcatcaactcccatggattctgcaccatatatatctttcaaatctatttcacttcttctccactatatcctagttcaatttttatttccctgctgtaaatcttaccccttcccaatgcattccctaaaccagaatgatcatgctcaaatgcaaatttgatcacgttactcctcagaaaagactttccaaaagcttctcatctatctttggataaagtcccacctgattttaatcctatacaatctctaccccctaccaactctctgggctcaactcatgctacgtattcccttattctctttgcttcagtcaaactggctgccaccttgttcttctctttttcctccccctcccccttttcctcaaccccttcttttcctttttcttttttctttaactttttatttttagataattagagatttacatatagtggtaagaataatcgagagttatcctgtatacccagtttcctccaatggtaacatcttgcatactagagtacagtatcacacccagaaagttgacattgttataatccattgacattattcatatttcaccagttctacatatattcatttgtgtatatgtatatgtatttagttctatgcaatgttttttttgagatggagtcttgctccattgtccaggctggagtgcagtggcacaatctcagctcactgcagcctccgcctcctgggttcaagcgattctcctgcctcagcctcccaagtagctgggattataggcatctgccatcacatccagctaatttttctattttttagtagagatggggtttcactatcttggctaggctgatctcaaactcctgaactcaggtgatccacccgcctcagcctcccaaagtgctgggattacaggcgtgagccactgtgcctggccagttctatgcaatttgatcatgtgtagatgcatgtgactaccatcaccatcaagatatagcacagttccatgacaaggatcaaactggccttattctggtgccttcagtgggtcaacttccttttacttataggtattcacatagctgttccctctacttgtaacattttcccctaataccattcatttgtccaattactatttatttttcaggtctcaaattaaacattaattctcagaaatactttttctaaccctacacttggttaggatgcttgttctctgttccactagcacccaacacttcttctctcccatgaaggcacctattttctcacctctgcattaatattattctgcatgaaggcagaggttatgtgtggcttgtttacttctatatctccaatatctagcacagtacttacaactatggaattcctcaattaaaataggtaggaacagtaaactcataaaaactgatgaatctagtggagctctttcctttaaggagctcccagtcataaaacaggccactctcagacagtgtattgaattagtattgtcttggaaggaagcactggaggttgtggggatccagagtatccattttctccccagcttctaaatatacatagttgggcacagccaggacaagaagaatccttgagtacccacgttcatctgcccagaacccttcagcacagtttagcaggtcaggtaagtggagcatagactgtggttacgagtctaaagacatgatttcaaagatctcagctggttaattttctcagctctgtaaccatagacagaaagcaatcttggttacagattgggtcccacactatgaatcctgatcttgaccacagaatgcccctgatcaaggcacagatcttaacaccatccaaccatgtgataaatatagcatcttccacaagaagaacaggtaaggtaaaggtaaacctccatagtgggaaaacagcagcctactctgacacaggaaagcagaacttgaatcatatgtccttctaggggtcaatgatatgcacaccctaagaaaagaaatataattattgagtcttgaagacttaaacctggaaggacccttaaaggcaatatgcacccttacgtgaagtttgatggtgtagagaatagaaactcagcttactgaatatagtagtaaaatgttaacctttcatatctagcttcagacccaaaaacccttgttcccatttcagaatcctttctaattaattttaccaaagcataatgactttcttttattttaatagtttttggggaacaggtggtttttggttacatggataagttctttagtggtgatttctgagattttggtgcacccaccacctgggaagtgtacactgtacctaatatgtagtgttttatccctcacccccatcctaccctttctcccaagtccccataatccattatatcattcttatgcttttgcatcctcatagcttagctcccacttataagtgagaacatacaatgtttgattttcctttcctgagttacttcacttagaataatggtctccagctccatccaggttgctgtcaatgccattattttgttcctttttgtggagagtagtattccatagtgcatgtatataccacattatcttttttttttgagacggagtctcactatgttgcccaggctggagtacagtggcacaatctcggctcactgcaaccttcgccacctgggtttaagcaatttccagctaatttttgtatttttagtagagatggggtttcaccatgttggccaggctggacttgaactcttgacctcaagtgatatgcccacctcagcctcccgaagtgttaggattacaggcgtgagccactgcacccggcccatataccacattttctttatccactcattggttgatgagaatttaggctggttccatatttttgcaattgcaaattgtgctgctataaacgtgtgtgcaagtgtctttttcatataatgagttctttttctctgggtaagatacccagtaataggattgctggatcaaatggtagttctacttttacttctttaaggactctccatactgttttccagagtggttgcactagtttacattcccacaagcaatgtaaaagtgtcctctttttaccacatccatgccaacatctattattttttaatttttaaattatggccattcttgcaggagtaaggtggtatctcattgtggctttgatttgcgtttccctgataattagtgatgttgagcattttttcatgtttgttggccatttctatatcttcttttgagaattgtctattcatgtccttagcctactttttgatgggattattattttttttcttgctgatttgtctgagtttcttgtagattctggatattagtcctttgtcggatgcatagtttgtgaagattttctcccactctgtgggttttctgtttattctgctgattatttcttttgctgtgtagaagccttttagtttaattacatcccatccatttatctttgcttttattgcattgcttttgtttttgttgaatttgctttgttttgttgcatttgctttcctgatcatgaactctttgcctaagccactgtctagaagaatttttctgatgtcatcttccagaatttttatggttttaggttacttaggtttaaatctttgatctattttgagttgatttttgtataaggtgagagatgaagatccagtttcattcttctacatgtggcttgccaattattccagcaccatttgttggatagggtgtcctttccccacccactttatgttcttgttcgctttgtcaaagatcagttggctataagtttttggctttatttctgggtcctctattctgtttcaatagtctatatgcctatttttatatcagtaccatgctgtaccacgtaactatagccttgtagtatagtttgaagtctggtaatgtgatgcctccagatttgttttttgcttagtcttgctttgactacgcaggctcttttttggttccatatgaattttaggattgttttttctaggtctgtgaagaatgatgatggtattttgatgggaattgcattgaatttatagattgcttttggcagcatggtcatttttacaatagtgattctacccatccattaacatgggatgtgtttccatttgtttgtttcatctgtgatttctttcagcagtgttttgtagttttccttgcagagatattcctaagtattttattttattttccagctgttgtaaaaggggttgagttctttatgtgattctcagattcgttgttgttggtgtatagcagtgctactgatctctgtgcattgattttgtatcctgaaactttagtgaattcatttatcagatctaggtgctttctggatgagtctttagggttttttaggtgtacaatcacatcattggcaaacagtgacagtttaactccctctttactgatttggatgccttttatttctttctcttttctgattgctctggctgggactactaatactatgttgaatagaagcagtgaaagtgggtatccttgtcttgttctagttctcagggggaatgctttcaacttttccctgttcagtataaatgttggctgtgggtttgtcatagatagcttttattatgttgagatatgacacttctatgctgattttgctgagggttttaatcataaagagatgctggattttttcaaatgcttttttgtgtctattgagatgatcatgtgattttatttgtctttaattctgcttatgtgatgtatcacatttatcgacttgcatatgttaaactatccccacatccctggtatgaaacctacttgaccatgatgtattgtctttttgatatgctgttggattcagttagctagtgttttgctgaggatttttccatctatgttcatcagagatattggtctactgttttctttgtttgttatatcctttcctggttttggtattagggtgatactggcttcatagaatgatttagggaggattccctctttttgtatcttttggaatagtttcagtaggattggtaccaattcttctttgaatgcctgatagaaatcagctgtgaatccatctggtcctggacatttttttgttggcaattttaaaaattattgtttcaatctcaccatttgttatcggtctgttcagagtttctgtttcttcctggtttaatgtaggagggttgtatatttccaggaatttatccatctcctctaggttttctagttttttatgtaaaggtgctcatagtagccttgaatgatctttggtatttctctgatatccatcgtaatagctcctgtttcatttctaattgagcttatttggatcatctctgttctttccttggttaatctcactaatggtctatcgattttgtttatcctttcaaagaaccagctttttgtttcatttatctgttttgtttgtttgtttcaatgtcatttagttctgatctttgttatttcttttcttctgctggttttacatttggtttgttcttgtttctctagttccttgaggtgtgtggttagattgtctatttgtgctatttcagactttttgatgtgggcatttaatgctatgaactttcctcatagcaccacttttgctgtatcccagaggttttgatagcttgtgtcactattatcattcagttcaaataatttttagtttctatctttatttcattgcttacccaaaatcattctgtttcatgagagcatcagctgtggtagcagaagggggacgtaagcttgccctaatacttggccaggataagtattcaggtttctcaggcaatgaatgcataaggccataaagctcccaagagtttgtgtcttttgtgttcagctgccagggcacgtagagaaaaaacatcaggttggggtagggttaggggggtctgagctcagactctttttgggaggggcttgctgtggccgctgtggggcatgggggagggtggttctcaggccaatgcagttatgttccaagggggattatggctgcctctgctgcatcatacaggtttccagggaagtagggggaaagctggcagtgacaggcttcacccagctcccacacagccagcaaggccaatctgactccactgtgccccactaacagcagcaccaaatttatattcaggcagcccacgtgcagggcttgaaccttgccccaggctacaagcctcctcactgagaaagcaagtgtggctttctggccttgcccctccctgcctgcccacaccgttggctgcagctcctgcacttgtatctacagccattcccatttacctcttgggttctgctcaagaaaatttatgttcagtcgaaattattacaaagtttagttggaatcttctttcaccttgtgacccctccctagtttctctggctgccttccccaaagacccctgtgagataaagtcagggatggcttccctgggcttcagctggagactgagagtgcctacagggcttttcccatagttttttctactttaatatcttgctcagctgcctaaatccatttcagctctaggtaaggttaaatccttcttctgtgttctggattttcaggttccccagtggggatgtgtgtttataggtaggttttcccctctcacactttgagagcttgcagttttttggctgtcttgtgaagtttacaatggcaagccgcttcctccacaggatctatgaactcttttggtcttctttgcatgtttttgcagtggttcttggagcaaaagttcacagtgtgagtctccacatgctgttctggccgggagctgcacgtttgttagtcctgtcttccatccgccatttctcactctggccttgcctccataataactttttttttttttttgacttcaaaacatcaaactaaagacatcccttggtctccagctggcactttctaacatcgtcttccccaccagccagagtaacctaattaaagcacaaaatgagctatgttaatttcctgcttaaaacccttcactggcttcctatcagttgatagaaagtttcaggatggaggccaggctcctttgtctccagatctcgtctccctgcttcctctctgtccttaccacttgcttctccttatattctactttcttgaacacaccatgcttttttatgccttatgttgaagctgtgcccattcccagcatggatttctcactgatttttgcctggctaagtctttcttaaccttcaagagtcaccttagccattatctctcccagggagccttccaggaaaaattaggttgggataatgcccctcaccctgccatatgtctatgcctaccccatcatgtcatttagaatcttcaattgggacatcttatttatgtgtctggacccccatcagtctgggcttctggggacagaaattgcattttaatcattcctttcctctcagtgtccagcataggacctggtacattggaagctcttggtgaactctgatgtaaaaagagagcaattctatgattaactttcattgaaaattaactgtatgtactaggaagtatgctgggggcttcacatgcataatgtcatttcattctcctaatagcactggaccactcagcatgcttaacaaagccctccccatcagagtataccacaggttccaatgtctatgctcccagtaatatccagagcctgtctctaggccctgcctctggcaccaccctccattataacacatggcctatggactcatgtcttgtcttttaatttcacttcatacttgaacttacatttctacctgacccattcaagtggcattcagggttaggctgtgtctatttttctgttttatttccaccatagacctctggttccaaccctcagcatcaggctctgcagtctgcatgcctaacctgatccaccccaggaacagtgaaggctccagactctcagtaccaacccgggactataggtccttgagtatctgagagaaaagagccggctaatgtgagcttgattattcccactagtgaagacaaggaagctaagtcaagtaatgtgcccaaggtcacatggcttggtttctgcccaatgccaagacccagacatagcatctcctcttgtgtagaggacaccctccctcttctttcaaacagctcttgaaggcccacttatttgtccatctcacaccttggttatgagctctataggcaggggctgttatccagcactgtccttcagtgcccagcccaagtctggcattgaaaagagccttgggaaaggccaggtaaagggacaaatgaatgtagagctcaagcttacaccaatctccctctgcctacagtggatgttctgcccttcctctactgctatttccaaaggcacttggagttctcttttgcatttgttttggcatcaaaggaggaaagctatcaaatgcattttcctgtcaatttttctttgtaattgataataaatccctctgtaaagaaatatataccctggacatcttaaggaaggcaagtcatggtataatggtttaaacaaaggaattacaaaattctggggaaggtacagatctgtaactcactaaggtctgaggtaaaattttctgaggctatgaaaagaggaagtgctttgtcattagacaaaactgggttaaaatcttggctctgcctctcaggacctgcagaccttgggagagaaacttgagagtatcctatgctttaccctctttcttgcccactcttgccaatctttcaaaaagttctgccagtttcactatctgaatggttcttctccaatctctgctacaattgtgagctagtctggtggttaagcacttaggctctggaatgatattgtctagacttgaatccaagttttcttagtatgtcattttgtcattttggatactttgcttaacctctcaacatctcagtttcctcatctataaaatggagattaaaaatcttagattattaacaagattttaaaaaatcccaaaaagtgatagcataatcctggcccagagtagaagctcacaaacactagctcttattattatttattacctcttttgttcaggctactatctcttgtaactttatactgcaacaactctctccaccctgccaactcatgaccattcctgcaaattttcctgcctggtttatctcctctactgcctcttctccaatccattccatgtgcaatagccaaagcattatttctaaaaggtatcccattacagggttgtctgtagataaagcatgagctccctagcttcagagaaaatgccctcagttatcaaggtccctgcatacctcccaacaattctgagagtgaagttttactctctattttactgtctgggagtggtcaaagaaatgttccaaggttttgcagttattcgctggtcaagttgggatttatacacaagtctctctgagcccagagcctatgatctcttcactggcccacactgcctctctcccccaacactgaccatccataactgacaaataagaggcagcatctgataaacaagaaagaaatggtgcatccggtaagaaagaggagctagaagggagatatcatggtgggctattgagctggggaatcattcctggaggggtaggggctctaggggtctggagggacagactagcaaagatggtactggaaagaatgctgaagtgctttcagaattgtctggtgagatgaagtgaggttcaagtctgaatagaaacatgtgctgcagatggtgttttcttcttccccagcaatggcaaaatcataggaagctcagaaattttgttttacatttcagttattgtttgctggggatggaagcaccatgttaagttttagggcttgccatattctctttgatagtcagagattaacaaactctggttggttgggagcgggagaagagtcccttccccttgagttcctacccatagtcttattatatcaccctgcagtgatgctacccaaatatctattcatctgttcagcaaatctcagaaacctgctgggtaccagacccccatgctagagatgcagaaaacagtcagaggtggttattggactcaaagtactcacgatttagtggggagaatatcccctatacaatgacgatactatgtgagaagtgctctggggtttggggtagggagtgcacagggaagttttcttagaaatgacatctaactaagtttctgagggaatgttttccatcaaaaggaatatttgggctcatttcaaaaggcaaatttgggttattgccttttgttattgtaatggcagaacaatgtgctcttgcttgatgttgtggagcatttagagcatgcaaggtagaatagctgtgcggtagaatccctggtttggggaatctaaaatgtagtttcatatttcatggggatttcctcaactatggaacagggataataacatcatttcctaagatttcatagtcaaagtacctgccagattgtctgaaggtggcatgaaaggtgaaacacacccttgggctatattaggggctcagtgaggtagtgcaaaagaataatggcccaggatgcagacaactgtgtgattttccagctatgtgactctgcaaaagttacttcaccacaacgaacctcagttgcttcctttgtccaacagggacaatattaccttgcctagccactaaatggtagcattggtccttggtctcccatctcatgctctatgaccccctctctcagcctgtttcctcatctgtgaacaggacaagatgagattctgtgcagagaaagaataagagaatattctctaagggctgtttagctttgacatcctatgcataaaacaacagccagattggactattgcttaattctatccaagctgccagataggcatttgaataagtaatctaatatatacatttttattctattaaatattcaggtcatctcctggttgggatgagtattcagaatgatgattgcttagaaacacaccattccaaatacaaatgagaatatatttgcaatattcggttcagcaaggatggaaaggtatgagattaggttctgaaaataatcacacctttcacatcttggatgcctatatacacatttactacatgcctttcttcataaccttggaaatgcaaatccttggactcttagaagcctgaatatttgccctgtactaagtcaattctcatgtgaagatggtagaatggggcaaaaagatgtgacttctcatctggtgttcgaggcccaactacatcttcctcatcccataagcagtggtctgttcccctcacactccagcagggacagagtgctcaccacttttcaaagccactaatcccactggtaggcagcttcgacttgaggaaatagccattcacattgagcaaaatccctacctctagtgcccctacattgatctttgttctgcattgtttcttctgccctcagatattcctgcagggatcaaagtcattgaccctatcccttcaaagtcagccttttccttgagctgaactaccactcccttcaaccataagcctgctctttctttgttgtagaacagaactcttgagggattagcctgggggacacaaagagcaacagcaagctcaagatgccctggtgaattcatttttctctggcttcctttgccatttggtaagagaaaaagaagcttttaaagtaacagtggcaaagtagctgattctgaggaaacttgccaaggcttttcaggaaacagcaccactggggaagggagacatttggattgtggcaagatgaacagcgagggttaccatatgaactattcccaaccaacattacacctgcctcagaaggtgtgtatgtgtgcatatatgtgtgtgtgtgtgtgtgtatctgtgcggaagtatctatgcttgtgaatgagcatctactctcatatatccaacaatgctttggttgtgttagtatacgtaagttcttcacttggccacttgccacgtctcttcaagattcactcagatgttacctcctctaggaagcattctgtgatatgcttttgaccttaaccaaccccgcactcccaggaagttttctgtgctttcttctatgttgttcatttccttgcctgtctgcccattagattgtggtacctttttgagcatcctgactgtgatggattcatctctgtgcctctgtgcctggcacaagcatgggtactctgtacatgttggttacatgaatgcatttgaagaaagatgtctcagtcctagtccagggttttaccactggctttgctgccatgctttgcttttcttataacaggctgaggtgatgcaaattaagaagaacaaaactcccacaaggctcagggagattgtggctcagggagatggggacatttgtagagaaataactcaaattagccagtggtatccacacttctgaaattgcacgagcctccctgtgagaggtgaaagttggggtgtagtgttgtttctccatccccagtctgctttgggccaactattctcagcgtgtgatctgctcttctcctctgcttggcccctgaggagcatccattcctatagagctgacactcacattttccttttatccagccaatttatagcttttgaatgttccccatgcagatgtgcaggattcttgcacacatctgcatatcagaagggcagtggaagttgcttggcaagaggccctggctcagcaggagtgctccattggtaacccccgagttgtgaaaggatctctccctgtattgttctgggccaaggaactcagccagagactgggctgggcagggcttttaggggtagagaaaactgcatcatcttaatctcctctggacacagaaaatcagtgggcacatcttggggcagagcactggtatctgaggcaatgacacaaagggaagagaaggaaaattcattcattaatatattcgtttaggagcagcccataaccctatttgtagagggactgctttgtgccaagcagtataagtcagtgagtcattaaataccaggatctgcttcatatttgagatctgccattctcaaggtctgggacccggggtaagtcttttaacctatttgatatcagtttccacatctataaaatggaatggtaatggtattggctgcttaccagatacattgaagggaagattattcttttatagcactttgtttactgtacatttactgtgttaggcattattagaggcaccttaaacattctgtcttattatttcccacaataaacctgcaagatagatattagtactcctgctttttttgtcaactaaactgaggcacagagatgttaagattcttcccaaggtcatgtagtatataaagaagctgtcagacctaacttccagggccctggtaagtcaggctcagttaaatgtccctgatgaggcagggccaaatttggagagtcccaagggaaaggaggcctaagctgcatatgagccagcagagaagagaaaaccaattttttttgcccagagaggctgagatcacagttggaaagatatgctgggtgtcagatctaatgtgtaaggcatgaaaggaaaagagagagttaatactgagcctggtaattatgaagggcaagaaacaggctcccaagagaggccatggccagcgagtcagcacaaaggctgagactgaagggaacgtgccagagaaggctggccttgagtaggcactttctctccctggagccgtagaagggctaataatacctagaccataaagatgaggtgaggactaagtgaagagctgcacagaaagctccttttatatctggagcacagcaggtgcttaataaatgcatctagagaaaaatattaaggtgtgtttttataagattccagaatgagaaacagaggtcactgtattcattctccagaaaaggggtcccagctttagactaggctatggaggactgttggggcagacttcttgcagggttttgttcccatgaagatccgtggggcctgaaattagcacagcagggaagtgcaatagccctactttagggaaggaggagggtaaaaatagggtgtgtgtccctgagattagtttcctggatcagctctatgggtccatgtttgagcaccagggagagaggagttgcaggtagaagttatttccaaaaagaccacagagctgtgaatacaaagtgagggagatgaacatttgtcccatttatagatcggaaaaaggtgtgactttggttgtgatagtatttcttgttctgacagcttgatattataaacaggcagcacccttggctagatcaagggatttctcctggtggacagtgagagccctgagtaggatggggcactctcaaatgcaagaaacaggaagcctcacaggatgggccgaacaagaaagaagcaacatggtagacatcatgtagaagtggatagcaccctttctgagcttacatacaatgccacttggagacatctagaaaaaactgaatgagacttggaggaagactggagtcctgccttaacaggtagaggaatgaggcagcaaaccacatgtgattattataaatagaacctcatttgtgcctgcaggctgttcaatttctccaggtctggggaaacatcagttacacactctgcttaaactctaaattactcttaggggtctgaggtaatttccaaagacgggtatccctatgcttcttttgtgtatttcttcccttacttctgacacactgttggcaagtaagtccccttgtttcattgtctcaaatattcctcaaattcacttcctccttcctcagttttattctgggtgcatgaggaatagggtccacttcttcaggcatttagggtggtataagagctaacctatgccctatattatgttaagtgcaggaaatctaaggagctataaagcatagacttttcccttcaaaattttgtggtgtgatttcaaccacacatcttaagactcctcgaaactctgttaaagaatgaatggaactactcatttactcattcactcattcactcaaccaatcaactaataaacatgctctgagaactctcctgaccttgaggctggctcctggggacacacagcccctgtgcttgaggtgcttctgatctggggatacaagtccacaatagagagttgggcactgagtagcctccactgttgacagtgggcaagctgaaaggacaatgcaaattatttttgtaaaaatatattccctaagccatttgtcagatgatttcttttactcatcctcttccgtgcaagatgtgcctgattgatgtggataagggatcgggtccacttcaaggtccccttcagaggcagtgtagagtaaggaaagagcacaggcctcaggcctagatcatcttgggtttcaatcccagtctaccattgattagatttgtaacttcattcaaatcacttcacctccctgaatctcaacttcttcgtgtgtaaaaaggagctgatttatgcaaagtgtatagcatagtcctgggcataaataggtactcagtagatggaagctattattttattcaaaatttcagctttggcaaaatttattagtgttcaacaaataaatgaactttactgtgatgagctactgagatttgggagtttttctgtattaatggcctagcccagcctatactgactagcacaaagggcagggatgtggtcttctcatgttctctcatctgaggcaaccagttcagagctgcttgctcgtttattttatttgtttcccttttaaattccaagtctcaaatttgacctttggacgatgctagttggtaaaaggcccaggttttcccacatgctgattgtctgctgtgcttgtccagtgtctacatatggagtgggacaacaatgcttgtaactgatcctgcgtggaggcctcttcctccctccctttttcccccatccctggttctctggaaagtatcaggaataaacaagagcacatgtggcacagcattcctctctctggctctgtcgccaacagatgggacacaataggtgttcctctggagctctgattctcagcagattgggagtgcaaggtagtgggtgggggtgggggtggtggatgctagatggagcaaaactcaagttcttcaggtcaaacgcatgtgtgtcatggaatctgagggcccgaaggaactgctaagaccattcaacattggtacatagtttatctgggacagattggggaggagaactgcccacagtcacatagacctctagtgagaaagccaggacctcagactcaagccttctgaatcccaattttgtgccttctgtatgttcctggacagctttgctcaagcatttacagtggcttcctatttttaactgtttcaaattcaaatgttctggtctgataattagggtctaagatctgattctcactttacctttctaggtttatttcaaactcaatgagcaacttggattggtacatcctgctcttgaaaatttgatctacaatttcaactagtatttttttaagtccccctcttctctgatttctattctaggatccccgtttcctagttatgtgtgtctgtcttcttgattctactctgtcttgcccaactctggtttctgtgaggtccaaccctctctactagagtggcttttgggtgcatatctaggaagagcacattgtgttgcaacagatagggtatgtacggagtgggtgggatctgattttagagcctcctgctagaggggttgacacagcagtgtccagggcatggctatctctgatcacagcccaagaggcaggcatcaagagggtctgagatgaaagataaggaaccgttcagcaaggtcttacacagggattgggtaactgtgagaggtgacttggaagttcaggaagaaaggcaaactcaggaaggtccatccagaagtcagggcagcatagtcaggaaacatgatgagaggccactacctgaagttgagacagataataagtgtgggtctgttgtgtggctgggatcttacaggtggggaattgtctttgtgggcatcaaaatggacagaagttcccagggatgagtcaggccaagaggcatatttctcaaggctgaaagttgtccagtgaaaactacaaagctggattcagaatatctgaagtcttagaaaagggaattcgtgctgtgtgatgggggagaggatgagtatgattttaggtgaatagtcattttggggctatgggtcatgaacagaaggaggaagtagattaggaggttcttaattcacaataaggactctggatcagatattcctatttcccccacctgctcctggacaacactgcgctggcctagacaaactcagtaatttcttaatttatttattcatcaaacactctctagagtctgctctgtgccaaatcctgggctaaacactggggaaacagcagtgaatcagatacattcccaacctttaaggatttcatttctgggagaaaaacattctcccattactgggtatatacccaaaggattataaatcatgctgctataaagacacatgcacacatatgtttattgcggcactattcacaacagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacactgcatgttctcactcataggtgggaattgaacaatgagaacacatggacacaggaaggggaacatcacacactggggactgttgtggggtggggggagaggggagggatagcattaggagatatacctaatgctaaatgacgagttaatgggtgcagcacaccaacatggcacatgtatacatatgtaacaaacctgcaagttgtgcacatgtaccctaaaacttaaagtataataataataaaaaaaatggagtgataagtgctttgagagacggaagacaagggggctgttgaaacacagaagaggcacctaacccagattggaggcaaagtgaggtagtcagagggagtggattaggaagtttctaaaagacggtaatgtctgctgagagacatgaattcaatatatgaagaagaaacagtgtcatattgttttagagaaatacaggcaggcttgtgagatgaactggcagaaaaacaaaacaaaaaaacttcagttcatgagtggaaataagcaatgggaaaatcaagtaggttgttcttagatgtccagatttgtaagcacatggcattagggaggtctggactcttggttgaggttcaagagaagagagaagtgattccaggctcccaggaggaggctgacctcatctaaagggagcctaggcttgatgatggaagcctcacgtattatctcatttattgtttactatatctacaacctggccaccagggctctctgcactagggtttgagctcaaatttccagctaagagtaaggtgttgctttgcttctcatgggtcagactttgtgtatttcccttccttgaagccttggtggaaagtaataactggtgatggagcagaattgggtaaggtggatcctagtactagacttactattcttcctgtgtagacttctttgctccttctcttctggctctgatggagacattttgggtagctttttttttttttcaaatcaaggctcaggagagggctctgggagaaaaggaccttcattttagttcagctcagctcagtcatgttatgcactgggatttggagccaaaatcctaggtaataataataataactaacttctcctctcttgtgaatatatttgcctcaaggagttgccagggagaattggctgagatgaggttagatttgggtatttttgaatcccctggcaaaatcctgtcatgatgttatttcagcaacaccttcagcaatattgctgtcaagtagttttagccagagactgattgtcccccagttccctgtcaacctcctccttgggaccttgaatctctttgctcttctcttgatcttcagccaagagtttaaacctcactggtgtaatttacttgctaacattaacatttaaggacttcctgcttattttcccatcactgaattctgctcatttgctactttttaaaaatattttttaattgacatataataattgtacatattcatgggaaacatagtgatattttgatatatataatatatagtgatcagatcaaggtaattagcatatccatcatctcacacttatttctttgtgctggaaacattcaatatcattgttctagctgaaattatataactattattgttaactatagtcatcctacagtggcatagagccctagaacttattcctcctatctacctgtaatcttgtatcctgtagcaaatctctccctatgtatgagatcaactttttttttttttttttttagcatccacatatgagtgagaacatgcggtatttaactttctgttcccggcttatttcactttacagaatgtcctccagcttcttccatgttgccataaatgacaggatgtcagtctttttgatgattgactagtattccattgtgtatatacaccacattttctttatccattcatctgttgttggacacctagatctacatcttggctgttaacagttctgcaataaacatggtggtgcagatgtctttttgatatactgatttcctttcctttggataaatgcccagtagtgggattgctggatcatgtagtagctctatttgtacttttttgaggaaactccatactgttctccacagtggctgtactagtttacattcccatcaacggtgtataagagttcccttttctccacatcctttccagcatttattatttttgtcttctcaataatagccaccctcatgggtgagatgatacctcattgtggttttcattggaatttccttaatgattaatgacattcagcattttccatatattttttggtcatttgtatgtcttttgagaaatgtctgttcagatcatttgctcatcttttgttgggactccagggactgattattccaacaataatggtgaatttttcaaacaaacaggtagggtacttgacctcatgcttagttacattttccctttcatgttttccttcactgttaaacagaacagtgagttgaataccagaaattcaaccagggtgagtaaattaccaaggtaatagcaataatggccatttgtagaacagtgtggtatgatggaaagaacaggagtcagtaggaactaattttgaatctgtgcttagttaaccagctcggtagctttcaacaagtgacttcactcagtttccttatctaaaaaaaaataggtgtcataattcctaccagataagttttttgagagaagtaaactatatttaattcctcaagggttgagtgcataatatattcttcatatactcagtatctatagagcacctggcacacagtaggtagaaagtgaaagatagcagttagtaatatttatttgggagagaatatattataaacatccaggcaaatcaagaaagagaacgatcatcttgttcttcactgtatggatctcaaaatcagaaaggcagatgggttaagagttcaaggcagttctaattacaacgctaatgttattagctgttaattatctgcatgttgctatcaacttagctcagtcagatgtggtctctctttctgaaagcaaatcttggttctctaaaatatctctaatgtaattaatatatttcattacctttgttctggcattagctgctcaaactaaacaaaacatgggcagattttggccacttattgaggaactgttttgtgtgtgtgtgtgtgtgtgtgtgtgtgtgtgtgtgtgtgtgtgtgtagagagaaagagagagagacagacagacacagacagacagagacagagagctagacagagatgtcgccagctctgttgattatggattttgctatatagaattacagttaaatgcttatgtcagattagcagtggttagctggggagaaggttgtatacaagttgaggactaaaggtaacctttgaaatagttgcactgttgctttttggatgggcagatacgatttgaagtcccttgatcatatctgagatcatccttttatggcagaacagccagattttgctttgccaagtcaatctaaaaagtaactcaaacagaactgtggtggggcctggcctctacattcaggtacttgtaggaataagataaggaataggtatatgttgaatgaggtataataagaatttgaaataccttttaaccagataactacaaaggcaagaaacttatcatgtttctaaagagagcaaggaaatgccagcctgtaaccctcaggtttaagggtcaactctcatttccctcaaggattatggtaactagtccctataatcaataagaaacctctggtaccctctgaacttttgtaagaatcttgaaagatgcttcttcatgtgtacatacagtaattcaacaaatgtttgaacaccaactatgtgcccagcagagagatgaataagatatggttctgtctgtaaagcgtccacaatctaatgaaggaaaaagatatcatagtatgcagtagtatgatacatgctacgatagaggtttgtgcaaaccactgtgaaagcacagaagatatacctacatctgtctaggcaaggaggggcttagagaatgccctcgaaggtggtcacgatgaataggaattaactagatcaacaagtgtgaaggaagtcatttgaggctgagggaccaacatgtgcaaaagcctggaaatgaaatagaagttagtccattctaggaactgtaaatacttgagaatagtttgagcacaaagaagaaaaactgggaaaaaaaatgaggaggggtgtttgcccaagtgctttatgaaagccagagatgagcgcccacccctctcccaacgtatgacattttgaatgttgctatttcctgcccctaaagatcctttatcactggaatagtggtattctgttaagtttaggcctcagcctatccacttaaaaaggtacctggttgactagcctccagaatcaaatgagatagtggatacaaagaacgtaacataatcctgtcactccatggagtcagaagacctgtttaatcactagctttgacatttagggcccaagtgtgaacttgggaaaaagctatttaactagcctgaacttcagtttctttatttatcaaatgggtgtgcttatggagaggattcaataaaataattttctatcattcaatatataaaccgagttttgctgcttaagcaaaatggtttattagtattaatcctgtgggtatctggacccctgttccatttatgcatgtgtccagatcaagttgtctaacttgccacactgatgagcttgagttctcccaacagctttggtcaactagaatcccagctgaccatacaggctggctctttgctgcccccacctgtctggagccagcttccacagtagcaacaggactggaagcccagcctggtgctgcagctttggcctccctcccacacatcctgatatgtcaggaatagaaagtgcagcacctaggactaacctcagctcataccccttcccagtgtgtgtttttgtgtgcttgcagatgcacctgggagatgcagatccattttgggtgaatggtggaggctgtgtagtcagtaggcaaaaagctaatacgttcctgtttgtccagagcctcagtgacttcttaagcacctgagagtctgcagtcttaccggaaacattcccgagattaggtcaaattcatatctgatagtcaaatttggaaaggccaccattctccttcagaagcaaatgatttcaccagctccatcttccagccggaaacattcccgagattaggtcaaattcatatctgatagtcaaatttggaaaggccaccattctccttcagaagcaaatgatttcaccagctccatcttccagctgcgtaaattagttaattacaaaggctgtaatttgcaatcaatattatctccgtggcatctacttcaccgaaggaaaatatttatggccatatttgaaaaggggcatattgccttaattgggagccatacatgaaacattgcactaagtgactcttagggcactgatgtcagtttttgcttttttggtctgggaggtttgggggagaaaacacaggcagattctagataaaggccctgattttcacaagataaaaacagccacagacactgatcctcagacacaaatcctaaacacagagaaatgctttatgcacaaagatgcctgtgattgaattttttataatggtgaaaaaatatgcacttaaacgttcaaccaaacagttatttacttacttatttacttgatggaatattatctagtcttaaaaacaatggttatgaacaactatatattaacatggaaaattctaatactgtaatattaagagaaaaaagagtaagaaaaatactagatatttgacatcttctttataatatgcatgcaaaaaacagcctggaaagaaatacatcaatatagcaacggtgatagtttttgagcattttaagtttattttttcatgtgtttttcttgaatagacatatattgattggcaagcagaggaaatgatttgtcataatggcaaccccacaaagtcactatattccacatcctggagtgaggaagctagcctgcatcatggaaatatattttccttcaattaggaagcaagtattaaaaatatatacaatggactggatgcttgtctttgccctcaaagcttcatgaaatattgaagaaggacaactctgctgctgtgtgaaagaggctcgtacagacagttttctcctaaatcagcctgggtggtcagtgaaggcttcctagagatgacgatattgaaaatagattttgaaggataaggaggcagataaggagataaagcattctggaaaaataaaacaggacaaaaaggtatggaagtgtgaaagaatctgttatgttttggggaataaccagtgcttagttgtggctaaaatgctgggtgcatgaaaaggagtgataaaaggggtcattaggccagattctgaagagccttgaatgccagtgtaaagcagcccttctctgagaaaggctagagaggttggcatttatcctgagggcaataaggaagcatcaaaagtgttaagcagggtcaggaagtggccagagtcatatgccaagaaggtctctccggctgcagcatggacttgggaatggatttaaggggtggatttgtgggggatacagatacaggttgaaggtagagaggccaatttggggactacagcagtagttctggtgaaagttgcaaagtgtgaaccaaggaatgctagacttacaagagcccctggaaatcttctagtccagtgtttgcatttgacattggaggaaaaacaagctccagaaggggaagaacttttatttgtaaggagttctttgcaagactcttaataggctttagcccatccaccaatgtatggtgtttctgttctctttaaagtgttcttgccaataggtggtccagcttttgctcacacacatccagtgatggggatcttgccacctaagaaagctgatagtaaccccactcttgattcaaatggttcttctattgagcctaaaatgggctctcttaagctctgctctccaatcatagtattccctcatgtagccacacaaagccattctgctgccttctgcattgtgctgtgtgttttcatgctgattgtctaattcaaccttcctaacttccattctaagtaagcacaattattatttctactttacaggtggaaaaattgaaacaagaaattacatggaacaaggataaggtcttttctctgggttttctatttgttatcctcaggttattttgactccagtgctatagttctgagtactgtctgggccctgggacttccttagaaaacactctcatttaaggtttgaagatctgaactgaatatcgggttccccagagacctataactggtacagaatatagaggcatcatcactccttgtgatggttaattttatgtgtcaccttgactggctatgaggaggtacacaaatattggatcaaacattattttgggtgtttctgggagggcatttttggatgagtttaacacttaaattgataaatgttaaactatgctttattgttgagtaaagcagattgccctccgtaatgtgggtgggcttcatccaatcagttgaaagtctgaatacaacaaaaggctaaataagagaatattattccctgaataagaggcaactcctcttacctccctgattttgaactgggaaaccagctttttccctgccttcaaactccaaccgaaatatcagctgttcctaggtcttgagcctgtcaacctttggactggaactatagttggctctacctagttctcaggcctttgaactcagattagagctataccattaggggacttaataaatgataaagtttctgcacagctaaagaaataacagggtaaacggacaagctacagaatgggagaaaatatttgcgaaatatgtgtctgacaaaggactaatatccagaatctacaataaactcaaacaattcaacaagaaaaaaaaccaaacaatcccattaaaaagtggacaaaggatgtgaacagatatttctcaaaagaagacatacaagtggccaataaacatatgaaaaaatgctcaacatcactaatcatcagagaaatgcaaattaaaaccacattgagatatcatcttacaccagtaagaatggctatcattaaaaagcaaaacaacaacagatattagtgtggatgtggagaaaagggatatgttgatggaaatgtaaattagtataacatctatgaaaaacagtatggggatttctcaaagaactaaaaatagaactaccatttgacctagcaatgtcactactgggcatctacccaaaagaaaataaatcattgtttcaaaaagacacatgcacttatatttttatcacagcacaattcacaattgcaaagtcatggaatcagtctaagtgtccatcagtggctggctggataaagaaaatgtggtatatatacaccatgaaatactatgcagccatgaaaagaatgaaatcatgtcctttgcagcaacatggatggatctggagaccatattcctaagtgaaataactcagaaacagaaagtcaagtaccacatgttttcacttacaaatgggagctaaacaatggacacatatggatataaagatgaaaataacagacactggggactccaaaagctgcgagagtgggaggagggggaacgttaaaaaatgacctgttggggacaacattaactctatggttgatgggtacactagaagcccaaacctcaccattatgcaatatatccatgtaacaaaacctgcacatgtgcccctgaatctaaaatttttaaaaattagagatattaagaaagtgaaaaggcaagcaacaacaggggaaagcattgacaataatataattagcaaatgatttatatccaaaatatattaagaactcatacaaatccataacaaagagacgatccaattttggtaagagcaaaagattgaacagacatttcacagaagaagatatttgaatgtccaataaactcatgaaaaagtgttgaacatcattacttgttagggaaatgcaaattaaagccataaggaaatactactaaacactcactggagtaacaaaactcaaaaggagtgacaatatcaagtattgacaaaggtatggagcaattggacaaaactgggaggagttataaaatgatacaaacaccttggaaaactggaagtttcttatataattgattctgcaattatattcctggctacttatccaatgaaatcaaaacatatattcacaaaaaagacttgttcaagaatgatgatagcatatttttccagaaaagccaaaaactgaaaacaattcaaataggtgaatggataaacaaattatggtatattatgagcaatggaatgctaaagaagactaaaaaggaataaactattgatacatgcaacaatctggatgaatctaaaaaataatatattgaggaagcaatcggacctagaagagcacatgctatatgatttgatttatgtgaagtccaattgttccagcaccatctgttgaaaagataatcctttcttcattgaattgcctttgcatctttgttcaaaatcaattgaccatatttgtgtgggtagaactctctactctgctctattgatctaaatgtatatgtctttgtcaataccacactgtcttgattatattaactttacagtagttattacaattgagtattgtgattcctccaaataaacaaacaaacaaaataaactacaccattggctctcctgggactccagcttgctgactgcaggccttggaacttgtcagtcttcataattgcatggcccagttctttatagcatacacacacacatcttactggttctgtatctctggagaactctgactaataaatatatccctccttgttttataattagacttctattaacacagactttgatcacattggcctttttggcatccacattgcctaagtggcatcagagttgacctaatgaatttgagagatagaatgcaaacctaggtctcatggtcccagcccaggaccttttcattccattgcattgcaccaaacataccaggactattcgatagaaaacattcttattccttgtaccactcttctggcaccagacttcccaagattctagaagtgacttggttttctaatacatctaactattcactacatgtttatttattaatagagcaaatattttcttccttctaatagtgtgttttacagtaggcacagtcaggaagcaaactctaagaagcaattttgatttcccatcaccatctatcacctctggttccctctgttatgtctaacactgctcagtaggctggaacacagtgccaaataattaaccaacatcccctgctaagtaagccagccctagctggaggcctatgcacactccaaggttggctagactccaacaccaggggaaaggtcagctggggcagactgagtactctggtgatttaaaggtgcaagtccttaccaatcacctttcctgattctctccttcttcttttcccaaggcctctgtttagaatgtacttcacctttgttgtctgcctgagaagttcccattttcccctcaaaacccagcttcaatgcctcctgcttaggaaaagcttcctgccccttccttgctgctcacacagcaccctgcacacatttctacttggctatgactattgtactgcattgcttcacttctccttgtcctcctttagactttctctaggtcaggaataaatctgattctcctgtttcccagtggccaacacaaaatatggaacagaagaggtaccaaagcatgtgtaatgcatggatgaataattgaacaaatgaatgttgatatcacttgaatttcaggtctatttatttcatctctgaattaaggaacctctgctaggccttagttttggcatctgtagaatgggaatatctgcttatcagaatcgttaccaggaatacataagagaaaaggatggtgggacaaaaggtgtgtgtgtgtgtgtgtatatgtgcacatgtcattaggatagtttccttctcccaagatgtgtcaataagactgtgagccctccaagagccatgtgtttctttgagcctttctctcttcctccctcccttctttcttccttcttttcctctgttttcactgaacacctaatatatgccactgggaatgtaaagaaaggaaagtcaaacctatttttctgcttttaagtggctcacaatgggggagtcatatataagatgacagtcacaaaccagcacaccaagagctaggacctaaaatacatgggggtcatgtgagcatggatgaagaacattcaccataacccacatgatcagagcagacttttcttatgaagacttaacctctaataaatgggagtcagttaactgaaggcacaggaatagataggttaggaagagcagtaagaaagaatggaggacatcagaaagttcagagtgcagagtgttagggtgaggggtggtagaggagatagtggttgggtaaatgttaaaatgtaagactggagaggcagacagaggtcagtcacacaaggctttattagctctagtgaggtattggtgtttagatgcaggtcagtgggagttgggggaggaatctacttgctggagtagcatgcctagatttgctctccaaaggaacaaacaagatcccagtggaagaagaacaactaggggtaaaaaggctctaaacctgacatccttgggataaaagctaatggctggggagcttggcctggagaagagatgacttggaggtaggccaggttactgccttcaaagctgaggggctacgggggcaagcgaggaagcagatgtgctctgcgtgctccagagagcagtgctagaacaagtgggtgtgactggctgacctggaatctcagctctgcaactacctgtgtaaaactggcaaatctcttaaccttactgagcctcagtttctccatttatgcaattagaactgtaatactgacctcagcacattgctgtaaggatttaatgtgaagatgtacatcaagtgcctagcacatgtttggcacatgggagatgctcatgttaggctctttatgactctaaaatgaatactgagatgggtgagaaacataccggcaggggtagcttggagggaggagggaaacaagaataatttcagcttcgaacacaaacacaattctcttcgcttcctattttgggaattgctgcggaggccaggagggagggaaagattccgattttagcgcaacccgccttctcactgggtctgtgacttccaatactccaaccagcctctggagtcagttttatagaagattctgtccctgaactgtcctgatggtatcagaggtcttaagggtcaatttaaatatcccacctcagaaaagccctccttgatatcccagcataactaggactttgtggcacaatatcttattgcaccatttattttttctttgccctgattagagtttgtctgtatatatttgtgtgattgtttaatactttccaccttcccccatgtaagcagagactattgatattttatgatgttttctattgtattcccagtgcccagaggagtgcttggcgtataataggtattttattcgctcattgactaagtgaataagtgcataaataaaggaacaagtaggaaccaaggggaaagggcattttcctcagaagaaagagcatgagcaaaggcaaagaagtggtaaaatgcatcatatatgcaagtaccaagtgaaaaactcagagcatctaagagataaaaatggaaatatctcttggaggtagtctgtatgtgtctctcagtgccctgttaatgacattgcactgtcttctatgggcaatggggagacaaggaaggtgcttaagcagggaagtcctgtgctggaagatttaggggggaagaaatgaaaggaaggacttctccactgctttcagactccgtggctttgccctctgcttgtctaggaccttcattttggatctcagagcccttctaccttcacccacaattcaaagtgacagggactttctcttataaacgatccctttattgcatttaagccccaagcttcaaggaacaacttcttccctaaaatctcaggtaatgaggatctccctcctgtcactcctttgataacccttccctctacagtcaatctttagcttgcttcagaagatgagagtcccaagccagcctcagctactatcacatgcttcagtctcacattctgtaaaatggggctgatgataattgcattataccaattgataattggtaggataattaaacaaaataaaaggtgtgaaggagtttgctgaattggctggcactgttaaagccatgtaccatcaccatgaactactgaaactggcattctgggccagagaactggcacacattagcaaaacatgtatgtgagctacaatcccagtccaccacctggttcctttgcaccccacacccaaccaaaagcaggtttgtggtgggagataataagcttcattcaaagagactccagagcctaggaatcagatgaacttcaggttaagaaaatttggaaatggcctcatggcccaagaaagaagatataaagcaagaggaggctggaaagttagaggttacaaacacctccagatagtggattgaataaaggtctaggcaggagaagaataagttttatcttgttccccttaattgtttccatgattttgattccatgccagcatattgcctatttgagcccaaccttctgaaccctaaaagacttaacaaacgctgagtctttctggttaacaggaaaccttcaaggatctggctccaatgtccttcccaccctcatcttccattgcatcacttcacactctcctcttatccccatgccccggagtctgctacatgggactattcaccagtcctcaaataggctctgcactctttcaccactatgcttttcccactgcctgaatattctttccccctctatcaagatcaagataagtcaagatctcaaacaagtcaagatcttgtttgtccttcaagattctggacaaatgctatgttttctttgaaattacccctgatttcttaaatcagaattaccatttttgtattgcctcagtatgctattactgtactatactttcatttggtagaaagtctgcagtatttgaattttagttggttgcttccatgtctttcctccattatactgtctctgcatctttactgactagagcaggtctcgatatagccaaggtgcttagtaaattcatgctgaagcaaatgaaagaggagtaatagggaaagtaattcttatctctcacaaaatggcatggcaagcactttgtaaatattaactcttataatcctggcctctccctagcttcccaggtcatgggtctttacatacagccaacatctgcttatgctacagaaaagccccagaagcctactggggtgaaagctctggtcttgtgtcttcacactgttggccaccatccacactgctatcgttttcttggctctcagattgtctggctccatgtccttgctctggataactgccccatgcagttatcaacttcaactcaaggcaaacataatttcttgagtaactactgtgtgcagacatgtagttctgcatgcttccttgtttaggaagcccttttaagcgggttgcaagcaagaaacagtcttagctgtacagaatcatgacagctgggaaattttccacaggctgggggatgagacaaacctcatgtggtggatattcccttttacaaatggagtcacaaaagtgaaaacaggctggggactagcagggagctgcattgctagtaagtattgaaaatgggggccaggagcggcggctcatgcctgtaatcccagcactttgggaggccgaggcgggcagatcacgaggtcaggagtttgagaccagcctgcccagcatgtgagaccccgtctctactaaaaatacacacacacacacacacacacacacacacacacacacacacacacacaaattagccgggcatggtggtatgcacctgtagtcccagctacttgggaggctgaggcagaagaattgcttgaacccagcaggtggaggttgcagtgagccaagattgcgccactgtactccagcctgggcaactccatctcaaaaaaaaaaaaaaagaaaaaaagaaaatggggttcaaatctctcccacctcatgccaaaacatcagacagtagaagagagaagacggattactcccctcctaccaccatagaggtgtctctggcagcagctgagtctcctccattgctctagcacttgctggatagagccatggaggttgccaaggctctatcttttgctaggtaaccatggctcctaggatccagtgccacctgttctccctttgacccttatgcccagggtgagagtatcttcctattgttgctaatctctgagtttctttaccatttcctgtttggcttctcaactggtgccagttccctgcattgaatcctctttgtttcaaatatttggagtgattttttttcttggttatgtactgactgatacattcagatttagatgaaactaaaaaatatcatggaaataatacatgataacaactcagtcaaaactattaactgtgcaacagtaatgcttgttcacaacaggttgtgttaaggataattctaggctgccagttctgccagttaaaatccattacttagctctagttataactcaactccctttttttcctctcatatttgaattgtaagaaaatgaagagtgacattatcattatcatagaagtaactttaaatctgctttacctcatataaaaaagtagatcatttgcaaaccttggtattttcactattcttagcattgtgtacgtgtgtgtgtgtatgtgtgtaagatatctcacaaccattgctctttgctatgatgccttccaaaataaagggttgttgagatagaatagatctttagttttggccattctgagtctggaactagagtgtccaaggtctaagatgaacccagtgacagcttacacttctctttttgggagcttgttcctgccactcatcatcagaaacagtcatgagcacttgccatatgccaggcattgtggtcttagtgtggacataagagcttggtggaccatcataaaccatcagagctactttatcaggaaactgagtcacagagaaattaaagaactataccaggatcgcatagatagtaaaaggacagtgttgagatgtgatcctagtcagtctggctccagagttacagcctatgccgttggccacaatgctttaatgcctctctatagagcagtcttgtctgcctggtggcccactaggaccctcattcagtgtaccatgacctctgtttctcccctttcagtctcctttccaaaggcatcatatatccccccattactgagataggaatgtgcacattttataatcatgccattggaaaagtataagttctgccctatggggtgaaggaggggatcaaaaaggttctgtctcatattattcctcctcacccttgaatataaccagtcagagagaggctgaaacatctctcaggggaagagactgaagaacagaaaatagggtagttggaagaatttgtttttccaggagttaaaccactttggaatggaaagcaggaaaaaaaaaacccacaaaaatgattttctgcttttttttaaacttaaaattatggaaattgtttctgacagcaaattgctcctaattaatttcttggctctgctgggaaaatgtactgttctgttgatttctaaattccaccagcttaattatcaaaatacattttttttcataaaactattaacatgtggggttgcagttagggggctgtcagcatagtgcaaaggaaaaagagagagtaggggagcaagggttggatgagcaccaggaggcctagagactcaactcaaggcttggtacccatgttccaaagtctgggagaaggtagcagccacaggaaaagaggtcttaatgatgcaggcagaatcacaatgcagggagtgcctgggaatgaagttgggagatctggattcaaattccatctatactacttaccttagacaaacagttgaatttttgctgcgcctcagtcgtttctataaaatgaggctagaaataatgttaattaacatttgtagaactcttgctatatgccaggcagtatcccaagtgtttctatgtgcattcacatgccattcttctccacagccctgtgaaataggcattgcaactctactttacagatgagaaaacacaagttcagaggggtcatacaaattgcctgaggttatacatgttaagaaccaagtagccaggatcactggtaagagaaaatgagtttctagcttagtgccaaactattgcctaacctgtctgtcttcctcattagactgagagcctcttgaggtcaggggaccaattcccccgattttgtatccacaatgtaggtaatgtctgataagttaataaatgaatgaacaaatggtttagatgctcaattagatactggcagaattcaaatctggaatcagttaatttggtgccattcaagaaaaacattcaatttcagtcacttggtagatgttaatcaaatatctgctgtatgccagtcactgagctaatcaataaataactttgggcacctagcaattttgcttttgggaatagatcataagaaaatatttggataattgtataaaaatggaagaataaagctgttcatcacaacattatttcattttttttaaacgtaaaagttcattcatctaacaaatattgctgagggcctgctacataccaagcattgttctagacattcccattgaacaagacaaacaaggtccctgtccccatcaactcacaatcttgtggggaagatagagaaaacccaaatggttatataatgtcaggtagcaatgagacctgtgaagtaaaagggagcattttcgggtaaggaaatgaactgtgaaaggaattaatttttggattggggctcagtaaaagtctctctgaggagaggccatttgagtcattcttaatgacatgagggagtgaaccatatgaacatctgggaagattagtgtagagggcagaagtatagtctataagcttgttttctttgtgaccttgggcaagtcacctcagctctctggccctctgggctggaagaactaagtccctctcctccatccttccagctatgatccaggcgctcctccctcctactggggcccagaacaaggttccatatctgagagagcctcttgttaccaaaatattttgcaaaatcccaagtgctacagagatgtaagtcagatgcaagttaatcctacctctctgctgaagccaagttcgactattacttcctttctgaagccttgccttactttgtcgggaaggatgtctctgggctccctttatactttttatgcacctctgctgtaacatttagttttttgcagcatatgattttttaacttcttgaagcaaggacaatgtatcctttgtttctgaatcatagccactaactcagtgcttggcacatggtagtacttaatatgggatagctgaattaacttgaaagggcatttgtggattgagcaagattttgacatgagttgggtgaggtttttagttacattgaaatctattctctcatacataatcggtacacaataaaaactcactgaatgaataaacacatgttgtgaaaagcagtttctttttgctgagtgaggattacctcatctctgcaaggaaatccatgttttgacagtaatcagacctggcaatacagggatatagagtggggacaagtggagggatgtgagaaagattcaccttcattacagatctactttagcaggcaatgtgttaggtagaacactgaatcattatcccagttgatcctcagaacaaccctgagggtactttttaattatccccattttataagtgaagaaaaatgagtcagagagattaaggcattactttcatacacaaagtagaaggggtgcagtaggatcaagaagtcaggagtgtctggcataatgtccttgctccccagagcccttggcactgaaggtggttggggaaacactggaaaatgcttggggtttcctctcctggagctgcatccgctcactggcacttacataaggagatggttgctgtttttagaaggtactcatagactcatagtcacacaaataaacatcctaatactttagcgagttgatggacctgccgtgtgaattctgcacagctcagactccatctcaggggagaacatggctttctaaggtaatcatgttttctctgctctaatggcatcaataacctttccctcttattgttgccacaaagtttttcaaggtactcgctaggttgtgagtaccttgaggttcagggcttggaattcttgcccctcttgtgggtagctcagagcctggcacaaagaggacctcaaattattgcaaataaaaggaaagagactgtgatggttaattttatgtgtcaacttgactggatcacggagtgcccagatatttgcttgaatgttatttctgggcatgcctatgtgggtgtttctggatgagattaatattcaattaatagactaagtaaagtagattgtcctctctggtgtgggtgagcctcattcaatctgttaagagcctggatagaataaaaaggcagagaaagggaaaatttgctctcttcctgagtgcctaagcttacacatcttctcctgtcctcagactctgacttataccattggctgtcctggttctcagacctttggacttggataagaatttacaccatcagttctggttctcaggccttcagactcaaactggagctacatcaccagctctcctgggtctctaatttgccagttgcagatgatgagacctctctgcctccctaatcatgtgagccaattacttacaatacagatctaggtctcctattggttctgtttatctacagaaccctaagtagtgcagtttagtgctgagaagtgggatgctgctgctagaaatgctgaaacacatagcatggctttggaactgggtagtgtgcagaggctggaagagttttgaggtgcaagttagacatatgaacattaaaagcacatctgttgatgtctcagatggaaatgagaaacatgttattagatactagagggaaggcaatccttttgcaatctgttattaagtgacaaagaacttggctgaactgtgttctagtgttttgtgaaaggtagaacttgcaaacaatgaaattggatatttagctgaagggatttctaagcaatgtgtaaaagaactagcttggttcctcctggctgcttataataaaatgtgagaagagagatgaattgaaagggtgaattgttaagcaaaaagcaagctgaatgtaaagatttggaaaattctcaatttatccatattgcagaaagtgagaacatatgtttagaagagaacaccaaggaggtggccagactatcatttgataaacagatcattggtccattggtataactcatgaacttaatcagccatctcaacagaagccatgaataaatgagattataccaggggaaacactgccagctagaagtaaaggagactcagaaatcaggacagaatgaagcatggttgttgggcttcttgtattttacaagataaaaacatagagctatttagctataaatgtgccctgttcctcaaaaaaggggaagattgacaccaaaagtaattcagagattatcaggactgccacttccaccacaggcccaggggacagggctagttccttttccatttcaaagggtggggttcccactctggtgttgacagatcagaatgcccctgcccagtaccttaggggcagagcattgaatcaaagagggttatttgcaagccataatatctaatggagttctccctggtatgttttggacttgctcagaatccatcacctctttcttccttccgatttctccctttttggaataggaatgtcaattctatgactaccctagcactgtattctggaagcacataacatatgtctggtttcatagcttcatagatggagatgaattttgcctaaggataaattgtattttgagtctcacccatatctgatttagatgatatttaagtgagactttgaacattagatattagagttgatgctggaatgagttaagactctggggctgatgggaggaattaatgtattttgcatgagagaacgatgtgaatattggggggccaggggcggaatattgtggtctgaatgtttgtgtcctcctaaaattcatattttgaagccctaactttcaatatgatagtatgtggaggtaaggcctttgggaggtctttaggtttacatgaggctatgagagttgggccctcatgatgggattaatgtctttataagaagagaaagggagaccagaaatctttttctctttctactgaggacacagcaagaaggaggctgtctgcaagccagaaagagagccctcaccaaggcaccttgatcttggactttccagcctccagaactgtgagaaataaatgtttgttgtttaagccactaagtctatggcattttgttataacaggttgagcagacaggcaaagagttaggaaacttctcatttccaagaggagtttgagttgagaataaaattctgttgacctttgtcatcattgaaccataccttcacaaagccccagattcctaacttggtgaaagttgttgcatgttcagcatctggagagaccattctttcttcagaaccagggtgctggtggcggctggctttctttaccagccttgtgatttgttcttataattaggctttgcagtgattgaggtttcaaacaaatgccttatcctaataaaaaatagctgtctatcatagaccccagggttcctctgtgaatggtgagttataaatgtgttaaatactcaaatgctctggatttaaactgggcttctcagaaacaaaggtctctaagcactattttatgctactaaatggacttatgggtttggccctactcagtgaggtttgagatgagggagtcagtctaccctgccaaaattatctcttagaacccctatcaggggcagaatgtttatgtttatctatttattcaacagattaaacaccttttaagtgactaagattatgtcagatgctgggatctaatgatgagcaaaaacagacatgaactctgtcctcctggaacttataggctagtgggagagacagatgttccttaaataatcacacaaatatgggtataattacactctgagatgagtgctatgaaagaaagaacagtgttctatgagtgcatatagcaaaggggtctgaccaagattatgggttcaaggaaggtttccctgaggaagtaagtttgagttgagatacaaatgatgtgtaggtagtactagagtgaagaaagcaagaatgttacagtaaaatggaagcattcaggggtagttcaggggtctataatcttaataagcctctgccaattctaaatatacaatcaaaaataatctaactaaaaacaatttgctttctctatagaaatgcaacttcaagaccctagaactctctaatcagaatgctgcttttaagttcttccaataaggaaatttgagagacaacactgatcccagcagagggaatatcatgtccaaaaacctgtaatcacagaaaccatgtaaatcacagaaattggaagaagccagtatggaatgaatactggggcagaggaggaatatgagataaggctggtgtgattaccctgaaaatcttggaaagtcactgaaaggttttaagccagtggagatggaaaaagtgggtacagaaatgaccacatgtactgtttgacgagtggttccagggacaccagttagaggactattgcagtagttcagatgaaagagaatgacattttggagcagggtggtggcagtggagatggaaaaaagtgaatgcattgagatctttaggtgaagcaccagaaggagtagaggcagaggacaggcaacccagatatgtcttggttctgttacaaattgctctataaccttgcacaaatccctttctggggcctcagcatccctctcacccaccagggaggctactaagtttcctcaaaaaaaaaaaaaaaaaaaaagtaggaatctgcaaaccataggattaggtaatccttcaaaggtcttccagtgctgacattctgtggttcaataattttgtgatcttaaagcttttcttctttatactccaaatgcctaagactatccttcctaaaaacatacttgcgggaatgatactcatgccagtagcttgatgataaatagttgtgacaccttgaatcagggctatgaagcaaacattgccaggtgtctactgcacaaaagaaaaaaaaggatctttggttggaagtttccctagggatcaaaaaaaccccacaagaaaaccaataacaaaaaatcagtgtcagatgggaaaatgccttggatgatgataatgatgatgatacgtataataatttcttaacttcgtttggtgtcttaacatgccttgtctcatctgacaaaacaaccttgtgagatatgccagttcatagaaatgagtagaatgagcccaggagataaggaaataaatgtcagtgtttaaatagacttagattcatttattaaacaaatatttacagaacttcttttatgtgctggttgtagaggctgggctaaatgtaatagacaaagtctttattctcatgagggttaaaagataataaaatataaaataataaaaagataatatatacaatattatatgtaaataaataacatcatatattatatatagtaatattatataacataagtaatatgataatatataattattaattatataatagtaagatatatagagacataaaataattattgtttctagtaagttctatgaaggaaaatcaataggatagtgagttggcaagtaaaatgaggaaagcgattttcaatagaatagtcagaaaatatttttggtgagatggcattacagataaaaagaacaataactgtagaggctagttacgggtttgacttgtctgagtaacaaaatggagaccactgtgattgcagcacagtgagtgtgatggttaatactgagtgtcaacttgattggattgaaggatgcaaagtattgattctgggtgtgtccaaaggagattaacatttgagtcagtgggctgggaaaggcagacccatccttaatctggatgggcaccatctaatcaggtgccagtgcagctaggatataaagcaggcagaaaaacaggaagatcacttagcctcccagcctacatctttctcccatgctggatgcttcctgcccttgaacaatgaactccaagttcttcagcttcgggactgggactggcttccttgctgttcagcttgcagatggcctattgtggggccttgtgattgtgtgagttaatattacttaatgaacacacacacacacacacacacacgcacacacacgcacacacacacactatatatatatatatatatatatatatatatcctgttagttctgtctctctagagaaccctgactaatacagtgagtgtgatagagagagtggtatgaggggcatgggagagatacaagaactcaagccaaaagagctctgtagaacataggaaggattttggattttattttaagtgaagggaagccattaaagggttttaatcaggaagattatactacttgattctggttctttttagaaccatatgactctggctgttgtgaggataatgtaccaaagagtggcaagaattaaaactggcagaccaagtaggcagctattacagtagtccaggcaagagggggattggtagcatagaagagaaacatggcactgcagatgaaaagcaatgaataactacccaaagcaatctacagatcagtgcaatccctataaaaataccaatgaaattcaacacagaaatagaaaaaagcaatcctaaaatttttctggaaccacaaaagacccagaatagctaataagttcctgagcaaaagcacaaagctggaggcatcacattacctgacatcaaagtatactataaagctgtattaacccaaacagcatgatactagcataaaaacagacatatagaccagtagaacagaatagaaaacccagaaataaatccacgtatttaattaactcatttttgacaaaggcatcaagaacaaacattggagaaaggaaaagctctttagtaaatgtgctgggaaagctgggtatccatatgcaggagaataaaactagacccctatctctcaccatatataaaaatcaaataaaaataggttaaagatgtaaatgtattacctgcaaccatgaaactactagaagaaaacgttgggaaaatgctttaggacattggtctaggcaaagatttcttgagtaagacatcaaaagtacagacaatcaaagcaaaaatcgacaaatgggattacatgaagctaaaaagcttttatacaccaaaggaaacaatcaacaaagtgaagagacaaactacagagtgggggaaaatatttgcaaacaattcaatttacaaaggattaataaccagaatatataaggaactcaactcaatagcaagaaaacaatctgatttaaaaatgggcaaaagatctgaatagcaatttctgaaaagaagacatacaaatggccaacaggtataaaatgctcaacatcactaattatcagggaaatgcaaatcaaagccacaatgaggtattatctcaccccagttaaactggctattatcaaaataaaaaagaaaatacaaatgctggtgatgacacagagaaaggggaatgatcatacactgttgatgggaatgtaaattagtatagctactatggaaaacagtaaggaggttcttcaagaaactacaattagaaataacatacgatccagcaattccaatgctggatatccatcgaaaagaaaggaaatcagcatattgaagagataactgcactcccatcttattgcagcactattcataacagccaagatactggactcaatctaagcaaccattaaagaacggatggataaagaaaatgtggtgtgtgtgcatatacataaatgtgtgtgtatatatacacacatatatgtgaaattgaatgtctttatgtctttttgacataaagaagaatgaaatcctgtcatttgcaacaactagatggaactggaggacattaggttaagtgaaataagccaagtacagaaagacaaatgtcacatgttcttacttgtatgtgagagctaaaaacattgatgtcctggaggtagtaaataaaatggtggttaccagaggctggaaaggttagtggagaggggagacagagagtataaggtacattttagaagcagaatacacaggagttggtgatgaattaggaggttggttgaaggaaattttttttaacttcttcaactttgcatacgggcaaattgaagcccaggaaaaataagaaatgggaaataactgaaacaaaacctcaatccaagacttctggccccacatacagtgctcgtcctggttcaccatacatctctgctcttggtgtcagcccagtgtgtggtggacagagggtgctcacttaattgcgtgtgtatcaactgcggccaaatttctgtatgcaagggaggcttctatgtctttttatataagaagtcctgtaacttgcttcattcctcacttgacaattgctctctggtcccagccttggtgggtcaggaaaggaagatggctttcactcctgctgagggtatatagctgctctttgccgatttaggagagagaagtggaaagatgatgagtgtgttttatagaggaagaaatgagtctgatgttaagtctaactcttccacacgttcacgctaccttcagtctcttaattttcatgttttcactgggatatttgggaaccatggccaattaaagcccacttctcctggcttaaatctcttttactctatgccctattcatacagaatacctctgtgtataagactcccaaggcagagatacctctgtgtgcccggtgcctgacacagaagctggcatacagtatacaatgcgtacctgcttattgagaaaaacgaggcagttaaattctcctggcctcagttttctcaacttttaaaatggaataattaatagtcatctcacaaggttgtaaagtttaaatgacttaacatgcatgtaagatacctaacagtgtaggagcttaaaatgaatttatgtattattatacatgaaaagctttcacttgttcaatatcattagacattagggaaatgagaattaaaaacacaagctatcactacagaccaattagactggtgagaataaaataaaaaagactgacaattccaagtgctagcaaggatgcagagtaaccagaaatctcaaatattgctgctaggaatgaaaattggtacagcttcttaaaaggttaaacaaagttgttatatgacccagcaatctcactgctaggtatttaccatagagaaatgaaaaaacttatgttcacacaaaaacctgtaaaagaatgttcacagaagcttttattcataatcgccaaaactgcaaacaattcagatggccttcagtgatgaatgggttaacaaactgtggcacatctatacaattgaataatacaagtctaaggaattgtaagcaatgaaaaggcatgaactattgatacacacaatttggatgaatctcagaagcattaagctaagtgaaagcagctattctcaaaagctacattgtatatgattccatgtttatgacactcttaaaaagacaaaattctagtgatagagaacagatcagtgtttgctaggggttaggaggaagggtgtgactaccagaggtagcacaagggagtcttctagggtgatggcactgttctgtatcctggttgtggtggcagttactcaaatatatacctgtgttaaaattcataaagctgtatatttaaaaagtcaatttaacggtgtgttaataaaaaatgacataaaataaacagctttcccatattggcattactacctagtacttgaggcctccaaattttctaaggtgtctttgtaatctaagggtagagtcttggttattcaaactatctcttactacaaaaccccccccccccaaaaaaaaagaagagagagaaggagcaggttgtagacagtgtggaagtatatgggagtctggtttatctagaagtttctaaagccagagcagcgatttcatttcaatttaatcctgaactttcaaagaggaaacagctccccgccctccaaccccccaccttattttaaagctttgctagtaaaactgtccttgcactgaaccagcaataaatctacagaacactatggtaatacccaaggagaaggcaaaaaggggcctccataaaccatgagatttgaactactacagatgttgcagtgagaatttatggttttcgatggatccttatctcttcttgccagtttctgcacattgaatcatgcactagcagagtctattttaagagtcataatttttttctttaaatattaaaaaaatctgtggcaattaatttcttccatactgttccatcatgacaaataaatgtgaaatgcatatttacagagcacatgtaattgcttttgggcacatgcaaatgacatgcaaatcttacgttctaaatgagtttgtttatcattcctgaattctaatccaaagaccttactttttaaattcagtttacattctgacatgtatacaaatgagtttgactctggaaaataacttaataaactcagggttagctatgcaattagaggaggcatctgggagctataaaatctgggaagcaacatttacatctttttctgcattcaaggtttcaatttccttgctcaatccctccccatcagcctgcactttcctcaccctaccaccccatttcccatcattccagcaatctcatcttttgaaatggcttcctttcctttttctttttttttctaggagaggtggatgagtgtatttcactgaagatgatctcaccaagtcattgtcctctgtgtagcgttttcaaaaactaagatcagagcgataaatgaaatgaaaactaacagaattaacattgatcaggactttccattcgagtttcttatgattatggctgccccagttctcctgtggatgcttaagtcttcccatggattattgaccctctaaagaaagctatgagcagtcacaaatctgatttgtcaaaggacataagagagagaagagaaaatgggatcatattccctttcacagggaagaaaagagaaccataaagcaaagtggaatggtggttcctcagaaaattaaaacgaactgctgtatgatccggcaatcctacttctgactatttagtcaaaaagactgaaagcaaggtctaaaagagatattttgcacatccaggttcttagcagcattctttacaataatcaagggtagaaacaacataaatttccatcgagggatgaatagataagcaaaatttggtgtacagatataatgaaatattattcagctttaaaaaggaagaaaatctcgttgcatgctacaacatcaatgaaccatgagggcattatgctaagtgaaataagctagccacaaaaaagaaaatatggtatgaattccactcacatgagatatttacagtagtcaaattcatagacacagaaagtagaatggtggttaccaggagctgggggaaggggaaaaaggggagctgttgtttaatgagtgtatgtagaatttcgattttgcaaggtgaaaaattctgacgatctgtttagtagtgttaagtaattttacttaactctactgagctgtacacctaaaaatggttaaaatggtaaaacaatagcaacaaacattgtccagggcaggggtaccttataaaaaaaatttatatgtgtaataaaattgccttattttggaacaacaatgattgatttagggttattgaactatgtgtgacttacgatttctgaaattttcataatgaggtgatattttgcctagagcttatataaatttctaaggatcatgttttaatataaaatattttgttaaaatggaggttttaaaattaagttcaaaagatctttttgtttttaatagaaatcagctttaaatgatcatagcaaaatctggcccatgaccacctgtttttgtatggcccataagctaaaatggttttcatattttcgaatagttaaaccataatcaaaagaagaatatcttatgacatatacaattatataatattcaaatttcagtgtttataatgaaattttattgcaacatacacacacatatactctaaacaaaaacaaagtggaaacaaaaaattccaaattctgaatttcattgacgcccagattaatagaactttctagtcagaaaggccctttgaaatgatctagtataaacttctcattctatagatgagaaaaccgagactgagagaggtgaaatacttgccttgagtcctggtgagataatagaactggaacttccctccatgctgagaacttttctctctcaacagaatgggtaaactcaatgggtcaaactgagcctcagagttctcttctgtttcttcctgattcccacattttggttacatatattgaatattatatttcttataagccatgcactcctcacagtcttagtgcacttagtcctcacatctgtcctgtgaaatagtgttattcctaagctgtagagctcagtattagtctccttctgccccccaacaccagccatgctggtctttgtcaggttgtctatccatctatggtgaattctgtgctctggcacccacctgctccagcctcctgggccctagctctgccctgatgccctctcactgcaggatctttaacatctcctcctctgcttccaagacctaacccacagttaatcaacatgttcaaatccctctcagcttttttaaaagctatccctcagtcctacatctcttctcagtcaagcttcatgaaagcgtagtctccacgtgcaatctctccttcactgatttctcactcctctgcaatctggtatccatgctttcccatctgactacaatgacttctttgtgtttaaaatcaatgatgctttaaaaattttatttgacaccagtgattactatgttcttgaaacgcatgcactaactgagctctcatgtgcaaagtcatatgccctgttaacaggaaagacaaagattgataaacaccttattattccagccatttttagtattacttcatcctttgcatatgccttctcctttgcttagaacactctcccatctccagtgttgtgaattcctgtgcatttttaaagacccaactgacatttcctcctttgtcagcgttcttggtatgctttcaagaagagttgatctcttgcttctttgcctccactatggcttatatatttaagtcaacagtgacccttatcacacagtatgcatttctcatttatacctcatatggattatatttttcttgaagcaggtagggacatgtctgattcatctctgtatggtaggataaattcccatttcaagtcctgtccctgcttagtgacctctttcctttatgcttctaccagaggaagatggactacaatgaacaatctcatggtaaacaaacatacaggcaacacattcatcagcacaagtgtatggaattcttcctgggtagtagagatgtaattctggacagctagtatgttttttcttgtattaggaccagtcccaaggagaggcagaaggaagtgaatatttcttggaacaatagtggggagggtggttggtcagtcctaaagagtaaggtcaaagctatgttgatcaaaaaattagcttttttttcagatagggaacaaggctacatcatatcagagaaaagtgcttgtcactgtgacagatacctgcctcatagcttccatggctctaatcggaacaaggtgacttacatttactttattcactgacctaggactcaatctacctccagaaactgagaggtctgaacaaacatgaatagcagtagtcatcaggctgcagcctgaaggatttcacacagaatgcggtatgaatgcacctccagtgaggagcaatagatttgttctgaaggagcacagtatgctcaccacactggaagatttgaagagatgcctgcatgaaatgtgggtgagggaagttaaggggattcagagtaaagtccagaggtattaatcactctctttgcaaaagcctaaatatggagttctctacctcccaccccaagagctgaagcatagctaacttagctagcattgtaccctttattcctcctgtaacaaccttttgagattttcctaatttttaagtaaagagcatctatatgccagtagagtatagcagttaagagtaaattctggagccgaactgcctgggttcaaattccacctttgctacaggccatgaaactttgggcaagttatttgctctctgagactcagtttattcatctgttaaatgataacaattatggtatttaatcatataagtttttgtgaagattaagtgagttaatgtaccaaaagtacttagaacagtgcctggcatgtaggtactcataagtgttatgtgttatcactgtttttcacagcataggctgaagtatctggtctagtggaggccaatgtggtaggaagtccagggaggtacaggtctgacttgtcccacttccttgagagtattggcttaaagggtataaactcttctggttatcagcagtgtgagagccacaacctgggagctatcatcagagagaattcaggcccaaaacacatcatttagactaaatttcttgattgtcccacccataagtataggaaggtaaccatttgtactttaaaagaaaggggcctgctatacctgggttattatgggtctgtagtactgctacatgctaaatactcaagatttgtaagatagatagatagatagacagatagatagatcgatagataagaaaaagaaaagaaaggagaaagaaagaagaaagaaagaaagaaagaaagaaagaaagaaagaaagaaagaaagaaagaaagaaagaaattcatttatagtaggcaaaataaatagtgggtatcaagacacaagtacctcctgcctgcttcacactgaccttaaccctctgtttcaggctttaggccttagatatccctcttatattgcttcattgcctataattcatttaactaccatttatttatttcatgacttttggcacgccctttctcctcttgggctcagttacttcatatccaaagtgaaacaaaccagtttaggcatggtaagtaggttttatctcacatgcagatataagggaatagtgagtggctagagtactgtgtaagagaggttttgaaaatgaatccaggctcagcaggaaagagtttactgatgtcatgggtatatgagataagtgattggcagtccatgtgtcatgtatttttttttttactcttgaacaacataaaataacctacaatcattttcttttgagaagtcctaaagtattacccaaccttaatgagagcattgattacagtgttgtggttttctcattataagatatagttatccctttgcacatgtcaagttacccagttgaaacaaaaacaaaaacaaaaacaaaaaaacgaacttggctgggcctggtggctcatgcctgtaatcccagcacttcgggaggccgaggggggtggatcacctgaggttgggagttcgagaccagcctgatcaacatggagaaaccccgtctctactaaaaatacaaaattagccaggcatggtggcgcatgcctgtaatcccagctactcgggaggctgaggcaggagaatcacttgaacccaggaagcggaggttgcagggagccgagttcacaccattgcactctagcctgggcaacaagagcaaaactctgtctcaaaacaaaaacaaaaacttactctaccagaaacttctccactcttgtgtgagcagctgaaaccaaggtcaaagaaggcactttcataaagaaatgaggcaaaaaaaaaaaaaaagcctgtattttagaattggcgttctcagccacttatgatcctgagtgaatctcagctgggtgatcctgagtgaatcacacaacctaaatcttagcttcttcttctctaaaataggatttgatatttacaattataagatggcaactaggatttagacaataaaacgtatagtacctagcagagtaaagtactttgaaggagaccctcagtattgattccttttctcatcttcaaagtgagtacaaggagtcctggactataaatgtcttggggacagagacggtgtcttttttatctctttatatctagttctgaacacaaatatttaagaaatatgtattgggttgaattaaacttagttcaattgaaatgaaattaaatgattttttacatccctttcagtaccaaacacagaacctggtacacagtctgtgctcataaatgcttatagaatatagttctatggtggcctgattctagaattggtacacattaatagaaaaacataattctcaaaggaacattagcagaagggccacacacccactcactgttggcattgtctcatcagaagaactgccacttgtagctgcttcctgctccataccctctttctcagagggaagaaagtggccctaataaatccattatgttccttcagcatttatgtgaagaaaaaaaaaagtttctaattttctactgtgaagccaggggacactgagaaatcatattctttcctgtttgggctcagcctatcttgtccctgcaggctacggtgaaaaccactattcccctttcacatcatgtcagtttcctttccaagttcccttactgtcccagtgacttaatgggcggactacaactatttcaatgtctgagtcattatctcattgttctaaatgacatatttttgccactggccctataactgttcttcaggtgaagccataaagtatttcatggctttaatgagtacatcagttattgttcatggaagagccaatgtctccttaaaggttatttgaaggttgattgctatctcagtgctttatatctggcaaatctatctcggccttatgaatgcatttgacctttttataggtacaggggaaaaataacagaacaaaagttaatttagatctctataatacaacatttttttttccgaaagaaatgaaagggcattgaaatcgatacctgcaaaataacatgctgatgaatgttgggatccaattttctcattttgctaactcgagattgggaattctgaatagttttcaatcctgcattctttgggcactgtgaagtctgccgtattgtgtccacaaaatgctgctgcacactcattataggagtaccagtggtcctgaaaaggtcagttagttagaaatgtcaacgttcaatggagccgcacagacctgtgtgcgcacagatccaattagagtggccaggcaacatcactgtaacccagaatcctaatgagcaactaaaagaaagatggcagcacctttttcccctttcttcttcttattcaaaagaaatggagattgcttttcaaccaccctacatggggttgtttaaactttaccaaacaccacttaggctccaggtgggctgggaggggaaccccagcttctgcaaaagttaaacctgcctagaacagccagatgtggaaaggaaaataatgaagaaggcaggagcagtacttcagacttcaggctggtggaatgggtcatcctttgcaagacttaggttgatagctgactaagacgaaaatggcctccttattaagtttatttctaagcccctgctatgtgccaggccttgtggtaaaaactggcctttgcctttatttttttcaaacctaaagcactggtacaagcatgtataaagagtgcatacaactgcatttatatattggccgatgtttcaacagtgcctctctctttccaattcatcataagctgacattttgaaaaagtatgctggtcataaatattatgctgcagcaatgtaaaactgctattaaagtttctaaatgctttctctcaatttctatatttatctcattgtggacagtttacactctggcaccagtccatggatgacactttgagtaacagtgttctagctacctctcctttgcttcttaccatctactcctcactcccaccttcactgcttctcactatttatctgctgcttctaggatgacaatcatactagtcacccttttcttgttcactcactacataattatttaaaacactttttgagactgggggcggtggctcacgcctgtaatcccagcactttgggaggccgaagtggacgaatcacttgaggtcaggagctcaagactagcctggccaacatggtgaaaccctgtctctactaaaaatataaaaattagctgggtgtggtggcatgtgcctgtagtcccagctacttggcaggctgaggcaggaaaatcgctggaaccggggaggcagaggttgctgtgagccgagatcgcaccactgcactccagcctgggtgagagagcaagactccatctcaaaaaataaaataaaataagaaaataaaaaataaaacagtttttgatatttgtcttttggtaccacagactccacatatagtgagaacactctcccagcagcccctgtctgggcttcagtggttaactagcctgaaataacaaataaaaactctaggtaattttgttacaaatgattcaccgactatactttgagaacaaatggaggattttacctatcaatggattcctaaactcaacaagtagtgatgatctgcttggctctaggccccaggcactatagcaacccatcccttcaactgaggtgacttagccctgtttgcagctgtcagatcccagaatcattctggctttgtggtcaggtaagggtagggacagcagatggaagaagtactgggttagtaaattggtgggtaaggtttgctgtctgcatttgctctgacctttttgcctaattttctgtagccagactcttgtctcaggccccatgactatctcatcccaatactcatttctgcagtaaatggctcatttgtccattcatttttttgtttggttttgtttttgtttttagcctaggtctcactctgtcacccaggctagaatgcagtggtgtgatctcggctcactgcaacttcaacttcccaagctcaggtgatcctcccacaccaacctcccaagtagctgggactactggcatgtgccacaacacctgactaattttctgtagagacggggtttcaccatgttgcccaggctgatctcaaactcctgggctcaagcgatctgcccgcctcagcctcccacccattcagtttttcttctaatatctcagcaacctctggatgaaccagcatccgtgattaggaaggcagctgagaaatcagaagttcattggattttgagtcggaaaacttgggttcaaactctgacttttccacctagaagccatgtgaaccatagacaaatctttttatttctctgagcttcaatggcaaaaataggactcagatgcctacttcatatggttgttttgctgtttaagcaaaatgttggttgaaaaatcaccttgtccattgtaatgtgctatatgaaaaccacttgtagtggttgtcattattgcgctattattatcgccccctgcagtggatacctttttaaaacactttttgatatttgtcctgtggcaccagagcccttatccgtagtgagaacacttacacagcagcccatgtctgggcttcagtgaactaaatagcccaaagcaacaaaaacccagtggagagaaagtggttaggttgcccctcctctgcatctttaggaaggaaggaaaggatgatccaagagattttgagtaaaaaacatagtcagggtagaggacttagtgggaccaacacgagcatgtttctgaaacaatctctgctggtttagctgagggaacaaaacataggcaggggccagagcatggaagggggttagtaattggaacctggcctctaagacagtatcatcaagtgatatgagatgcttccctatgcaccgtctaaggctggaactgagcccacctgacaaactcattaaatggcccttgatacaaaaaaggaagtcttatttcccctacaaatagctgaaaaccaccagttttcttttcattaatgcaattaagaactcttctctaacaagccagttttctgtataatctttaccagaaaggaaatcctttgtaaggacatccagccagccatcaaagaacggacttcatctgggttgggctgatcctccctcattttttcagtttctagagagaagtgcatcaggcttttaagataattattcagcaaccatctggacaggaggaaattgcatggcaaatgccaaacatagagcctattggcatgtcagagaatgacctaatatcctgtggctaagttattgagaaaaataaaaaacaaaaaaagagatatctgtggtgaccatcctcagagaagaacttcccataacaacatgagcatttccaaggttctggtatgtgccagatacgtacttttttttttttttttttttttttcagatacctactttatcttatctaatgctcatgacagccctatgaagtcaatattattagtgctattttagggatgaaagacttgaagctttgacaaattaagtgttttgccccaaatcatatcaagatcaaatggcagatctaagatttgaaccctggcctaactgatctcaaagtttccactgcattttagactttctttttcttttctttctttttgagatagagactctattcttttgtcccagtagtattgggtaagcaccagtaatggcaggtcagtaaatcttgctaagaccaaatgcccatattcctctagcctatcctcctcactgtctttgatgatgttttagaccagagcatgaaggatgtgtaccaccctccgtgacatgcccatgggtcctaatctctaggaactcctaatgtatgtacttggatcacacttgcctgaattcagtagcagccccacactcatttgccaagtgtgtaaagaactgtgatataagctggaaactagacattggggcacataaccttttttcctaaattagagaattttgcttttcttagtccagcaaatagaaaatgtttcacactttcactaccaaaacaagcattcttacagttttaggtctacgttaggataggaaggtgtagatggacaaatttagctgtttattcatggaaaaaatgtagctagattattcttaatacctttctccaaaatctctgccaatctcaaaaagcgaggctaggcaatctcaaaaagccatatcttgggaaaaagaaaatccttggagaaatgagaaaagataagtgggtctgaaggaaccaaagaagtaatactgataatcataatcatcatcattatcattttggcgctggcctccaggatgcccctgaatgaatctaacttcctagtattcacatccttgtctagtttcctcccaggtgaatagggctgacttacataactagtaggacattatagaaatgataggctatggcttctcagcctagatcataataaacattttagcttctactttgccctattttggattagtcactctgaaggaagtcaattgccatgttgtgactcaagcagccccacagagaagtctatgtggcaaggaactgaggtctcctgccaaaagccagcaccaacctaccatccataggaatgagtcatctggaaagatgatcctccagccccactcaacccttcaaatagatacagccttggctgacatcttaactataacctcatgagagaccccaagccaaaaccatccagctaagctgttaccagattcttgacctacaacaactgtgtgagataataaacatctattgatgtttgaaactgctgaggtttagggtaatttgtgatgcagcaatgtaatcacagtaataactgtttatttaaaatctatgggtcatgtactttactacattagccactttacatacatcacatctaatcttcacaaaactctaagaagtattattactatcttgcttttttataaacggtaaaatggaagtaaggcactgaaaacttaataggccttcctaaggccaaactgaaagcagaagagagaggattcgaacatataacatatgtatgtactacaaatcaattacaatgacaaaattgatcgttttttcctttatccttcagattcccatgaggtctgtctacctcatggctgggctaggttgactataattgcactgcttcaggtcacagcacattacactggcctacaagagatattccctgatgccccataagtgtagagacagacttatgctgctgcagaccttcagcctgtggatttagacctccatccctgaaccaatgagaaccagcatcctcccagctaaagttagatgagctcttatctcctctcaaacctcattgtgcagaaggcctggtgttatcaacagagctcctgttcatagcctctaacatgcattacatttacatgttaataataaagtcctaggggatttattgtcatgattacctcacttaatctttatttcatccctatgaaataggtgccaccattcatatttgatgaaaaactaagccccaaggcagtttaacatctttcataaggacagggagctaagaagtggcagaatcaagataggaacccaggtctacctggttcctaatcttttactccatgatcttgattcataaataaggctggcatcctgctccatatctgttaatcatagctcctagactctgtggtctgctctccccagggcttgctgcctgctcccaagatccttggtcactggtatgggtctggctttaatcagaaaagccctccttaggtccaagatattacaaccacctgatgataagtcccttcactgcccagagattctagctgtggagcctctagtagccttaattttttggatacaaggagtgaagcagaacagatccatgtttgttctgctctcaggctttataattcatatacttggcttaaaatggccacagagatagtcactgcaaaatttcaatattgcaaaatttgggccattttcaagtaatgccaggccccagtttatcccccaatttcaggggtggtatttatgagccacctctcagccaatcggcacaacagactttcctggacatatatacttgttcaaagatgggttcattatgactcaatcacagaatgagaagtgataaaaaattctgctaggacttctgagtgagtctcttgtttttcctaggagtagaatttgggagaatgtaaagtctgcagctgctacagccatcgtgagaccacatgtggcctgagaatggtgttaatactgagaaagttgagttaagagaaggagaaaaacagattgggtcctttgagccctgtatcaagatgcacaagatgtcagatttatttgtggattattcatttacaagaaccaatgagttctctatttttgcttaagctaatttaggcttggactgaagaatcctacttatatagtccctgtgccttaatttaatttagcttttgtgtcttgaattcaagttcctctaggcctgaggcctgccttcagcctaatagtgaaggtcttaaccagttctttcctgacctgatctccctcatgatgatcagctatggtgccttgcgatgccctaccttcccagaactcagtccattcaactggatgttccaaaatgggacacctgatcccttcccagtgatcaatcccttcactggagccctggaataacggcatctttcatagatttctcaggacaaataccttaggaacatactaattagtttgtctctcagagaccacaagcacatgtatgcttctccctgcctttatgcatttctcaaattctgaagtttctttattcaggtttaactaatcgtccgagtaacaccaatgtgatgttttttgttgttgacctgagagatggagttttttgggggatggaggtgggagtattaattggtacaatctttccggaaaatgagttggcaataaagcccaataattccttaaacatattaatggtctttgacccaaaaattccatttctaaaatatccagtaaaaaactaatataaaaaagtaaaaagctttttgcacaaataaatttatggtagagttatttataagggcaaaacatctagaaataacataatgcacaacaatagaacttttttttttgcaaataaggctacagataaaaattggaacatactagagactttaagaataaatatacttttaaaatgctcatagatctggtaattccatccctagtaatctattttaggataataaaccaaaatatagacaaaaacatacatgcagaggttgagaaattattcataaggtagagaaacaagaatcaagttaaatatccaacattattgacatgggaaaatatttctgctgtaatattaagtgaaaaatcaatagaaaattttatattctatatgatctcaactatgtaaaacaaaattatacatgcagagaaaaaaagcaaagaagtaaatgtgctaaaatattaaatagtcattgcctctgggagataactgatattttcatcactataaattttctgtgtttctcaaaatttgtacaatgagcatgtgcaattttttaatagagaaagtgatgataaaaagatggtgtgtaaactacatagcaacatggagattgtttatgaaataatgttaagtgaaaaaagatgtatataaaacttactgtgattgcaattatgtaaatatgtttctgcatatagacaagaactaaaagggaaaatgtaaaaatagaattcgattttgtattgtgctaaggttgtgggattaggagtaatttatttttcttctctaaagatgattttaaagctgttttaatgatgtgtatgcagtttttgaaacagcccctcggctgttagaccactatactgctagactggctctgcaggtctcatattggctctgaaaatggccataaggcagtatctagtttggcctctcttgttcccttagtctcagaagggctgagttcaaatcataggagactttaattagagaaaaagcccagagttgtcatgtactgggaagcaggatcagtccatcaccatctaaaataggtattgctttaacaaggttaagaggggataaagaactttgtgaatatttgcagtacggaataaacctagctgtgatttttttctggaagtttctatcatattttaggaaatcaattgtatcttcagaacacagcctcattagtgaaaaaaacccagtgactatcatgtccctgacattctaggctttctttatgcctagaaaagtgggtcagcttgaattctgtctggggaagaggactgaaagggataatatcacagatgaagtgatatttctatgcagcagtgaaaaagacaaaggatttagaatacgatttagatttgaatcctgattccattacttattaattgtgttcacgtggacagttcatataatctcatagcagcttgttttgcttctctgcaaaacaggaaagataactgccttatggtataacagggagatttatgtggaaaatatatataaagggcttaacctagctctgactctgagtagacattcctaaatgcttttcctttagtttactccaccaaatatctataacaatttgacaagatggacaacataattccatgaagatagaatagtcttctcaacaaatagttctgtgaaaactggctggccacatgcaaaagagtaaagttagactcctaccttacataatataaacacattaactcaaaatggatctaatacctaaatttaagagataaagctataaaattcttagaagagagcataggtatgggccgggtgaggtggctcgtgcctgtaatcccagcatttgggaggctgaggcaggcagatcacaaggtcaggagatcgagaacatcctggctaacacagtgaaaccccatctctgctaaaaatacaaaaaattagccgggtgtggtggcaggcgcctgcagtcccagctactcaggaggctgaggcaggagaatggtgtgaacccggaaggtggagctttcagtgagccaagatcgcaccgctgcactccagcctgggtgacaaagtgagactctgtctaaaaaaaaaagagaagagagcataggagtacattttgaaccttgggttaaacagtggtttcttagatatgatataaaaatcataaacagcaaaaggaaaaatggataaacttcatcagaattaaactttttgcttcaaagaacaacaataaagaagtgaaaagacagcacataaaaatgtaagaaaatatttacaaatcatacatctgataaaatagtatccagaatatatattctgaaaacctcttaaatgcaataaaaagacaaatatagtccaatcaaaaatgggtaaaggcaaataattagaatagacatttctccatagaagtaatacaaagggcccataagcacatgaaaatacatttgttatcattagacatcagaaaaaatgcaaattaaagccacaatgagataccactttacacccattaggatgtttgtaataaaaagatagataataacaagtgtcagagaggatgtggagaaactggaactgtcctccactgatgatgggaatataaaaggtgcaatgattttgtcaagcagtttggcagtttctcaaaatctttattgtaaagtttaccatatgactagcaattccattcctaggtacatatgcaagataattaaaaacatctgtccacacaaaaacttttgtgcaaatgttcatagcagattattcgtaaaatccccaaatggaaacatcccaaatgtccaataacagatgaatgaaaaaataaattgtggtgtatctaatgtaatactatttggcaagaaaaaggaatgaagtatgctgatacatgctacaacatgggtgaaccttgaaaacactgtggtaagtgaaaaaagccagtcacaataggccatatatggtatgatttgatttatataaaatgtccacaataggcaaatccatagagacagaaagttataacagcggttgccaggggtcaggaaaaggagaaattgagaatgactgccagtcggtatggagtttatgtttggggtgatggcagtgttctggaactaggtagtggtaatggttgcacaactgtgtaaatatgctgaaaaccactaaattatcactttaatgaggattttatggcatgtgaattatatctcaataaagctgttattaaaaaaaggtatgaccagcacttttaacttggtgggaatataaaaatctttctaaaagtatgataaagtatattagtcattgaaaaatattcatgtcatcctcattgcagtgcacttccctatgggaagattgcacatatctacccatttgaatttatggtcatatgaccataaattcaaatccttgctttgatcaaggatatttaggcagaagtgacgccttctaagagtttttaaggggagagtcgtggctcctcatccctcccttttccctctgtcacaatgactaacatggcaaatgctaggcctccccacaatccaacctattttcccagcttattatttctggatgtgttgaataacttccaactggcaacacctgcaaatccatcccgaaggttttctctgacccattggaatctggtcattgcatacattgagcagatcagaagtgtcagggaatcaacacctccaccctctctcctgctcctttgtccctgagaagtataactatgtagcttattttccacactggttccatgggctctccagtgggattaagtcccagttgccctctgtggtagcttgcttgataatgaatctttctcggctttttttcttttcctgtctcacttcctcactcctctaccaatgtctctgggatcacctccaatttgcactaaagtctttgtgtaaaggtctgcttcttagtgaaccccaactaagacacccagtgatattacaaatagaggatgactgttccgcctggctgctagaacacaaaagatacaaagcataactggctgcagtccaaaagggacatgtaccaagagtgaataagcctttgctttttaagcttttgcaatttgatgtaattgttacttcagtgtcacaactagtgaatgatgtatacctctcctcagtaattcttattctaggaatttttcctaaagaaatagttagagatatagaccaaaatttttatataagaatgctcaccgtggtgttatttgtaatgaaataattggagacaacaacagtaataatatacaacaataggggaattaaaaatagaatagaatgctttttagccatataagattccctcttagagaatattaaataatattggaagatgttcacactacattcgaataacaatagtttatatggtatcattcaaatttcattttaaaaattatatctacaactgtgtatacttggacaaaaaataagtctctctcctcagtctgctggtaaggattttacctggacaggaaaagaatacggtacttcctcatattgcctcccttctactgacgaggttataggaaaatcaactttctaaaaagtaaagaagaaactgtagttgaacttctgggccaaacgactaaataagttcatatttcaataagcccatttattcccatcaaatagtaatattggataatatgtgaaaaaagaaatgaaactatattgttgggctccattgtgggagacatcaccacaaagctcaaatgtacagaaatgcaaaagggtaagtggttctggggctactggctagctgaaatctgaatgtagaagaagacagtagcagttggacgtctgcctcctatgggataagggagactaaaagtacactacaggagatgggaatcagagataagcttctgcttagagcaaggaccttgggtggggctctcctgtcatgaaaggagcctagaaaaaaaggctgctgcataacttttgggagatagctctcatccattgtaggtatagagaggtgaggaatatagactcaggaaccagatgcaatggttctgttaactttttgtcattgaatctgcaatatactcaatattccccaggtcctatactgaagatgtgggtagaggcaactgcaaaaaccatcacacagggagatgtgaacacagtgggagtttgaggggtgagaaaagagaaaaccagaaaatttccttctcaaagtgatcttacaaattaaaatttcaaaacacatgaagaaatcgaatgctaaaaatgatactaaacaaaatcaacaattggaacttgaatttcctccagatgaaacttattttatggaacaaagattttaaaataagcatattgaggatgttcaaagaaacaaatgaagacattaaaactgaacaagaaattatgaaacagaacaggcagaaataaaacaagaacaggtgggtatgaataaaattagaaatcttggaaatgaaaaaacatagtcattgaaatattgaaagagacagaaaaaaatctagactagacatggtcaaaagtgaatttataaatgcaagttacttgtgaggaattcaaaatcagtgcagtaagacaaaaataataaaagttatgaaaaatcaattaagaaccatggagggctgcttaatagcatctagcatttgtccaatagaaattgttgaagagagtcaaaggaataaaggataaaagcaatatttgaagagttaatttgccaataatttccctaaattaaagaaagacatagaatcttaagtgaaaagtatactcagagtatcaagcaggataaataaaaataaattcacatctagacccaacaaagtgaaaaggcaaaacattcagattaaaaaataatattgaaacctgcccaagaaaaaaataggttaccaaaacaattatatgatggcagacttctcatcagcaactatggatcccagaagacaatgaaaaaataggcatacttctccactgtgaattctactgctgttgcatcctctatatgggaatgcaagacaggctttcccagtgactttccagaccttttaccataatgcaacaactatcatctataagtcttggtactcatcaatattttcaactccaaatagatcagtttcattctgacacccaatgactatgcctcctttcagcagggagtagccagaatgaatatggtgacaaccaaatcccaacaaaatgaaatggaacttggcagtggagaactgattgtaatggtgtgcccccattttcctaagagatagtttatttttctctctctgtctcttcttttctcatttccctggtttcctacttcctacttagccctgtagaaatgcaaatataatattttaccaccccttcaccagacactctttacagggcaaatttatctaactatgtgcctagaagctccaacaaggaactccttcccaccaggagactgccttgagagatcacagttgattcataactcaaagtcccactataaaactctctcccacctggggagttttcagcctactgctgcccatgaaggcacaagcagtcaccagctcaactgcccggttgataaggcaccagagctagcacatggacctccccaacctgctcacttcctcccctgcgtgccattctcctttaaaagtgccggcttcttcccctaagatagttttgggattaaaagtcactttaaaaaattttttatatttttttgacaggacttactttgtcattcaggctgggtgatctccgctcactgcaagctctgcctcccaggttcacgccattctcctgcctcagcctcccgagtagatgggactacaggcgcccgccaccacgctcggctaattttttgtatttttagtagagacagggcttcaccgtgttagccaggatggtctctatttcctgacctcgtgatctgcctgcctcagcctcccagtgtgctgggattacaggtgtgagccactgtgcccagactaaaagtcactttctttataccagacttcatttttgttaactggactctgcaaatggcaagtgactgaacctgcattttggttacatcactacacatatacatcactactgcattttggttacatcactatccccaaaatgtactgctgttttgcatgcttttaagcttatataaatggtattatgctccaaacaaagaaaaaatccttaaagttcaaaggaacatcctcctcaaactcaaatttatacccagccaagttatcattccagacagaagtcaaaacaagaatatatacagattaagagggttaccatggactctcactaaaatagctattaaagaatgcactttggtaaggtaatataggaaaggcttgatatacaataaacaaaagaatgcaaaaattcataaactatgtaggaaaagtcaatgagctaataataataatacattgttttcctttttccaaaaagtttaacttagtctaaacaagaataactaggtgacagtgttcaataggtggttaaagcatgtaaggcctttatgtggctgaaagaatgctagaaagtcgcagtaactgtagactttgttgtaagaaaatgtatagctaagtacatacccacatataaccagttaaggttagaaataaaatagatagcatccaaatccacagagaatgcaataaaaaaggtaacatataaaaatgtttaaaaggcagaaaagaaataaagtgaatgataaacagaaaacacaaatatggtggtagaaatatgtctaaatatattagttattataataaatgaaaatacattaaattcacctgtcacaatataaggattattatactgtattttaaaaatttaattgttgctttcaaaagataagcatgaaaggcaaaggtccaagggtatttccccataaattattaagatgatatgaaaattagaatttattataaataagacaatgttgaatcgatgcagaattaagcgtggtaggccaatgcaatagtatcgagaagaaaatagattttgtatatagtaaaattgatagatgacagatgtgtaattactaatgggtagaaatatagactagtggtttatggtgctgagacaatgggttatccatacacacacaaaaaaataaattcctatttcatatacaaagatcagtcctaaatgagacaagtaaagacccaagtgtgacacaaaacttgagaaattttagaagtaaatacaggagaatacgatatttagatagggaggatttcttaaataagccacaaaagtaaagcctataaaacaagagatcgataaattcaactacataaaaaaattttttaaaacctcgcatatatcaaaacacatcatggaaaaaatttaaaaatacaagccatagtctgggagaagacgtttgcaatgtatataagtgacacagtactgatactcagaacaataaactcctaaaaatcaataaaaagagacaacccaatagaatacagataaaggatatgaaaaatcaattcacagaagaaaccaaagtggacaataaagatataaaaagatgccctatctcattagtaattagggaaacatatattataacagcaataagataccatttcatgttcatcatgacaactggcaaaatttataagtctgacaatttcaagtgttaaggctgcagaggaatgaaaactcttacattctgctattggaagagtaaatatgttcaattactttggaaaacaattggtcattatgtagttaatttgaagatgcatataattaataaatcattttccctagagaaattctcatactcatacgtaaagagacatgcacaaaaatgctctaagcagcattatttgcaattgcaagtggctataaataacctaaattctgatcaatacaatggataaattgtaattcaatcatatatggaatatctaacagcaattaaaataaatgaagcagagctatgtgtttcaatataagtgaatctctacaatataatcatgagtagggaaaaagtcatagaatgacattgatagtgtgataccacaggaatttgtaaagcaataccagttacattttttgatacaaagataaggaaaaacattgaattcatgacagtgcttacctgtagggtgaagggacaaagatgtattaggaaggagtatagaatagtctcagttacatttataattttcgtccaaaaataggtgactctggcatataagacacatgttgatatgacaaagccaaggggttggcatgggggcaataaatggctgttcattatatcgctactcttttctgcatatttgaaattattcacaataaacaaaataagactttaaagaaggtatcaagcagattaaggctttcaaattcctggtcagcatttcagaaggctcccagtctatgactggccacatcacactgcagttctgttgttgaagatggtctggggaggagttcagacaagccagtacctcctactggcagcgcaagaaaggtagcaagttgattcctagctgctgcagctcctggtgagatgtagaatgggggtgaatttgatagcacaagatagtgaatgaaagtccttttgacatggaatagagtcatccagataatagcatgatccaatggtgcttcctaacctttctaagtcatggcacacattgataatatttgtctgacacattggagtggaagctaccacctagggggcttcagttgcgctaggtcctacctgtgtccctgagagctgagtgaatcggtatctcacaatatcacacaagtatagcccatttgcaatacaccagtgtgccacaacacaccttttgggatgccctggctcagaatttattcttttcacatctaagaggagggataataatgaaccactcaaaactccggcagtgctgatttttttttcaatcccaaagctgtctaaatggactgtactaaagagtcacacctactttgcttgcatttgtgaagtagtaattaggaacagaaagaggttgtacaaaagaaatgcacttaacagagcctgaagatttccccctaaagcaactgaagacagatcaacaactctctccaattcatacttagctatcatatcagggtgtgacctgataaactcagatgtggaagcaggcaatatggacagtgtattgtggagtagaacaggatgcaattaaaagcaattaaactgtatcggacatagataatccctcaccaccaccttaggaggaattggtaggtcatacaagtgagccactctagtcatgtcagcccaggatttggaatttctatatatgttaatcatatatatgttaaatgtagatcattctatggaatagagtaaactttttttgaactaattctatctttattcttcagaagtctcaagctcaaagagttctgtcaggtatagaactatagtaaggtcacccaaactagtggctgcaccttacagttgcagtcacttttttataccctagttatgtagaccagataattgctaggatagtgactacagagggcaatatctcagtctctttgaaagtgaggcactggcccatggatacagcatggtaggctttgtggagggaagggctgacagagttcagccatgctggttactaatatattgaaacatatccaaatgtattggtaattagtcatcccctgagacccacaaacctgccgtatgaccactgtgccacactagctcctcctccagaaccccaactccccacagtccagtaaccaaagtgttaatgcctagcatagcagatggctgttaaatattttgaatatcacccatggatgaagataaccaccacatcaactctcaaatgctcactaaccctgctggcaccatcatccccatgatcataagacagaacagtacctctttttgtccaactttgccttaagtttccaaaccagagtaaaatacctctctgaaagaattaaactgctcagcctcttctaggccagatgtcagctatagaggggaaaaaagaccttttaatcccatggtcatggtcacagctttttgggtggacctgaccttcccttaaaagtgagagacaaaagttatcttgaccctctacacagccaaccaaatctgctcactttcccagactggcccaatcttatgagccatcctcccttcattctatggcaccttccaagcagattctccattccacatgattctaaaacttatttctcagggactgggagacttccttgacacgtgggtccaatgagtgatttggagagaacttgaccctagaatatgcagcaacatccagagtatcagccctgccacccatagtcaagaggaggcagcacagggctggcagggagaaaataaactgcctgtggagcagagggtaggggaggagaagaatcattcatggtgcaagagttctgccgttcattcagggagccaaaagagaagggcaagaattgcatttggataggcaacaaggcatcattcaagaaataagggaaaagcaaaggcagaagggccacgcctactcaccagggctggttatcgtcaggaggtcaagctttcgttgttgctgcaaaagaaaacacactgtgagggcactgatttgagccagagccaaaattgtgcttagcaggtcagggcggacaagcaaagaggatgttgggacatactgcagggtaaatcatacggaatgtggtactcacttccaattctgcagagagggtttgtaccctagagacaaagggggatggatgggctttttgtttgtctttggaagcgtaggtggttagagcttagaggtctctcagacaaattataccatacttatggaaaatgaggccctgagcagaatgtggctcacctagagccacagagaaggtccctttccagtttcccagtcatgggctcattcttctgtaccagatagctttagatttccctttgcttatactggctgcactggttgagtgtccgatatattggcaatgctctttgccttgagtgcctgttgtactgccaccctccagatacttctttttaaccaagatatttctagattggtttcattcttaagtctgctcataatactataacaatttcaattagtgatgaccaaccattccttttctaactgaatccttatccttttttaccacacaatattcacacagaataatatttgtctagcacactaggctatagggatgaggcagcttatgtttggaagcaactggccttggataccccaaagcctgaggtgatcaatatctcaaaaggcctgttccctattacagcacagctactgtcctagactggatgccatgaaaacctgagggtagagaagtgggtacaggaggctgcagctggtgaagtggtgagcagcccttctaaagacttgagtcagggttccttaagtcccagtcctcctgctgacctctttctctttcctacacttgattttccctaaatagtattggaaatctctgtttctgttttcttaaaagaggtccaaacaaattccattttgagagtcattgctctagattacaaattgcaggagctttcaatcacctagtattttgtgcagtggaggccttgctatattttacctcccctgcatttccctctttatcttgcctctatccaagaatggcttcctaaaattctgcttaagcagaaaggggaaggcagaaacattttaaaatactaactgtggtcaggcacagtactaagtactttgatgtatcaatttttttcatactcctggcaattgtacaggagagaaggacatgatatttagaggggagaaactgtctgtccaagacatcttcattaaatggcagggtcaggattaaaatttagtcagttctgattctgactctagagtccaaaatatggcaatgaatataaataatctagcatgatgcctggtacttaaaaggttctcaataaaaagatctatgcagtattgatgttgttattattacagaacatctgatccttggtttatgtaagatggctcttactttttcatgaattttacttatttaaagttcagagatttgacctgccacgtgggcagggaccccctaaatgtccccaccaattgtataaactgcttctgtttcatcttctttcttggtagagaacccactactttttttggttagacaggtctactttgagcaaggttaaaagctgcttcctgatgacacaatcactgtttctagctacttcagtccatgacaatagtttggagagctgatgaagatctgtgttgtcttctctccagtctaaatattcccaggtcctttgtcctttactcataagacctggtctcaaatctccctctcctcagggtcaccctccttcttcattaactttgatctgtttcagtcaaaatctctgtaagatttctctaccccttgcttcaatgacttctcatgtacctaaaaggaggtccagatccctccagtgccttctcaaacacacatacctgttttcctgccaactcataattcattccagttgacactttcaagcaaacaatgcaactctaagatgtcactaatctacacagtaagaacatatcctagcactgatatgaaacacccacccacgcatgtgggctagaaggaacgctggagccagaccttcttccttccctaacacggaaccaggccagtgggacatctggcttaagctgcctttgccaaggtcaacctatgtggcttggcactttcttcatacataagggaagaatccatcatgtccttttttcatacacttgactttgtgatgatcacagttggtgaagatggcctatttgtctgaaatgtatttttttctaattaagaactattgctaaacggcaactctgtgcctaggattctttaaagaaaaaagggaagaaaagctgacagagtcagacaggcctgggcttgtgtcctggctttctgtctctggcctcaaacttggcaactctaaaatgagcaagtgagactgaaatgccatcagtgactgggagccaaacgcaaccaggtagtgtgcttacaggctccctcttctggtgtagaactccctgagaacctgtagccagcacactgggggctcaaaggacagagtcagattttaaaagggaccacattttcaactatcctctcacattttaattttctgtgcatgtatcagtctttctcactagatgaggagcatcttaagggcctagaacacctattattaattttagtaaaatcagtacatgtcacagagtacccctcagtaagtattggctgaactcaactgaactagtccccaaatccacagacattatcctttcaaacctccatgcctttgcttatgctatcatctctgtctaccctcttgaaatcttcctgaagatttcaaccttcctgaagatttcaaccatggaaacctcaagatttccatgaagtcttctttgaacaccacctcccaaacctaaccactttatctcccttcctcagaacagaatttcacactttgttcttccaatgcatcttgcaaagcctatctcactaggatcctcaagtaggatcctagtgagaaagacaatgaagacagtatcatgtactgtcttccttgtctgtctttgtcatgtactgtctttctcactaggagaaagtatcatgtaccgtcttcattgtctgcctttctcactgatcctacttgaggacagggctatgtcatttcacctctgtgtccccagttcccagaacaaaggtctggaaggaatgtttgatgtcatctagctcaaataaatgtttcaactatgctgttatgcctctgcaatgaccctgttgattaggaattaatcagcatggagagtaaacatgctctttcttttccaagacttttcccctgctacatctttggggttctttgcctttaagattttgctcctgccatgtctgtagccaggaatactgtcaatccatctcctctgggagggtttcccttctttactgttgcccagagcattactatctctccccactcctacagctcctactgtctgtaccacctctgtggtgataaattaacactaacctggtgataagcccctttaacccaccgatcactgacatatgtgtgcaccacctagtggcacaagcagatatgcgtaggctgttgttttaacctctagctcttaaaacaggattacaaaacctgcatgttctaggtgcaaacgaaaacaaaagtgtatgttccagaatgactctgcaacaatttttagctaagaaactggaatatttaaataattccctcaaagtcattcaaaaataaaaggactgaaatgaagtgaaaattttccttactagtctaccaggcacaatcatttgagattgccaatgaaaactatgtggcatttgtaaaaatagagcacatggtttatagaatttgaccaataatgtacaatcagccatatacagagaggggcatgttggacataaagaattaccaaattattataattggttgccaactgagagagataagagcctttaatatggatggtaggatagggaggaaatgaagccagtaaggtaggtggcaggtttaataggcagacagggcctgatgactcttgaaccactttctgaccaaaagctacagtctaaggaaggcagagccttcacatgtgtagtagtggttgtgtgtgtgtgtgtgtgtgtgtgtgtgtgtgtttgtgtgtgtatgtgcgtttggggtcggggagaggacattcatctcagacaaagaagttccacatttggatggaggagaatgcatccaagtgtgcctgtgtgggattctatggactactgaaggaatgtgggtatgccagcgttggatcaatcaggagtagatatgtggactcctggctgtgtatgacccctgcatccagccttccctgataaacatggtgccccatggacattcagaggaaaccaatttctttgcttaaccactgtgtggtgaatgctgagtatgacctcataaggacaatggagggtggggattctaaggtcagcaggagtaacctctgaattgggtatccagggattgccagagtgtctatagtggatgcttgaggaattgtccaccagcacccttgctccaggaattatccattattcccccatgcatcgagtgaatgctgttatattagtaccatgtcaccccacctctagtcacagtggacttctccaaaggtagaagtcctaaaagctgggctaattagacaccttactcaagaactttggaccttttctggattcaattattctctctgaaaactatagttgtcctaagttaaagaacctatctttaaaattttcataattatgaaaatcacacatgctgatttttgtcattttccaaatttccagaaaattcagagtaaaagtagaaaaattgctttgagtcaactgcaaccaagaactgggaatatttccagaaaattcagagtaaaagtgaaaagtaatgaaatcctaccactgaaagagaaccatagttaatattttggtgtattttcttatcatctttctcactatgtgtatatatttaatgatattgtatttatatataataaatgaagtacaagtctaatcctgtgcaacattatgttcatataatttttcatcccaggctgcatctttgttttgaagtaggagagtgtaagtcacatatatttatggtcatagctaatacatttgatcttacaactgtgattttgtttctaatctttttcttttcagggaaggtagcattaatcaacaagataccagtaggataaacacttgcttattttgtcacaaggagccagtttgaaaagcccagctactgcagcctaccaatatagataaagccttctgaatctgggagactcttcaggcaatattcaacttagaagatactcttttattttttcatatctgaagcccctatgattgcagttacagaaagcattaaaaacaaacaaaacaaacaaacaaacaaacaaacaaccaagaaagcattctgaagagtgctggattcaaaatcagacagacaaaggtgaattctgattctataacctctgagctctgttatcctaggcaagttatttaagctagctggcaatgaggtactcagccataaaaagagcgtacgccaacccccaggggcctaacaggaaggcgaagcaaagagaaaaaggaagaatcactctaaacgggggagcaacaggcagagtgggggaatgcactggttgaatactaggatttccgagtgctggctacatctctgtgtcacctcaggctgagcctttgggcttctcactatctggtacctagccctttactatggcctcttaaagctctcccagtttctagttttctttcctacaggtcatcctccacactgcagctggagtgagctttctagaatgcacatcttaaaactcatcaggattcctataagacaaaatcttagccttaggtggcttttggaggacttctataacctggcttttgccttccatctcttgtcctctcagactctgagctctagctatgatcaaccacttctggttgccaaatttgccgtgctttcgtcatttgcctttgcacatgttgttccctctaattggaacaacaaccccatacccaaactagtgaggaactgtctaactaattcctgcttgttatttggctcttaactcacgctacctctgctgtaaagcgttgcttaacttgccaaggctgtgctagatcgggtccttcccctgtccttccccatcagagcaccatcacattgtatttccgtgacctcctcactcctccatcctctctagtggttgtgtgagtttcctgaaggcaggcgctgtgccctctttatttctctcctctcagggactagcctagcacctgaccaacagataatgctcaattcagatttggtgattacttgctcccaggatggcaactaaacagggtcccactgaattggtcaccaaaagaggtctttagttttaccccttgtcttccaataggcacacatcaacatacccatacaaaactcatgcactacccccataatttttgtgaaaactctatttctgtcttggggacccaggaattggaccacagagaatttggccttcttcatcttgatgggtagttacgagtctatggttaaaaattcacttttcgttttggtcacgactgcattgcaattacctcccagaatgagaagggacgtgttgttctgggagctcagtggctggtttgatgtgtggggttctgcgtggtagaagagaatagtcactgattatgtgttctgttttgctttctgtgtttcgtgcaagatagctatttggggaaaagtcagtctttcacagcatagactggagatgatttaaataagaacaccagtaatccccaggcattctcctgtcactccagaagccagccatcgggggaggacttggggatcaacactctccagaaacaggcgccacaggggcataagcacacatttggcttcagggctcaagccctttcctttcctgtaacccctcccttctctgctcagttcattccctcccccagccatagtcactttctaggcatctagggatcccatgccctgctccctgccctatccccaagtgtagcctgcttcctggatatattttatgtgggacaggcctctctccaaactcactgcttctaatctctcttactccaatctagcctcttcactggctataggactgatcattctaaaattaaatttgctcttttctttgaataatttaatgattcccattgcatttttgggaagactagatttcttagtttggcattcaaggagggtgccaaaaatctccacgagttgtatgtgttatttgaaaaaatagtttttacattataatatttacatccaaatattacatacttggaaaacaaaccaaaaatacctattattttcagaaccaagtttcagacaataaagtggggcctgtaattatgtcagtcagtgtgatatgtagcagactgattctcatctggctggaggaaggagtggggaggggccagtttcctctgtgaggaaagagagcagagatcatcgaaatttgggaaacactatctcaaggccctgagctcatgcccacccccaagccttctatatgcaagaccattctgtgcaccaccaccttacctgcttccaaccttggctcctgcccttgacaagatcttctttctacctctccttttgctgaacaactgatgggcagcatggctttcccagataacaccttgcctcaactccatgactctccatttatttatttgttaattcaacaaataccaatgaagcatttgctatgtatgtgccaggtatcttgctggggatagagtgagaaagacacagcccctgccctcaaagagctagctagacagatagaagacagatatgtcaagcaaataatcacacaatatgaatttattttaattgtggtaagtgctcccaagaaaaatatgggaaaaggtattctgatgggggttcaaagtatccctcaagctttaccttggtccactgactgatatctggatgccatacccgatcacctctcaacctcactgccttcaggggaaacatgaacagtggctgaggctcaccctccctttccaggacctaccctcatcagaataataaaaaatgctttagcatgttactcagagagagagtagataagcgtggacatcactcaaagctgaaataaaattccacaactaggggttataatccagtgggaagcagagtggggtagcaaacaaaacctcagctgcacatgtgagattgcttcaatatattttgcagagtagtttctgctcctgtaactctcttttattggaaaattcaggcatgcaagtgtctttcatccccagggcaacttaaaggagcatcttggttcagcctctggcggccggcacaaaagcagggcaagtggaaatagagaggagcatataaaactgcaaagacaatttgcaagtagaattaatagctgctgtggctgaagcagctgccatttgctgagcactttgtatgtgccaatcttcacaacagccgtttgaggcaggtattgttgcccttttttacaaatgaagaaacttgctcaaggtcacagctgctaagtggaaaaacctacactcaaacccatactgattgcctctgaagcctacgctccattagtcgtgacagcagttagttgtgagggatgagggaaaaatcttggcttattcgcaggtttataggcagaaaagcagcatgaattgctgtgggtgacaccacacacctggagcagcctctgcacaagggagtgaaagaagccacaactcaagtgtgatcttttgtacttttcctccatagggttcacaatttgaaattctctattaacttgtgtttatatttgattaatgctattctcattacattctaagctccatggcaaaaggacagtgtttaagtctcctggcagtgtgggctctgtctagatatgtgttaggcgagtgaatacagaaacctcgatcaagttcctaaagaggactggataaacagctgaaacccttactcctgctggagagaaatgaaacatgcctcatcctaaaatcttacacagtcagatgggggttgtgctagaggatttcactttcctttgctctggaggaaagacccaggcatcaagaggcagcgagaggaaggccgttccagtcatgagtcagaagattacatgctagggcagtaattctctgctctagccctaaaaggtcatgtggggacctgcaagaagagactggtatttcaagtgacagtaggttgtgctcaaagctgacaaatgcccacccagtgcacccatgggccccacagcatctaggcagtgattacctaacatgtctcatgttacagttaggtgcttacatattggtctacctcttctctcttcatgtgccaccctctgccttctcttccaacatgaggacctgaatatttttcatatattgatagttttttaatacctgttccctgatagggctttgagaagtttgttgcagatgtgatgttttagcttattgacagagcaagtttcatgattataaattattttgatatgtttttaataagtcacatttctttttgtggaatcaaactttagaattaagatgtgcctttaaggacttcaaatgatacttcagtgctatgattactcttcattattaaggaagttaagatgcagcatgcatgatgctatcccaaatcacacactgctgggatgtcagagcaagggtctttggagatccactagcccaactattttaaagaaaagtaaactgaggccacagaaggaaagggatctgctcaaaatcacctgccatattgttctgtactgtttacttgtttctctccttcagtagggtggacgaagcagatttatgtctataatccagtgcctagaaaagaacaaatgcccataaaaacttgtcaaagaaagcaaggtagtggggtgtaagtagaggaaggggaaatatttagttcgtaattagttctggattccaaagttatgctatttatttgattcaagctgttttaactgaagatttaccaagagggcctcgttttagacatggtaattaacgtagatataataaaaggaaagaaacctaggttagcgatgaggccctagctaccttctgtctccaagaatgggtctgttatgcttgacatagtcttaagactatcaggaaatctctctgaaacaccacattctgtttctttacatatttgattatttataatatactaattccaaaaaaagaatttgaagatcttacaataaaagaaatgcaacaaaataaaaataatgcaattaaagacatggagaaaaaaataaggataggcaaaattagatgatactaggtgcaaggtcatgactcacaattcatatccttagtgtccttaggaaggatatgctgaggcctttagggtggtaggacttgccccagttcatgtagtgaaataccagcagactgaactcccctgtgttgtttgaataaggattaggagcacagagataggtgaaatatggcagcagggagagcaatggtgccagaataagatgccccagctctgggccatagatcagagcaaaaaacagacaactggacaagtcctagcttacacattcaccagcactaaagcccttgaacaaatgacttcatctctctctcattttcgcatctctaaaatgaggactaaatggaatataaactggaatataacttcactcagaagtttcatattacaagaaatattactatagtaataggatacaatacaaaattttctttttaaagataaaacattaaaggatgaaagcttcagattttttgagagtatcaaggtcagtctctagttgggtggaagagtttggaggctgtgacttttaaaaagatcctatcatactcaagtaagtgttcaataacatcttttttggttcccattctccttcagactcagcaattgtacaaagtagctcacagcagctccacatagaactgtggtatagactgaatgaaatggatcaggaacacttagaagccaggagctgtgttttctggccccagctttgccactaacttggtgtaggaatcaacaattcaccttctctgaacttacctctgccatacactgtctaagtgaccatgaacaagtcagttaaatactttgaaatgggtttaacaaaactcgcctacgagtagagcagttagctaagtgcttggaatttttaattccaagaccccttgtttggaaagtcttccctcctgtctttctttatatatgactcagcaccttgtattacccttggccacagacattatcactgtatattacagtgatctgtctgagtcatctgactgtgagcttttaccagcaaggacactgtgattcagatcggtatctccagctcctaccactgtacttggcacatagcaggctctcagtcatgtttgctgaattgcacgatattgtggagttcctgtgaaaaatatcatgacattcaaaataaaagtctggcactgaaagtgatgcaacattaatctgtattcctgcccagccggagtaatgcctcttcacgatgtcagagttatatatactccaggaagtaaaagtgccaggccataaaagtctattttctgcatttgactgtctctcaaggaagctccattccacgctgattgaccaagactttctacaaaaaattgccagcttgattatgaggaaagaatccagatctaattgttctttgtaagcctgggacagaaggtattgttgcttgaaaaatggaactgtctaaattaattttcctgaaacaaacatctttgccaaataaaagcaatgcataataacaacccataattaaaagcaaaatgataccttttgttacatggagaaagcaaatgtgttcagtataaaaaaaaaaaaaagacaaaaatgttattttcttggatttccagggacacatcttgaagtctgttgagaggggtcagtgtgtgtgtgtgtgtgtgtgcacgagtgtgcacacaagcatactcgcttgtgtttagaagtagcacgcaatgaaaaagatgtctctttctttcctttctttgttactgaaaaagaagttttgaaaaacaagcattgtttatctctgatttctcaacaatgcagccagaatattctaaaattcccttacactttgtatagacaagaattagaaaagtgagggaaattcatatttattgaactgcttttattttcccttgcctaactttcctaacatattttaatttatttcaattttttgacatatatatacatttgtaaattgataaatgctttcataaaaagctcattaagatataaaaaattttagtgaacatctactatgcaaataatgctttatttatgttaacttatcttatcctcacaacatatctgtaccataatgcaggtatttaactccattttagagataaggaaactgaagctcaaagaagttaattaaattgcccaagtcgtacagatagtaagtgatggagctcagattaaaactgagcttttgattctgaagcctatgcccttaaaaatactttgatcatagtatacagtattactaaataattctaccaatgatatcaaaataaaaaatgaaaaatacatataaaatctcaacatctcaatattttcttttttacatttttaaaaaatgttcataggttattgggggaacaggtggtatttggttacatgagtaagttctttggcggtaatttgtgagattttggtgcacccaccacctgagcagtatacactgaactctgtttgtagtcttttatcccttatccccttcccaccatttccccctgactctccaaagtccattgtgtcattgttatcccttagcatccttatagcttagctaccacttatgagtgagaacatgtgatgtttggtttttcattcctgagttacttcactcagaataatagtctccaatcttatccaggtcactgcgaatgccattaattcattcctttttaaggctgagtagtattccatcatacatatatataccagtttctttatccactcattaattgatggtcatttgggttggtgcctcatttttgcaattgcgaattgtgctgctgtaaacatacatgtgcaattatctttttcatataatgacttcttttcctctaggtagatacccagtagtgggattgctgattcaaatggtagatctacctttacatctttaaggaatgtccacactgttttccacagtggttgtactagtttacattcccactagcagggtagaagtgctccctgttcactgcatccatgccaacacctattatttttttattttctgattatggccattcttgcaggagtaaggtggtatcacattgtggttttgatttgcatttccatgatcattagtgaccaacagctagtctcacttttttccatgcttttttctagccattgtctaagtatctgtgtttgtgatgcataggtaataattacatattaaaaacaaagatataatcatggcattaatatgatgttgtgacttggtgtattctgttatttttagtttatataataagaatttttccaatactgttacatagtcatcgtgaatgttattttaattactttataatgttccttttatggaaagagcatagtttacttaaattttaatataagacatttagactgttattattttgttattataaatgacatcacataaaacatcttcctgaatatagttttttccttcatttgggtaacataggtaagatgaatacccatgagtgaaattcctgggtctaaaagtgtgtacctttttattactctttgttcatattgccacattgatttccagtaggatcactccagtttacacttccatgaataatgtgtgagataaagattttactttagccttgccagcatgtgggattacaactgaaattttttttgtgattacaataggtatcatatggtattgaactgttgttttaattccttttttaaaagatgatttagtgggtttgaagtttttcattatcttgttaattcattatagctcacatagtgaaaactgacttttcacgtgtatctgtcgggcattaagattttggctctgtttgcattttaaactctcaggggataaccacctcttttgttctcagttcaccaactttagtagcactgggaatatccacttgggcctgaattggcaccaaatgaaatgttttccctaaataacaaggcccctttcaaagtttcccgtcaaagatggattctagctaaagttggaaatacacatctagatagcgttaatatagctccaccagagtttaaggattctctgatctcccccctccactttttatcctccctgagaatcaataatgtcacttctcacaaggcatgacaagctttgctcatcaaagacactgattgggccaccgtgcaagagctgtgcctctttccagtggttcctctggatcccttaattcctagatgctggagaggatagaagggtcccaggacctactctacttaggaagagatactcttctcaccctcagagaaagctaggtaagatcccccatgaggctttgagaaaagagagccacattggctttgcctcatgttcaaaaggagttctcctggctgggcatggtggtttatgcctgtaaccccagtgctttgggaggctgaggtgggaggattgcttgaggtcaggagtttgagattttgcctctgaagtctggaattcctgggcaagagtctagctttgctgcccttgggcaggggcatatactaccagtctttatagtctcaggtagtcatatactactcagtctttatgtcatgtgaaaacagactaatacactacctaatgtgatcatgctgcccctgtctgtctgtacagcctccaagcttgccaccactcccctgtgagtcaaagttcctgattaggcaggctgatcttctttattcctcaatatacagtgctttcctatttcctccatgtcttcttttaaaacaaatttcatttactttttatttaaaatatttttccctcagctttactaaggtataattgacaaataaaaattgtatatatttacagtgtataatatgttttaatacactcatgttgttaaatgatatgatatgtagtgtgttagtccattctcacatggctataaagaactacctgagatatattaagaatatatcttgaatgtccttaccacaaaaaaagtaagtatgtgagagacagatatgataaactaagctattatcatatctctcacatattattttttgtggtgagaacactcacgatatattctctaagcaattttcaagtaaaattattgtcaccatgctgtacaaaggttctccagaacttatccctcctgtctaactgaaaatttgtaccctatgaccaacatgttcctgtccccaacccccatccccagcctctggcaactactgttctgctctctgtttctattagctcaacttttttagattccacatataaatgagatcatatagtacttgtatttctgtgcctggcttatttcacttagattaatgtccttcaggtttatctatgctgtcacaaaagacaggagttccttctttttaaagactgaatagtatttcattgtgtatatataccacaattttttatccattcatctgctgatggacacttaggttgattacatatctcagctattgtgaataatgctgcaataaatatgaaagttcagatttttcttcaacatacagatttcattttctttgggtatacacccagaaatggaattgctgggtcatatggtagttctatttttaattttttgagaaacctccatactgttttctataatggctgtgccaacttgcattcctaccaacagtgtacaagggtttcctttcctccacatcctcaccaatactcattatcttttgtctttgtgctaatagccattctaacaggtgtcaggtgatgtctcattgtggtcctccatgtcttcttacatgttgatccctttgcctgctacatccttccttgcctagctacctcccactcctttttcaaatcttagtgacacaagattactcatttatagactgaagtaattatgaggtgccaaaattatcagatgatacaacgttacttctatctgtaagctttctttgactctccgtccccactgcggattggtttagatgccattttttaccgtgcttgcatttctccctaacatagtacttttgctatcattctataattatctgtttatttcctcactggactgtgagatccttgaaggtgagaactgtgtcccattcaccactgtagccccaccatcgaatcatagtgcacagcacagagtagatgcccaataatacacttcgataaattaataaaggagcagaatcaaaatagtctacagagttggtaaatagctggtggcttaagaagtcagggttttctaaattgtcctttattgtagctacttagagttgctgggtattccagtccagcattccttggatgactgctggaataaacaataaaaagagggtctataaaaaacaaacaaacaaacaaacaaaaaacaaagaggaagtcattatttatagttgattaagcttttgttttcccagctacagtccctcagagggccttcctgctcctagcctgctactctacaagcattctataaaggacaaagtatgggctttgcaattacatcttggtttgactcatggctctgcctttttctggctctagcttttcagcagcccctattgaataaatgcctattgtttttcaggcacctgttattggtactttatgtatcttagctcaaatctgtaagtattttttacaaacctgaattgtaggcattaccattctcacacaggtgaggaaactgaagctctaagagttacaatttgtttttgtttgtttgtttttttgttttgttttgtttttaggtggcataagctaaaaagtaccagaccaaggattcaaacccaagtctcactggttcgagagcctggactttttttttttttcctatattgcacttctaagtttctcatagttatgagcccacagtaggtgatcacaaaatgttatgaattatttgcattcttcttatgaagaattacagtttctctgagtcaaatcttttcttccctgagccagctcctatatgtgggcagatggaagacagtgacaattgtccattgcttccttgaatattgcatttgtatcatgttcacaaatacatttacacagatgtgtctgtggataaagatggagcagacaagacatgcttttcttcatctgcatattatatccctaaatatgtcaatattttttctctgcaagtagagtaccacattggatcctccttgtctctgtttcagtggttttataattacttagacaagcaagaattcagcagctggctccctacagagaaagaacactggctccagtgctccagtgcttataccagttgaaagaagaaagagcccctcatgctgagatggatgattgagagaaaaagagagaaagagaaagaaagaaagagagagagcaagaatgagaacctgagaatgacaaagagagagaggcagatttaaaaaaaaaaaaaaaaaggtaaaaaagcaacaggggaaaagaaagggagaataagacccagctttctaagacttacttgactgggtgctggaaggcccctggagatcatctagtccaggggtggcaaactgcacactagccaaatctggtctgtttcctgttttgtttagctcacagctaaatatgatttatatatttttaaatgattcaaaacagacaagaaaataatattttgtgacatgtggaaattatgtgaaattccaactgcaatgtccataaatatttattggaacacagttacgctcattcattcatataccatctatgcccacttttgtaccacaaaggtggaggtgagtagttgtggcagagattgtttgacctgcaaagtttaaaatatttactctattgccctataagaaaaagtttgctgatctactaatctagtccaaactttagacccaacagccaacttgaaggcagaggttatatgcatgtttaaatcgatattcctgttgcccaggacagggtctaacaccaagaccggccacataatttatggggctctgtgcaaaatgaaaatgcagagttcctttttcaaaaagcagaaaaaaatggcattagaggtactaaaatataaagcctttccctttcttctgctgtttctcttgacctatcatggcatttttaatctcttatttaatgttgtgctctcttgggtataggggtagttgcaaagtgagtgcagaccatcatgggtgcctagaggctccccactgagataagatgcataagtgcacagggcccactggctgctggttataccaccatcttggcttctgccagcaagaaagacagagaagtccaggcagacgtctcccatttccatgggttggcttccccaatctactgtagatggcaaccccaaatggtattgcaaccatcacactgggatgaactacatacctggatgagagtggacaactgctgagttcctcatgcagaagcctctgccaggacccacgagctccctttcccttttctccccaagatggaacccactctgccacttccatcttggggagagagaggtcaggtggggctcaggacaccagcaggtgaggaagtaggtggctaagagccctgcctgaggaggtggggagttggtagaatgtggaactgtgcatgtgctgagactccagagagttttaagacagcgaccacagaccattaaattctaaaggcagggtctttctgagtgggggtcccgttccactgcacaggttgtgcatgtagaaagctggtcctgcctagcacacactagaggctgaagtgctgttgtattaaggatgtttttggctgagacaatatgccatggtgaaaaagtacctggatatccagctctaccacttcctgacccagagctgattgttttgtcactgtaaaacatgtatttctttaagtgttcaagtgtaataaaagggaataacaatgctctaaaacctgctgtgggcgtcacacttctccgggagcatcattgggcagctcagccggccacaaattgttttttattttttatttattatttttttgaggtggagtctcactctgttgcccaagctggagtgcagtggcgctatctccactcactgcaagctctgcctcctgggtgcacgctattctcctgccccagcctcccgagtagctgggactacaggcacctgccaccacgcctggctaatgttttgtatttttagtagagaggagtttcaccatgttaaccaggatggtctcgatctccagacctcgtgatccgcccgcctcggcctcccaaagtgctggcattacaggtgtgagccaccgcgcccagccacggtcagccacaaattcttattggctccaccatattagcttccagtctcattccctgattcccaagacattcagagaggtttcaggatgatgaggtcaacagataagtgtgagaagccaaaagggtgctgtgggatcccatggaggaaagcagtgaagtctaactgggggcatcttgacaaatttcctaaagagaaggactcaggactgtttcttatagggtggctggatttctcaaggtggagaaaggggaaagagggcttgtgggccctggcagaatcttctgtgtgagcaaagacccagagatagggaatcacgtgtgcatctgcagtgtggtgaatattccagtatgacgagggcatagaggaaaaagatgacgtctaggaggtggtcttgctaagggcatactctagagttttctatgccctacttaggagtttgacttttatttctgagacaactaaaacccactaaagggcacagtgatggagaaggaggccttactgatgtgtgcccttggccatgtcagaagctgtagacagtgagaataggctcagtgcagtttattcccaccgaagaggcaagcacatgacaggtaagagggaactaatgtttggaggcagtctaccatggcccagggctgtgtgaggtatttttgttcctagcacaacaaccccatgggagaagcattataaacccccttttataggggggaattgaggctcagagagaatagacgtccctctgaagatcacacagctagcaatgaggcagagtcagtattttgccttgggtctacctaacacccttggcctaaactcttactgatgtcctactttgcttttcaagatccgagcaagcaggccaaagccacacatttcccaggagacaagccacaggccttgtcaaaagtctcctgatcctctaggtagaaatgaccactacattttggccctatttttgttgaaatcaccagtatctgtaactgtgtgctccttgaggacctatctcctctctgtgttcctagaatctggcaaagggcctggcacagggtagatgatcagtctctgtttgtagaatgaatgagcaaattaatgatcagactgggatttttctaattcctcttggagttcatggccctcttaattggaagccaaagccaaaagcaacccttgcagttttcagaaagaggcatgctgaggctgagggctgtgaggatgacacacagttctagcatcagaaccaaatttacagcaaatagttcccataaacagcacaagcaactcagttaggctaatttatgttcacaccagggctgtcctggcccccaaagcccagaggtctttacaattccaaaatgattaaaagcatcatacaaacccatattttccatttttattaaaagcactaaggcgggcagtgctttctgcatgtcaatggggagctactttctgacccagggagaaaagccaaggcagaatctgcacatccagctctgggtatccttctgcctcaaaaccgcactatccttctgtccgttagaggagttctgcccctttcacccacttcctctgcgccatagcctgccccacccaagcccacctttgctcaaactatgttcagttagaggcacaaccctacttaaggtctttaaagactttactgtccaagcttcttaacctgacatccaaggaaggcctttcccagaatggtgcaaactgcctgcttcccctacaccttctgccatgattgattgcaagtttcctgaggaatctgcagccatgcctcctgtacagcttatggaatcgtgaatccattaaccttattttcattataaataccagggtcagttagttctttatagcaatgtgagaacaggctaatacagtatgcttctgcattttggaatacaagctcaatgcaggtagggagttgtgtatgctttgttccttagtctatccccagaacccaaatggtgcctggcgcatagtaggcatcgaataaatatctatgaaaataataaaattacatttgtttttataacaacagaggcatctgcacctttgtttggtcgcctttcttttaaagaatttggtctcagcctcagggcaacactcccaatgcaggcagaaagcctagtttatttccagaccctccaactttcaacaaagaagctaaaggagccaaagagaaggatccacatgtaaagttcatgccatcaggaatcttagaaatgtgagctgtcaaccttaggctcatagcaagaaggtagtgcttgggaaagacccacagcacaaagaaaagcattctttaaatgtaaacacttttaacatcactaccaatgccctgcccctccaaggcacaatgactgtgttcagtgtcacagaaaggaaaacacacattagccagatggcaggtttcggacgcacgcctgtgacattatctctaatcatatacagtctatttaatatccgcttttttgtgggcttcacaacttataattattgccagcaggaagaaagcaaaaaaaaggtagggaaatgttggaagggaggggtatagacaggaggaagaattctgatagcaataaactgagtgagaaagataggccagagcttattagaaaatattagaaactatatttggattaaaactaagaaaaataaattgtacataagctatgagactgtgcaagtcaggaagatcttataaggctttcggactgtctcattacactgtgtgtctatgacactggaagggagttagtgggaagttatgaaatgtgtcagatttagggtccagactaagtatttcataaatctatacaggacatggaaaggcctccaaggttaacagctgaactccttcattctataaaacaaaggaaggacctgcagggcaaggactcaaatctaggcttccagattcagagcacagttgaatcccctatagcaggcaactgtaaccagaggccctttctcatgtcaattacccagggtcttgaattgggaggaatttcctccgagtttgggactgggacggggaggatggcagagaacttctgagaacaacatgaggctaaaatgggaaactcttctggatccagtgatcctaacactcaagatcacagcctgcttgcgtgtgtgtgtgtgtgtgtgtgtgtgtgtgcatttagcaggtgtgtacctatggtatacaggtatttgcctattgacagagctgggttgtaacactggaacacagggctagaagcagaatcacccacagacaggcaggtttcactcctgctttccttcccaccagtgccttggcctcctttcaccctgtctctcacgcaggtttacccatacctcaagactaccaaggaggtccccctctccatacccagaatacctatggtagagatgcagtggtttagcctccaagcttcaacttgtgtcatctctcagaactctctttgctacttgtaaaacctttatctgagtcttagctttcacatgtgtaaaaattcctacctttgcaggattgtggtgaggattaaatattatattactttaaagggtactagtacagtcagataatttattggagtaagaatctatgtatatattcttgcatttttcctttctctcttgctccaagcaatagctaggctactagtctttgtttcccctaggggtttctgaaggagaggcagtcagaagctccttggagtcagtgatattcttgtgtttttgtgatgtccaatgtccactgaagagactgtggattgtggatgtccttgaggggaaaagaaggagccaggaagaatggattttgggtgaagatgctgggggttatttcccaaatagagaagggaatgaaggttggtaagtctgttacccgtactctattctgtggcagcatcccagggtgagctcaggttggtatttcatggatacttgcagtctggcagattcatcaaagatcgttatgcccatagtaatgaatgaacgcagaagtgcaggaacatgagggtgaaggaaatggtcgtgttggtgagaactgatcggaaccaataatcaataatcagagagacagagatactaccccaaatgcttctgatactttgatgctgcataagatcctgggatcgtggcgaagtgtagtgttggggagccacagaaatggcagagactcaatttactgatcagtccagtaggatgtgggctacaaatttaatttaaatgcttttaactaaaaagaaatacatttcttacattactgagtttgtagaacaagattcatacccattacagtagcctgccatgaagaaatgctccctaacaggcagatatcattattattaattaagtcactaaatgtttttgagtaaataaaaatcatagtgtggatcaggtcacaggagtcagtaaaggtctaggaatcaggtcaagactttttagcttgtgctaaaaagcacaagcaaagaatcagaaaaaagctgaactcaaggaacagaaacaacagagtcaaaaatgacaagaacccagtcccaaataccctcttccaaaaactttcactaagcacgtattttggaccaggcactagatgctggagtcataatgataaatcaaacctggtccctggcatcaagaagcccccagtctgatggagggcacataaagagaccacttcagtttaaaacgcttgttgctatcttaggaacctcttaccaaaggccggcttcctgtttcagctctactgccttttgtcttctgcccagagatttgctttcaaataagataagagttcaggcacataggcatggctaattaagacaactcactggtcaggcagaaaatttggtggctggaagaaagcatttcctagtacaggcactacatgggaacttcactctactcccagctgagtatgaggatttccctgcccatggagctcatacaaccattaaatggcagaactaggcctttagctaggatggtcagacacccaaccctgaacttttttcattaaaccatgctgtctccagaaatgaccctaggaattaatagcttatgttctaataaagggaagagcagaaataaaaatgagaatacacattgtatttatttcctagggctgccataacaaattactacaaactaggtgacttaaaacaatagaaatttattttattacagctctagagtctagaagtctaaaattaaagtgcagagagtgcagaggcatgctctctccaaaagttctaaggagtaatctcagaggcaataattttgcctcttccagcttctggtggttgctggcagtctttggagctccttggtttgtggcagcattattcccatctctgcttctgttgtcacatggcattctctctgactgtctgtgtccttgtgtcttcacattgccttcttttaaagacacaagtcactgaatttagggccaacccgaatccagtgtaatcacatcttcacttgattgcatctgcaaagaccttttctcttttttcttttttttaatttagaaagtttattttgccaaggttgaggacacatgcctaggacacatgcctgtaacacagccacagggggtcctgatgacatgtgcccaaggtggtcagagcacagcttggttttatacattttagggagatgataaacatcaatcaacatatgtaaaatgaacattggttccgtctgaaaaggcaggacaactcgaagtaaaagcggggcaacacttgaagcggggagggggcttcagggcacaggtaggtgagagacaaacagttgcattcttttgagtttctgattagcctttccaaagcaggcaattagatacacatttatctcagtgagcagagggatgactttgaatagaatgggaggcaggtttgccctaagcagttcccagcttgaattttcccttttgcttagtgatttgggggcccaggatattttcctctaaccattcccccccttttcttttttaaaatcttttggagaaagcattttaaaagaaaatgagtttctggttagaccatctttctaaataaggtcgcatacacaggtaccaggggttcagactttaatatatcttttaggggaatacagttagactcagaatacaccccttcaaaatacacacacctgcatatacacagacagaaaggagaaaccttctggagtgcacttatctactgtacactgctgaatatccatgagaacacccctacaaaaatcgaagtatacactaaataaacacatacttgcctgacagctggggctgctcagctgactttagacctgcctgtaccaatgggtggtttggaccatgacagaggagctggaggtagaggagagaatctaccaacctaaaatgtacccagtccctgttatggactgaatgtttgtgttccccctcaatttatgtgttgaactcctaccctgcaatgtgacggtcttaggaagtggggctttggggaagtaatgaggtcatgagggtggagcccttatgaatgagattagtgcccttataaaaaagactccaggccgggcgtggtggctcatgcctgtaatcccagcactttgggaggctgagatgggcagatcacgaggtcaggagattgagaccatcatggctaacacagtgaaaccccgtctctactaaaaatacaaaaaaaaaattagctgggcatggtggtgggctcctgtagtcccagctactcgggaggctgaggcaggagaatggtgtggacctgagaggcggagcttgcagtgagccgagatggcgccactgcactccagcctgggcaacagagtgagactctgtctcaaaaaataaataaataaataaaaagataaaaaagactccagagagctgggtagctctctttctaccatttctaccatgcgaggctacaagaagccagtagtctgcaacctgagagagggccctcagcagaacccaaccatgctaacactacgatctcagtctttcagcctctagtactataagaaaaaagttccattgtctacaagccacccagtttatggtactttgttatggcagcctggactgactaagaaaatcatctaattgtataatgaggaaaccaaggagcaagaggagaaggaacctgcttaagctttcatcatgtactggccaccagagtcgcaaatgttggccaacatcaggaggctggtttgaggaaaaaatacttccgtagcttttgaaagtattagtcgacttcaaaatgtgcaaaccctttgacccagtaattctactgttaggaaattagcttaatggttaattagctgaaatgatgaagatttagctataaggaagtttatcaaagcacattaagaaagacaatagttacataaactgaaatttactttatgtcagacattgtcctaggtgctttgcatacattctcatttaatcctcaaaacaacctttcatctaagatgaaaaaactgatactcaggttaattaattttctcaagtacacacagttaataatgttaagaacttgggttggaatccacatctatttgattctaaaacatctcttataccataccttctgtataaagtcagaaagtcatcttcaggggccccaaatggaaatgctaatgattgggaattggttaaatacattatgtgcattaatacaataaaatacaataagccattatataagcactctcctccagggtcacttgtcacatgtcatgttgtaggttaatatctgatgatgtagtatatagtaaaaaaaaaaggttgattatacatgtaacttagtgtgtgacatgtagatacatttactggttagagtgggtagataaataaatatgaaaacatgaatctccattatttctggataggattacaggcaaattttaagtttgatttttaatatttataatttgctacaatgaacaaaggatgaatttaatgagaagaaaaaaagaatttatatttcaaaacaaagaggtttccagtacgtagggagacaggatttcctaaaaagatatttctaagacagcatctttagtttgaatttatgcttcatcatattagcctttacctctctagacaaagttcatccacctatttggtaagtcaaattggcagtgtttcactagttaaaagggttaatttccttggacttagcagacgtacctgggcagttaacgctgctaaggcacctgagtatcagagggattttagggcatgttccctctgttctgtggttagaggaatctaataatatcccaccatttctttttcttcttccttctcctgaaaatgcagcaggtaaagttcctgattgaattccatcttgatttcattaaatattcataaaggccaattagaagaggagagaaagagcccccttctatcatcctgtcagaggtcggcttgttgaccgtcaggcatgggccagccagtggtcaacatggccatgatcttcctgcactttcctctggggtcacttctcaccatcccagcaagggacccaggactggcaggaaatgagaggcagaggcctggcaaggagagacagcttataattctgacagcaaggtgcttagcatgtagaatgcaaaatgcaaatgctgggaaacatcctcaatcatttctggaatggaaatctttccctaatgagcgatgacgatggcagagagctgattgcactgaagaaaaactgcttaaaattcataatcaatcaagcgagttgattttagtcttttgtaaccaagctatcccattctagcttcctttattggccaactggagcttatcactccctaccttgttcccttcatctagctcagatggtaggtcccactggagaccctgaaagagactcgagcatatcaggaaggtagactggtaggactcagaagagctcatccattctgatcatttaattttacagttggggtgtggaggataagagaaggcaaaggacttgacaatgttacatgggcagtggcagtgcaactagctttctgtctgcaagccattgaagaatgctatgaaagaaaatgtaccaaaagtctagagttctacatttgggaccggttttactatgtgatattggaacaaagctgtgtagtattggaactaagtgtttatgctatttgcaggttgccattcaaaaatggcgatggcaataataatgcctttctccctacttcacagggttcttgtgacactcacataataaaaaaggatataaaagtgctttgaaaatggcaaagcaccctgctattattaaacatctcctttcattttccaggcccctaggtactccccctctaaatcatattccacacaggtatctgcaagttctttttaaaactcagatctcaccttgccatttccctgtttaactcctctcacattgtcctttggacaaagtctaagctctaagtctggcattgaggaaccttcacaattttgggaatttgtcttctcttctcgagcttcagtttcctgttcataaaacaagaaaactaatacctacctgagaaggctgctgtgattagaattcacatctacaaagtgatcagaatggcttctggcacatcatagctggcctatgtagcttaattataatcttattaagtttcacaacaattctggaagatggctacagaagaagcaacttccactctgattttacaagacacgagaagcccagagaggtgaagacatttaataatggctgcacagccagaactcagacctgagatttcactcttgggcttttggctcatggaggcaggggatgcaatggggagtaggtaggagaagcaggtgtggtgctacctcaggctgccagcatgaaatgattcttttctgagatacctctgcctagtccaaaaggtagagaatataattttcctttctttctttttttttactagtacaaataaaaagatttattttgaagcaaactaatacttgaaaaaaagcagctttaattagacaatgatacaaaagtacgtattctttttgggactagttctgaatgagacttttggggtcttcaagggtttcacaggctaagtgcacttgttatttcagatttctaatttgccttttaaatggcagatttatccctagtacaacttttacacttattaacattgatgccatttgttttttcttttgcagactgaggtaatgtataacatatcatctttaccattttaagtgttcagttcagtggtaataaatacacttatatcctttttcccccttcatcccctactccatcccctcctttctggcctctggtaaccaccaatgtactctgtgtcatcatgaaatccacatttttagctcccatgtatgaccgacaacatgcaatatttgtctttatgtacttggcttatttaacatagtggtctccagtatcatccatgttgctgcaaatgagagggtttcattattttttatggccgattaatatttcattgtgcatatgtaccacactttatccattcatccattgatgggcacttaggttgattccgtatcttggctattgtgaacaatgctgcaataaacatgggagtacagatatctttttgatatacagatttcctttcttttggatacgtattcagtagtggaattgctagatcatatgttaattctatttttagttttttgaagaacctccatactgttcttcatagtggttgtactagtttacatttctaccaacagtgtatgagggttctcttttctccacatcctcacttgcatctgttattatctgtttttttaatacaagccattttaactggggtgaaataacatgttgttttaatttgcatttctctaatgattagtaatgttgagcattttttcatatacctgttggccatttttatgtcttcctttaagaaatgtctgttcggatcttttgcccacttttttttttttttttttttttaagacggagtctcgctctgtcaccaggccggagtgcagtggcacgatctcggttcactgcaacctctgcctcctgggttcaagcgattctcctgcctcagcctcccgactagctgggactacaggcacatgccaccatacccggctaattttttttgtatttttagtagagatggggtttcaccatgttggccaggatggtctcgatctcttgacctcatgatctgcctgccttggcctcccaaagtgctgggattataggtgtgagccaccccacccagactgcccacttttttgattatttggcttttgtttttttgtttgtttgttttgtttttggcttaaattgtttagtctctttgttctggtcattaatcccttgtcggatggatagtttaaaaatgttttctcccattctgtgggttgtctctcccactatgttgagtgtttcctttgctgtgcagaaactttttagcttaatgtaatctcatttgtctgtttttgctttgttgtctgtgcttttgaggtcttatacaaagaaaatcttttgcccagaccaaggtcctggagcacttccccagtgtgttcttctagtttcatagtttcaggtcttagatttaagcctttaatccattttgatttgatttttgtgtatggtgagagagaggaatcttgtttcattcttctgcatatagttatctagctttccccacaccatttattgaaaagaccatcctttcctcattgtatgttcttggcacctttgttaaagatgagttggtatatccggattctctattctgtttcattggtctatgtgcttattttttttttatgccagtaccatgttgttttaggtattagagctttgtagtaaattttgaagtctggtagtgtgatgcttccagccttgttctttttgctcagggttgctttggctatttggggcttttacggttccatatatattttagaatgatgccctttgtgtttgatccacaaaaagggagagacatccagagctgaagagttttccctgagaattttgtcaagagcgtcgctctccaggtacacgccccccgtcaaaggcggctctaaggtcctctcacgagggagcgcccatggtacctccttactctcagctatctgtctctccccgaccccagagtgattgcgctgcttcctccagagggcgggaaccttggacgtggcggggctgggtcagccacgtcgctgggcctgaggcgctcggctcagcctccctgcaggctggccttccgcaccgtcgtgaagcccccgacaggccccacacctgcccaggtagaacggcgccagcccgagtgacgcctggcgtgtagccgtgggcaggcggctcagtgccgcggggcgggcgggcgccacacctgtgcgggcgagggcctataattttattttctaacatgatcacaaggccataggttctaggcctgtccaacttctcttgcctcatttcaaactagtggaaaatgaaatgaagcaaaggatggttatcttatgctaaacagttgcttgaataaaaaaggaaaaatgaaattctcaaacaataagttaatagtttttttttttttctcagcttctcctctaagccgcatttccaggcagcaaagagaaattgagtggaaatgcataaattgttgcaaacaaatgtctcattcaagagagattttctcaagataccaggctccatatgaggtagctgggtgagtctttggatgggagtagagaaacctggatctggcctcacttggcttaatcttttctttcctgttcttcttatgcatcaactcaggcctgctacaagtcctagatccacactgatatgaaacaaaatgacgagcattccaaaaattcaactttattctttcattcatttaacaaatatttattgagcatctactatgtcccaagctctttgctaggtggaatacaaagttaagaaaacagacacagattctgccttcatctagcatttacagtttattacgggaagaaagactttttaaaataatcaaatattcatgtatatgatttcaccctttaataagtatcatgaagaaataaatattgggagctaggaaatatttaacaggaatatctgatataattaggggctggggtggggtcagaaaagatttccatgaggaggaaacatttgagctgaggggcatttggagttatgaaggcaaagggatgtgagtggggtggggttggagtgctccagtcagagaggacagcttgtattaaggctctgaggtaaaagggagcaatggcatattcaaggaattgagagaccagagtgtctggagtatagagatggggaccaagaaagatgaggctagagaggagagaagggtgcagaccccacacagccttctaggccagggaatataagctgggaaacaaattattctaagcatgagagaagccattaaagaatttttaaaagaggatgggcatgatcagatttgtattgcaaaaaatccactaaatcctagcaggctttgttataaaaatgtcatactaattctgaaattcatatgaaaatgcaaaggacctagaatacccaaaataactttgagaaagaacaaagttgatgtactgacactacctgatttaaagacttattataaacctacagtaatcaagacagtgtggtttggttttagcataattagatccataaaacagaacagagtccagaaatagacccacacatatatagacaaccagttttcaacaaagatttgaaagcaattcagtggagaaaaaaacagttttttcaacaaatggaactgaaacaattggttatccatatgggggaaaataagaattttgatccatacctcacaccacatatgtaaattcattcaaaatggcacatagtcctaaatgtaaaacctgaaactctaaaattctggaagaaaacataggagaagaccttcataaccttagattagggaaagatttcttagagacaacaccaaaagcatgatccataaaagagcaaattgatcaaaatttcaaaacttctaattgaaagaactgttaagagaattaaaagacaaaccatagattaggagaaaatatttgcaaataatatatctgataaagggcttgaatctagaatatgtatataaaaactctaaaatgaaataataaaaaaagcaacctaattttagtaaaagcgggcaaaagatctgaacagatgctttactgaaggagatgtatagatggtaaataagcacataagaaaggctcaatatcattagtcattaggaaaatgcaaattaaaaccacaatgagatatcactagacaactattagaatggataaaattaagactgcccataccaagtgttggtaaggaatgaaggaactggaattgtcatacactactgttgggaatataaaatagcacagccaccttggaatgaagtttggcaatatcttaaaatattatatgtaaactatcatatgatccagacattccactcctgggtatttttccaagagaaattaaagtatatgtccttgcaaaaagttgtatatgggtgttaaaagtagctttattcataatagtcaaaacctggagaaaattcaaatgtgcaccaattcgaacctggaaataagcaaattgtggtatatctatacaataaaatactactcgacaataaaaacgaatgacccactgatgcacacaacatggatgaatctcagaatgattattctgagtaaaagaagcctgacaaaaagcatacatattgtataattccatttttataaaattttagaaaatgctgtataattctgtttatgtaaaatctagaaaatgcaaactatagtgacagaaagaagagcttgtggttatgtggggatgagtgggaataggggagggagtgagaagaagagattacataggggcacaaggaaaagtttgagggtggtatattgtttataatttgattgtggtaatagtgtattgatccatttttatgctgctgataaagacacacctgagactgggcaatttacaaaagaaagaagtttgttgggcttacagttccacatggctggggaggcctcacaatcatggcggaaggtgaagggcacgtcttacatggcagcagacaagagacgagagcctgtgcagggaaactccccattatataatcatcagatctcatgagacttgttcactatcatgagaacagcacaggaaagacctgcccccataattcaattacctcccaccaggtccctcccacaacacttggaaattcaagctgagatttgggtggggacacagccaaaccatatcagatagtttcttcagtgtatacatatgccaaaatgtatcaaattgtacagtttaaatatgtgcattttattgtatattaattatatctcaattaatttttttaaaataaaaaaccataaactagatgttatgaggaaaatgaatagggactatatggtggtagtgggagggaaggcacaagtgagtttacaatgaacagttagaagactataataaaagtccaggagtctgatgttgataatctagaagagaagaaaagcagtggagatgctgagaagtagaaggatccaaagtatttagtggttaagaaggaaagaactggtggtggattggaaagagaggagtgcagtggtgacgagtgagggctaaaggatgaaatctagatttttggactgcctactctgtgccatagtgaaatttattcagtattcaaggaatacagaaggaagccctcatctcctttttcacattcatcccctccatatccccattatcacatccctggtttagatggtatcatcttttgcttgcattggtacaaagcttcttccctaatcttctcatatctagatttgcctttggcaattgaaccttacactagagactgcagtaaacttcctaaatgccctgtctggccatttcactctcattctaaattccttcccataactccccattgccctcaggatgatgttcaagatccttagcctggcacttgtgaggccttctaagacttggcccctctcatcttctgcagtcctctggctctgcctgccaacacctggacttagctccagatataatgaattgcttgtagcttcttggatcttctcacctccttgcctgtgcataaattgatttcatttgccccaaacttgcttcttataatgtcatccggtgctcaaggcttagtttgtgctctttcagcattttgtggatccttttatcagagcaaatatttctctaattggaatttgtctgcaactctgatttggtctctgttcttggacctttttctctttcatctctatacagatctcctttaatctcgcctccaagtctggtaatctgtttgtttctcctggaaccctcccagaatctgagtcctatccagattaagtgaggttcaagtgcagagtcggtgcctgagggatatctgtggaaggcatgacagcctcagctttgagcctcaggctttgcttcctatgtgtaatgttgacagttctaatcagctatttgcttgtagacttggcctgactccccagtccctgggatctgcctatccactgagagctccctactttatcttgtagattactggctcagctcaatgggagactcttaacaggatttggacaccaggtgatggcttcagtgatgttgtcagggtttggtctcttgttcagcacttctcctaccactagaggcatgcactggacactccttgtctttcatgcctcacctagtgccagagttccttccttcctcacacattgtttgactctatggagtcaaacctgtgctaggcattggggagataaagacaggtgagatatagtcactggcctcaggtagctccaaatgtgtcaccaaacaagttgttcccacctccttgcctgtgtgtaaattctcattccctgattcttggtttccccatctgtaaaataatgtttaaggtgctttttcctttaataacctcatgcttctgagattaggatggagcaagtgacaggaaggtgaagaagagtaaactgtagatgaagaaaagctaaacacctgaaagaaaacctgcagcattaataaaatgatctcggccaggcatggtggctcacagctgcaatcccagcactttgggaggctaacgtgggtggatcacctgaggttaggagttcgagaccagcctgaccaacatggtggaatcccatctctaataaatatacaaaaattaactgggtgtagtggtgggcgcctgtaatcccagctactcgggaggttgaggcaggagaatcatttgaacctgggaggcagaggttgcagtgagccaagatcacgccattgcactccagcctgggtgagagagactccatctcaaggaaaataataatacaataaaatgatctcaattactgcttggctaattagttaacttatctatgaaagaaacaactatggttgtgctgaaacatgcatggccatgggttgctgtcattgctcaaagtctagtgtttgtatttaaagcatggactataaagcgagtagcatgtcaaatgtttatttgacagtttaagacaagtttctgagatgcatggcctgtgtcttcagaaggcagtttagagtaaaggttaagaataaagtttcagagctgtctgtctctattcaaatacgagctcaacaaattcttggttgtgtaaacttgagctaataaccatgcctttctgtgcctctgtttcctcatatgtaaaatggggatataataaaaacctacctctggagtgattgtgaggattaaataagttaataaacattagcatgaggtcagtgctcaataattattgaacaatattagcaataattatttttatctaaaaagatctaagaccaattttgatttcccaaagaagaaacatgtaattaccaacatagaaaaacttcaatgcaagaattatgaacaaacctaacattcatgtgttgctgcttccattggctcatgcttcttcccagtgtcataaggcgagacgctgtacagtctgcagttgcaaggctcatgacactctccaataataaatgtgatcatgttccctggaggattttctgtttcaaaattataattacaatccaatggcttaatttaattagatccttcaatctacctaaaaagctggtgcagaatagaataggaaattatgagcctgggtaactaacgaggaatctttaggaggtggaatcataaattgtgggttactcattggatgcaaagccctgtccttttcaagggccctcaaccttcagaatctttcagtcctaccagcccctctatgaaagacacttacaacaagagggaagcaaaaagcacagtttccaagaagtttatttgtatgcttgcaggccttctaattttacatttaccacttatggtaaaaatttagggacataaatattgcaacaatgtttggtaacaaatgtactgcaatgtcttcaaaacatagtcaaaaaagtaatgtagaaatcattgagaataaatactaatttgaatgcaacccaaaacacagttataataaacaatggaagaattaaaaagataatccatgtttctcatatagaaggtttctgaaattaagagaagtttaacagctctcatttatttgagaacttcctgttcttagcacttcatagaaattttattctctcaataaccctttgaagtaagtgttagtgttatctcctttttacagatgggaaaactaaggcatagaatgattaggtaatttgcctacactgactctagtgactgtgtgtaaagttcaggcccacctagacttgctatgtcacataggtgatgaatgtacctttggttgagatccaccattctaagtattatccccaaatcagacatggcaatactaccacagcaacaattacccaggccctctagctttcactgactgacaatgcctagtagtattcatccatttatttgaaaaatactgattgaccacttccaatgtgccagactcttacaggaactaggaatataatgatgaataaaagtgacaaaaattccttccccccatggagcttacttttaaatgaaggaaacagacaataactaaaatgagtaaaatttataggattttaaggtagtgctaagtgtcacgaagcaaatcaaaaagggaagaaagatataatgggtgttcaggtattaacttaaaattttagatagggaaggtaagggaaatctcaccaagaatgtgacatgaaaaaccaaagaggggagggaaccatgaagataagaggtatgttaatattaaacaataaacttaatcttcctgttcacccatgaaaacaaacatagcatgttattttacctagaaaataaaactcctcttggagagagataaatcatgtactgattttgactgtgtgccaggcatcatgctaggcactgtggagtatgcagagacaaaagacagagtccctgcctttagcaagcttgggttactggggagaaaagtatgtgagggatggctgtcttataaagtatgtgagggaggggcagtaagttttaaaacagaggaataaacaattctacagaggaaatggttacgacaaattggaaagggattaggggtgagggaggtagactttggagctgagatgggcccccaggtcagaggaacaaatggaacagcatattcagagttgggggcctggaaaacagagaaatgctggtaatgacattgtatgcagatggagcgaggggagctagggaagatttgtgagaaaggtaaaaggaggtaaaaatttatctaatttggttatttcctgtcatgaaaacaaagaaataaaatgatttgcattaattggcttatgtgattaggcagcttaatacaatatagaatcattttaaatctgcagaggaatgatgtgagctataaataagtaaataagtacattgtacaatagatgactgaagaagatacgtttccttctgtggtcacaaaaaaccacttcactgtctgtacatctgagctgagtttacatcaactgtgaaaaacagccaggcctgcagaggtatggaatatggtcttgaggtaagatgacaagaactggtgacatctgggatgccacttaaactttctgtatcttgcttccctcactggacaatgtgggagatctttacactgcctgctttttagggctgtgtagtttcaatgtggtcttggatatgaaaagcattttgcgagctttaaagcactgagttagcacccacacgcaactttgccttattgaatttaagtgaaaaattttaagtgagaattagagattggagggaatctttctccttcttatgttagccatgtggatttgggaaaatcttagaacctctgttttctcatctagaagatggagtctaataataactaacaagatagtaataaagtttgaataaaataatgtagctgtcatactatgttgctgaataaatgagcacttctgttcaagcactctaaaggtccacgtgtttctcaaaagcaggagagtgggcataatctatgaccatagtttattattataatctataagtgttccattctggagcaagccaggggggaaaggcctggtggtaagacaccctgaagccttatatcaagcagcctgagggaagctctagcctacgcaattcatcattccatagcctggaggtcctcaccctgaaatgattcacatctgcaatcttttggggtccctgacccttattcaggtcagctcaaataacttttgctgggtacatgctgtttcagtcataatataggtgctaagatatagacaaggttaaaattcagagggggctcatgatatagttggggatgcactgtgataaatgcatggtgctgaggaccctgatgagagctgcatactccatcctgaggaatcctggaagagagctcagaagggtagaaacagtgccatatcttggagtatgagtttgccaggccaagaaaaggagggtaaagagagaattatttgagcagaagtatggagtgttaaaagaacagtatgtgagtgtgtgtgtgtagtggtatcttgagaaggctaggttagggaatgttgactttcaaaattttcttgtgatactttcaagctccttctttctgcttcctccaaagtttttgcagttctctcttctaagaggcactcctaagactccctgttccttttgggaagacagtaatttggtcctgaccttgtaagagaacagctctcaaccaaactgtgcttctctcctccaggccccagctgacatcttgtaattatgccaaatcccagtcacttcacaaagggtcaactcactctcacagggtcatcctgattcatggcaaactctttaaagtagtgaacaaagttgccttttcaaaaaattcggggaaaaaaaaagatacaaccaatacagcatcttttcttcttttcttcatgctatctcatgccaagactctaattttataggcaagttgtgaatctctgtgaaaataaagtaaattccctataagtgaggtcttatggatttattgcaatggcatttttaagtacacaaatgtcttgtttattccaaattatctatgggtttatggaagtaagaatattttagtatactgagcactagcaacaacatgccaggcaatgagctggtgcctctatttatgttatctgatttaattctcacatcaccccatgaattagaagtgtttttttccattgaacagtggagaaaactgaagcttaggaaggttatttttccattctactgctagaaaagggagggctggtaatgaaacccaggttcattactccagagcctatgttcccacagagccttagtctttcacatatgtagtttctaacaactcagcaaattccaaagctttctcatcatttttggtattttgaatgtaatcttttaaagttatatcacatcctcttttatgttcctatataggcaaagcagaacataaatcaaccttgccttttttttttttcaggactagtttttgcatctactctgaacaccctccaaacactatgctgttgccttgtttggttagcttttaaatgatcattggatttagcatgcacttatattactagcagtatagcagatttacctcttgcaaatccttccagtccctttacatttgctgcttacaaattgtgttaggctactaaataaaatagctatgcttatttgagtatgcccaaaacaaggtatcatagggttgaagatagttgggagtgtccagaatatgtgaagagtgtcattattttaatgcatatgtttgtaatgatagttaaaaataagttaacatgacataggaaatgtcatgctggtcacggttctgtctgctttcatttcagtactcaataaggaatttactcttcctattgaaaggattaaaggcaaactctcctcccatctgtacctccatagctaaggcagaagccattagatacagcatgttcagattagagagagagatgttggctttaaactcagagggagaaatgatttccactgattcataagcaatggccattttgcagaacctacaggaggaatgcaaaacctcttcagacacaccattgttgaagactgcaattagagtgaatttggagcaagcccataagcagggactaaattttttcctcaagtaataacaagactcctattactaggatgtgatatatcagtatcaacttgctcgggaaaaaaacagtgagcacatgaaagacaggaagatgtcaaagcatctgcaatgcagtagaaagagaaatacgtacgaaacatacagaacacataccattcttttagtacatgtaaccacaagtttccgtcaatttcttattgagaaggaattgaaagcatatatagaactccagtgaatgccttgaaatatactatatttatgtttatgtttcctatacataatttctatagttagttctcattccatgtggtgcattccttctcactaaatcctcttgcttttccataaatcctgattttcagactctctctcagtattgtgacaaagatttggacttaatggactctatctaactattgcagtcaaatttttatttcctagaatgggccaaaggaagtaaacagacccaattagaaagaacttccttaatgaatctgaattttgtctcaatgtataatacaataaacagggaccttgtgacacataccaagaagactttagttttctggattccacacagatgaggctgactgaaaggcaaccctgactatattaagcaggtaagtaggtgctcagtgaatatcactgttctcacttgacgtgaaatgcgactgaaccataatttccaagagtagttgaaattcactgaacattattattgatcaggactctctaaaataatcttcctaaaataatttaaagccatttttagttgaggcaataggatgctggtgttctcattgaagacttttggtgtggtagattcactaacagttattttgagatgctccttagctccttaaaagaagaaagtctttccacatcacccagatgcagaaaaatatgcaggccccccaagagcttaagaaaaacattcattaagacagactgtcaaaacagtcagctcgcaaccaaatttaggaacttcacaaacaaggcatggggtgacagaagcaagagaaagaatgacagttctgacaggcttttttttcttttcccttcagtaaactgcccgtgggtgcccctgaccactggtttcagtgttgaggcatccccgagggaaagacattcagggtagaagaggtggccgtaattgctgcttgtcattaatatttttaccaaatggatttctccatatggcagttcctttctgtcatgggttatttataatccttccaatctttaccaccaaagctaatctataccacattagtaaaaacattcctaggccattgagttgagttcccttattttatttccaggaggcagggctattaaagtgaaggctgaataagcacagacctgcatgtggctttgttggctaatatcaaataggattcttggatgtttctggacagaactggttttttgatcagttttgtgtgaccctttaaaaaagaatggagcctgtttctgatcccatcaagctcattcatctttcatttgaacttacttctgaaaattctattctcccatttattgtctcatttagtattgatgagctcctgctttatgtcaggtcctgtgctaggcactgggactgaaagaagaataggacatacttcctgcttatgaggagtcctagctcctccactagctagcaggtgatcttgtttaagagacttcatctctctgtcttcttgtctataaattagaaatcataaggacctggccgggcgtggtggctcatgcctgtaatcccagcactttgggaggctgaggcgggtggatcacgaggtcaggagatcgagaccatcctggctaacacggtgaaaccccgtctctactaaaaaaaatacaaaaaattagccaggcgtggtggtgggtgcctgtagtcccagctactctggaggctgaggcaggagaatggcgtgaacccgggaggcagagattgcagtgagctgagatcacgccactgcactccagcctggatgactgagcaaaactccgtctcaaaaaaaaaaaaaaaaaaaatcataaggaccaacttataggttattgaaaggataaacaggagattgcatgacagatatttaacccaacacctaacacattataagcactcatatatggtagttactgtcatccaaattattatagttcatattattagcaatggctggctccagtgctaccttctttgaaatattttcaccaattttgccagttaaaagtaatttctccttttcctttccttagggttctacagcatattggaccctgagttactacttattttattcatcttctgttataaataattgcattatttttataattgcatcttctgttataaacaatttcgataaactgtgaactgcttgagggcagagatcatttctcatttccctctatttaatattaattcactcattcactcattcattcatgtaaagagcatatactgagcatctgtgatatgccagacactatgctagccacggaaaatatagggaacaatcataataaaaccatggtctagttctcgctatcatgtttagtggttgtagggtaaacacacctgacagcaacaatgtaagcatacccttagatttatcctgtatagcatcggtacctgaatatgtgttccatgctagggaatccaggagtggccagcctggagatttgttgcttatctatgacaaacatctgaaccaccagctcatcccattgagcacaagccatacagaggattgaggagttggtttggggttaaatgaaggttgccagttgaagattgctagagggagagtgttaagcaaaaatgctgtttgcaggcagttatggttttcctgcccaggacgttgccattgggttatgttgtccagaccactgccactgggctgtaggaaggcagatatgatgttgttcagcctgctgccactggactgtatgtaaggtggatatgttgtccagcccactgccaatggactgtatgcaaggcagatatctggtccagctcactgccattgcaccatttctgtacataaggtggtttcctgtccagccactgggctctctcccctgtatgtaagcccctaatgaaacctcatgtcttgtttgctagctttgggtctcttctttggcctcttcaacctagtgccttccctattgaggttactaggagcttggcacaacagttgtggagacagataaacagcctgaccagcctatgaaaggagtaggaataggggtctattagaataaacgtaagggataataaactcagaccataagagtcagtgaaagtgtcctaaaggaagtagcatataaacttaattctgagggtcaagtaggagacagctaggatagggtgaaaggggcaaggaaaatatttctgacaaaggaaagatccagagggaaaagaaagcaagatgcattcaaataactatgaagttttatatcactacaggaagaaatgtaaagaggagaggagtgagatgagttgaagatgtaggaaacactggatcatgcaagaccttggaagccacgttaaaaagaatatgggaagtcaccagagggttttaagcaggggagtgacatgatggtcatctaaactagagtggtggagaggtaatgggggaaaggacatttttggaagatcagaatcaatacaagtgagtgattgagtcctgttgctgttgaggatgggggagtgagaggagtcatagatagcttaaggcagaagtccccaaatcccagttctgtgtcctgttaggaactgggatgcacagcaggaggtgagcggcgggctagagagcaaagcttcatctgtatttacagcccctcctcatcactcacattaccatctgatctccacctcctgtcagatcaacagcagccttagattctcataggagcgtgaaccctattgtgaactgcacatgtgaaggatctaggttgtgggctccttatgagaatctaatgcctgatgatctgttactgcctcccatcacccccagatgggactgttttagttgcaggaaaacaagctcagggctcccactaattattatggtaagttgtatacttatttcattacatgttacaaagtaatattaatagaaataaagtgcacaaaaaatgtaatgtgcttgaaacatcccaaaaccatccctcgccctgacctagtctgtggaaaagttgtcttccacaaaactggtctctggtgccagagaggttggggactgctggcttaagggtttctggatccaagtagattgtcatgggattttcatacccgtggaagaagggttggtttcgaatctggggaaagataatgagtcctgttttaaaacacatttcaggtgcctgagatatcacagtggagatatcaagtgggaagttggaggaaagattgggagttcaagaaaaaacaaagtagcaaagcacagatttgagtgtctgctgcagagaaatgataattgaagccacgagaggggatcagatcatacaagaaggctgtggagaacgagaagagaaggcagcctaggacggaaccctgaagaattctaagatttgaacattagataagaattgctaacaaaactgactggaagggtgtggtggaggagatagaagggcactcagcagaatgctatgtcacagtagcctatggaaaatagtgtttccagatgaagaggatggtcagcagtgtcattaaaaaaacagaacagcatttgctgaccttgaccagagaagcttctgtaaagttgagtggggcagatgccaatctgtaaaggattgaggaattagtgtgaaatgagggagtggaggtagcaaatatagtaaattcttttaaataactttgtgaaagaaaagtcagcaaacctagaggggacatggggttaagaaagttattttttgttttattttaatatggaagagactttaccaaagctgatgtgaaggcagttctccttcataacacaggcatgtagttaatactatgtttataaaatgttcttttgttcattctctcatgtcctagaagccttgtgagttgggtggaagaaggactgttaaccagttttttagttgatgttgttaaatagatgaggaaagtcaagcactaaaaagagagactttgcctgcactcacccagtaggttagtgcagaggcaagacaagtgtagtgcccaacactgtctgacacataaggaagaggaagaggaagagttcagggtttctcagaaaatgtcagactttgagccaagaactttcatatatctcagtatttctctacccaggctgcacattacaatcacctgcaaagatttaaaaaatatcaaagatctgaccccacactaaaccaattaaatcagtcttacactggaagtccaaattcctctgtaaagcagactgattcgtccgtgaggaaatctctatcgtgttatttttctgttttacttatttgttatttattattacctggagtatgaaaaagaaacattttagcatgacattcaagactttgtactaacctcttcagcttcatctcttctaatcctcacattcctgaagatactacccattctccccacatttcagcctccataaatcttttgttgcatttggaacatgctatggctttttgtaccactatgccttggtacatgctgttcaccttttctgttgctggtgaagtcctagtcatccttcaaggccagctcaaatgccactgtctttgggaaatttttggtcttcttgactatacagggacagttaattacatagttatttgtacttttggaacattgtccccactcctgtagcacagaaaagtattttcctatttgtttatatctcccatctccagcctgtgctagctttgagcccagggactgtcttggtcactgtgatatcaccaatatgtggcataatgcttggcacttgttagtgctcaataaacactaaaaaacgtggttctcatagtgtgttcccttggtcagcggaatcagcatcacctgggaacttgttagaaacgtaagttcttaggctaatcccagatctactgaattaaaaatactgggagtggggtctagctctccaggtgattctgacgcatactcaagtttgtgaactgctgtactaaaggatagaaggaatcaaagaggatttctctgtgagaaacaagagggaaggtctcccagggaaggaagcctttggattgggcctgataggggtaagatttagatactaagaaataaaagaaataaaataaaaaaaattaaatttttctctctgaaagagaaaaatgtaagaacaaagcaaggagatacagaagtatagtgcatggtcaggcaatgctgttgggcctagctgccttgagcctagagagagtggaagaaagtaaaggaagatcagtttgttaatcagcagcttctctcactggcccataagttcttccacaacaggaactgtgtttgttttagccatatatcctgatatctggcccagggcaagggcttagtgaatgtttgatgaatgattgactgaaggcagcttgactgaagaagaatgtcagagaaatagacgttctgcgagatcagccatatcatgcaactgttcctgaaaaggaaagtacagggaaaatggttcccctgcagttagagcataaactttcccatctggctccatctagtgtcctaatgggcagatttctgatctaggacatctctagccacagaggaaacatgctctactcactttgttatgctgcaggcacagggaggagagggaggcggggcaactggggtactcaggccctgtgcttactccacagcttcagattgaaaacaactttaggtctgagatttcttgatatttctaatttgcttatttcagttaaatttcctgtagttccgttttttgtgtgtgtgtgacacacacacacacacacagatacctttcttgcatttgatgtttccttgttcaaaaaaacctgtgactgatgagagacaagccttgctgatgccaaattccaaaggctgtgcactcagaatcttgaatttccatatcagggcatttgtgacaggttttggtcatgttctgtaacctccaccagggggtatcccagactctagcaaagtagcatgaagcctaggacttgggaaggggtcgtttttctttaagggtgattaataaattattgtcaatgcctttgataaggattgaatgagtgctattctaaggaaataatcagagatgcaaagaaaagaggttggtaagaaatacagtgactgatatgttgacttgtagaattagcagcaatttaaatttaaattctatttgtataaattttctataatgaatgtttatatttaaaatatgaaattacattaagaattcagcagtagcagaaaaagaaggaaaatgttaggagatgaagagagggatattagtcattttggggagatgcaatcaagtagaaaatatgtagttctagtagtttgggaaaacgtattttgccaatattacccagtataatccaggacctgttcttattgctgaccaagaggtcacatatttgatgttttaatgaactattttttaaaggattaatttatttaaaattattatttataaaatacatttatttaaaaataattcctacttttaaaataattaaataaaattaatttgtacttcgttaggcaatttagttttcaagaccaagatgctacctatgagacaatagatgtgtaggctggttgaaatgtttaaccagctaagctggaggtagaaaaaaaaatcacacatttttgataatatttatccttaatgagccctctatgaatacatcatttacctagcagctgtactatcccagatattttcacataaatctcacaaaactcccatgaacaaatcttgacagatatgccacaatccttttgcctaaaagaacactgtctcaaaactggcaggtcaagaaagatttgctggtacttcttaagtgcctcaaactgacattgtgcctgtcctctcacagatttatatcaacaaatgttcataatgatattttgatatagatgctgttagctttgttttgtatatgaaaaaattggggctcagagaggtgaaatgacttccctaaggtcatacagctagtacacaagtagcaaaacctggttgaaacagatttgtccacttgcaaacccaggtacttcctactatattcatcatttttatagggatcacctccaggggatgattaaaaggatagaggaagagaggcagtgactgaagctctcaggaagcaccactgtggcccagcttctgctttgcactccagtgaccttgaggttgaaagggacaaaggagcagactcccctgatgctccgtgatgagtcaagggtaaaggcagctctcagggaaacagctggcctttctccagcagccaggcctgggagataaacagatcaatgcggacactcacctccacctaatgagctaatggcgcagccggggcactgccttattggattgctggtcgtgctgacaagcctagagttaagcaggtccactgcaggggtgggggcctcattatcccccagctcctagggagatccagttccttcatatgaaagctaggaatgccttgttcctttatttgtttgttcattcgtttgtttgtgtgtgtttgtttttactcattctcctatgacaatgttgagatttgataggatgatgtcagtgacctttctgctttgtggaccaagtgtcacagatgacggaaacaactgccctccaaagaggcagcctggtgtgttgctgcaatgggctgaatgtttgtgttcctccgaaatttatgttgaaatcctaacctccaatgtgatggcattatgaagcagggcctttgggaggtaattaggtcatcagggtagagcactcacaagtgggattagtgcccttataaagggaccccagagagctagctagccatgttgggatacaacaagaagatggcagtctgtgacctggaataggcctctcaccgaaacctgaccatgctggcattgtgatcttggactttcagcccccagaactgtgagaaattgttgtttagatgtcacccagtctatggtacttccatagtagcctggactaagacagttgctaggagccctcacctgggcgtcagcacagctgtataccaatttcatagtgactcattgtggacttgaggtacctctctgcatctctcttgagtggccaggaaaagctgcctagggttgggttctgggtcaggtatctccccaagtccccttctctgaatattcagatctctgaaggcagacctgctgtttgctgcacatgtacaaaaagatcaaggagctgagcagtctccataatagaaggaagccaggtaggccactggactcactccaagtctggagaaaataaactgtagtcacagaggcattctttgagcctattttaaaataggagctttatatttgttcttttctaagaagtcttcagagggattttggtctaaaagtgtctgtagggatgaactatctcagtggtttacaaattctttaagctatggaactctctgtacagaaaaaattacattcaaagcccatagcataaaatagatgcagttggctgggatgttgttaaggctccatggaccacaatttgaaaatcactaatctatttcaggtcttacatttacctgctgctggtgaagctttgaccaaacttggtctcctggtccatagtccagtgctctttctcatatacacattgcctgatttatgcactctgaatttattccccatccaagcaatattaactgagattctactatgttgaatctattaagggaatcaccagcaacacatcattcaagtctacaaagagctcacagaccaccaatgcacaggtcaaagaaagaaagtcagacacctacaaatgggttagatcagggtttctcaacaccagcagtactgacaatgtggatcgggtaactcctcactatgggaggctgtcttatgcattgtaggatgtttagcagcatgcatggctcttacccactagatgccagtaacaccccctcctctcaagtgttgacaatcaaaaatgtctctagacattgccaaatgtttcttgaggaaaaaggggcaaaattacctccagtcaaaaaccactgggttacttaagagaacaacataagggatctcactgggttgtataaaattaaaggtcaggtaagcagtgaagacaagtgttgcaagaactctgagaaaaagaaatccttcttctcttgtgttgctcagtatatgtaatccatgctgccagaaaaaaacttttgtttgctagaaaaaggatggggtatgggaagaagccattgcctgtatgatgatatgagcccagtggtaaaaaagaaggggcagactcttggctgaagatagattggctctggtaggtgaataccattgttctgtcaccctatgcaatcataaagattgcctgtagacttcccatgcagctgtcaggccaggaaattcctcactgtgccactaatttatagtatgacattggccacatccctttccctactgaactttggtttcctcatctgtaacaagataaaaagtggggactgtagtttcaccagtgatccataaattccctcctagctcccaggatttcattctctaatttttgctacaattctagaaagattgtcaggccaatggctacttgatcttaggccttctctgctacatctgaaagcctacttcctcaggcagattctagagataaatataaggggagtttacgctcctatccataccttggaattataatgatgatgatagtgattcaccttcatatgcagctttatagtttataaagcaccttcaggtgtgatatttacatacatgatcttaaaaacaaccctatgaggtaagaataattactgccacttcatggacaagaaaatcaatgttcagaaaggctgagtgccttgcttaaggtcgctaaggtcacgtagacctgcctgacttcaaacaccttgctgtttgaggtgtacccagctgcctgtgcttccgcatgttggaaactatccctccaagtctcctagagataggccaactgactaagacactcaggctggatagggagggaagagacaatttgctgagaataccatgctgactgtggtagtggcaacagaactggctgaacaagtgccaagccatgtgctttgaaagggattgaaaaaaggaaaaaaaaaaatcttcccactgtttgcctgccaaggccctgtactgggacaagggtatggagctctgcttaaggcttaattctattgattacacattccattttccaaagtgccatttgcctgaaggagcaggtggtgttttcggcatccatttagctgatgtattagccatgtggctcagtgcatcagcaggcccgagtcatcaatttacagcgagatgacagagggaatcactcactgcagaactgtaatggggagagggggaggggaagtggaacacagagaagtagacaaaaatattgaaatagtggtcctgactggcatgtgaggaagcagggagctatgtggcaaaacataggacctttggctgaaaatagcaaatgtactcaggatgactccatggcagggcctgtgctggacactggagatgcaaattcctaccgtgacagactcactttagtggggaagacaaatataaataattaatgacaataatatcagacatatgctacaataaagcgatacggtaggtaatagaaaagtgttttaaaattccatagctctggctcaaattacacctttgttatttagtagctatgtggttatatgctaagtcagactggaaactcctagagggtaagcactatgtcttgtacatttttggatgctcactgctctagcccagagtctggcattgctattataatataaccaaataatattaacagtataatcatgataacaatacaagtagtcacaatagaataatatttagtcccttaatctctattttatagaggagcagatggagcctcaaggaggtaaataactttcccatgtcgtgcagcttatacataatggtagagccaagattcaaactcagatccgtctggcttcacagccatacagccattcaacattatgaaaatcagctattccagttgttacttaaccttgcagagactcagtttccttataagtcaagtagatgtaatattatttttcttctttatggtgcattgtaagcatcagttaaaacaatatacgtggaacatttagttagcatattctaaaaatctcagcaaattactgggtacaaatagtactcagtactattattatcattatttttaaggttattttgttcaggcaagatctttgaggggcacagcccttctagtttaaggaagtcttctccagtgcctgtgtgattatcaactcttctctgatgaaatgaagccaaggtgtctgctctggcccctgttcttgctagcaccccagtgtgtttctttttaattaggtcactaatgatttatttattaagacttttctcatttgttatgcacagaaaggtggctcatgacaaaggcaaaatatgagctaagccaataacggctttggcaactgcattccaataaaaaggctagttggcccttgagtttcagaagaaaaaaattagctggcagaagtgtagaggtggaggtaagagaaggatgctagccagttgccttggaaaagaatcccaccaccaccccatctctgtctggtctggctggagaacacccctctacttctccctgagaaaggagtgacactgaagaaatgacaactcagtggcattcactctctcattgccttatttattcagcacacatttttaaaggctttgttttatgccaggcaccatactaggcaccggacttagacacatgaatacgatttcattgttattcttaatttaggagacaggtgatacttgaatagctataaaataatgtgaacattcattgctgtgtgacttcacatatactgtaatgtacttgagaaccatttaaagtataaattctaggaaatttttaataatcatttcaaaggaatattcacatcatgtccaattaatatcatttaattatttaaatcattgattaaataatgtcaaataatgtgggaaaatgctcacagtatattaaatgatatataaatgatatataactataaaatatgttctcaactatatatatatatacatacatatgcaaataaattaggaagaaaatattcagcatattaatagtagttatctttgcatttaaggataatatttttctctaatataacattttctgtatgcacaaaatcttctataatggatatataaacagaaattaaatagaaaaaaattaaaaaaaatatataaaataattattgtattatacatatgtatagaatattcctgggatagaaaaggctgactttccaacgcttccattttatggataaataaattgagcctccaagagattaagtgactattctgagactttccagcccataggtggctgaagcataactcaaacccatgtcatctccttctaaattgagaactctttctgctgagccacagggactttccaagagctagcagagtgcctgctgaaatgtaggggttggcttgcctagaaggtctcaaagggtctggcagagctgctgttctgattgttccagaaaaacccagaagtcaaaaggaaagcctgggagtgattcagtggtggatcttggaacacaggttagctgctgatttggaggaagtgcacagcactgtaaaagtaatcttgactgtttgcatttcaactcttcaagatttatgatagttaaattagaagagtaatataggtctggatatatgtttaatgttttcgtttagatttagaacatacagccccagtatggagctgatttcaatatttgaatattttaatgtcactgtattgtgtgctcagcatccatgatcaaatatatctcttcaagtccaatttacttttatcttcattatggtctaacatttaacgaatttgcatttggccacatagcccaggaccaatgtacatttgtgttcatacatccgtgggcatgtaagtctcctaagagaagtcctcttaaaacacaagtatttcctgttttatgaaggacctattgtcttagttattagagaatattagagtacataggtactgagagatgaatgcagccaaccttccacttctattcttagatctggcccaaagggaccctaccctgggaacctactgatacaaacactgccagcccatctctgtcccaagagactacccagatgtatataataagaattaagttcagatctctttgatattttgccaacttcttgtaaaaactatagctttacaagcatctttctagtttgtcattatggaaggtttttttgtcaaattaggaagatagatatatattttaatattttgctagctattcataccccaaacctcagcatcacacaacacacaatatatccatgtagcaaacctacacatgtacctgctgaatctaaaatataaataaataaataaataaataaataaataaataaataggcttatgcttcatgggtctctatttgttctctcacctgagacctgcaaatgttttatgtgggcctggaacttcccccagctcccagtaagtatactgagagggtctgttggcaaaagactttaaaataaaccatgtcttgctcatctctgtatttctggtgaatatcacagtccttcacacttggaacacactcagtgaatgacaaattgaagtaaactaatttggagtttttcttttgttttgcatttagactggggattttataagggtaataaaaaggataaattcaggagacataaagccaatagagttcactaaacaattacccaacaaatagctgcccaaaaaatatcaattaatatacatatccaactgtagtataattctgcagcctgaggggatggaattgctgatggactcgtgtatgaggtcatgtgtctcatctctgactccatggatagatgtctctttcaaaccacatgtttaaaagtgatcctccataagcaagatttgagtgctattatcagaagaggaggaaatggaacctatacaacaaaataaaattttaaatgtactttgaatttgacatttatagatgctacttgactcacaatgaggttatgtcccataaacccactgaaaatatgttaaaaatattttaagtcagaaacgtgtggctgacttggagctgtgctagctgctactgcctagcatcaagagagaagtaaggtttttactaaatgcgtattgctttcccaccattataaagtcaaaaaagctgagtcaaaccattgtaagctgaggaccatctgtatatatatatatacatacacacacacacacacacacacacatatgtgtgtgtgtgtacagtcatccctcagtatccatgggagattgattccaggacctcctgtggatacaaaaatccatggacactcaagtcctttatttaaaatagcatagtattttgcacataacccatgcatatactcctgtatactttaaataatcttagattacttctaataccaaatacaatgtaaattctgtgtaaatagttgttttactatattgtttcacacaaaagtttctaaaacccatggcccacaggccatatgcagcccagaatggctttgaatgtggcccaacacaaatttgtaaactttcttaaaacattatgagattttttttgtgtttttttttaaaagctcatcagctatcgttagtgttagtgtattttatgtgtggcccaagacaattattcttcttccaatgtggcccagggaagccaaaagattggacacccctggactagagaataatgacaagaaaaaataatctgcacgtttgatacagatgcaattctttttttgaatatttttgatctgtagttagttgtagctatggatgcagaacttacggatatggagggccaactatatatatgtgtgtatagattaatatatgcatatgtatgtaaagtttccacccggtgagatcagcaggccatgaggtgttatccactgggcagctgtaactgtatagaagtttttttctgaggtctacaagatttgcactgcctccactctccccctacaaccctcatctctgccatcccccattgaaggaggcattctcattatgaggtaatggtagtggaatagagctctgtcactggataatgatctcctgtggttagatgaatgaggacagcaaatgtgggcacctttagaaacagaacagcaaggggctgccaaaatgttgatttttcaaagagggaggttttaatcctgtcacaatattctattcaaaacaaacattatatgcagaagaagacagcaacatcaagaagagcaagacgcttgcaagactgagataagactaagatagaaggtggctgaccactttgcatgaccatgaattattttattttattttattttattttattttattttattttatttatttttggaggcagagtctcactctgttgcctatgctggagtgcagtggcatgatctgggctcacagcaacctctgcctccagggttcaaacaattcttgtccctcagcctcccgagtagctgggattacaggcgtggaacaccaggcctagctaatttttttttttttgtatttttagtagagatgggggtttcaccatgttggccaggctagtctcaaactcctgacctcaattgatccgcccacctcggactcccaaagtgctgggattacaggtatgaggcgtcacaccggccaaccatggatgatttaaaatcattgggtagccctctgttttaggcagctgaattgctttgctacctagagagaggaaactgatatatgtataatacattatgattctactgctaccctattactaccaaacagcaatttgtgtcttccagaacccacactgacttcagggagataaagactgacttgaagtctgtattatagaagtagaagtaatgctaatagtagcactagcaatgatagtattaataatagaaatacaagtgttagtagcaatagtagtagtagcactagtagtggcagttatagtaggaagtggtagttgttgtggtattaatactgcagagatggagatgtgagtctaagagcaggagtaatggctgagagaactctggaggtaccagatcttttgcctcatcctctgatttttttcctttattaccttttgcctttgtctgtatcattatgtacctggtccatcttagaacagtagaaaccccactccccctaaatggaggcaggtcaatggcttacagacagcagccacaaggaacagggaagcctggtgtattagtctgttctcatactgctaaaaaagacgtacctgagactggataatttataaggaaaaagaggtttaatgggctaacagttccacgtggctggggaggcctcacaatcatggcagaaggcaaaggaggagcaaagtcacatcttacatggcagcaggcaagagagagagcatgtgcagggtaactccgctttataaaactgtcagatctcatgagacttattccctatcatgagaagaacatggggaagaccaaccctcatgattcaattacctctcaccaggtccctcccatgaaatgtgggaattatgggagctacaattcgagatttgggtggggatacagctaaaccatatttcacctagaaacaggttttccctttccagacaaggcctggatgtgtggagtgaggatgaagtcccacgaaagaatatggaagacaggcacattgaagggggatattaagtgtcagtgggcaagatggataacactcttgctaagcagacagaagcgaaaggaactaactggctttggcaaatgtgtcaagcactgtgttgggtactttcctcaaaagtgacatagaaactaaggatccaatccaactaactctagtgtctcagagctataaggctcaatgctaggattcaagcccaactctgcctgcccaaagtctatggtattcccatgaaatccatactgtctctccaggtactcttgtgtctgccctttaaccactaagatgcctaatatgcctttcttatgtggctcacaatgtggttccacagttaaaagccagaatgctaccccagttggtcagccatcatgataatatctaagtgtatgcgttttttatattgaaggttttaaaaatgcacagttcaagatctgagaaagttttgaaaatcatgaattcatcagtgctaatggctttaggaactataccaagaatgccacctctcctcctttcttctcagcttctgcgagaagcatccactgacaggatggggaagtcagcacactgctagaaggaacagacagccccatcactggagcttaggatcagagccacatccttccagtagctagaatgaaagcttaatcaacattaggattagtacatccgcacttacaggggtttgaactcaattaaaaatttcaactggaatcttagcacaggtgctgtgagacagaatctgactgttctgggctctccccccaattttagtatgtattcctggaagaaaatagttgggtcagatggatctggggctcactttagacctttggtataaaaatgtaataaagttctatttggaatttcataacgatttagttaaattatagaatcagctatttccataggtctctttttccctcaggcttagtattttccttgaatttgatgccattttttaaaggggtggagaagcaggggaggactggacttggcatccaaaggacttcacacaaattctggctccatttactagctagatgctcttggtcaaaccactcaacctctctgggccttagttgtctcacttatagacatataggcataataataggcataattatataggcataataatagacataatatatataggcataataatagacagctcttcctcaaatgatggctgtgataatttaaatgaaataatgttgtctggtatatggcattgctgaactaataatttactttcctgcaaaatcttcatttctgacaggttctagtaagttataccatgtgacatttcagtcctttactagcagactaggtcctagccctcaatggttgctttaattacaagagccccattctgaaccctgggattttggttagttatgctacctgctaggattttagattggttctgctacctgcctacattcaccaataaccttctccagacctggatccttctcttgccctttggctggcatgtctctgagatggtataacttggcacatctccaatccattcttgccacaacagagatatccttttaaaatacaaatctgattctcactcccttactcaaggtctctgaggtaaaagattaaaatgtatcccacggcctagagggaccagcacaatctggccccacctacatctcacctacatctcaagtctcatcctcccctcaatatctttgcttcagccgcatttgtatcctttcagttaaaaaacatgccactttggccttcactttgttcccattgttctctttcctggagcaattttctctaccaacttccttcctgccccccttttaaaatcaacttatttttataactcagctcaaaatcacttcctcaggagtgtaacctttgaatctggaaaccacatcagattttcctattatttctctgataaaacttttcactcatggcaacttgtatggcttataactatatattcaattaatgcctatcttaactataaactccattgaaggcagagatcatgtgtttcctcgtcactgtatttttgacatctgataagttgtatagcactgttgattttgaaaagtggcactccaacattgccactcctttataggttatcctggaaccaactgtcttgacccacttctgaatcctaatttcctagagattctccaggcttctaacatcgggactcatttctttctttctttcattcaaacctgataatcaataccacttcttattctgccacctcagacttttctctgattttattattgtagatcacttcaaggaaagaacacttccaggcttaggcctcctgggatgtgctaccagatgtgtgccaaactcaatgggcaggacttgtctcctgccaaacttaaatatattgatctataactggaggactggaatcatctagccctcgtttttctaggcctagatctctgtctggtctttctggagtgtccctttagccagatcaacatttttaggccccttttacctagcttgctgtacttgggcccaaatacgatcacatacagaaaggagctttgtaaacttgaaaagattagacacgtgtaagggattaagggcttagttcagcctccctttcaattcataactaggcttctgcttggcacgctctgccatctggagaaattttctacttttttcttccccaatgacagttctaactcttttctctctgttccttctcctgcactggcatagctagaacagggttttagttgttgttgttttgaatggcagatccattgctattaagccagtatggtccctcatctttaagtttttgttgactccctatatgatttgccaccataaagctgcacaatagcaacctagatagccaataccattttagcaacttacatcttgatatgagctaaataattcatgctcacagttactttaggatgaagaataatagcacaaaatgacttgctctataaccttgggcagatcctcttccatttctgagcctcaaattcctcatctgtaggataaggagttagatgagtaaatgctcacgtgctgattaaaacagatcacacatttaagagggcttgtatatggcatgtcataaatattttgtcactaccattttttaatctaactccatcactctacaaaacagaaatggaagtacatggaggttcattcactcattcattcattcattcaatcagtcgttctataatgatttgttagatgtcttttatgggtcctgcaggcactatggcagcatctaagtgacttacccaaggttgcacagcaatctcatggcagatgtgggatatcaacaataacaatggctattatttgttgagggctcactataaaactagcacttgctaagtattttatatagtctaatttaattctcagaaattgttccctgtattttttatgataacaaaattgagccccaaaaacttaagtgccatctcaatgatttttactcaaatatttctccaaatggttgcataggtaccaaaagatgacactgagatgtagaaactaatatatggtgaactaaaaatgatcttggttatcagttttcaaaaacaagttaagcaaaatctctaatactaaagcatgaggtgccatgtttaaagatttgcaaagttggtaggcaacaacatgacaggattgggagctagacaaattctttcagccataaaaatgacagctattgtacaaataaaccagttactaaatggacagaaacactcttcctccatgtaccctctcacttcattcaggtctctgttcaaatgtgacctacttagagatctttctctgtccaccctatctcaagtagcccttaaccttctctatctcttatactgctgcatttttcttttctttctttctctttctctctctttttttttgagacacagttttgttctgtcacccaggcttgagtgcagtggtgtgatcatgactaactgcagccttgttctccagtgctcaaatggtccttagacctcagccttcggagtagctggaactaaaggcgtgtgccaccacacctaattatttgtagataacggggtttttccatgttgaccagcctggtcttgaattccagggctcaagcgatctgccagcttcggcttcctgaagtgctgggattacaggcatgagtcactgtgcctggcctctgtggcatttttttcttcacagcatctgaaaccgtattatttatggtttatttgttcatttgttggctgagtgactgaacgaatgtggttaccttcctttcctcctggctcccattctggtgctcttctccctgcatgcaaaatcagcccatccttcccaggaaagagtatgggagtgagtctccagaaagctaggtttcctgtctgactccccaaagagactctaaggttctgctgcatccactcaggatggtccctctctccacctgagcagtatgcagtgggaatcctgccagcaccagaggaggctgcctgccttcttctggcctgattgcttcttggttaccccagggcagagatgaaacagagataggtatgcaggatggtacagcatgtcttccctgaaagaaaagctttgcaagtttaattaaaccctagtaattttcatagaccacaggttgaagaaggaaaactgtgttcttggagcttttcctacccttaaaaaaatgtgttcctttagtctagttttgatttcccgtgtaaaagggtcatgaaattaatggaaaggaaatgcccaggaaaggaaagatgctgttactcgttgaatttgaaagaatatggggatgatatttctgatcatatttttggctgtcaaaagaccagagatgctcttttaatggtataaggacaaaaagtttttctttttgcagacttgccagaaatgagacccaggagaaaggcattgtttcctgcaattacacagttgccagggaaactgtgtatggaagttagcctaagtgcaagtaaaaaaatgaagcatctcataaattgttataagattattttgaaaagtctgggccaatcatggcatagagtgacccttgtagaactgtaaggatttcttagctgtggcaggaaatcacacttaaaggttacctttctgctgtgaacctctttaatgaatgtttttctaggagtgaaagtcttcaggtaatttttttttacacaactccatcaccaaaaacaaaacaaaacaaaacaaaaataaacaaccaactaaccggaaacaatgtttgactgtagtctagagaaacaggtaaaaacacacacacacacacacctttgggaaacagtatttggtaatcttacatgtcagaaaaagacttcatttttttcctctttactatttttttccttttacctctttgtttatgcaaagattatatgtggtttgctttaaagaaaggcctgaactagtatcaattatttcaaatatattaccatccctgagactcagttctcctttctataaaatagagttaatcatagtctctaccttccatggttattctgaaaatgaaataaagatatatatgtgtgtgtgtacatatgtgtatgtgtatttgtttgtatatatacacatatatatggtatttatcatatggtagatgttcaagaaatacctagaaaatcttagagatcatttagtttagcctcctacttagtgcagataatttcttttaaaatacaatggccatccaactttgccttaaactcatccagagacaggaagctcactaccttacaaggcagcccatatcatatcaagaagtcagacagctgacttttatttttttagttgggatctgctccctatagcttttattcatcagacatgatggcttgtggaaacacatggaataaatctattcccttgaccctgcaaaagtatcatccatgtcttcttgagtccaaataaccccattcctacaactagctctatatcctaataataggcagctctgtgtgaccctaagcaagttacttcacatctctaaccttcggtttccagccattaaatggagatagtaatttttttcctgtttctctgtcaggcctctgctaaagatcaaaatgaaatgctagatgggaaacttttagaaagtgtaacataccacacacattaactagtatttattattacttcttcccaatcatctccacttaaccttgcccaaagggagcaattggttctgtttgggacagtgaaaagagttggactttctttgcttaagctctgccctgtatagtcccaaggcctgaaaactgatttgcatcttcttggttccccttgctgctttcttagcatgagcccttgcctctctccccaggttccctcgttgacgttgctcacccatttagttaaatgctgttttgacgaggtagcctattttggtaagtgcctctggggagctacagaaaggtttaattcccattcttttccctaatgtttatctaatggtaagggattgagaataggtttgatatctctggagactctaggctgaatgattcaataatgcacgtgtctaggggctggctgagagacttagctttctgaagagaggagagggcaggttgaagacgctcagctattatagcaggaggggtgtcactcatcaggatgtatcccaagggcttagtaaggggcagcatgaatgaactagagcatgtggtgatcaggatagcaaggcagggtgaccacatgtctcagtatgtatatctgttgtcccactgtgattattaatgctatcacctttcactctctaaagtgaaattgggaggatatattacatgtccactttagacatagaaaggatacttggtggatatctaggtcctttctgttcagcttcagacccaaatacacaacggtatgctagacatcaccacccagatgttccccagtcatctcaaactcaaagtaaactattatcttcccccaacatgctcttcctccagaattccttatcccaggaaagggcatcaccacccacctggttccttaagccagaaacccaggaggtctctgagattttaattaccctcatccctacaaccagtctccatagaatccttcagaccattcccctcctttctattcccacggctgctgccttagttctgagtctcattctttctccaggatgcctaaaactttaatttggtgttgttctattcagtccctggctccaagtcttttaagatcctctgtcctttgttatactagccatctcttcaagtttctttgtatgatcatgcttttggtgtacttacctaactcaatgagccctgtaccttgtctctagaagtcaaacttctacttcatattttcagtcgttcattcattcattcaacaaagatattgaaaagttctgagagtacaaatgtatcaaaattatagagacaatcaattttggttatagcctgctgagcaattaggaagacatgaatttgtaccaatgtctactgtactttagattcaaatccactttccacttaatatcccagtgttatttccaaaatatgcatttcactatgccacgctgctgtttaaaacactccaatatatttccattggctatggatatgtttcaatatggaggaattcccactaaaataacatcctgcctgccaccctactcaccccttcccttaccagagtgtctttaaggggtggggtaaattgtccaatggtgacagtgggaaaatagagctttatgctcccttttctctgaaatcagtctacctacaaacagcatacactcagttctgctgtctgtgctctgccgcactgctgctcgttattggcaaggggaggtaggtttctagagttcagtatttgttgccacccacttcaacgatgctctctaatctagcttttctaagtggtaatttacctgacttcatctctcagttgggtctgatcttggatagagagcagaggtataattcattgagttcctcaaaccccaacatgcaagaaaatgtcaagttacctggttttgtaaacaagtagaagatgggctgggtgtggtggctcacacctgtaatctcagcactttgggaggcctaggtgggcagatcacttgaggccaggagtttgagaccagcctggctaacatggtgaaacgccatctctactaaaaatacaaaaaatcagctgggcgtggtagcaggcacctgtgatcccagctactcaggaggctgaggcaggagaatcgcttgaacctgggaggcggacgttgcagtgagccaaaatcatgccactgccctccagcctgggtgacagagcgagactctgtctgaaaaaaaaaaaaaaaaaaaaaaaaaaaaaaaaaaaaagatacaagatggctgggtgtggtggctcatggctgtaatctcagtgctttgggaggccaaggaagagcatagcttgaggccaggagcttgagaccaacctgggcaacatagtgagaccctgtctctacaaaagatttttaaaacattagctgggtatggtggtgcatgcctgtagtcccagctacttgggaggcggaggtaggaggtaggaggattgcttgagcaccactccactccagcctgggtgacaaagtgatatcctgactatgaagaaaaagtacaagaaatctactgccttctgtttttgtaaagtaaagagcatttccctttctacagtttctcggtatccttcctctccttaggtaggcaactttggaaagccaccctctatgatgacaatccacaggccaggcaaaccttcacggagataatgtctgagaccaaaagagacatgaaaagccagttggaagcagtttggttacaggagtactgtttgattggcaactgcaatgggcccttacagtcccctcagctccacacagctcagaagaactgcactctgatggttgattgtaacactgaagcagctttgagttcttgaggaaggcttgagtacttgctggcattgaagtagccaccccaatctggctatgacattttcttggctacatggtgagaatgaatcatcccggtcttatttgcaaataatagtaaaagggcattttacggtttgtttgcaaagatctttttcctttatttatttcatattatcagaaaaccatgctaagtgcacaaaattaccctattttatggatggagaaactcagtcaggttaagtgactttctcaaggttcttcagcaagtttgaggaaaaacttggaaaatcccctcagaattaatcagaattgtaagggcaattgggaatctcccttaatgataacttcaaaatctagcatcttttatacccatgaagaactttgtcctcttgaaaatacaaaatatcacaactgaaaggggcctcagcaaacatatcatccaatcttcttccttgacagacaggtaaatcaaggccggaagtaagaatgtgactttcctgatatcttgaagtgaggctggcagacatagtacttgaatctaagcatccaatttccatctaggccgtttctattaaagctgcctgcagaaagtataagcccattgtgcagatgagaatattaacctcagagaagtaaagtatattgctcaagatgccatgactggagaatggtagagctatgattagctttagagtcagatgatgacacttggctgaattggtgggagttattattataataaccaacaccactccactggatggctttgtagccatcataaaatcaggccatcagtgattcagcttcattattagtcagtttcatagattttttcttcctttgttactagtgttttcattgtgtgacatgccttcaaaaaaataaggtatatacagaccctagactctgattatgggtttcaagtatatgctgtttctccatgacattcactaactgctaccccagagcccgggatctgttaagttgcctgcaaacatttgacatttgaaagtgttttttttcctctttttttcttttgtaatcaataaatcacttttgatgactttaatggaaataaaataaccaaataaaatcaggcttcagcacattattgcctaattatgaatttcacatttttgacagtaaaatggaggcttgtcagactcaaaaagcaggcaactgctataaaattttaaccatgtctctggggctagaacccaggtccttaggaaatcactgctgttaccttccatacccactactgctttggattcttagtctctttgggacatttctaatcccttaagcattccagagcacaggagtgggagccaaacagacctgggttttaattgcagttcttcgacttatcagcagggtgctttggagtaagtaacctaacttctctgagtctcaatttcctcattcctaatattgggactataatatctacatcctacaattactgaaaggattaaaaataaagtactgaaggtgtatggttcatggtaggcattcaagaagtattgctttcccttctctgtttaagtgatttaccaatatagatatgctatcaaccaaaatgtttgggccttatgcaaacaaagcactggcgtcttacctgcctattctggcacataactcaatcatctgctcaacaaatattaatgtctactatgtgccaggctctgtgctatgctgtgcaccttatccagtggtaaaaacaaacaaatatgatccctgccatcacggagttataccctaatgaaagagacagagattaaataagtatataaaatatgtaattatacattgtaataagtactataaaggggggaacacagcgttctatgacaataggataatctactttctttagaaggagtagttggggatggcttctctgaggaggtgacatttaaacgggaatgataagaagtcagcaaagagaagagataaaagactattccaagtcaggaacccagcagctgtgaaggcctgagaagctgatattagggcatctttcagatccagccctctgtctatccccacagacttctacatcccgaaataaattgggcatttgtatatgtacgtaactttgcatatactcttttctctgcccctaaagcccttctcccagttctctatttggaacgccaaactccaagtatcacatttcaaagaacccttaattaatctccccaaagcagatctaatgcctctccttttgttttcccccaatatttgtgtttaacttcataatatgtggtaataagtacatcatgcctgttactgaacacttaccctgtgccatagactgtgctaagtgtcttacctgaattatcacatttaatcttcaaggaagcccagtggaggagcgactagtatcatcaccccctttttacagaaaaatactttgaagttgacttaccctgactgtcagaggcagagtctggatttgaactttaggtcttttgcctccaaaacctgaactcttaaactcctgtgctatgctagagcaacatctctttatgtcttttccccattggaccctgagattcctgagggtgggtttttgtgtgattcatcagtatatacttagcacacagaacaattcctggcacaaaggagttaactatttgctaaaagaatgtcttggcaattacagatcctgactgataaagacaaaatcacataacgtgtagacaggtctgtcccttcagccttcaggcacagcctgtactgtggcctctgctgatctgatttgtacagcgattgacaggctgggtccctctccttcagtcccgttaatggcattagcatctagtcaataatgctcagcatttcattttagcactttaattaacaaattcaatttgttcaaactgctgtgaaaacaaattaaaagctcaagaaaggggcctccaggagggggaggaaaggcaggggctctgtaagtattaggctggatgttgatctgctctttggaggttaaaggctggacattgcccttcagccatcttcctatccctgacgcaactgaatgcctccgtgatatagccaagatgaagcaaatcagcttctgtaccttctaggtttgtcctttccctctccatgtaggcaagtgggggccccactctgcccttcaggtttgctctccttcttcaaagagggcattctgctttggatctgaattcaacaatgacaacattaataatgaacagcttcctcatttagtgattctaaaccagggataattttaacccacagcggacatctgataatatctggagatatttttagttatcacaactaggaggagggtgccactggcatctagtgggtggccacaatgctgctaaacatcctacaatgcacaggacagaccacctcaccaaagaattatctggcgcaaaatgtcgatagtgctgaggttgcaaaaccctgttctagtccctttacagttttccaggaacccttggtgactgcaatgtccttgtgagataagcaggttggagactgctaaccccatttaagagttgaggaaggcccgggtgggcagatcacgaggtcaggagttcgaaaccagcctggccaacatggtgaaacctcttctctactaaaaatacaaaaattagtggggcgtggtggcacacgcctgtaatcccagctactcaggaggctgaggcagaagaattgcttgaacccaggaggcggaggttgcagtgagccgagatcatgccactgcactccaacctgggcaacaagagtgagactccatctcaagaaaaaaaaagaagagttgaggaaattggcagagttcaagtgacgggctcaaagtacacagtaagtagtagtgatgagaccagaactagatcctttcaccacctctagttgaattaaaagagtggaaagcaccctttgtaggctacaagtagtgttttgggaaatgaaaatggtttacagatatgtgcctgtcccctacatatttcttaagaaacagacactggccagggtacttacccatttgataggctgtctaggtttggtggcaccagacctgggaaaaggtgcttatgatgagtgaagctgggaaacttcctcctgcctcctaccctcaacggttatatccaaagactgcaaatcagtgacaaacttttaaatagaaggcagctactgaaaagttcagcttgctctcaatcattggttattccaaccctgagattcaattgtcctttctatcttagaaagcaagaagggttaagtaaagtcagagctacatatgagttttgtggtgagcaaaaatcaaaaccaaaacttaacatttgaaccttttcaggggttctgacaaatacacagacatattagataaattgggaaaggaggggagtgggcaggcagagaaaggggagaaaagagaaaaagaagaaaggaggaagggaatctgatgtaagttattgcagaggatcaatagaagcttcagagaaaatgtgtccaaagggaagagtccagcagaatgaagcagccatggaccctgaacatcagagggcagtggtggctcctagtatagtgaatatcagatactctggcagcctgagcatatgacccagattaatagctctgagtgtgtgaatcaaaagagatggatcactaaattctgtaacactttggaacccaaggtgtttgctgtgggacactattgaagtgagcataacaagaagggcactttgtgggaagaagtgttctctagggagttaatttctggcactgggatacaggattggcctgttactttcatttcaataggtcacaattttccagctcttaagataatggcaatgaacacaacactcaaaggaataaagtttcagcctagaagtagttcccaggtagactaaggcctaggattacaaagtgccagctgagtttttgtagtggccagtagtaaccacaaggagtgtataaacacttgtaagactccttgggatcctttaagctgtgtggggaagagcaatattgtaaaagactaaatttcctgctatgacaggtaagggtacagtgatgcagaaatacagttaataatgttcttgtgacctcagtgatattaacaaggtgatgaatttaggttttttcatgttatctcatttcatcctcattacaatatacaagcttgttttattctctccattttcaaagtggaactcaaagaggttaagttgcttactcaaagtcatgtaagagttgggatttgaagcaggatctgtgattctaaagaacaagctgtttgtatcatacaaagtcaggacctcttatgaggaaaaatgaatagtggccagaagggcccaagtctcttcatctggtttcaacccactttccaatgcctttttctcttgcccgtgcaaaccatgggacctctggagacaagcaaatgactatttttcttttgtgaggactgttctataaagtcaacaaagcatgtttccaagttagtaatcatagatatagtccacataggaaagcctgaaagttgccattataaactccaaggatgacaaatctcctgctccttgcccagagaaaagcaggtctttgatgcaagaaaagagatactgagaaggtgcctttgaaaagacaaaggcctactgaaggactctctgcagaaatacccccattcctccaatcgtctacttagagccatatgttgaattattgtggtggggggggggggttgtggtaaaagaatatggctttagagccagactggtctggatttgagttctaaattaatagctccctagctgagtgaccctgggcccatgacttaatctctcaagtcatcagattcctcatctgttaaataggataacaatgaaactattagagggctgttgtgattattaaatgagatgattttgggaaagaatctagaacaatgtctggcatataagcagatgctcaaaaatgtcagctctactccccatattcctaagtcttccacttactctggaagctgtgtcccaattcaatgttgtattcctagaatttagaataaagccctggacatagtaaacattcaataagtgaaagtttgatgggtagataaagggtaggagagtagtgagaaaaaaattagggcttatagtcaactcagatttgaattacagctccattgttttctaaccactaagtgatcttgagcaaattacttactctcttccagcctcagtttctatatgggtaaaatgaggatagtactaacttgccaacctttttaaggatagaaggttacatatacaaggcacgtatataccatatacctggcatttagatggtattggctataagtattcctactagtgagctggattttttacggattcactcattttaagcaaattatctaatcatcatcttttcccctttatcgtagttatttcctctgattatgcagaaagtatgtaaaaacaagggaaccaatcttattgagcttcatggaattttaagtcccacttttacccttgtacagtaaacaaactcataaagattgtctgcagccgcatgcaccacgttgtgttagggctggggaatccataaggacaccactgacaatgtccctgcccccatagcgcctaaatccagtgtgtgggagaaagtggggtggaggtgggcaaacaataaccaaatagattaataaaaaatgtcttgctttatgaaatttgcaagcgccttcactcatctgtgcttttgttcccctgaataaagtttatcagatgatgccaatgagacactgagcttctcagataaaaatggtgggtacatacaaaggttgagatctttcaagactacaatggctatttaaaggtatttcagttacataatgaagcaatttgactcttatgggtccttatacccccacatacactcccactgaggcatgctctaagatatacttagtaacacttgctcagaacatactatgttccaggcattgtgccatgtacaaaagctacaaagatgagtaagacataattcctgccctaataagacttggtccttacagttaatggtccagtcaggaaaacagctgatacaagtaggcagcaccatgtaattataattggaatgaagaggggcacaatgggctaacggagtctgggtggttgtttgttgttgttgttgttgttgttgtggctggtggtggtggtgttgatggtgcctgtgttgatggtggcagtggtatgtatacacgtgtgcgtggtgtggtattaaccctgcctgaggtggaggatgggctaaatgtcatagaaggcttcacggattcatatggctatttggaggtaaagacaacagaacaatagcatgccagggctagacgggttagatggcatcaggcctagtctcctaccaggattgtgagcaacattcaacatctgattgcacaatcccatatgccaggccctgtgatagtcactgacgagacaaaagtgaataaggcactggcctgcctcattgagctcatgatatggcatgtagaaatagtcaaggtaacagcataatacatgacagcatggaaggaagctcagatggtggtggggtggccagctgggaccacagaggagacagaggtggctcagtcttcccaggggttaggtggggccaaggaagtcttcacagagaaggtgatgcttatgttgaagcttcaaagctgagttgagttttctccttccatccatccatcaatccatccattatactgattgattcgctcatacactacttgaagaattactatcgcaggcatgagcagggcagtatctaagtaaaattctgaagtgttcagattctacttcagcaccatagactgtcagaggaaaaattcttataaatgacatggtcaaactcccacaattttatagatgtggaaactgaggcccagaaaggctatgaaagcattaacatcaaatcactcaagtagcaactaatagatacagatttacattaatataaccccagcgtgcccacgccaggcctcattctgttataacacactgccccttcctcagcctgtgttttctgcaaactgccccccgcaacccttctcctacccccaggggattctaatactgtcttgcccttcccctttcttcttgatcaaacattttcctggagaaagttcagaaaataactcatatcaaggtaaacaattcttagtgttacatatggggaaagcagagcaaggaaataacacctcatattataacaattcaggacataatacagtttctttatttgtattacagaatctaactccaccataggggtttaaggaagagggaagatctctgattaggagggccttaaaatctgatccaagccatgtggctggttggtgacctcagatggtgacaatcatggaaactatgtgattactgcattaggatgatcctctttattccatcctttcctgacttgagagtggagaggcactggagatgtcctgtggtgctgccacattattgaggtcccaactgaaaagctcttcaaagctcacagaagagttaaaaccctgacaataataaaatcaggccaaatcttaggttttagtagtaataatcagggattccatccatatacacatcatattttccttgcaatgtccttggaacacagggatagttatctccattttataggtgaagaaactgaggcccagagagacacggtttggaaatagcaggaccaggatctaaacccaacattctatcccacaacaagatcctgggaccatactgagtcccagggcacattctagctcaagcattttaatgcacatcccatttcctgctgcatttgcccaaacacctggggtagacatgcagaccccttcattagacctaaagcatgctatggaacttcttcgggccttagatccaaatgataaaaatgagaatattacttatttcatagagttgtgagcattaagtgagaacaagtaagacactgtatgagagagctttgccctgttctggtacctggtaaatactcagttagaagggggaaaaaaccacaacaactttatttttcaaaatctgactcgactctgtattgccaggtgctatgtatcacacagacccttatttactgtcaagaggcaatgttaagagtcagtagagcagaatattaagagcaaggggtctgcagctatttctggttcaaattccttgtctaccattaattagctgtgtgatcatgggaaattacttaacctctttgtgccttagtttcctcatctgaaaaatgggcattatgagaattcaatgagttaatatatataaagttcttacaatagtacctggcacacagtaagtgttcaattagtgctagctaattattatcatcactcttaatatgagaatagatattcttcctctgaacttctgttcacgctattccacccacgaggaacaccattctcttccctattgaaattgagccttccatgtttagctcaagaactacttctcccgttactccttctcattctcccatgtctcacaagttatcttagttgttaatgtctgattgttttaggtatgtgtgctctatcaccccacaggcactgaccatactgtgaagtgaatactgtgtactcttgaactctgaatccttagcccagggtacaggggctgccctatgacccatgaaccattcagtaaacatttgctgaatgaatggacaaataatacctttttgatttgtctgtgcatcccaattacaggagatattcacattacttagtgacagcttgatcgataatgagggtgtaggagaaagagcaatggactaggacacagattgcacttgttctgaatttggctttggcatcccaggtacaagtccttaagcaatttgttttagccctctgtgcctcagtttctgcattggaaaatgggtggctgagcattataaagtctgaggacccttctgtctctaagctttgtaatgaaaggcaaaaagttagctcactctgtgtcgggttccttccataagcacttggtgccaggtctgtgccagacactggggacacaaagataaatgacactcattctgtccatgaggactcatagttgagtggagaacacagacttacaaactgacggttacatggacacgagagtagtagagggaagcacagagctgggagggcttgatagcccagggaaggggacttaggtgatgacatcccggaggaagtaaaagtaaagccagtctttgtggagaaatgtcccatgtaagcaagagagaggcagaggagacaggccaacactggggcctaagggcacacctgaggtacctggaaaggctctgcatctcagagtctaaaccttacttctccccaggaatacagtttgtcactggccttcttttcaattcttccaccatactgtgtttctttctctatccccagaacatgcttctctctttcctatctgcaccttccctgttacttctcctttgcctccctccagttaacccttattctttgagtccagctcaaaagtcactttgtcagaaaagcctttcctgatgctccaggttaggttaggcctccccttgtatgttttcttagcaccttgtgcttctccttcattacattttaaaatagcaagctatgtgtttagtggcttaatgtttgtctactttgccagaatgaagacttcataaagggcagggactcttatccaatgttttatctcgaacagtgcatcttatatagtagagtctcaataagtatttccagaattaatggaggcacaaagatggggtagagaatgggagagggcagcattcacctttctctttggttacactttcaggctattaatctgttttcattatattaaaatctacaatgcctctgaggctagtgctttccagctgttccatcctctcctgtttttctgcactaacctcaacagaatccttagagtttcaggtgctcaaaagagatttgtaaaatgaaagaaaaagaagaatatcaacctaaatttctcactgcattaactgcccaaagcttttcctactcctcaaaacgtaacatactcctgctacttccaggatactctagtcagacaagccagtccctcaatgtaactgatttcaggtgagggctgatagagaaacaatctgattgagtcatctcacactaaagtatgaatgatggattgtcctttaaattttttttttctctctctctttttgttttaaaacaggacagctgctaaatacaggttttttgttttgtttttttttttgagatggagtctcactcgtgacccaggctggagtgcagtcgcgcaatctcggctcactgcaagctccacctcccaggtaatacaggttaatagggtactagaaacatacgtaggtgaaacagaaaatatctttcatagcatcatcccacgaaagcaagatgatttttcacaaaggctggaaaacaggtccttacagaatatttggatcatctcttttcacttacaaatgtacaaagggatacctagaaagggcaaaagacttgtttaaggcacacagcaaagccacgtcacagatgggactggaacagatccctccctgcccgggtccagtgctccagctctttgcacgtgtgccttgcgctttgtcagcagtttgtaaatcaagccctcctgctctccctttgctcttgcttcctttgccttctcagcctgcctttctttccctgagtcccagcgacagcctgcctgctgcagctgcccttgctgagcactgccactctgtagatggttttgccgcctttcactgattcatccacttgccatctgctttcagatttcttctgaaaaccccagtgttttggctgtttcctgagatctgtcacgtcttcctccctactaatgggctcaataaacagctgctttaatttagccttcatccatctccaggccatcattttctgaaatttatatcatctattttttaccctcttgccttttttgattcactaatttcagagaattaaatgtgtctgaaagagcaaaggtgaggcaatgatgccttttctgaggaatcctaactacagtagtcactcctttattcatatgccatttagttcaatgaaaattctttgacacttagtatgtacaaaacactgtgtaggcagtgaaggatagctaaagaaatggaaggcattgttgtggtcctggtcattgacataagagatacatgcataaaagactaaaaaaaaaaaaattgaaaggatgtctgtttgacgtgataaaaagggaggcttgaatagtgacagaaacatgtattgtgcactcactctgtgttacagtatgctaaagtggacgtttcatctgaggaaccaggaaattagaaatgttgtttctgaagacataccagaatttatacagaatttccaagtacacatctggaaactgagtacaagactcttgaaaccccttgcccacttcaagtatctaaaggaaaaaagggttgaaaatcaaagagaaggttttatcagggggagtttgaaggcctggagtcccacatgccacacctccaaaggaaggatcagggggcacttttccctcacctctgcataggtagaggggtgcacagtgggcacaattctgactcctgcctgagaaatctaatgagcaaaagactatggggaaagtaaagtaggtagaccgagattggtcaatgatatccagtgactgcccaggcaatagattctgagcagatgggtatgaatggcagatagaattggtttgatgccattttgactcctgcacagagtctatatacagtggataccagaaaagcagaaaatacggaggcagcaacactaggaagaatgggacacattctccatgtgatggctgcctttgaacagaggagcctccaaagaatccacaagagcatccataagagagggagtcagctacaaacatctgccaggcatagagaaactgaagccagcttaggggagtgccaggcaagtgatatccttctgttctctttgcactccttccctcttcccacttcaaccttggtgagctaatggaaagacatgagtgaaaatcagagaatggccaatgctccatccccaacccagtaagctcctcactggaagcaggtgtcacctgggggatggaggtaccggggaagaagacaacattaaatcaagttcagagttttgattactgtctgtaattgaacattttaaattactgaattgaaactgtgtttctgtttacctaaacaggaaattctcatctagggcaggtaaaaactaacccctctaaataggtctgaacctataggcagaagacaaaaataaagctgcttttatgaatacactctgagtccagcatattataacaatctactattggctacacatatattaacacactcatacctgacaacaatctgggagtaatattaatggcctcatttatttatttatttatttttgagacatgtctcaccctgtcactcaggctggagtgcaatggtgtgatctcggctcactgcaacctccgcctcccaggctcaagcaattctcctgcctcagtctcctgagtagctggggttacaggcgtgtgccaccacacctggctaactttttgtatctttagtagaaagggggtgtttcaccatgttgaccaggctggtcttgaactcctgtcctcatgatctgcccacctaggccttccaaaatgttgggattacaggcgtgagccaccgcacctggccgacctcattttaacaaatgagaaaactgaaacgtagggagattaagtaacttgctcaaggtcatcagctagccaaatgtaagtacttttaagcactataaacttcctttgggtgggaatatatttgatccctagctgtatcctcagagctctacagagtgccaatggctcagtaggtatgacaaatattgtttgagagtctgattttagaatgctatgctggaaataagtgcatgagagagtctttaggtttttaagagcagccagcttgagccaaatgagacgaatgaggattcatcaggaccatcttaaaaggctcccagctcccttttctggtctcctggccaggccataccaaccatgcccacattttgtcctttagacacaatcttataatctgccctagcttgctgttgcttttatattgctttttcccagggggtcctttactctcttcttcttatttaaacctacttctactatccccatccccattattttcagttcctctaattatgtcttggtacttatagccttaatataacattgtccaacagccttttctcaggaacctcaaaaatccagataaaaaatgtctaagtaaactaatatcatataagatttagagacaacttatcttgtccaaacttttcattttagagatttaaaaaatcttaggttcagagaggggaagtaactagaccaaggtaacacagatgtcaccttcggagctaagtctagactcagctctcttatatcttaccccagtgctttagagaaaggaccagtcagtccatgtggactggcatggtcagcaaaagcatcagaaggtaggactactgtgtgctgcattatgtctcagtgtctggaaagaatatcttctctggcgagattcttaaggttttgtgtgactacactaatcacatgtgactacactaatcacatgtgaagagagttggaggggaagctcctgtgttttacctaagccacttatggaaaatacatgataggccaagttaattgcaatagactgaatgtttgtcacccccatccctccccacattcataggttgaaatcttaacccctaatgtgatagtattaggaagtaggaacttcaggaggtaattagatcatgaggctggaacactcatgaatgagattagtgcccttatacaagtgaccatggagaggtctctcattctctttctgccatgtgaggatataacaagaagatggcagtctgtgacccagaagagggccctcaacattacccatcatgctggcatcctgatctcagacttccagactcccgaactgtgagaaataaatttatgttattcataactcacccaccctatggtattttatgatagcagcctgaactgactacaacattacctcaactgtgattagtatttttgatgagaattgttgaacaaataggaaaagctaacaggaagtgttgaggagaaacactttctttgatttatgtctacaatggccttatgagggaagcattattttctctattttaaagatgagaaaacaaaacctttgagaagctggataatttgccaaggatacaaaactaataaatgaagaaatctcaagctgaagctaagttttgtctaatttcaaagctccagttctttttgttttgtagcttgtaaatggattcaagaggtcattactaaagataaatgtgtttaatgaaagttaataaagcaataacagtattactggaacaagtgcacaatgtctccagaaaagtactttgagtgaataacacgtttatccatttatttgctcattttattcacttatttgtttaacacatattaattgagcttttaccaactgctaggcactatgctaggcatttaggagacaagcttgggcaaaaaggctttaccctttggagcttacattctaatacagagtagaggaaaatcaaagaatggagagaatgagcaagataatatcagataataataacagatatgaaggaaataaatcagaatgatatgatagtaagtagaatgaattaatggaaagtgagaagaatggagagaagctaatcaaataaagtggttagtgaagtcctcccggaggacgctggggtaagattcaaaagcaagagactaaatgaatggaatgaatgttcatattctcgcaaacacacaagacaaatgcagagaaaatgagatgctgtcctctctctcctggtgatctcgcctctggttttgaatagaggaagaaggaacaatgaggcagagagctccaaggcagagaagtgtaatgtagataggtggaagatgatgggctttggaattggatagatcccaggctatagaccaagcttgtccaactcacagcctgtgggccacacacagtccaagatagctttgaatggggcccaacacaagttcatcaactttcttaaaccattatgagatttttttgtgatttttttttttagctcatcagctatcattagtgttagtgcattttatgtgtggcccaaaacaattcttctccttccaatgtggcccaggaagccaaaatactgaacattcctggactttggatgagttctttagccactgacactgtttccgtgcgtgaaaatggtgatagttcttcctttctaggatgtctgaggatcaactgagataatgaacagaatatcatttctcagttgccagcaacagaagctaactggctgattaaacataaagggaatttattaattgaatctcggtagctcacacaatgagctgaaggtccagagaaccaggcttaaggctaaactccatgcccaaaaccatactgccaaagtagtctgatgagaaaaccatagtttctatccccatcactaagtaccagatgctacagttaacactactgccacttctgggccaccgattcaactttattgcaactactatgctgccagcactaatgatgttgcagggccaggaactcaagattacctctactgcctaggccttacaacttgcttgcctcagaattgattgcttgtgtggtgtgtctgattgacggggcttaggtcacacatctgtgctctagctgcaggagaggctggagaagtgagtttttaacttctatcttgatgaggaaggactcatgaagaagagtattcaaaagtcagaaaatatgacaagtaactacatagaaagaaggttcctagcacagtgcctgggacccagcagatgctcagtgaaagtgaggttttttccttctttcagttgcacagacttctatccatctgatccttagctctgaggaggtattaataatgctgtatgggtagaagaaaaggccaccatgtactatttaagattcccagagaggaatcataaatttagcctgtgctatagacaccttccaaagagacgggctgctaactgggacttggctcagagcaggaacaacgtgcttggcatttgcctaaatctagcctagcttagaggtagagtagcctgattaaatgagctaagttcatctatcaccaaagattgggagaagaaacataaaaagacagaccaagggtcttcagcagacaaatgatgagtagtacgattgttctagctgccccgagcagagtgcttagggggcttcagacatagtagtgcctgctaggccacacccttccttctctatctgtattccatctcataacaggatgtatgcctcagtttcctgatttgcacttcaattccctcttcttgccacttcttttgccctttgggaccaaagaccagctctgaatcccggaagacttgaaaaccggtcaagaacttaccaaaactgttccatatgtcaggttccctcatcccagataagactctcccagaaataaaccacatcatagatgaaagccattttgatgctctaatttataggtgaaatatatacaaggcactttcttgcacattatcaaaattgattccaatggcatctctgtgagttttaggttattacattaaacacttgttgaatgctattcagtctttattatgtcaggcactgtgcagagtcacagagagcagaaagtgacctgcccaagagcacagagcaactttttgtattcttctattttgccttaaaggttgttaagatcaaatgagatactatgtagaaaagtgctaaataaaagcatgaggttattattattagtgtggttataacatatggattttgtttctaagccattgctctaaaattgtggggaacataacagaggcataaacttctatgagtatgatgtaaacttgagctgtgcctcaatgtccctctgatcccacagctttgtttctatatgactacctttccttgccccatttcttccctccccttctctaatcacgttatttccagacaggaataaagcattgttgtcctggaaattagtacactacagatctggaaggtaaaggaattttagaggataaagacagcactgacctcaagagatcagtgagaattatatcagataatgtatatatagcatatggtaagtgatatctgctattattaccttcattttaaaaataaggaaaatagggcttagcgtgattaagtggtgtgcacaggggcgtaaagctattaagagggatgagaagattcagaattgggcctgtatttccctgtgctgcactgtttgtctgtagagctatacacatgcttcaagcttagtgcacatccttccccttcttccaagcttctcagagctatgggagcagaataaatgtcctcctccatggctcacccttgctctggtcctagatgaaaaacgtctgagttgggagggatatcaaggtgacgcagacatttttaaccacagttataatatttttgataagtggtcacccttatgggtaatgctgcagttgagctttagacagaaatccttcctttatgtgtttgttgacttcattcccggagtagcagtaagacagatgggctgatgaatatgaaggctgaggcctggcacccaatgaaggatttcctctctctcctcctttccttgtgttagctctttatcacaggctatctcttatttgaaaactttgtatgccatttttgtttttattgttgttgttgtcattgttttagagacagggtctcactctgttaccaaggctgcagtgcagtagtgcaatcatagctcactacagcctcaaactcctagcctcaagtaatcctcccacccgggcctccaaaagcactgggattacaggcatgagccactatgcctggcccctgggcctctagtttgtttaccttggtataattgaaaaaacgagaagctaggcagtcccagatttaaatttcggatttgcccgtggctggatgaccctgggaaaaagttttagcctcctaagtctgaatctccaccagtgaaacaaagagaatactgtgaggaatatggtataacacaggtgtaaaatgtccagcaaaccatgtggaaaatacagagtattcagtaaacagtagctgggagtcattaatcattaactattattattaccttgctagactgagctttcacagtggctgtctgccctgaccctggctctaattggatctggcctttccttgtttgctgcaatagggagcaaaaaaggcttgccttgggcattaggccctgttgcatttgcctagattttccttcttttccaaggccttttcttgctcttgtctttctgctggtaacaaactgccttggattacttataaaacccaaaacatggccaatgcaggactgctttggatttagtgtgggatgaccctacacattgaatttcttggccctcagtggcatctgtccagtacatagacatgccaactgtttacttcaatctcaagtaccccaactccctttcctggaaagacagaagccgtaaatcttaatgtattcaaaactccagtgctaatagcaacagacaaaattgctttgcttcagataagcactatattttaaaagttacattacaaccaatcaatggctttccatcacaagagccattttcttatagaaatatttaaaagaacctcatacctttctttaaaaattttcccaattaaaaacataactgcaattgcttacagaaaagtggaagagagactggggaagggagactcagaggttacaagtagaatcagagaaaaggaagaaagaggtttgtaatcattcctaggaaagtagattgagagattcattcagtcattcaaaaaacatttactaatacttactcaactaactctgatttaggctctgattaggggccgcagccatagaaaggaaaatatggcccttttcctcaaagaacttgctgactagaatagcaggcagataggaaacaaaaaataatgatcagtgtgataagttcaacagtgtgagacaataacaatattcccaaaaggccaatggcaggacacacaccatgttttgcttgggtttgatgctttatagaggaagtaaatttacttatctaaatttgtaaatatttaatttttaaatatttcaaatatatctaaaaatagactaacataatgaatggcatactagtcaatcaattcctaacattttcccatatacttcatattttttaaagaaacaaaacactacaaatatgggtttaaactcccatgttttaacccaacccttcttttatataacaggggtaaacactgccctgaaaatttgtgtttatcatcattcccatacattttttgctattattacatatatatgtacctataagcaaaataaaacatccacactttcaaactgtatataagtggcatcatattgtacttgtcaacctaaagtatacttttttccttttatagtatgctttagaacttagctgtgttgatatttacagctctagttcatgtattcaacttcggtatagtaatgcaatgtgtatgatctgaccaaatgtatctatgatcataaggtttacaaattttgttattgcaaataatgctgtgactaaagaaatctgactactgtacatgtgtgacattctctagaaatggaatgggtggctagtaagatttaagcatctttggctctactaggtcatgctacattactttacaaagtgattgtgccaatttatttgtactcctctcaccaacaacagatgatttcccatctctccaggtcttcactaacacttctttctgtgcgttatccacaaggctgtcccacagctgcttctcttccactccccagcccctaaaaaacaatgtacttaaaataccaagagtacttcctatgttctgaattagctctggctgatacagcatctcacaccaacattgacttcagtgatttcctaactgaagggctccctgattccaacaactgccctggaaatgatgatcaatcaatcaattaatcatcaatcaattcatcacagccagagatctttccaaaacacaactctgaccgaatcactctcctctggtcaaaactctacatttttcctcaggataaacttcaggatccttggcataacagtccacagtctgacccctaatgacttctgcaggcttgttttttttttgtttgtttgttttgttttttgttttttgtattttttttagtagagatggggtttcaccgcgttacccaggatggtctcgatctgctgacctcgtgatccgcctgcctcggcctcccaaagtgctgggattacaggcgtgagccactgcgcctggcctctgcaggcttgttttttgccactctcttcctcttcttcatgtgccattaacacctgtctttagttccctgcacatgccatgatgtttctagcttaaggatttttgctcatgctgctcctttccctgtgaatgcctttctgctcctcaattccacttcagagaggctaacttttcaacaaatgttcttattctctcttctgccaccatagtatagagctgtcactgagaagtatctgcttaagaagggactacattgtccagtccctataacagttagatcatctgaatgagttacagccaatgcaatatgagtagaagtgatgtatactacgtttagggctgccccataaaaacctattacatattagagcctcagtatggaagaaacctggcccctgaatcactagcattacaatctttacagcaagggaagtcctggtcttggtctcccacatcaggagtcctgagttttggagtgcctttcttgaaattttctaggatttcttagtacctgggactggccagggctggcagtgttatctgggcagggtgccctaagcttagaccactcctcatatttccctcttgggagtgttctctgaccccctaactaggtctagcttcatgaacacagagccccatgctttatgcttggttcaatgctctgctgttgccatcttggagttcttaacaattttttaacaagaggacccatgtttttattttgcacttagttctatgtcattctctcattctcattagccaaccatctgtattttactcatctgttcatatgtttgcctctcctattagactatagactccttaagggcagggatttctgcccatgaatcttagcctttagcatcacactcagggcctggagaatagaagtattccacaagtgatttttaaatcaataccattttgtgagggaggcatctggatagcgtaggaagagcacaggaatgatatgacatggattatattgctaactttccaactattttcctatataatcttaaaccattttcctctcctgagctcaaatatccttaggcataaattggagattataatacctacttttcatggctttcctgatgaataaatataaaatatgagaagtacttcacaaactccctgaatcataggtgatgttcaaaagatggtagtttttatactagtagatgctcaataaatacttgttatttaataattaatccagcaattatttgagaacctactatgtgctgggcattgtttggggcactagaaatatagtaatgaatgtcatagctctccaggagtttatgctttaatagaagaaaatatcaattaaaaaattgacacaaaggacacaaaggaccacaaggcagagtaagagagactggaaatgctaaaggggtcaagcccctaaaggatcttagataggatggtcagggaaagcactagtgataaggtaacctttcagcagggacataaagggagagaaggaatctttgagcagagacatgaagagaagaggtgagccatgagaatatctagaaagaatattctgggtacagaccagtgattatgaacattttgaagcaagaatatgcttggtgagtgcatggagcagcaaagaggccagtgtggctacagcagagtaatcaagtgagagggaggtgaagaatagatcaatgaggtaggaggtaagaaacagatcatgtagggccttgtaggccacagtaagaagactttcatgttgtttgtttgtttggatgagtgagatgagaagccactgagggattcttagcagagaactgtcacaatctgactttcatttcagaagaatcactctggctttcaggtgtaaaataaatcatagtgagtgtatatgaggaagagcaggagaaggaggcaacagcagaatcagggccaccagttagtaggctatttcaagagtacaggacacatataatgatggtttgggacaaggaggtaaagatgaagtgatgagagtgaataggaatatggatatatattgatcatagaaccaataagatattggtggaaaggctattggaaaagagagagaggaataaaagatgatttcaaaattattagcgttgccatttacagaaatgggggagactttggggaagtggtttgggggattagaaattatgtttgcttttggacaagctgtacttcatatgcttatccaagccaagatattgagttaacaattggatgtatgattctgcagttcaggaaagaggtctaaatagagacaataaatttaggagtcatcagctaacatatggtattttaagccatgagagtggatgaaatcatcaaggatgtaatactgactaagaagagaccaaagaacaagctctggtgtatttcaaaatctagagatcaagggaatgaaaggaaaccagcaaaaggagacctggaaagagaattaaaagtggtttcttaaagccaaaaaagagtgcaatttgaaagtatgaatggtcagttgtgttaaaagcttctggttttattacttcatcatggaaagtattgacatagaatatagaatactctgtcatgaaatatattctgctatagagttagtagacgcaggctcaaacccattagctgcttcctttatcaaatgtgaatatgaatttctgaatactattttctcaaattgctatgggtcatatataaaataatagttgtgaaaacatttaatgaaatactttactgttcaactatctataatacacactctgcaattaggacccttaattgttcttgtagctaaggcctcacctagcacactcattgacaccagctctatactaggaccctaatctgggatatgaggacagagacagtaccacataccactgttctctgcccttgggcagatcccagtctggggtgtgtgtgtgtgtgtgtgtgtgtgtgcgtgtatgtgtgtgtatgtgtgtatgtacagctgtggagggatgcctagaacactgcaggaacatggaggaactgcagggcagggtaagagaaattggtagtaaaatgacagccccaagacaccacaaaaattggaaaagaggaaatattctgggctattcatttcctgagcataaatcatggaagtggcagctggctcctgaaatgccagtcatttttatctctctcaccttctgactcacttggagcatcagcactgttagctgaatcaatactttctccttgacccaagcaattgattttcacaatatgcttctttgtcaaagaagaccaagaagtagaaatgcagaaagaccgttacactccctgagagagagtaaagaacagcaagggaaaactgtgtgttggcgcagaagtggactacagggtcacagtaagctcaaggctggggattctaggaagcgggaaggttgagaaaagagcaaccaagggagccatcccaggaggatcctggcatcactgtgcagtgctgccatcagcaagaggaaaggaattcacattgggaagcccaggactaggcagccagtaagtgacacagagcaaggcaaggaaacaagctgcatttccaccaggctgacaaaagaggccaggacaacagcagttagaacaatatgaaccttttccagaggctaaggaggcctgggtctctgccctacagcctacttcacctaagatcaggagccacctgacagtcacttacaagctcctcacatccaggtccacagcggggaaagtacagtcctttcaaaaccagtgatctcaattctggctacaaataccaatccctgggtatggattctgattcaatggatgagaagggaggcaattggtattttttagaggctctgtaaggattcccatgtgcagtcaatgtatagaaccacagacttagaccaccctgaaaagcaacctggttcacttaaaagatcccatccatccatccatccatccatccatccgtccatccatccatcatccatccaacaggtatttgttgaatgttacgaagtacttagacttggatgaaaatcacaacccagatacttattagccatgtgatgttggcacattacttcttttaacttaaatttctttaaaataggagtaataatactacctatttcacagggttgtttagaagctcacaagaaattacatgctagaaatgctttctagtaataatcactcaatacttgcacattttcctactccttttcttaattaattggaaaatggaagagctggcattggggaggggaagcagaatgtaaagagcgcttatgctatgactcacagggacacgggaatcaataccaagttagcctattgttggtcattgtgtttctgttcatgtaactagagcaattaggactctgcattgttcttgtaggtctcaggtagcacacagttctttgggacctggggtcctgccatgctcccagaagttgtataagacctggattattcgggccttgctacctacctatgcataaactgctagttctgtgcataggcctgcacttggcaggactggaggggcacagacttgagtgtggcatacttacatttaagctggttcagtaacttatgagtaagccatttaacatcagaacatccatttcttcaattctatattgagaatatgattactgattcagctcacagactccagagttaagcatcctgggttgagtcttgattctgttactcttttctcttgtaaagtggagataataacaatatgtaccttatgaagctgtggtgaagataaaataatccactaagatgtttaaaacactatctggcatgtagtaggctatcaatattatttttactattattatcattacctctacgtgtttgtcttaaaccattttctgctgctatcacagaataccacagactgggtaattttctaagaacagaagctcatgcttctggaggctaggaagtccaagagcatggtgccagtgtctggtgagggtaaacccatggtagaaggcagaagcaagacaaaagacaaaaaggaagccacattcccaaaataactaacctactctcctgacaacagccttaatccattcatgagggcagccttaatctgtgcataacctaatcaactcttaaaggtcccatctcttaatactgtcacaatggcacttaaatttcaacatgagttttaaaggggatattcaaactatagcactccttgaatgcccatggaagcctatgatcagctgagcagcctcactgccaatataagcttcaaaacacagataattaatccattaaggcagcagcgtcaatgacaacttaaaatgtgtagaattcatctttttttttttttttaatttccagacctgtcatctctcacatgataatggcttccaggcaggcccagtattctgtatgatgttcctggggaactcccataggggctcctgaaggtggtatgaaagatggaatccttaccagagcttttcagaaaaggggaaataaatgacctcacagcatcccttctactcatcctgtgcctctgtggctcatcaagtggccattttgtgccctgaatgcctaactattgaggcttgagcaacagattaaggtcaaaaggagcttattagctgacttagtaatgactattgttgatagaaacactcttacaaatagcattttacagtttacaaagtcctttcctatatatcatttcactggattcattcattcaatcattcaccaaacactcactgggtatttactatgtgcaaggctctgtgtaaggtaacaatcagtcaacaaaatatatttaaatgctgagcatacagtagcaaacaagtctccagatatgaatcacaaaaattcacaatcaaaatcacagaagttgtatcagattaaagaataggcaagacacaggtcctgtgatggagtcagggtaggtgtaggacatgctacaagcaaaagagtgacagttctatctgggaaggattggacaagaaagacttcatacctgggacccatgtcttaggacaaaatgttaagttccaactgatcctactgccatacctgagccagttctgcacctggttctcctagacgatggaggcccactcgtgtgcctgatctccgagcaatatccactccttggtttatccaaatctgtgtgctataattgctcctgtaaggtttagaattttcaaagtatggttgccagctcaaaatcatagttatacctttaacaaacaggcataatatttactactctttgaatcccacaggattactatgagcattacatgagatcatggatagagatataatgccaatgatataaagggccctttttgaattcttaatatgtaccagacatcaagtactttatgcaaatctttgctcatcttcacattttttatacatagatatgaattccttctcttttatagaagttcagtgacttatccaaggtcatataagtagaaagcagcagagtttatctactgccaaaagccattttattattatgtgtctctttcctctatatcacattgcctctccaaagtgaaaataaataaatacatacatacatacatacatacaatcacaaatgcagcacctgccatttgccaggcaccaaaataggcattttgtttgatatgaaactcacaacaagatagctctttttaaacaggtatcttttttcaaaaagatttaaacactaaggcaactgatgctcagagaggatgaaaaaaaatcaaacagtttgttgatggtaaagccagggtttgaacccaagttgttgcctcaaaagttgttgtctttccactatatcacactacctcccaagatcctcagtttgctgctagctgcctattgctttccttccttggtacttactttttccatctttccaaattttatctttccatctttccaaaatttatgacctctaagagctctttcagctttgaggttctcaggttctaagatataaacaggtagagatgaaaggcagacagaaagacattctgtactaggaaagcagggatacaggattgcaaagataagagaacatttaggaaaagtcagacattatggggctggagttagagcaactccattctttggataggggaacagaggaggcttcataaaggaagtagcatttaagccagacatagagggatgaggataagcttgaaatgttaaaaagatgggcactatttcaagaaaaggaaaaacacaaaaaggactcagagacctgcaattaaaattaaagtacatttgaataacggtgatttgtctgatgtggcttttatcccaggaaggagcagaggaatcaaggggaaagaggttgtaatgatgaatttcaccacagtggtagcaccggtttcagctggatttttgggccacccataggtagctacttttgctcctggtcttcgttaaggtgccacacagttcctgacaatttgagttgtataactaagctggaatagtgctctgctgtgtgaagctgttgcagtccatggacataggcagggttggcagaggccttctgcatctttcactgtgggtcttggggtaaagacaacttatatttgcctgctatacccacaaatataagcaggcaaatataagtaggggagcctacaaatacccagcctgtcatgtcagacttaagtctgacagaataattacttaatgatttaaaatttttcctattagttgtgatctcttggctcattccattgtattatatttgggaggcatgcactgtaaaagaaagaacacagcttttaggagaaaacagatttgaggtagaattctcacttcacttttaactagctgttttcatctcagacaagttactcaaatgctctcaccctcatttttcttccctgtaaaatgagcataatatttttcttacagaattgttaataaggttttgatacaagaaccacaccttgtacagtccctgatacttagtattgagaatggacgtcaacccatgctttcttctaatccaaatgtggaactagctcaaaaagaagaaagaatgtgagcaatcaaatgtatgtctctgttcaggtaacgaggcgtgatgcattgaaaaaggggcccaagatagcattgttttaaataaaagtcttaaattccctttcaatttccttgttcaaatcacttaaggggagccttatgtagttctgctaatgaagtcatcctcaaaatcactttcagacagactattgctcaataataaactaactgcatgataatacacacacccaagcccccaagttgggagattttttaagatcagaatccatacaaacagtcattgagagtcttaagggggtcatttgcagagattggatttctccaaaagaaaagaatatacccattttattctctttattttgccagctcatcaagaagaaaatgatgaaaaaactctaatgcctatggtacaattcatcatggggaattttatggcagaaaaatgttttcaatttataatggcattaataagtgacattgggcaaagcctgtaagagacttttttttttctaccaggagtcagccaggaatagaagaggaatgtaatcattactcatccctggatgctgaatgtttaaaggcatcttacacaacagcatgcattttattatcctgctatacaccaggcagaaaaattttaccaaaactataatttgctgtttataatggagtccaattcaggtcacatggtgggtaaatgggagggtcctctccttgtcagaacactaaggcttattttgtcaagtccaaacaaaagggtgggtctcaaaaagagagccatattgtagtgttcggtttacattttttttttaaacacacacacagacacacacacacacatacacaaagacacacacacactacttcattggcagagttttctaataattagaatgtaatggtagaaaactcactgagcactatttccaaaatccactgtgtttccttatacttcatggtccttaattcccttgattgatttcatatggccaaggcattcttgcctgttttcactctccaatctggaaatgggaagtcaccaagacctgtgagtacttaccactgtcactatcatcataattctgctgcccccatcaccttcattcataattcactcgtttatttattcattcattctacacttaactcaaaaactcaaatcaatgaatatttattgtatgttaatatgtcaagcattaaaaatgtaacagtgattatttcataattccctgttttcaagacaagggacatctaatttagtagagcagatagctgaacaatcacaccactgcatgattgcaagattgcatgataagcactctgctagaggatatacttcgtacagagattcaaaagtagcagaagctgaataacaaatttagcatagaggtgccaaaagaacgcttcctggaggagatgccctttttaaagttcaattgtgatggatgagtgagcattttccagtaggaaatgggtagaaaggcaggatagacagaagaaagaatatgatgtacaatggtgaaacagtagggcataagcatagaacagaaagcagtcaaatttagctgaaaaaccaagcctaagcgtgttgattaacttgttacaggtaaggtgttgttctgtatgctctagaatctcagatgtgaagaaacacagccactcatctcagagttactaatttataatcagggaaactttcttctcctttggcaagttaactgactcgactttgttgtgcttttgttatttgttttgttttgggggtttctttttgtttgttttcttgtttgtcttgatggcctttgttttatcctttgagggacctaaatgaagagagagtaaaatgtgaaaatctgggatcagaaatctccctgtcagagagaacaggaactaccctaaggaaaaaacagatgttcctagagatagcaggaactatccctaggaattagggatagtatcctaaggaataacaagaaaaccgaagtgctagagcagagtgaggaaacagaagaatagtaggcaataaacaaagagagcaacttaggagccagatcacatgtggcctctcgagcaatatggtaaaagttctggacttcattctaggtgaatgctaagccactgaaggattaagaatagaaaaatgaaattataggactctcattttaaaaggagcaatctggtttctgtgtggggcatagactgcagagggcagtggggacataaatgagggatttgttaggagaggggcatctaaacagactgaagatgattggggcttaagttggtggtaatgatggaggagatgagaagtggttggaatcaagacatatttgaatatcactacttaactgtctctctcccattttacttaactcctcaaatgtctaaactgttcattctataaatagagaagctgagtcctagaggggaaggacttatctaaggccacacagtgggtccatggcagagatgaacctgggacctagatatgctgcctcttttttagcctcccaaattttctaccaccttcttccagtccaagtcaattgcattgtttttcataagcttgcaacaccatcttcctgatggcattttaagaaaaccagacggcattcagcagaaagcctgcccagcatcaagagaaaccaggactttgatgtgctccaattggagcacagaatatatgtagaaaataccaagcaaatgtttggactagaaatccaaaataacatgtatttaactttgcaatttaaaaagctaaattcaaacatgtgtcttgttggttttccagaaaatatagaatcttgaagcataaaattaaataaacaccagccacaactgtggtctctttctccctccctccctccctctctccctccctccctccctcttttcttccagcattttctctaattcttttcaaactctctctttcattaaattaggaactttccatatgtttggtctgcataaggcacctaattcacgttggctaataccataatacacggcggacactccttatttcccagttacattatacatggccagctctctgggcctttgctcatgttatccctctgcctgttctcttcctcagtgccctctatttgtcggaaatgcactctttgcagtctcctttttcaaaggctattccacagttctccctgccatttaattggctactttattcctcttaaatcttgttgcaaaaatatagctatgaaatcctcaatttcttcaaatttacagtacagataaaaatatttctatttgtcccacagagatttgcaaagattaaattaatagatatccatgaaatagcttggaaaagactaaagtgttccactgttagtattagtctttcaccctccctcccttattccctctctctcccttccttccttctttccttgtttcctaaattcttaggaaaatatacccttcctttgttgggacatgaggtgccccaaacatataaatgtaatagatttcatcattagccagaatgataactagacaagcagtctccttcagcatctagggccaatctaccctataggattgctgtaatagtatctaccctataggattattataatggttcaattaaaagatgcatgtaaggttctttcactcatttccagcacctgataattgacaaaataacaacagctaacattcatcaaacacatgtgctaggcagattctaagcatattacttgtattaatttaatctttgagacaactctttgaggattcttattatcccaattttatagacaggaaaactgaggcacaggaaggttaaattacttgcctaagatcctacagattgaaaatgacagagttaggatttgagccaggtagtgtgactccatatcctgttcacttatccattgtggtgaactgtctctaaataagcagtagacttaattgctgttattaatgaggtcagcaccagaaaggagagaagcaaatgtggtgccttggaaagcctcacaaaaatccttcacagcactgcagccctgccgagttgattcaggacatagaaatgcctgatggttcctttcaaaatggctcctgctgacaaaattccagatccccatgctttgctctttggcattaattaaaacaaaggagttaatcaagataaacttccacacctacccagcaccagcctggaagtttatcatgtctaaatatgtttcttatgcatttactgcaaattagtttctgaaagtgaatttcaaggtctagtgactctgaggttccctaactccattttcattaagttttcacaaatgatctactgttgcattattcttttatagtgcagatttaaggccccactatgaaaagcaattatgctgtcagaaaagtgtattttgacttattaaaaaatctgaaaggtttcagaaaactatttatttaggttctcatcaggaaagtattttgacagtcctcagaaaaaaagcacttttcagttgcatactatttggagtagcctaacaaggcctttccgcgacacatatgtggggtagtggaataagcacagcacagagcatcaagaggctatgagtgctacttccggcagaaaggccttgggtctttctgtcctcatctgaaaaaatacagaggttggacacagtaacctccagaataacaagtgtacagaggttctatgattacaactgcctgtactgagcacctactatgtctcagggatggtgtatatctaactctgagaggcatactatatatcattcccattttatagatgaggaaactgaagcttaaaatggttaggtgacttacccaaggtcactcagtagacagtagatttggggtgtaacctctattgtatattctatggcaggggtccccaaacccccagccttggacaggtactgggctgtggcctgtaaggaaccaggcaatacagcaggaggtgagcagtgggcaaggagtgagaattactgcttgagctctgcctcttgtcagatcagcggcagcattagattctcataggagtgagaaccctattgtgaactgcgcaaatgagggatctgggttgtgtgctcgttatgagaatccaatgcctgatgatctgaggtagagcagttttatcctgaaaccatctccccctccacccccagtggaaaaattctcttccacaaaaacagtccctggtgccaaaaaggttggggaccactcttctgtgatacatacacatgatgaaatagtattgaggggaaaaaaaacagaaaaactgttgatatgttcaataatatggacggttgacttaaataagtcagatataaaagagttcatactctttgactccatttatatttatatgaagtatttatagaaagttcaagaacagacaaaactaatatgcagcaatggaatcaaaagtggctgcctatggaggggcagagagtgaatagacagaagaactttctgaggtgataaaaatattctaaatcttggtagggatggttaaaaagatgtacacattatcaatgcccatggaatcaaatgcttaagttcagtgcattttactgtacataaacctcaaaaaaagtgcatgtggctagtgggcagtttgtttggcttgtgaaccccatgcactgacaccagtatacaaagacttgcctcctttgaataggctggggcagtgcgcccaatctctaggaacctaaaaggcagggatagctctcttctctgcctggtgtttctccatctatgcaggcctctgatgatgctgggcaagatctctgcattgagagaatgatcaaggcttgtgtttgtgcctttgtcctgcatgactatgggtcagtaattccccttcttggatactagtttcctcattttaaaataaacagtctataagcacctttctaactctaaacttacctcacttcgtaccgaggtgcttttttcatgaaaagtccccacgcctagttgctttcattatggaaagctggactgagggcaacagaggtagggaagctgaagggagatggtcaagttgggggatatggacttagtccatccgtatcttctcatacagtaattataagtaatattgtgaaataatatgaggtgtgaaatagtcaggaggatgaggactcagacatgatcctagtttaggtctcagtccatggacagaataaggattcagttgtgtcttatttttagcttattttttgtatgcctgctctattctagacactgactagtatcctttaaaggcagtccctcatttcattctcaatcccgtggggtaggcatcattatcccattttataggtgaagaaaggttaaataatttgcctgaggtaggtgactttcttacagcgtagctagaatctgattcatatatctctactttgaacctctatcttaaaagacaatgttggcctgaagttagcctatgggtcagggctcagcctgaagccaagtttaagaggctcagtctgtgaccaagatcagtgatcagtataagacaggggttagaaagaattgttcattttttggcagatattatttttgaaaccaaagcataggggataaaaaatacattctagattggaaagaaaagataactaatttgaaggtggcacccactgtttgttacgcagtaagggctgcaacaggaacaattagaagactcttattccatgtaaccctaaaatataccttttgatgtaggtattaccaggctcatatagatcaagcaactggcccaaatttgtcaaatttaaaacattctcatgagcacctaattctatctctagtccgtagtgtgtagtgtgtgcaagtgtgtgtgtgtcaggaaatacgtaaacagaataaaggttacagtataatgctagggatgccctcaagcaaattctttttcttttttaattgatataaatttcactaagtgaaatctagattttcactaagttattgtggtggtagtcccataactattcatggctataattttaaaatgccaagccatctatttgaattaaggcatgaaaaataaagttatctttataatatatttggatctatttcctggccaattaactgtgtacatatcacattttagggtgaattgctctactgcagcctcttccaacttcctaatgaaacatacaggaaaggcaaagaagtaataataatttacaatatccacaattagaatgacaatctattgctagaaactgggagttacttctatgaactctagtactgccagagctgggctaaagaaaacagttagtggcctacttatgctttgtctcaagaaatagaacagggccttccactgaaagaaggtgggaaaaaaccccaattcatcccttgaccactatctatgggactcaagagctataacaggcagcaaactggcatcccttcctctatttcataagcattgttatttaaggcagccgaagtacttctatcttcaatccctgctcaaacctttctccccctagacatatcttactgcatttattcgatgacttcaactttcagaaaacataaagggcactgattatggtatgctgcatcctaggaactgtcatctacacttataaaacaatgtagtcaagcatgacaaacaagaagtggtaacagggttattagagatagtagcgttggggttttgtgtgcttgtttgtttatttaatgtgctacagagaacaaagtagtgtaggttagagaagatcccatctcagtacatcacagactggatgtgctagttcaggtgctctgaaaatctgacatcaaacatcctatatgtgcaataaatttactttgggaaatggctgtgagagaaaatgaggagggaactctgagaggctgggattgcagtcagatatgatgtaggtactcaagggtatgaccttgagtgaaggataaagggaaagaaggacgaaagtttaggtagaagtgtcttagactgcagtgcagttctaaggaaagatagacaaggccaacagagagagcttgagccaagtatgcctgtcagaagagtcccccattaccccaggaataggacagccttaatatcccaactgagctgagctttttgtgagggcagcctatggaatgtgtttcctgtgtgcaaatgcagcagtggatttcagcacagcagctgggaccctcagtcaattacagttcttgcatgagaagtactctgctggctgccacactgggagaagtgtacaacttagtctcctgttatagacctgaggaggagatatgaacacagtgatgagaaatgccacatcctaaatttcatccacaaagtctagttagattcccataaattttatttttataaaacttgatagaggagaaatttatgaaccaaaatctaattgagtctatagacattcttattacttccccatttgactcacctatttggcgagtgaagtaattggatgaatcttggagaatgactataaaatactataaatttaaataggtggtgactctaattacagttgttattctggataaatttattggctaaatatcaaacaattcctatttctggcaccttgtataagctattgatctggcaaatacttttctctttatcagttttcaaagaccacaggaaacagattctacctgtcagggaccatagcataccttccctatatttttgtagggctatttcaattctcttgcttttttatcataatctagtctgctgagctcttgattatcttgactcccacagatcatcccaatggtacactatgttgacagctacaatattataaggaggaagttgcaagtgccataaatgctgtaaaagacacagaatgtgagaaagtgagagataaatctcataaaaatccagaagcctatcatttcaatgaaatttaaaaatgtctaggggtctggggcatattggaatatcccctccaaagtgaaaaataagttgctatattttgtactaaagaagcacaatgacaggtgggcctttctggattttgaaggaaacatgcaccatatttgactgtgttgttcttctattgaataatctgtaatgttaccagtttttggtggagcccacagaaagagaagactgtgcagtaggtccagactacaatgaatgttgcgctggtttggaccttatgacccaacagacccaaaattactgtggtcaatagggatgctctgtgaagcctatggcaagctccagtaggaaaaccacacagaagattcctataggtaagagaaaccatctcaactatcttgagaaacacctgctagttgtgttgtaaaccccgataaagatgaaacatctgactctgggacatcaagtgattacgtggcctgaattgctcctcatgaaccaagtataatctgactcccaggaagccataagattgagcctactatccaccaacaagtgaaaatggtgtaagtgatatagcggcatacaaggttctaatagatatgaagatacaagtaagttgcatgaacaggtaagttggattcctagagcatttcttcctgcagcactgtttctttaccttcagttcacgctatgacttcaaaggaaattctgtggaactgattgaagaataagaaatctgcatggcacgctggtatcaatcagaagtgggttgctatagttttatagtccccaaatcagaggtatccctgaaagataatagtaatggggaatctttccagtgctcagaacttcaagcagaacatttggttgtccactttgtttgaacagagagatggccagaagtacatgtcttcttattaatagcctaatggttttgctagatgatcagaaacttggaatgaagattggaatattgttatcagggagatctgagcaagacatttgacaatggaattattgggatgggaagagtgtgaatgttttatattttacataaatctaactaaagagtacccactgcagagggggttcccaaatatcatgtagataaaataatgtattccttggatgtcagttagtctccttatccagacttccaagttctggcttgatggatcaatatacaaagaggccatggcagcaagctacacaacttggacttttcctgaatatcgaatctgtcagtagcagagaccaatactgattctctgatatggtaccattgaccagccagtcacttggtggcagaatgattatagtatactccttccataatgaaggggcagtgatttgtcctcgctggaaagtgcatttattatggacttgaatctgctttttctatactaatgcttcttctagcaccatcatccatgggttatattaatagaatgtcttatttacctatggtgtcctacacagcattcattctgacaaacatactcattttgctgcaaagacatagcagtgataggctcatgcatataatatttattggtcttatccttgcagttcctagaatatgtcaagcatgcatctacctctggacctttgcacttgccattctctctgcctggaatgctcttcccctagagaaacaaagggctcattcctcctcaacctttagtcttaactccaatatcccctacttttttagaccttctaaggaccatcccacctaaagttgcaacactctttccagattttatatcaccctcactacctttttcctttcttcagcatgtatcacaaatcttgcatatatttcacttattaatatttttattgtctccccattagaaagtatccctatgaacccagagattttttttttctgcagtgttttctacagtgtccctaaaccaatactgtccctagtgtgcctggcacatagtagatgctcaataaacatttttgaatgagtgatgaatgaacaaacctggatagtatataggaagtataaggaaggctaacaatgcatgaataccgagtacaattctataagccagaactctagattttaattttggctgtgccagttataagctctgtgactgtagactgtttattaacctttctgttcctctgcttcttcctctgtaaaataaaaattggtgtctaaaaatatatttatttgttttaatatatgcctcatttccaagaagcagttggcctcatagatttatgagatgatctaataaagtctcagttccagttccagttgggaaaccgaaagtttggggtgttctctgacaagagataatgtatgctttgaaacagtgtttaacatatgatgctgtttctcacacagtgagaacatagacatccgagactcaagggtggaaatgagattggctcctctcatattacacctgaaaacccatttacagaagtttcatttctcatacccacaaccttggggtctgcttgattaggaggttttatttcctaagggaacacaataatggctccattgaagtagaagctaaggctaccactggtcatttagagttccttatgctactaagctaacaggcaaagaatcatgttgccgtattggctggggagactgatcccaattactaacgaaaattgggttgttgtgacacaaatgggagcaagaaacactagtctggaacccagaggattatctgcgaagctttttagtgcatctgtgcccaataacaaaagttagtggaaaaataaagtaacccaataaaggttcactgagaatgcatactcttcagaatataaagttcagcattggtagttacctttacaagttggcctttagattacatattattaagggtgactgtgactaaaagccattgctcagagacagataacatgaccttatctagaaacagatacagtggccattggaaccttgtgtcttactcttttgaggagatggtgagaacatatttatgcatatgaaaattagttgcatcttataaggtgaaaacacgaagttcacatattttgttacttggaaggtcaactatgtatggaaatgtgagtataggtaagtaaccaaagggatggactgtgtccgttattcacctactgtctctcattcaaatctacccttttcactctgctgtgtgatactgcaaattacatttcccagatgtctttgttactgtcttcctgctaggttctgccaataactaaagagaaactggaaggcagtaggaggagaaaagagattgtttttctgctttgtgtgtttctatgagttaaaccccagaagtagctgttgggtccagcttccagcttcttttggtactcctagaaccagcctctttatgtcctctcagaggtaccagccacagacaggcaatgccctctcctcaaaggtctgaatccaatgctgcagagtccctctctaagctcctaggtcctgataactcccacttgttccttttgttccctaatgcttccggtgataacagcttcctgcaattgtccctgagttatttaatgtcctttttttctcctttagtcctccatcctagtaacattttccatatactaagcccttttgttgaaatgcttagtgtaattttgtttccctgaatgaacctgactgacctagtcacatagaaatatgtccttttaaacaggatctcaaggtcactcgacaaggcaatggctaaactgcattaattaatagctgcaatgttttcaatctttaaaataaatttgtttttcttttgagaacaaagagtaaaagaagcaaagatacctgtgcactcaagataaaggtaaataattaaatacctggcagtaaaagataattgacaacaaatctgtgccctttacaaatggagacctttgtgtaaggtctatttagaacaacttcaaagtgacttaattctgcttggcaaaagctggaaaacataaatgaattctcctttcccttgttaactttgttctgattcctttcaaactcaaatgttatattccaattggactaatagtccacactttctgtgtgtataaatatgcacttaactctaaattagtatctctacttttcctcaaataattgacctgtatcctaaaactgtaatttttaaaatcttgtgacacagagtattctaaaacattactcactaattcattttatttactatttcaacaaatatgtatcacgtgcctgctatgtttagattgtatttagattgtgctaaggaactggaatatagaagaagtaaaaacagacacattccctaccctcagatgcttccagtctattggggagatagacattgatgaaaaaaatcacatatgtagttgaaaaatttaatagtaaatagggcttaaatatacagtgataagcgataaggtataaatatatgataacctataatagtgatttggatagggtgggaaaaagggaagcaggaaaataatccaaaatctttaatctttgaagaattgaaagccaccaaagtgtttttttttaatttggggggaacttcagtgaacaaatgtgcatttgattcactgaagagaataagttcaattaagtttgtactggcagggatatataatgtaagaaagacactggattttaaggcacacaacctagattcaagaaactattattatttaattggatataagatttgaatggcaattacaagggttgattatgatacttcccaattttatatagaagggaggttttatgagttgaaattaatttttaaaatttttattttactgaggtaacaatgcttaacatgagatctatcctcctaacatacaatagagttttaaacagttcattctgtatataatagctttatctctgtagtatttattatgtctatagtattatagatgcttactcaggaaggtgatacaaatattacatgttattttttccctcctttcagctaagcctgacttagctctgtcagactgtccccaggtagattctaaatataagtgcggcattgggcagctgcttctcttcagctctatttattccttgcaaaaatgctgagacattgcttttttgctttagcttttgttttcccctaattatgttcaacttaaatggctataggagctaaaaatatagcatggagaagagctgtgagagcatttagtacaggtcctgaatgaacacctccctcagaagccactttttaaattggcttgatgctcaatatggaaaaattcccaacagcctccaaagctattgtcacaaaatagatagccagattgctgccaaacataatccagggaactgacagttaatctaatggaatcctagaatcatagagttatagatttaaggaaacacagaaacttagaacttcaaaattataaactaaaacacacatttttaaaaatatggagacacttgagctgggcatggtggccagtatctgtagtcacagctacttgggagggtgaggcaggaggaatacttgagcccaggagttcaaggccagcctggacagcacagacaggtcttatctcttaaaagaataggtggtgattggaattagtgtttaaaaagtaaagaagaaatatatatatatatatatatatatatatatatatatatatatatatatatatatatatatatagttgaaagtaatctgaagtccacctgcttcaactaaccactctatgtttgaacttactattaatataatatctgagccctcaagtagctgctaatattctatttgaatgcatagagtaataggagctcattacctccctaggtagcctgtttcatatttgggcagcttgaaatattagaaagcttatctcaaggctgagattaaatctgacctctggtaatgccaacacattggtcctggtaattcctacagattggtcctgttctagtacaaatgctgtgaatgtccaaggagataaaacatggataagctcactcaaggtcctttggatttgtttgatttccttcagtcatagacatagcaacacaagaatacaatcaagaacatctgtgtattttgttacgaggcctgggccttagttatcttcccatgcttcttaatcattttcctgtattatttaatagaaatctgagttaactctgatttcttcttatctatttctgcacatgatagggaatatttgtcaaatgtattctatatactttatatatgttctaaggactttatgggtgtaactcatttatttctcaaaataaccctgtgagataggtttgtcattatcctcatttctccaatttatcctcattatgtagaggaaaaaaaattgagaagcaaaaaaagtatgtaccacatacaggtttttcaatagtgagtgccatagctggaattcaagctcaggacatctgactacatgagaagacaaaaataaaatcaaacaaacataaaacaggatgatagatgcaataataaaaagtgtgtgtggccaggtgcagtggctcatgcgtgtaatcacagcactttgggaggccgaggcaggtggatcacctgaggtcaggggttcgagaccagcctgaccaacatggtgaaaccccagctctactaaaaatacataaattagccaggcgtggtagtgcgtgcttggaatctactactgtaatcagctactctggaggctgacacaggagaatcgcttgaacccaggaggcagaggttgcagtgagccaagattgtgccattgcacaccagcctggacaagagcgaaactccgtctcaaagaaaaaaagaaagtgtgtgcacacagaagagcgatcaacttcatcttggggtgagggtaggagccaaggagaactctggagaagtgttgataacagatcaaggttttgaagcatgacaaagagctcactaggtagataaatggtgaagaaccttctgacagaagaggtgacatattgaaaaggcagagaggtgtgtttgggacccaacaagtagttcactaggactgtttggtaaagtacaagggagaaggagtaaggaagaagtgggtaggagccaggtgacagggctgtggtgccaactaaggaattttcttttttatttaagttttagggtacgtgtgcacaacgtgcaggtttgttacatatatatacatgtgccatgttaatgtgctgcacccattaactcgtcatttaacattaggtatatctcccagtgctatccctcccactccccccaccccacaacaggccccagtgtgtgatgttccccttcctgtgtccatgtgttctcattgttcaattcccacctatgagtgagaacatgaggtgtttggtttttttgtccttgtgatagtttgctgagaatgatggtttccagcttcatccatgtccctacaaaggacatgaactcatcatgtccttttttatggctgcatagtattccatggtgtatatgtgccacattttcttaatccagtctatcattgttggacatttgggttggttccaagtctttgctattgtggatagtgccgcaataaacatacgtgtgcatgtgtttttatagcagcaccatttataatcctttgggtatatacccagtaatgggatggctgggtcaaatggtatttctaattctagatccctgaggaattgccacactgacttccccaatggttgaactagtttacagtcccaccaagagtgtaaaagtgttcctatttctccatatcctctccagcacctgttgtttcctgactttttaatgattgccattctaacttgtgtgagatggtatctcattgtggttttgatttgcatttctctgatggtgccaactaaggaattaaaacagggttttacaagagagtgacagggtaaaaacaacaaatgcatttgcttacctgtgtatgtgaggttttttaaaattttgaaatataagtatgatcagttgtacagatgttattttgggaccaagttactcatcaaaaatgacattcctgagactgaagttgctttcaacataataacaaattttaactcttccttcatattcatatgaaagccaagaacattctaatacttaaaaaaaaccctaaaattccatttaatgttgccatctagataaattgtcgcaattatgggtaaacaatggtgcaggtagcaacctcctggagggctgaaaaaaagaggttgagaatagtctgttctgtcaggcttttgacttggcagctgcttccaggtttatggatactcaaagggaaacaaggacaaggagtttctggcggagacactcaacttgtatggagatattagtaagtgctcactgacaaataggcatcccacaagggacatctggaccttgctcatttctcagaattaaataagattattgtaaaaggcaacaaagcaaaattatgggggaaaaaaaccttatcctaagtagtttccatcaagcaaacaaatagcaaaaatgtagaaaattcaagttaatttcataaatgcattcattcattcaatcagagagcaaatgttaatcgaggaagcaaacctattagaatttgggttctggtcatggttcagccacttactagctgtgagtccctgggcaaattaattaatctctgtgccccagttttctcaattataagagaagaaataatagcaataataatacctgtatttttaggggtagagaataagagagttgattgaaaagatatcaagggggtgaaaacaaccagaatcaaatttgttaaccatataaatgaggaatgaggaagagagagaagcttagaaaggtctctagggatctgatctagggctagttataaaaacagggaacacagcaaggaaggactgaggacacatttattaggactctgttataggtaaggcatgccaggagagaagcagatgctcttgtagctgaggcaagacttttatatctgtgtcatttaggagagaacatacaaggatatgatattgctaaaatgagtactaggaggctataagaattcaccaaagaaaaagctcagggaaagttgctacaatcatgacaggcagtagaggattagaagcctgaagataaagtttaatctcatcaagtctaacctccactaccacttttcagatgtggaaactaatgtttaaagtgggaaagtaccttgtccatggtcacacaatgaattagaggtaggactaggactaggaatgtagccctctttctgctacattgggttctatgctcccacagggacctgaacagggaagctctcaggtacctttctatctatctactgcacagcagggctttggctagtatgttttatctttctttaaaaaaaaaatctgcctgagcctcggctttcccatccgcctatcatatttcttcttggacactcacagtgcacactaggttttcaatatgcactgtgagtgtccaagaagggatataataggcagttttctttttttgaagtaaaaaattaaaaaaaaccccaatactgtttaacctaatattttccaaacagatacctactatcttataatgcctatatatgttcccatgaaacacaatttgagacatgcagaaacaattctgctagggagatgcaaggcttataatctgacctacggtgaaagttggaacaaatagggctatctgatgcctgaactgtgcctggaaatatagtaagagttagtaaaaagaaggagatagtgaacagggaaggccttctgggctgaggaaatgtagaaatgtgccacaagatcatatatgcagaattccacaatggaaattgagcacaaaggagtagagagagattaggataaagaggtaactggagtttccagcaagagggacttacgatgccataataaagaatttgggaggatgttcacttctagctgagaaagaataacagtttggatttaccctcccacctgaaaaaacaaaccaaaaaaacagaagaaaatacatggaaaaatggtttacaagacattggacataagacaatgaaggtcagtgatcactgtgagatggaaaactaatgtattcagctccaggattgccccagcttatcagagagtttataggccagggcacagggagggaaaccaaagaagaggctgatatactccctgagttaaagggaccaatctgagagcttggaaagaccctcaactaaaatttgcaggtcagagaactggagaggacagagtagaagacagaaaaaattaaagagctttgccaagggttctccttgagtattcagtagagtactgatcagcacaagtatgtggaaaaactgcagccaaggaaagaaccatttgaaggattagatggaaaagtgcctggtactcacacagggctaagaacagttaaactagaaacctcataattcatagggcactgggtagagtactcagaaggaagggactggcctcagtggtagggaaaaattaagctgagcaaatacttttctggtgtcacctaatgaacttaaaagcaagacttcaaagaacgaaactgtttctaagtaacataactgcatcccagaatgaagtttaaaaacatttacaggaaaacagaaatgtctaccactgaacagggtaaaattcagtcatttgagaaatgtctgctatataataaaaaaaagcaggcatgcaaagaagcaggaaaataaattgaaataaatggaaataaaataaattgaaaataatgaggaaaatagtcatatcaaaatggacatagaactgatacagatgttagcattagcagaaaaagacattgacagttattatagctgtattccatatgttccaaaagttaagaagagacatgaaagatataaatcaagcgtctgtagataaaattataatatctgagattacagtgtacattggatggaaaaatggcaaattagatattgcagataaaaagactagtgaattcgaagacatagcattgtatcaatagaaactaaccaaaaagaaacacagaaaggaaaaaagaccttccctccccaattaacaaaaaaacagtgagctctgggacaactttaattatcctactatacaatgaattggaatccttgaaagcagggctaggggtaggcacaaaaaatgtctgtggaaataataggtgaaatttttccacgtttgatgaaaactaaaactggctgattaaagaaactcaatgaatcccaagcacaaaaaacatgaagaaaactataccagggcacatcataatcaatttgtttaaagtcagtaataaagaggaaacttgaatgtagctaaaggggaaaaccatgttacataccgagaaacaacgataaagatgaaaacagacttctctttggaaacaatgcaagtgagatgacagagcaacatgtctgaagtatggaaagaaaaaacttcaaactagaattctatacctagcaagaatttcaaaactaagacaaaattcaggtttttcagatataaaaaagctaaaagaattcactactagcagacccacactctaagaagcattaaaggaagtgcttcgagctgaaagaaaattatgccagatggaaatatggataccagatggaaatatgtatctaccacattaaaagcatcatttaaccatatgaaacaatacataagaatatgtcttattagttaaataacttcaaaagattttactattcaaataaaataataacaatgtagtttggggtttataatggaaaatatattgatataaggttcttatactacatatgaagcagcataatgtcagttgaatatagattatgataaagttgtatactacaaaccctacataagctacaaaaataatggaagtagttaattagttatttaagagttatatttaataaactcttatacagctagtatctaataaaccaacaaaggaaataaaatgaaaccgtaaacatattcaaagaatactccataaccataaccataaccataaacatattcaaagaatactccaaaatatccccaaagaaggaaaaaaaagagaaaacagaaacaaagactagatgaaacaaatagaaaacaaatagcaaaatgaacaccgtaatttaaaaatcagagatttacagattagataacaaagcatggtcaaatttattatccataataaatgtccttcaaacataaagacataaatagattaaaagtaaaagaatggaaaaggtataccatattaacactaataaaagctgaagtggccatattaatatcagattaagtagactttagagcaaagaatattaccagggataaagagagtaatttcataataataaaggggttaatttattaagaagatttaacaattctaaatatttatgcatctaataccagagcttgaagatacataaagcaaaaattgatagaattgaacaaatccgtaattataatcagagatttcaatacttcactctcaataattgacagattacatagatagaaaatcagaaaggatatagacgatttgaacaacactatcaaccaattttacctaattgacacttatagaacattccactcaacaacagcaggatatatatttttctcaagtacatgcagaacattactaagacagatcatattctgggtcataaaacaagtttcatgcatgtgaaaaacctgatggaatctacataaaagctgtaagaactaataaatgagtttagcaatgttgcaggatacaagataaaactctatccatcctcagggatccagtgtggttctatgaagacaccagcctattttataagtctgggtttttctcatgctgggcactcttcctagaatgctcttatttttcttctcctcctgcttccccttccccaccatgcactcaagaaagctgtgtaaaaagactgcttatttttcaagatttaactaaaatatcaccttctctatgaagcctttcctgacccaccccctcattccccatcccaggggaaaattcatccatcttctgaatgctatatacatacacttaaaatggaacctacctctaccgttctaaaaaaattatctatgagccactcgagaacagggatttttcctacccattccatgaagtttagtggataaatgaataccttctccactgtaatgtaacaaaattgtgccaaactatttatgtatgtttgtatctccttcactgaatagggggggcttctaatgagtggggattgtgtttgacttctattttatgctcattatctaacacaatgccaggcacatggtaaacttttcatgtacgtatgcagactatatacctggataaacagtatagggaaggtctgaagttcacagcttctgggagaaaatatttcagaggccacaggataaggtcgataaatgaaagcatggaagacaaaacaactttctcttaagacagcaagcagattgccttgagttgtctctcttcagaggcaaatgttccacctttgctaccaacctgttggtcaatactgagagcctgtggctgggacaaattatgccgcactctcttttcctggcaaattaagaaattttcagcatctcgataaagtgtcagataaaggagagaaaaattcaatttagaaggccttcataactcttcacgaaggcattcccaggcatatgaatgggcaggtggaggggaggaggcctgccagcatcgatatctcattactgctagcttcaatgacctgagaggtcagcaaagaaatgagtgtctcaggggaaatttagcttgagagcagtgattctgcctttcattgtgttgatggactaactccattcattcctctgacaaaaaaaggtggggctacttatttagtctaagaaatttcacagctgtaaaagggaccgtttagagatcatctgctctgtctctgacagatacggaggtagaggctcagagaacagcaaggcaaaggctgacttcgtcagggccctggctttatgactactctctactctctgttgtcacagattctgtaaatcttttggatttcaatgatgtctaagggtaaagtctaaatgtacgggtgtgttcttcgagagccttcattcttttcttttaatttaaattttttactttttgttggtacatagtaggtatatatatttacggggtacatgatatattttgatacaggcatacaattagtaataatcacatcaaggtaaatggggtatccatcaccttaagcatttatcttttgtttttcaaacaattcaattatactttttaagttatttttaaatgtacaattaaattattattaactatagtcaccctgttgtgctaccaatactagatctactcattgtttctaactatattttatactcattaaccatccccactctatcctcccacccaccaactatccttccagcctctggtaaccatccttctactctctatctccatgagttcaattgttttaatttttagctccccaaaataagtgagaacaaacaaagtttgtcattcggtgcctggcttatttcacctaacattatgatctcaagttctatccatgttgttgcaaatgacagaatctcattctttttatggttgaatggtactccattgtgtatatggaccacattttctttacccattcatctgttgatggacacttaggttgcttccagatcttggctattgtgaacagtggtgcaataaacatgggatatgtttgtttcagatatgtcttcgatatactgatttccattctttgggtatatccaatagtgtgattgctggatcatatggtagctctatttttagttttttgaggaacctccaaactgttctccatagtggttgtagtaatttacattcccaccaacagtgtttgaggattctctgttctccacatccttgccagcatttgttattgcctatcttttggatataagccattctagcgggggtgagatgatatctcattgtagttttggtttgcatttctctaataatcaatgatgttgagaaccttttcatatgcctcttggccatctgtacatcttcttttgagaaatgtctagtcaaatcttttgcttatttttaaattggattatttagatttttttttcctatagagttgtttgagctccttataaattctggttatgaatgcctggtcagatgaatggtttgcaaatatttttctcccattttatgggttgtctcttcactttttgattgtttcctttgctgtgcagaaggtttttaacttaatgtgatcccatctgtccagttttgctttggttgcttgtgcttgcggggtactgatcaataaatttttgcaaagaccaatgtcctggagaggttccccaatattttcttgtagtagtttcatagtttggggtcttagatataagtctgtaacccacttaaatttgatttttttgtatatggtgagagataggagtctagtttcattcttctgcatatgatatgcagttttcctagcatcacttattgctgtctgcttgttttgtggtctttttttccttcttgttttctctttagtgaaggtgattttctctggtgatttcttgttttctttttgtgtatccgttgcacatttttgaatttgaggttaccatgaggtttgtaaataatatctcataacccattattttaaactgatgaccagtgtaacactgattgcataaacaaactaacacacaagcaaagggacaactaatgaaaattctacactttaacttcatctcccacttttttgtttctatttatatcttattatatatgtcttgaaaagttgtagttattatttttgattggttcatgatttagtctttgtacttaagatatgagtagtttacacaccacaattacaatgttataatatcctatgtttttatgtgtacttactgttaccaatgagttttgtaccttcagatgatttcttattgtttattaacatcattttctttctaaataaagaactccctttaacatttcttgtgggacaggtctggtgttgatgaaatccttcagcttttgtttgtctgggaaagtatttctacttcacgtttgaagaatatttttgctgaatgtactactatagtgtacaatttttttgttttttttgtgtgtttttccttcagcactttaaatgtgctatgacaccctctcctggtctgtgaggtttccactgaaaagtcggctgccagatgtactggagttccattgtgtttgttttatttctcttgctgcttttaggatccctttattcttgacttttgcaagtttgatcattaaatgccttgaagtagtcttcttttggttaaatatgctaggtgttttataacctacttgtacttgaatattgatagctttctcaacatttggaaagttctttgttattatccttttgaaataaatgttctaaccctatttttctacctcctcttgaggctagtaagtcttagaattgcccccttttgaggatacttccctagtcttgtaggtgtgctatattattttttattctttttctctcttttgtctcttctgactgtgtattttcaaatagcctttcttcaagctcactaattctttcttctgcttgatcaattctgctattatgagactctgatgcattctttagtatgttaattgtatttttcagctccagaatttctgcttaattcttttcaattattttaatctttttgttaatcttgaatttatagaattcttaattccttgtctgtgttatcttgaattttgtcaactttcctcaaaatggcaactttgaattccctaaattgtcacaaacctctgtctctctgggattggtccctggtgtcttatttggttcatttggtgaggtcatgttttcctggatgatcttgatgcttgtggatgttccttgctgtctgggcatttgaatcattagggatttattgtagtcttcacagtctgggttaatttgtatctgtcctttttgggaaggctttcaaaagtattcaaagggacttagttgttgtgatctaactttttagtccttgtagccatatctgcattaaggggcaccccaaaaccagtaattctgtggctcttgcagactcgtagatgtactgtcttggtggtcttggaaaagatctgaaagaattatctggattaccagacggagactcttgttctcttccttccaatcaaatggagtcactctctctctctgtgcagagctccctggagcaaatatccctgtggccaccaccactgggactgtgctgggtctgacctgaagccagtatagcactgcgtcttgcccaaggtccactgtaactcctacctggctagtgcctatgtttgctgagggccctagaactctacaatcagcaggcggcaaggccagccaggcctgtgtccttcccttcagggcagcaagttccccctcaaccctggttcctcccacaacccttggttcaaaaccaagtcctggagttggatatcttagaaatctacttggtgctccattctactgtgactgagcttacacccaagcacaagatgaagttcttcccatccttccctcccctttccataagcagaggcctctctccctgtggctaccaccacagggcccatgaggagtactgccagactaccacttatgttcaccccaaacccaagggctcttcagtcagcttgtagtgaatctggccaggcctgaaactcacccttcagggaagtgagctcctctctggcccagggcaggtctagaaatgccaacctagagccatggcctggaattcgggactacaagctcctgcttggttctctacccttatgtggcccagctggtaactaagctgcaaaacaaagtctcctttactcttccctctgcttttctcaagcagaaggagtctctccccatagccaccatagatgggaatgtcctgggtcaaacctgaagctcgcatgtctcagggtctcagccaaggcctacaacatgtatgacctgactatcactgctgattattcagggccacgggctctttagtcagcaggtgatgaatcctgccaggactgggtccttttcttcaaagtagcagattcccttctggctcaagttatgactagaaatgtcatctgggcactaaagcctggaatgggtacctcaggactctgcctgacaccctatcctactgtgactgaggtggtatccaagttgcaagacaaagtcttctgaactcttctctcttctccagaaagaaaggggtctgtgttggagctgtgagatgtgctgaaggggtctgtgttggagctgagctgtgagctgtgagctgtggggaagggatggcacaagcactcccctggctgtcctggctgatgcccctcaagttcactggccctgaccccggaacagcactaggacttgcctaggagtaacagtccttgtgatccagaccgcctttgaagtttatttaataccccaaagcactttaactcatggtggagaggcttgatggaactcaattatgactaatggaattgatgattcctctctggtttgggctggtctggcctaaatgctccctccatgagtattggctgagtttagcctgttgtttctttccactatgacacagcagcactgagttccaatacaaagtcccacaatcactgcactctccctccctgaagcacaaagatttcacatgatgccaggagaagggggaggggtggcatcagcaattcaagatggtatttcctattctcttcagttcctctatcagtgatatgaagtaaaaaccaggtactgtgattgctcacctaatttttggttcttagaaaggtgctttttttgtgtagatagctgttaaatttggtgttcctgaagggaggatgatcagtggaggcttctatttgccatcttgagcttcctccctctaagacccttcagtcttgattctaattcacctctccactcttcattttctacttctttcccacctgtattccagccacagtgtacattaactcatagtttctggaatgtcccacgtaatttcacacctctatacctgtgcctgtgccattcccactccctaattgacatttctttcttttattctctgtaagattcctagtcatccttcaaagcctagttcaaatgttgcttcctcttttaaaacttcctggatgtttcaaggcagaactacttcctccctgtactatgcttatagcattttctatatgtatctgttataacactacattataccataggtatatgctatgactatatatattaatatatacatatgcacaggcaggttatcttgtttggaggtgttatccccatttaaaatgttcaggtatatgtaaagcaaacaccttattcatgcagctatttttgcagacctacatttggccaagtagtgggtacccagaataatattactgccccaagaaactgcatgtatttcccaagttcaaatactgaagtcataaacatttatttataccagaaacagtagtatatatgaggatatatggcttacttatgatgttgaaatactttttatgaactcataaatcaaattctatttatagcatatggtttatatatatattcattgatattaatagacaataatgtatttaatacaaaagctctcagtagattagttctgtagtatatatttcctatgcataattagatcaggtacagatacataattccaaaattcatgtaatccatattctgtagcatcatccagggaaaaatcccatgaaaataagaggattatcttgataaaagaagttgaaagaaaatacaaaatttcaaacacaatttgagccaaaaaagacaaatcacgaaatttgtttatttggctgcttccttggctgtctatttaaagctaaatttcaaagtcctgagcctactacataaactggtggctgtgtacctctcttcattcctccagccctgatggaccatgtgacatacagtcctactctccctccatatgtgatcttcccctactcttcacctggctaaaaccaacctatcctgcaaatttcagtttcagtttatctgatgtgcccagcttggttaggtacctgttttggcctatcacaacctctgggcttccctctgtcacagcacaaattatactgtgtggtcaccattcacatttcagtctctcttattatactaaagccttgagagcagggatctaataggtcagtctacagatatttattgaatgtttactaagtgctgggcattattctaggtgctgggaatatagcaataaacaaaacaaatgccttgccccaaaggagttttcattatagcaggagaagattgtcttaaattagtaaacaaaaattaaatgaaataagttcagctactaatacgttatgaagaaaattaaatggcataatttggtaatgactggggtagtgtggtatatttcaactagaatgatcaggaaaatattctctgaggaggagacccaaaaaatgaaaactttcctatgggaagagtgccaagtgttggagagagaaatgagcttgccatctttgggtgacagagagaaggtcataatagctagaccatagtcactgagtggaaggggaaaaagtagaagaagtaggcagaaaacaagccctgtagtgccttattggccatgataagaaccttatttgaataggaatggaagccaagaaaggttttaagcagggagagacataatctggctgttgtgtggagaatggattctaggggcaagaagtagggagaccagtcaaggctatttcagcagtccaaacatataatagtgacctggattagggttatggcagaggatatggaggaaagtgagtgggttggggacatatattagagatagagtggcaagactcactaatggactggatgtaagatgtgagggaaagaaaaaaaaataatgatagccctcaggtttttacccaaattcatttgctgtgatgaaaaatacctgagtttttgttttgaatatattcattttgacttgcctatttgacatctggattgagatactatgcagacagtttgattatactaatctagagttcaggagaagttaaggttgaaaatgtagatatggaactcattagcatatagttgacatttaaagctataggaacagattgaattatgtggaaaatgagtatagctggggaagagcaaagaaaagaagaaagcatagtggctagagtactttaacatttaatgtatgggagcgaagaatacatcaaacgatcctgagaaaaagtggccactgtggagaagaaagaggactaagggagtgtggtatcttgaaagcctaaagaagaaagtatttcaggaagtaggttgtcagttaactgtgtgaagtgctgctatgagatccaataacatgaaaacagggaaatgaccattagaattggcaggatgatggtctaagatgatcttgataaagggtgtttcagaagaatgttgtgaattaaagttaagagtggaaagagaagagtgatgcatggtgagaatgtggaaaggatgagtatagataattcattagaaaaattttggtatgaagtagagaaatgatttatagccagaggaaaatgtggggccaaggaatttccttccttcctcccttccttccttccttccttccttccttccttccttcctgtctacttatctatataaagatataaaatattattgctaatttgtttgcatataggaaatccagaaagtaataattgttttttcaagatggagtcttgctctgtcacacagcctggagtgcaatggtgcaatctcagcccactacaacctccacctcaggggttcaagcaattctcttgcctcagcctccccaatagctgtgattacaggtgcccgccaccacgcccagctagtttttgtaattttagtagagatggggtttcatcatgttggccaggctggtcttgaactcctgacctcaagtgatccacccgccttggcctcccaaagtgctgggattacaggtgtgagccactgcacctggcccagaaagtgataaatttaagatgtagaagagatagggataattttagtaagatcaaatggggtctaaaatacaggcagttggacttagagaggaataaggacatgttccattctaacaaaaggaaaggcagggtgtgtgggtaagcatacaagtaggttgatgaattttcaggtagttgttatcatatggcttcttttttctcttttaagaatgagataaagtcactagctaagatgacccatttgattccatattcttaatgtttagaaaaacacgcagcatacaataggcactctggaaacgtttgctgagtgatccaattatcaaacaaaattgcacatgatctggcctcatgaactgaatcttcttaactcaagaggaagagctctataaatacaaagtcttagactgaaatcctgggtctgtcagttaccagttgtaagactctcactaaagtacttaagctttctgagtctaaaatttcttacccataatatgaggatgaaatgcctacttcataggaatattataaaaaatcaaccagacactatatataagcacttgtcatagagcttggcacataagtgcttgataaatggatattgccaccagtggtgtatattgtcatcattactgctacttctactaatattggtcaccatcaaactcttccatttgtttcctcaaatagattgcaaatgcctataaagtaaaagaatctgtcttataagcctttcacagtaagtttctttttaagatgatggtgaatacaacttctttgggtattccaaaaacagaaagaaccctttaggttgggtagtcagagaaagattgaatccactagtttgaagactgaagccaaactatttcatctttattggcattttaaaaaatgcaatttcatcgattatccctttctgccttcaaaagagttcatgggatgaacattttcctcctgatttaataaacaaataaagacttaagaaaagtgaaatgatttaagggctcagtttataaatgtggagctggggtgtctgcatccaaatgctctgtgctctctactacattcattttttgaaacatgccacaaaaagagccaaatgaaagatattgaaactggcaatagaagtgtgaggcccctctgagctatagcctgcccatctgatatcatacggtatggtggagactggtgaatgacccctaaatttcttctcctccttttctgggcatgtctaaaccacatttcctatgaacattctcactgcaataaataccaggcatgtcaccaacttctgaccagtgggatgtaaatgaaggtgaagtgcaccatttcaggcctaagctttaaggcagtgggctttctttgtgaactctctctttcctctttcaatcatctagaacccaagggggcctaaatttgtgcagatgacaaaaatgccctaggtgaaggtggaacagggtactgaaaggaatgtggattcctatataactgtggggagtagagctggctgccagtgtagactgctcaattcagaaccatttgtgaaagagaaatgaacgtcattgttctttaagtcacagtactgttgggtttccttgactattattaacacatagggaaacatacttgagaagacagctgaaggagaggaagcttaggagaatatggcagctgcttgaagatctctccatagttcccttgaggcagaaggggcagataagtcccacatgtacccagaagcagaaccagaacagatgcacaagtaggacccagagacagagtttacttccataaaaggaggaacttccttttggagttgttttactgtatgagagatgtctttcaaggtaatgagttccttgtcagttcaggtatggcagcagggactggatgatctgataaaagtgctacagtcagggctcaagctttctttgtagggttgaactatatgacccttaaggtcccttccatccctgagagtctagactgcagaagaaaacaaatctcatccaattaagaacatcagaaaagtgagtgatgactcactgatgaagaagatggctgtgcttggatttcaattgccataataatcatcatcatcacagaagttctactggctttttctccctttgattaaagtcctcagaaataccttcaggctcccttccaaacaaatggcccattatagaaactcaattttaatctgatctcctctctcagtaattacattattcgtcaagagaacaggacattcacttaatgaaggggatgcagctcaaagggtaagcactgcaaacatccagaagtgaaaggaatgcacttggcatgacgtgcctccaccaaagcacattagaaaaaggctgtgcagcacgagaaaagtatcagattggaaggcagaaagcctgggtccaatcttttccttgcttgactcactttctctcactgggtctctacaattgggtgggagtgccactcccacccaatccatattccacaaagaagcctgaaggacttccaaaaaaccaaatatgattaagactgtctatgctttaaacctttccctgaatctccactattttgggataaaccctaatatgatctaccagccccccttagaccccattatctagacctggaatgccaccttccagcatcaacagagtccattctattaaagccatacttgggttctttcagttcctagaaatagactagttcttttctcagtctttgtagatggtgttctctgtcaagaacacttctcttcttgctgtttgtctaggtaacttctattcatcctttggatctcagcttcttttcaattttattactatcccttactatgtgcaaaatactaagtgctttctaaatattagctagttttatcatctttaatgtgctgcaagtaggtactattattattcctattttatagatggggacactaagactcagagaagttacatgcgtctcccaaggtcacagggctagtaagtggcaaagcaagtattccaacccagtctggtttgagtccatgcttttaacccctatactaagttgatccatcacttcctcagggtgacctttatgatcaagtgatctcccttatgtatatgactgcacatgtcactccattgttaataagtatgtaatgctatcttccctgctagtctgagagctctgggaagatgaggatacaacctttcttgtccattgctatacctccagcctccagcataccttgtaaattcagtaaatggctttggatttgattaatacatatacaaataggaatcagttttctaatatgtaaaattagaaaagttgatcttggtctacatttttttatattgctttaaataagaaacagtcctaatctgagatgctggccttgatacatgttggaaaactatcatagtgaagaccatttcaactatttaagccttagctgttcccactgtagaagactactggactagctgctctttaaagacaactctagagtacctgaagtgtttataaccactgcatattataggatgtgagcatgggaaattttggttatatttgccttgtttagtgttgcctatttctggccggatgtaaaattcttactgaatacaccactaagaacagagcaattatgaggcttggaagcacaattggtttttcaggctggtgagaaattcagggaacttaggagtaatagaggacaggtatagtgaagtgaagagaatatacaacccaaaggcaaaagctcagggttgagtgccgggctctttcaacctaccaactatatcatctttaatgagtcagttgattgataaattcagattctaagtgggaccaaattagtgtactgcttagggatattactttctctttaaaccattatgcttcatttttaggaacttgcaggtctgctttgtttcgagaagcttctgtggcctccagttttcagtcttttgtactttctgctttttaaagagttcaaagaggaattaaagtgttaaagttataacatgaccctttagataatggcttcttaaagtggctaatatcatcttgaaatcttcaattgacaagcagttatttagctctaattatatgccagagttcataaaataacttgggcaagttcttaacttctgtttgttggtattctcgcctataaaatgggaacattcgaatgcaagttcaggaagttatgaacactcagggactgggcaggaagattcttgtcatttctttggtaggagggtcctctccatgaacacttttgcagtgacctgtgcttctcatcactatgggtaacatcacaaactacacaccagccctccttgactccaaccctaattctctttcaggtggttaccaagtggtgtcagctctaagtcctgaatatctccttaacatctcaattctcactgccgtggtgcttcctacatgtctagccaagattactatgacagtctcctcatttgtcttcccataccagtctctctggccacagagaaagttcttaaatttaagtgtgaccatatcacttccttgtttaaacaccgtcagtaatgctccttgtccttgggataaattcaaacctctagggtatgatatataacaattagaataggctaggattagaaatttggctttaccagtaccctgccattggaacctgaggcaaattagctaactcccttaactctctgtttcttcatctgtaaagtaagataatcgtctttacactatagggttgtggtaaatattgcattaagtactatgtttaagatacttagcctaatgtctaggacatagctagagtgtaataagtgatatttctttttactacaaagaaactcaaatattacgtataattgagcaagaagacagacatggtaacaatcatggaaaacaccagcaaaaatagatgtataagcagcattctatgtaagttcagaggcagagggtcataaacactgactgagaaataacagtagccttctcagaggaggcagtatttgatctagatcttgaatggtcacctaggatgactaacatgggcagagtttgttggacccctttaatggctggttttctgtgcccctttctgtagccttgctcactggaagttgaaataattagcatggaggttctgttcaccaggctgtgatgatgcacttattctatcgtaaaactaagggcttattttccaatataattgatcccttaaccttcagagactcaaacattctctgtaccttcaaaacaatagaaaattaaaagaacaatttctctttaccttctaaatcttggcaaccaaaaataggagagcaagggagagaacattaaggtctcatcggtttcaattctcaacaatgtaatgtgtattttttcttattggaatttcaagaactcttataatttaatctgttatttattctgttaaagtgcagtcttccttaagagcaaaaggattaatggtttcaaattccagcacattgacctttattctacattaaaatgcttatttgaaactattctgccagggttcccataagccattcagtattgaacatcaaagaaatataaagtttaactcccactccactcaggaagcagaattttagaaataaaaatagacttttgcatgcatagatgcatgtaagatgctctgcagggttgtgtatagaccaggagcagaggcttagttggactagggcctacctccttggttcagctttgactcaggcccatcatggactgaagcaaggtcattttctgaatatttttctgtcacagaagaacataccttgttttatggcatggaagcaagtgaagaaaaatcccaaagaatgaatgacttgatgaaacattaaaaataaagttgaggccaggcacgttggtgcacgcctgtaattccagcactctgggaggccaaggcaggtggatcgcctgacgtcaagggttcacgaccaccctgactaacatggtgaaaccccgtctctactaaatacaaaaaaattagctgggcgtggtggcacatgcctgtaatcctagctacttaggaggctgaggcaggagaatcgcttgaacccaggaggcagaggttgtagtgagccgagatcacgccattgcactccagcctgggcaacaagagcgaaactctatctcaaaaaaataaatacatacatacaaataaataaataaaataaaataaaaataaagttcaaagatttaatatggggagaagacgagaaagaagagaatgtatatttattggctacctactatgaatttagcatggtactaggagcttttaagtaactttgtctgcaaacaacactttagctcaggtaggcgtgatctccctctctgaactcccacagccccttatcaatgatcctttcacagcatggctcttcttacctttcctcacagttactcgtgtatgagtcttgcctcccacactagactgggtgctttcttttagggtagatacagctgttgttttagccatctctcttttctggagagccaggtccatatttagatactagttctgttgaattttgtcaaaataatctctggaaatcacctctttcctgtccaaaatcttctgcacatgaatccccttagtaatatcacccaaacaggagccattgctggttccctacaaggctcttggagccagacatggtcagacatctatctctctagcttcccactgggactttggtttcttaccaaatttgatcaaattccagactctccgaatagtctaatgagtcccttttgctgtcatttaaactgggtgctaattggccccaactcaaaagattcacatctcatttccacattatctcaagggctgggccttcattgagcctccctctcttactccgcataactctaacacctttatatgggatcctccaaataaaatgagagctttcttggcagaactcttgttgtccagtttctgggattttttcactctcaatatgagctgaacaaatccaactggtaagcggctcctagtgttggacacatggcattccccaagatagagtcaggaaacagatcatcaagagataaagtcctgattgaggattacgtatggcattacaggtatgataggcatattaaagggataatgtttagggagagcaccagcctgaatgggctgaataaaatgaaatggcatataaaaattatctctcatagagctggcccagagcaggtgctcaatgaatatgtcgcagcccctatggtattattccaaaaacttctagggaacatctcatctataccaagctctgggctgggcactggggacacagtgataaatcagatccagtccttgtccataattagttcacaatctagcagggagaaaggggaacaaagataatactaggcataaaatgctggattaaaaagaggcacaaagcactgagagaaacagaggaaggcaggcctgaatcttcctgaggaattagtggagccttgaagtaagggggacatttgatctgggtcctgaaccatgagtagaaattcttagacaacttcacctcagaaaaagcagatggaccaattgtacaaggcccacaatatgtatatgaaatataccttgacctttgaatatagtgagcagtttgggatggagtatagcatgcctggtgacgttagagggaaataagactggaacgagtttagagcaagatgtttgatgagcactgtttctcaccttgcagtccaaataacttcttatggtaatactgggggacatgggaatgggtataggcagagccaagactggaacccaggtcacagaccttgaaccctgcattttccactataactagcatctaataaaaaccaaccaagaatatttagttgaaaaatcatatcacctatctgttgataaatgcaggctatttatcaaaaccacaaaattgaaagtcacattcaactctgaattcccatagaaactaaatttcaagttagagagaaacttttccatacagtagtccctacttatccattttcattttccatggtttcagttccccacagtccaaaaatattaaataaaaaattccagaaataaacaattcataagttttaaattgtgggctgttaaataacatggtgaaatctcacaccatccctcttcatcccacttcatcccacataggacttgaattattatccttttgtctgacgtagccatacactacctgcccattagtcactgagtagccatcttggttatcagattgactgtcctggaatcacagtgcttgtattcaagtaacccttattttacttttattacagtatattgttataattgttctattttactgttagatattgttgttaatctcttactatgcccaatttataaatcaaactttatcataggcatgcatgataggaaaaaacatagtatatataggattttgtactatctatggtttcagacattcactgagggtctcagaacataacccctgagtcccagcactttgggaggccgaggcaggtggatcacaaggtcaggagttcaagaccagcctgaccaacatggtgaaaccccgtctctactaaaaatacaaaaattagctggacatggtggtgtgtgcctgtaatcccagctactcaggaggctgaggcaggagaattgcttgaacctgagaggcagaggttgcagtgagccgagactgcaccactgcactccagcctaggcgacagagtgagactccgtctcaaaaaaaaaaagggaggaggagccaagatggccgaataggaacagctcgggtctacagctcccagcgtgagcgacgcagaagacaggtgatttctgcatttccatctgaggtaccgggttcatctcactagggagtgccagacagtgggcgcaggtcagtgggtgcgtgcaccgtgcgcgagccaaagcagggtgaggcattgcctcactcgggaagcgcaaggggtcagggagttccctttcctagtcaaagaaaggggtgatgaagggcacctggaaaatcgggtcactcccacccgaatactgtgcttttccaacgggcttaaaaaacggcgcaccacgagattatatcccacacctggctcggagggtcctacgcccacggagtcttgctgattgctagcacagcagtctgagatcaaactgcaaggcggcagcgaggctgggggaggggcgcccgccattgcccaggcttgcttaggtaaacaaagcagcggggaagctcgaactgggtggagcccaccacagctcaaggaggcttgcctgcctctgtaggctccacctctgggggcagggcacagacaaacaaaaagacagcagtaacctctgcagacttaaatgtccctgtctgacagctttgaagagagcagtggttctcccagtacgcagctggagatctgagaacgggcagactgcctcctcaagtgggtccctgacccctgacccctgagcagcctaactgggaggcaccccccagcaggggcacactgacacctcacacggcagagtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaacgcagttcctcaccagcaacggaacaaagctggatggagaacgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgactggtgtacctgaaagtgacggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgcaatgaaggaaaaaatgttaagggaagccagagagaaaggtcgggttaccctcaaagggaagcccatcagactaacagtggatctctcggcagaaaccctacaagccagaagagagtgggggccaatattcaacattcttaaagaaaagaattttcaacccagaatttcatatccagccaaactaagcttcaaaagtgaaggagaaataaaatactttacagacaagcaaatgctgagagattttgtcaccaccaggcctgccctaaatgagctcctgaaggaagcactaaacatggaaaggaacaaccagtaccagccactgcaaaatcatgccaaaatgtaaagaccatcaagactaggaagaaactgcatcaactaacgagcaaaataaccagctaacatcatcatgacaggatcaaattaacacataacgatattaactttaaatgtaaatggactaaatgctccaataaaagacacagactggcaaattggataaagagtcaagacccatcagtgtgctgtattcaggaaacccatctcacgtgcagagacacacataggctcaaaataaaaggatggaggaagatctactaagcaaatggaaaacaaaaaaaggcaggggttgcaatcctagtctctgataaaacagactttaaaccaacaaagatcaaaagagacaaagaaggccactacataatggtaaagggatcaattcaacaagaagagctaactatcctaaatatatatgcacccaatacaggagcacccagattcataaagcaagtcctgagtgacttgcaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccacaaatcaacagaatatacatttttttcagcaccacaccacacctattccaaaattgaccacatacttggaagtaaagctctcctcagcaaatgtaaaagaacagagattataacaaactgtctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccattatctgtgggacgcattcagaggagtgtgtagagggaaatttatagcactaaatgcccacaagagaaagcaggaaagatccaaaattgacaccctaagatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaatagatagactgctagcaagactaataaagaaaaaaagagagaagaatcaaatagacgcaataaaaaatgataaaggggatatcaccactgatcccacagaaatacaaactaccatcagagaatactacaaacacctctacgcaaataaactaaaaaatctagaagaaatggataaattccttgacacatacaccctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcatttgatgaggccagcatcattctgataccaaagcctggcagagacacaaccaaaaaagagaattttagaccaatatccttgatgaatattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaaccattcatgctagaaactctcaataaattaggtattgatgggacatatctcaaaataataagagctatctatgacaaacccacagccaatatcatactgaatgggcaaaaactggaagcattccctttgaaaactggcacaagacagggatgccctctctcaccactcctattcaacatagtgatggtagttctggccagggcaattaggcaggagaaggaaataaagggtattcaattaggaaaagaggaagtcaaattgtccctctttgcagacgacatgattgtatatctagaaaactccattgactcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatgcccatcaagctaccaatgcctttcttcacagaattggaaaaaactactttaaagttcatatggaaccaaaaaagagctcgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaataagcaatggggaaaggattccctatttaataaatggtgctgggaaaactagctagccatatgtagaaagctgaaactggatcccttccttacaccttatacaaaaatcaattcaagatggattaaagacttaaacgttagacctaaaaccataaaaactctagaagaaaacctaggcaataccattcaggacataggcatgggcaaggacttcctgtctaaaacaccaaaagcaatggcaacaaaagacaaaattgacaaatgggatctaattaaactaaagagcttctgtacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggacatgaacagacacttctcaaaagaagatatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagagggtgtggagaaataggaacacttttacactgttggtgggactgtaaactagttcaaccattgtgcaagtcagtgtggcgattcctcagggatctagaactagaaataccatttaaccctgccatcccattactgggtatatacccaaaggactataaatcatgctgctataaagacacatgcacacatatgtttattgcggcactattcacaatagcaaagacttggaaccaacccaaatgtccaacaatgatagactggattaagaaaatgtggcacatgtacaccatcgaatcctatgcagccataaaaagtgatgagttcatgtcctttgtagggacatggatgaaaatggaaatcatcattctcagtaaactatcgcaagaaccaaaaaccaaacaccgcatattctcactcataggtgggaattgaacaatgagatcacatggacacaggaaggggaacatcacactctggggactgttgtggggtggggggtggggggagggatagcattgggagatatacctaatgctagatgacaagttagtgggtgcagcacaccagcatggcacatatatacatatgtaattaacctgcacaatgtgcacatgtaccctaaaacttaaaatataataataaaagaaaaaaaaaagctacataaaaaaaaaggaactcccccaccccctccaagtataagggagggctactgtacaatggtgtgaaaagcaggcagattacagggaagcctgtgactccctttctgtgtggaggccgttcagagtacaattttcttgtctttttgctcgaatataaagatgacacggataacagtgagcctgggtttcagagctaactatctgctctcttaaaaaggtgctgtgtgcagggaaaatatagagacaaagacagagaaagagacccagagacagagagggagaagaaagagagagacaaagaccaaaaaacataaagacagaattatgagcaggtggttggggagtatgtgaggaagagaacagacatctattaagagtctcttatatactaggcactgtggtacatacttaacataagagcatgtagttgtcataagataagaagagagagctagggagttccaattcactcttacagcataatccaaacccatagctctagaaaataggcctattcccagagaagagtcctcaaaactgttgtggtttttggtccgattaaggaagtgacatgttatccataagcaggaactattcctgacctgtacctgaaattctaccattctatttgctctttcagtttaaacatttgccctcagttccaaagcaaactcctgagtgaaagatccaagagcccctttggctgaactgtagaaagtgaatgttctggtttgaatgtttgtcccctctaaaactcatgttgaaagttaatccccaatgtaacagcattaagaggtgggacctgtaagagataattgggtcatgagggcatgagccctcattatgtgttaatagattattaataagtcatcatgtgagtgaattagttatcatgagagtggatctgttataaaagccaggtcagctctctcacaagccctcctgcctggtgatgctttcttccatggtatggtgcagcaagcaggccctcaccagaagctgagcagatgctggtgccatgcccctgggcttcccagcctccaaaactgtaagaaatgaatttattccttataaattacccagtctcaggtattcaattacagcaacaggaaacagaataagacagtgagcatgacagcaaataaccaaagagatgagtgtttgtagatgacatatttgtggcaatatgacttgcctgtggtatcctgggggtgtccaggaaacctcacagaatgtgactgccacaagcttggtatcttctttacacatcatgggttcaatatagaacactaagcaacactaagcaatgtccaggaattctaatgggaagctggttgcagcagaagcaaaagcttctctggaggacactgagagtcttggtgagcaagaaaacaatggcagaatagatactccttcaggagccctttattttacaaagttggaaggaacggggcttcataatacccaggcaaccttccaatttaaaaagtttataggctccatctgtcccagaagaggcttctctgagtttcctcatttattgtccctaccattatgctctgcctatccccacctcttctgtattctatttgctgctccccaattcccacctctctgggtagttcttgcccattctagccactcattcttcccctaattgcttacatcagaaagcagcacagatcactaggctgggaactagggcacttaaccctgccactttccagctatgaggccctagataagtctgagccttagtttcacagtttggaagtacatggcgtccaggttccttatacctaaaaatgggatcattctttcatgctttgagatttaacttaaggtctacattctctagcaagccatttctatttgtccacccctttcttgtcctcttttatattatattgtccttattgatggacccacacatttataatataaggacaatactgtgttttctaacacaatattaggaatgttaaaagtcttgtttctctctaatgcaataaaaaaaccctgaggaagtggtttcactgattgtgtgctattccgttcttcccccttctctccatgtgcacatcccaggactggactgagctgtataagtatttttaaaatgaagtagaaggaatcttgtcaactaaggttactccatttctgaaagcctgactggaaatggcttcctgaatcctatattatcagttttctgagaaaattggtgagacagggcattccaggcagaggaaagagcaataaaatacaagttaaatgctttagaccaagaggtagtataatattgtcgttaagtgtacaggctttggagccaaaactttggcttccaattctagctctgccactgaataccttatcctcttgtgcctcagttttcccttttataacatgaaaataatctatgagggatgcttggaaacttagaacacagcttcacattttcgttcactgctgaattcctcccagtgttatttctaaacctgccctctgtatgaaggcgggccagcctcttacagattgaccactgcatgccaggtcagcctcttcatattatttttttcttgcctgttagtcaccatgcacaaaattccctctcactgatgccttctaaagctctagctgctttgctagcccacatgcagtcccaccctacagggaacctccttcattgctctggtctgtcattctctctctcatggagctacctaatcatatatgagcagtagccatataacttacccaaataaggacacttctgagagtgaaagacaatgttattattcattatgttgggatgacaggtataagtaaggactatcctgatcagaaggagagagatacacagttatcttaccaatggacccaggggtattgagataacactgcttcttacagtctttctctttctagtatttccatagaaatctgcatagtattttccagcctacaaaaaacttctacctcatagtctcactgatgatcacaccagttctgggaatctactgcgtaggactatttcttgcacaaagtggtttttcttaggtcacctagaggctggaactggacagaaccttatgtttcactctggcatccactttagcccctgattgtgttggggtttttttggggggagttgattttgttcccttaggttggtggtagaagaaagaatcatgccatacttcttttcccctcatctttccgctatctaaagctgggggaatggtagggtttgagaaaggtgaaatgagaagctaacaaagaaacaatcagaaagtggcaaagtatcaataaatctaatctcattcaagaaataattataaatatttatctagatgataggatttcaagtaattttttttttttttttttgagatggagtctcgctgtgtcgcccaggctggagtgcagtggcgcgatctccgttcactgcaagctccgcctcctgggttcacgccattctcctgcctcagcttcctgagtagctgggactacaggcgcccgccaccacgcctggctaattttttttttatttttagtacagacggggtttcaccatgttagccaggatggtctcgatctcctgacctcgtgatccgcccgcctaggcctcctaaagtgctgggattacaggcttgagccaccgcgcctggcctcaagtgatttttaacattatccttactccgttctatatcctttgaattagcatgtaccacttacataattttacaaaatgctatttcatttatttttttcgttttaaagaaagaaacccgagtcttcagtaaaatggtcaatttcagcggaaaaaaacccccaaaaacaaaaacataggcttttcaaccagacctaggttttcatcttaattctactctgtgaccttgagtaagtcacatatgccttcaagcctcagcctcagtttcctaatgggtagaatatagacaccaccacccacttcacagggctgttaatgacgattccacaagattcaaaaagtgagtaccccaggtaagggcccagcttgtggcagactctcaataaatgttcattcccttcatgtgggtgttattgatgcagcttcccaaggcttctgacaagacttgccacctcctctgctcacagctctggagtcatcaggggcatgcctgtgacagctgtaccccctcagcatgccagtggggctgtccagagatgctgggtgcctaatgcggggaggcagtcctgtcagaatcactgggggttactcatcccagcttcagggtttctgacaggatgttttgataaaataaatctattttaagtgaatgtaatgaaatagtaaccagcttctgaagggctcttaagatgtttttaagaagtttcagatcaaaggccctgggaaggcagacttcatgcattaaatatttagtactgactcagtcacttgagagtgccggagttttgacattgtaagaggaagaaagcacattctagctggggccacactcatgttaaagacacaagtgatgggattcaggagcaagaggccaatcttctggctcctattggctggaaagttggaggtcatgacctcaaaggctgtctgcctaaagattcaggatgtgatagaattattcaggatctatagtagttgggtaaacaggtcgtcagcgaaccctgacagcagggatctgccttcccagctgttactaccaggctcagtgcctgtcattctgcacattgccacttggagcccaccaagtgtgtgaaatctgcaatgtgctttgcagtccagctgagagatactgtccttgagaccacacatggactcacacagtcctggcaggtgaggctcaatgaggagaagagatttgttgaagaaaggccacactacacattaatggtatgactgggaatggtgtcaagagctcctgcctgactgttccaaggtctttccaatatattacactgcccctttaatgaaaaacagctaccactggtgtagacatagaaggacaggaagaagcctagaatagggtgtaaagtagtggcccttgatctatatcaggtcatagctacctctggaagtctggtagaagttacagatcctctcccagaaaaatgcacgcatgtactagtatgtactacggttgacatctagtgttggagaattagagcatccttttaaacacattcttgaacatcagattgcaaaaccttgaaaccgaagtcatagtagaccctgtgatcccagagcttacaactttgagtttcttgaatgacttttagaatagtggtatgacagtagaaccatcacaaggtttggtattatacaaacctggattagagcagcacctagcacatatgtaatattaaggaattacttaatttctcttaacttcagattcctatttctaacgtggcataatatcatctaatggagatatttggagttcaaacatgtaaataattttgagcccctgaatacatgcaaaagatacaaagttcccatccatctctatctacttccaaaaaaccctgatggattccttcagcatccagtcatccactctattcccaccttacaactaaactttagactccaggagggcagaaatcatgtctagattgctcacaataactacctctgagtatactgactggcacatgataggtgcttaatatatattgaacgaatgaattaaaataacaaaataatgagtccagtggatacacagtaacttccagagagggggcaggagcagtaaatagagcactaaccctggggaaacttcaaatattgcttttggccacagaccaaaggtgtttcagggcccagaaaaactaatgacttaggaactggcattcagagaagacaacctagaggaagatctccctgtttatctctgttcattgtttcattccccttcaccattgtcataggcctggtctcttcctacatgacaagccgaggagctgcagttacaccaaaaccaggtcaagtaagcctaaaacctaggaataagggaccaggtaggaagtaggaagaggcacaagttattagctcctacctgaccccgcctttgattctgcaggcactaccacttccacctggaagattagctgtgctcagtttctgagccagtcctaacagggaagagagtacagaagcagttttagtctcctctacaggtggagtcttgttgtcctgggttagaaggcacacgtgaggtgagcccccacatccttacataccagtggaggtgagccccaaacccttacataccaatggagtcagagttcccaagaatacctttcttggaattcaaggtcagtctgaacctaaacctggcaagccccaactcagacccttgccacctcttctcctagagcctgaaggatgcttccatgcctgaggtagtggtaataaacagaagggaggagaagcactatgtcaccacccacttaacttccaatactaactattgtttggaagttcttcctgacatgacaaaatccccttagaaagacacacacatttgtcagacatttctgggtcctgagcatccaagctgaatttaacacattccttataatccccttctttacccctttggtggctctatctttcaccagtttaaacaagccagaaacctagaaataatgcttgattcctctcttttcctcacctacaacattcaactaatcacagatcctgtgaattttaactcctagatatttcttgaatttttcaactcttttccatgttttctgctagtgtcataattgttagagaactccctaacaatattctctgacctttaatccatcctccacataacaacccaaattacttaatataaaatatttgaccctgttattcctttgtgtaaactcctacattgacatcccatcacaaccagaaaccaaaaaaacaaacgattctggcttctccgtgtccctgggctccttaggtatgtacattcgagaagatacacagtgactccttctctggcttaacagaaggagaataggaagtatgagctatcacaagttggaataggctattattgaaggtagtgagttctctgtgcctgaaagagtgtctgtagagcctgaataaccactcactgggatgctgtggaaaaactctgctcttggataagagacgggttatatgccatacgaaggaaaattctgtcctgaagagacttccaggggtttcaggatagcatgtaccttggggacaataacacctccctgctcctctcatcctccccacatggacatcagtaggaggaggccccacctcaaggaaagcagtttctcttctgaaaccagcctgacccatagccagcataaatgagatgttgttttggcatttcttcttcaggtcaatgtaatcagtgtagaaaatgtaaatgaataatttaggtttccagaaataaattaactggagccaagattgtcaaatgtggctgtctaccctgatcaaggtaaccaggtaaataccaaatctcactcccttttcctgcaacatagctttttaggcattccttactaagtgacgagaaagaaacaaagtcttcaggataacaaaaacaaacactttgcatttgtgtagctgtttagaaatgtaacatgctgttaaattatagttaccagttgagaatctaatgtgttccaggcaacatggcagctgctttttagacataatattttttaaatcacagacttttgagacaaatttattaggttcatattgcaagtctcaactctgcctctaattagctgtgtgattttaggcaagttatttagtctctttgcacctcagtttcctgatctttaaaatggacagagtaagggcgcacgctttaaaaggcaggataatacacacaaagaacttagctagtgccatatgtggcacatatacacattcagtaaatgttagctttggtttatattacccctgacaaataccctgaaaagtaagggttattttgcaaatgtgcagatgaagaaagaggctgagtgatatggaataatgttcttaatttggtaatgaattagtggtgtatctcggattcaaatgcgatctgtctgactctaaaacctctgtgttgagagagcagcatggttagttttactaatgtggctgttgtcaccatcaacaaaactaatagcattaataacaatgccctctcacttgggcacagcacttttgagtcttcaaagaaaatgtagacacattattaaagaattatcagcccttgggcctgtaaacaacttcatggaacctcatccacactttccatctcagggcagaagccatcctgtggtacccttgacaggtgatcatctgtccaagatgggtctcaccagttctaaaaggaaataagcagaaaggactactcttgagcagaacagatgtgggcagggcaaagactctatgatatgggaggctccagtattgagggagatctcagagatggaaacacacctatcagtcttcctgaacactttcaggccctcagactgcatggcagggggtgtcctggaggaggagggcttcctagttcttagcaagggtgagcctgaggtaagggcagccagatgagcctttacccacttagagataactgaaaagaaacaggagcccagagcaagatctaactccaagagaacctggacagttttctcacctttgcctgtaccttcatctgctattttgtttcccagctctgtgcctgtaggatgtaacagaaaatcctaaaatacaggaaggcccatagccttgtttaatggggcaaagatgtggggaaggacctggaaagactgaatcagcctcctcaactagactaatggcaggaaactcagggaagtaagggcaggagaacagtcacaaagaaaatggaggcaggttagattctgatgcaagtctgagagaagacaaactagagcttcagacacaatattgcactgccctagaggcataaggataaagccctccctaccagtgaatatttccatgatcctattaggttcctacagcaacacagaggtagtcagtgaaaggattcgggcagcatagagagcaaacattttgaagtcagacggatctgggtacaaatcctgattctaacagttgctagctatgtgagttcaaccaagttagtgaacccaagccctggtttcttcccatgtttcagagaataataatcgcaacctatttttaattataaagaggaaatgatcacatgaattaagataaaagtagagcctagctcatggtgtgctatggtctgaacgtttgtgtccccttccctctccaaattcctatcctggagcctaaatccccaatgtattgttatttggaggtagagtctttgggaggtaatgaaatcataagggtggagccctcatgaatgggattagtgcctttaaaaggaaccaaaaagactagagttctctctgtcatgtgaggatacagcaagaagtcagcaatatgcaatctggaagacagctcttaaaagaagccaactattttggcacccttacctcagacttccagcctcttgaactgtgagtaaaaaattccggtttttaataaaccacctagtctatggtactttgtcatagcagccaacactgaccaagacatagtatgtgggagaaaattgttcctttttgttgacattcaaagagcataagactcccaatcagaaaaccaaggtcacgctcctaggaactttacacattttctgtccttaggccttggttttcttagctgggaaaatagggtgttagaagacttatatttcagggtctctctgggtccaaactttgtttcaactgcctgtagtgcaagtatcatgaattggagaaacagatagactcccagccatctgtttttcctccatccctgtgaaatggcagcctggaccaacaatatcaagattgagtaatattctgctgacctagttagaaaaagttaagaaacttttaaatacatatgaatattattgaatgaaaaagagaaggctgattcaaatggttgcagtgcatattaatatcttattatccactttaatgtaggaaagatactggaaacctctatttaatcttcttagcaaaataattgtcttttaatgccaaggtatggtaaataagccagaaaaaatcaaatgatagtgcaggatgaagttaaataatttagaaaacaagaatccagaattcaataaattattccaatccaagatgctatcaagaaaaaaaggtagaattcttaggttccattttctgaaataatatctcggtgggaaggcaaatgaggaacccgaatattcctagcagtttctccttttaaaagagatataaattaatagatttgacaaacatttttttgagaacctactgagcattcatcagtcatacctacctctttgtagccacaaagaggaataaaatcccaaacacttctcttgaagacttctctggctaatgggggagacccacatccaggactgctataatgatagcttatctagcagtaatgagttggagctcgttccttgataaactgtagaatgcctctctcagcccctgtaaccttctcctcaattcctattgacatgtgaacttactcttcttggcaaaatagatgggtccatctggaagaattgatttatttaagacacatacaaatgtctttctgagaaataggtattaataaggtgtatattactattcatgtatatgttgtggaatacctactgtgtaccagcactatgctaggctctttgctagtcactcatttaattttcctaacaattcctaacaattatgaacaattccaaattacaaatgaggcaactggggatcaaagagtttaatgaacttgtccagagataaatgttgaaaacagtgcaagcagcactaaaaatcaagtccttcttaaataaaagcccttggtcttttcattaagccatattgaaagcatagtaaaagggttacaacattgaaatggagaatctatgttgaccatggacctgagtcaacaagagaaaagctctgcctacttacctggtcatccttacttttaacttaggaatggagaagggctcaggccatcttgggagcaggaaggtatgctgagagtatgttctaccttgaggcctggaggccccatgaaatcaggacaaggtttagatgaaaaaagccaagactgtgtcaaggttcaggtctgggccagcaactaatgaggcaggctcagttagtatgggtatctttaaggtcctagaatcagggggtactggagatccagcagctcattcaggctttggtattatccagctgtgtgaattgagtgagtcccttgccctcaatttcaatttctaaaattggaataggcccaagagtaagttgggccaaatgatttattcagatctcctatctccaaaatactatgattttaagatttcaaatatggactttaccaataaaagccacaataatcattatttgttgagcactcttaatatgacagcactctactatattaactctaattgcaacctcatgacaacattgcaaagttgtatttattatccttgtttagaaggtgagaagccctggaatccaaaaggtcagctacaggtaacttatccatcgccattaacttttcacatataatttattcatagccaccaatattataaatggcagaatcccaaactgtctaacatctaaaactgtacccttcttatgtatgccttcttcctttgcctacctctgccctctaattaaaacatgtgaggacattacctcaatgatttttcaatggcatcaggttttcttaatagctttaatctgaaagaagtgtcctgagaaactaagttcagtctcccacttgcttaagcaggaggctgttgtacctttcactttgagaggtaaatgctagtaactgagagcaattggcaaggtatctgcagctgaccaagatatagggtcaatcaagaagatgaagaaaagttaatgcttagataattaattttgataagttgagtttactaacaaaaagaaattacagataatcatagatagtgtatcttccttagttcccagcccatttttcatatggttggctcaagatatatatttaatggattaatatggtttatctttcctcctcgcactctcaaacatccttctccacagacttcagccaatcctgaacatgacagggagaatcatttaactttctagatgtctttccaatctttactctttaccacatctccaatatgccatgctctcacccattatataccctgtaagatagagttcaaacgttacttccccatagcaattctttctgattccccagccaggttttcatgttcctttctcattcctcatcagtcatctactccttaatttcttctatacaagtattttacttattagtagggtaatcttggacaagttacttaacctttctgtgcctcagtttccccatcttcaaagtggggaaaataatagtaccagcttcataaagttgctgaaggtttgactgagaaaataaataacctattatcatgtttgacatgtagtaagcactctataaatgttagctggtttaatttttatatgacaaattgtatgccttcggggagcttggagtctaagggagatatggtattacaaatgcgttatatccaagaacttacaaacaattcaatttcacttctgttatccaatatctactagaagcctcttgtcatcacagaaacccttaagctaagtcacaatgtctagtttgctggtgactctagagaggttatttgagatagccaaaattcaaatccccatatggctccagccttgatgatcgttctacttacattttaactaatagggggtttctctggatatctatcggggtagagggtagggtgctaatgtatgaggaaaagaggcacgaagagtttgagtaactggcccaaagttacacagtgaataagtggcagagttaaggttctaacctatgtagcccacactatactaacttatgcacctaatttctttcttactgccttgaacgtactcagttaatgtttgcagagagtggataaacaaacaagaaaaccttgcaaacaggtctggaagaggagtgagttgcagtggacagaggctaatctagaagtcagcagctgcgtttccaactaaacttgtcccactaattcgctgggtgactcaggaaagttatctcccttctctggaccctctgtctccagcacagaaagagagagaggcctttaaacagtagcagttaagtcttttcttcaaactaagtttatggagaaggccaataaacaggatgttccagtgtatttggcagaaaggacaagagaagtcagagccctcactcctcctcagggatatggggagcacagttttaaaactctagaaccagaagaacttgggattcttcttggctatgacattctattacacagataaaagaaattgccttgtgacctaatgttatatatcttctgattcaaccaagtgaaaatgtggcttcagaggaggtgacaaagtgtgaccatacccaaaggtaataagaaggaattacagctccaacagcctgacttctgcacctgcctcagtcatagacatgccctaaatacaaaaatatctcacaaacctgagaaaattgcattcatagtataaatatatttaatgaaaaaataataagtgggctgtggagtttccggatttattattttcataaccatctttgctttctgtaatctctagactgattaataaaatcttgctaaaagaggttcatatttggcatttgctcagagaatgggagttttttcaactttattgaagcattttttacatgtaatatgtcatctatttcaagtgtgcaatttaatgatttttagtaaatttaccaagtgtgcctctactaccacaaatcagttttaggacattgtcattgcccccataagatctggcttgggatggttttgtatatttatatctatatgagattcttggaaaaactcaggttcaaaagaaatagattgcataaaaattgagctctagtttacatagtctaatatcctaccattttcctgtatgtacagagtccactgccctagaagaagaaagggagaaagttgtctcagctcttgtttgttctttcaaggcatttaaaataatatacattacattaaatttattgagctttcccactgtcgggccaaaaaagaactctgaaagcaaatcaggcacagttactaagctcaaggagcaaccaatttagaaaaagaaatttgatatacacaacagagtcataaaatagggcaggaaataccaggagtctacagaaagtaagagaaattgctgatgagttcacttatagctgaggggaatcaaggataatttttagagaaagggcatttgcactgggccaaatttcatctaattctgtcatttactgatgcagttagtcaatatacagtcactgagaaccactttagaattcacatctgtgcttgaattaggcatggtccctgtcctcacacaatgcacagtcaaacataatgactttatttcagcagctcaccagatatcctgaatatttctattatgaacttaaatggtgcagaatttttgtttgttcttgcatttctcttccctatttgattatgagctcataaaaataagaaccacttctgaagcacatctatgtccttggttcccagtatttcctatctcattacatgtgattcataaatatttgtttaatgaataatttgttcatttaatttttcccctttatatcaactgatggttcacttactggttttgggggaggggacagtaaaggggagaaggcaaattatttaattccaataaaattgattgtgttttcttgtatttgtaatgagggcccaacagaggacttaagtcaaaagagtcaatgaaataggctgtgtataaagaggctttttacagcagagattaactttcagaatggtggtagaaggagcacagcataccttcttcccagcaaaacaaccgtttaactgctaatttttttttcttttttgagacggagtttcactcttgttgcccatgctggagtgcaatggcgtgatctcggctcactacaacctccgcctcccaggttcaagcgattctcctgcctaagcttcccgagtagctgagattacaggtgtgtgccatgacacacagctaatttttttgtattattagtagagacggagtttcactatgttggccaggctagtctcaaactcctgacctcaggtgatccacctgcctcagcccctcaaagtactgggattataggcatgagccaccgtgcccagcctaaaaattatttttaaaaacaatcatttgaagtcatttaaagccatttgaaccatgacctgctcaaattcccaccctctaactcagtgggatggaagctgtactccaagagtatgccatcaagaatattagttccctctctacctacttcctagtctatagctatgatttcaccttgggaggggcaggccacaagcacctctcacatagcccccatccccattctatattgaagaagctctattcaaggtggatgctgctaagaaataagtcttccttcccccaccagaccttactcatagaatgaaaactctaaaccaggcatggtagaccaagagtattagaagccaaatgccctcggcccagctaatttgcaggacagaggtttcaggccaagatgggcaagacaagaagaccaggggctactgtccctacccagagcctagctcatagagcaggggtgacactctaggagaagtgggcactgtccctgcccccagttctagggcagtggcatagaggttctgttcagggagaatggcaagcaataagaacaaataactccacaacactgcataaggggattgagttcatttggaacagcttgtagtgaaatttatgccaaagggtaatgtcaaaaacaacagagatcctagtgtggcaagcaaataaaaggaagctggtcactacatgagatttatagcaacaagtaaaacaacagactagctagaaggttagaataaagaattagggaggaaagatagctaagaaggacacttcagggggcagagcagcctgaaagactagcaataccttgcccctgcaaaaggggtctatattaactggatcagactgtgaaacaattattgcccctagagaaaacagaacaatcagctagcgattaatacagggtaatagcttgatgtgataccaatagaggaagaccagcccagatgctcaagtatgcccaaggcagttaatgaaaaataattatacatccaataagttcaccaaacttgaagtaggataaactcatggagatccacaatcaggcacatcatagtcaaaatgatgaaagcttagcacaaagagaatatattgaaaccagcaagagaaaagtgattcatcacctactagggaattccaataagattaatagctgacttgtcagcagaaacaatagagggctgaagaaagtgagatgacgtattcaaagtgctgaaagaacaaatctgtcaatatgattccatcaggccaggactactttgatacccaaactagacaaagacattgccaaagaaaacccctgaatatcaatatctcttgtgaatataaacacaaaaatcctcaacaaaatcctacctgactgaatccagcaacatataaaaaggattatgtactgtgaccaaatgggatttatcccatgaatgcaaggttggtttaatatctgaaaatcaatcaacataatatacaattttaataaaataaaggacaataaccacatgatcatttcaatagacacagaaaaatcatttgatacaatccaacaccctttcatgataaaaatactcaacaaactagaagaagaagaaaacttactcaacatgataaagggcatctataaaaagctccaaagctaatgtcatatttaatggtgaaagactggatgctttacctctaagataaggaacaaggcaaagaagtctgctcttgccacttctatttaacattcaactaaactatccataatggcccaggtaattaggtgagaaaagaaacagaagaatgaaataaaaggaagaagtaaaaatatatctacttgcagatgatatgatcttgtgttttaatcttaaggaatctaataaaaaacaattagaaataataaatgggttcagaaaggttgcagaatgaaaatgcaaagctaaatttgtatttaagtccaaaacaaaattaagaaaacaagcttatttacaatagcctcaaaaggataaaatatgtagaaatgaatttaacaaaataagtacaaaccttgcttatactgaaatctataaaatatttttgaaagacattaaagaagatctaaataaaaacatcccacattcatgcatcagaaaattaaatattgttgatatggcaatattctccacactaatttacaggttcagtgcaataactatcaaaatctcatctggcttttttgtagaaattgataaggtgatcctaaaattcacataaaaatgcatggcaccatgtatagccaaaacaatcttgaagaagaaaaagttggagagctgacatttaatgatttcaaaacttactacaaaggtacagtaatgaagacagtattgtactggcacaaggatagacatatagatcaatagaatgtaactgaaagtccagaaataaactcttacatgtatagtcaactgatttttgacaagggtaccaagacaataaagtgggggaaagaacaattttttcaataaatagttatgggacaggcataaattggaacattttcttacaccatctgctaaaactaacttaaaatgaatcataaacatcaatggaagagcgaaaattataaagctcttagaagaaaacataggagtaaatctttgtgacctttggccaggcaattgctttttagatacatgctatggactgaatatttgtgtcctctcaaaatttgtatgctgaaatcctaatccccaatgtgatgctattaggaggtggggcctttgagaggtaattaggtcactgtgggtggaaccttcacgaatgggtttaatgctcttatgaaaacacactagagaccacgatttctctgtctctgctctctgccatgtggatataacaagacagccgactgaaaaccaggaagtgggccctcaacagacactggatctgccagcaacttgattttggacttttagcctccaaaagtgtgagaaatacatttctgttgtttaagccaggggtccccaaccaggatactggtccctggtatgttaggaaccaggtcacagagcaggaggtgagtggcaggccagagagcattaccagctgacctctgtctcctgtcagatcagtggtggcattagattctcaaaggagtgcgaaccctattgtgaactgtgaaaggaagggatctaggttgtgtgctccttatgaggatctaactaatgcctgataatatgaggtagaagtttcatcccgaaaccacccccaccatgctggtcagtggaaaatgtctcttccacaaaactagtccctggtgccaaaaaggttggggaccgttggtttaagccacctagtctatggtatttttgttttagcagccctgattaagtagaggcaaaaaaaaaaaaaaaaaggaaaaaaagaaaaaaaatggatcaatcggacttcatcaaaatttaaaaattttatgctataaatgataccatcaagaaagtgaaaagaggctgagtgacggagtgtgaatggagaaagggaagatgttggtcaaagggtacaaagtttcagttagatagcagaaataaatcttggtggtctgttgcatagcatggtgataatagttaataaaaatgtattacatatttcaaattgctaaaagagtagattttctgtttctttgtcttttgaaacagtttcactttgtcacccaggctggagtgcagtgcagcaatgacacctcactacagccttgacctcccaggctcaagcaattctcctgcctcagccctccaagtagctgggactacaggtacacaacaccgtgcctggctaaattttgtattttttgtagagatgggattttgccatgttttaaatgttctcaccaccaagaagggtagattttaaatgttctcaccacaaagaaatgataactatgtgaggtgatggatatgcaaaatagcctgatttgatcattgtatctcataaatatatacaattactatttgtcaattaaaaataaaaagagaacgtgaaaagacaacctacaagatgggagaacatatttgtaaaccatatatctgaaaagggactgggatccagaatatacgaataactcctacaattcaataataaaaacacaaaaaataatctcagtttaagaatgggcaaaggatctgaatagcctttcttcaaaaaaagatatatagatggccaataagcacacaaaaagatactcaacatcattagtcataagggggaaaaggaagttctctggcagtggtgtagaggttagatttcataggagagactagagacagagcatcagttccttctataaagacccatctgacatcatacaatccttacgcatagagcagtatataagacagatatggtccttgtcctcatggagtttaaaaatcttctaaagaaaaatgttgaatgagtagtcagaagagtgataagtctgttaaaagagaaatagaatatattacagaagtacacaacaaaggctcttcaactagtctgagaaagggtacaagaaagaattccatgaagaaaaaaatgtttacattggcttctgcaagcagaataggaagtaattaggcaaatggcaatagagaaagaacattccaggtagatgggccaatgtgtatacaagttagggagaaaatccatggtcacagaaagaactgtaagaaggccagtgtgggtagaccataggcagcaagggaagtgggatagagataggttgaagaatcaggcagagaccagatgatccaggaccttgcagaccatgttaagaatttgatatttcatcatatactacagagtggatgttcaatgggttattttcatggatagcgaaatcattgaatatggtagcagtggtgtagtagaaaagacaagtatggatcaaactcctccatgattcatagaaatgtccaagatgtcagtagaagagaatgacaaggagtggcagggggttgtataggctgatgccataaaattcaaaacatgtcttttcatataatctctttttataagggaggggaaataatgatctcaaagcagcaatcttccaacctagctgaggtggtgttcagtgaagaggttacactgtatttggtcaggcatcacaggatcagtgaagaggtggcacatggttaggagaactgggacattctggtagccattgcaatgctgagatatctgtgtgagcaggatagtgagcctggaaacctgttcacctcatatgttgtaacccttggctaaagaagctgttgtgatttcctgggacatgctgatagtttgaagtatggctatggcagcagagatgaggaagggacagattctatggatactgagttgtagccttgatcatacttggtggtagtatatgagaataacttaaaagaagaagttaaataggacaactttctcatgggcagctggagtgatggcgatgcattctctgaactagggaacccaggaatgcagcaggtgtgtggtagtctcggttggcttctatagcttcaggtaaatcagacatatgcctcctttatctagcagagggaggacccagggtcacaattcccagcacctttgttcccaggcccttattcatccagggttaaggtttggaatggatgggtcttttgaatcagcagggtgaactggaagaccctcagctagatactgagatgacatatctgcctccaattaagttggactccttttgaaggcagtaacaaaaattatgccaagagaatggtgacttgtgaagtggcctgctggaagggagccaaaaccactacacttgtttaatttagagtgtctgatcaggacatggtttggtgcagatgggagcccacggaactctactgagaggtggattaggggctgataattgatattactaacttccaaaaattattcaatttaaaattcatccaaaaagatgtaattacttttcatatgtttgcttggtcatgtatccagttgcaactatatcaaggcggaaaaagaagaaagcgggaaggaacagaaagaacagaaggagactagcttattttgaagttaccgtgctggtcagaactgtgctggccctctccaccctgttttctgtggaattgccttctgctccttgactttcctgcccacaaggtcatcagtcctctctcacctcctttccgacatccttgcttttccacaagagtcacacaaggactgtagtagaatctgccaaactctgtatcttcaactcttccagatatctttacatttgctcaatctgctcctcttcctccttatcctggctctctggctttctgtgattatatcatgttctccattctctttcctctggtttcatgattcagcttcctttttccttttctttttttttttttttacttctcagatttttagtttggtttggattctgaagatctttcaagacagggctttcagaatcttccctatgctacctaaccattctcactgtgacttcaggtaaaaggcatcctagtcccaccctacccctgatctgggagccaaaagattgcagaactgggccaatcccatgacaaggggttggagttccagtgttgattcctatcacccaggggccttattgtagagtcctacctaacatgatccttccccagcaagcactcctttatctaaattttgccctttgccatctggttctttctcattcatcataccattaaactaaccatcagacaaaatgttgtacgtgatccttatggacaagatggagaaatggggacagggattatatcttgtttatttctaaatctctcatagtacacaacacataagagatactaaaaatttgaactaaaatgaatttgattggattaatttggaggaaagtaaaatcttgtttcacatacatgacttatattactggggttagcagcataaccaaacccagagattgatataaaactgatgtaaaaatgccaatctagggtgaagtctccagtaatatgcctaggtctctgttcttagcctcaggtcttgtcctgttaaacacttgcattcctgacttaaattaatactttaaaagtattgatatggtttggctctgtgtccctacccaactctcacctggaattgtagttcccataatccccatgtgttgtgggagggacccagtaggaggtagtttaatcatgggggtggctacccttatgctgttctcctgatagagagtgagttcttacgaggtgtgatggttttataaggggctttccctccttttgctgagcacttctccttgctgacaccatgtgaagaaggatgtgcttccccttctaccatgactgtaagtttcctgaggcctaccagtcatgctgaagtgtgagtcaattaaacctctttcccttataaattacccagtcttgggtatgtctttattatcagcgtgaaaatgggctaatacaagtatgtacgctaaaatttctgagtgaaattactaagcctgtagataagagtatccaagaatcaaaattattacaacagactggaataaaggactaaaatcaacaagttgtattgtatcagggtaagtgtagaggctttattttaaaatctaccataagctaatatggtattctgaagaatcctggaatagaaaaatattagtggaaaaactggtgaaatctgaatacagttctgtgttttagttactagtaatgaaccaatgttaatttcttactttggacacatcctccatgattgtgtaagatattaacattagaggaaactgggtgaaggtgttaccagtggaaggtatccaagtcacgcaggtctactgcaacctcaattcttgcctcctcagaagaaagaatttgattgaggggcataaggcagaaggagagaccaaggccagatttagagaatgaaagtttattaaaaagttttagagcaggaatgaaaggaagaaaagaaagtacacttggaggagccaagagggtgacttgaaagacaagtgcatgatttggctttctgactcagggttttatatgttgacatacttctggggtcttgcattacttttctcctgattcttccctggtgggctgtctgcatgtgcatgcttgagcccactcacccacctcctgagatcttactggaaagctgttgattaccagtttcaggtgttttctattaggagactgcctttccctggcaccagctgtgaccaattattactttagagagacaattaacaacagcctgactatcacctgattgtcacctgacactcctggggtgtgtgtgtgtgtgtgtgtaggtggggagctctctcctgccctgctcatgcctgactagctacctactgttacaaagggcatatgaacaatttctatattatctctccaactttctataaacctaaacttatttcaaaataagaggtttatgcatgttgtcacttacaaatgaccgctaaacactggggtctcatggatataaagatggcaacaatagaaactggggactagtagatgggaggagggagtggggcaaggtttgaaaaactaactattggatactatgctcagtacctggatgatgccatcaattgtactccaaacctcagcatcatgcaatatacccagggaacaaacctgcatatgtacctcctgaatctaaaaaaacattgaaaaaaaaacagaaataaatttaaatcaattttttaaataagaggtttattaaaaagagaatatcagataaataaaaatatatttatttaaagaacagcaacaaaaaaatctactatagagaggcctgcctgcccaaagaagctaatgtaaattctgacttcatttctagagatctaacatccagagcaagataaggcaatagtcctattctgctgtacatgcttagattccctgtgtagttttatattcagtgctagcattttaagaagaaaataacaacctagatcatgtccaaagaagaacaacaaagaaggtaaaaagtttgacaccatggagtataaagaaatgttgaattctctgggggtaggagaaaagagagattagtttggagaagagaagactcatcaagggcatgtagtcagtgtcttgatatgattgtcttatttatttatttattttaagacagagtctccctctattgccaggctggaaagcagtggcacaattgtagcccaacaaaaccttgaactcctgggctcaagcaatctctctgcctcagagaagctgggtctacaggcacacaccaccatgctcagctaattttttttttttttttttgtagtaatgaggtctccctatattgcccaggctggtcttgaactcttggcctcaagcaatgctctcagtttttcagccttgtcttggtatctttataggcctgactatgagctaaaagagcaagaacttgcaaggtaggcccagagggtggggctagaatcaaagagaggaagtcacagggagggagctcttttgaggatagtgggtctttcttgtcactgggatggagcacggctgctgaagaggtgtgtgagccgagactgaaaagtgaagtttctcgaacgttaaaagaagatgcacatgtaccctaaaacttaaagtataataataaaaaaagaaaaaagaagatgctggtttttacagtttaggtctttgtccacaggagatgattaatatatttgctaagtttgaatgaaatccctataatctttggcagctctagagattcttttgaagtgttaagatcagagaggccaatttcttaaggttttcttatgtcattcctattattatatatgtagtcttcgtggttttcctcctggtactcttggctaacaaagatctttgcctgtgggaaggaaagccagctagacagcgtcttcttatcaggaaggtaagctgccaccagcaggggaggcttagagatgtaagggttaagggtcacaatgatcatactgcctcttgcttggttcctagcttccctcaggatacagtccaaattctttaattcggcattcaaggccctcctcacttggcttctacttatttctcctgcatcctctgtcaccacccttcctatttttcttaggctgaccctgtgcttttatcacaaggagccatgcaacactgtcaggacacaccatagcatctcagcctctttacacatgtttgatactcaagtaaagatgcctccttccttaagacttcgttcactcccttgtgccccttctctgcccactacttgtattataccagatcttacctttttattcatttttacatctatgtcacccattatattgtgtacttttcagggacagaatgtgttttgtgttaatcttctctccccagcatccaacatagagcctggcaggcagaagatgctcactagatatttgtagtgttaaagaacagctttgcaaggattcactaaataattataaagttcacatagacttggcttcaaactccagttgcattatgtagacaaattacttaatctcattaaatctccatcttaaaaatgcaaatgggagaagacaatacttacatatctcagaatttaagtgctaccttctaaatgaaatcttactccccaaactgatcctctttcctgatttaattactccaatattgtctgtctcttcctaccataatgtaagtctcatgaagacatgaatctgttttcactgctgaatcctcagagtctagataatgctagttacatggtaggtatttaataataataatactcacataatattcttctgaccaatcttgaggctatacatatgcacataggcaacacaatatgaaagggaaagtaaagcagacttgaaaactgtccaaagtttgaacatacttccctactcacacacagatccaccagcagaagatagaagccttactggcttagggtggctgaacataacctcagcccaatagtagcttacctttaacctgcataaacacagggttgattccctgggaattaaggcttaaaataggaaagaaaaaacaaaactatataaaactcaacaataagaaaacaaacaacccaaataaaaatgagccaaagaccttaacagatactttacaaaagaagatatacaaatggaaaataagcatatgagaagatgctttacatcatatgtcacttgggaaatgcaaatcgaaacaacaatgagatacagtacacacctattagaatggccaaaatcaagaacactgacaacactacatgctggcaaggatgtggagcacaggtactcgcattcattgctaactgggaatgtaaaatggtacagccactttggaagacagtttggtgatttcttacaaaactaagcctactcttaccatacaatccagcaactggactccttggaatttacccaaaggagctgaaaatgtatgcccacatgaaaacctgaatgctgatgtttacagcagctttatcataactgccaaaacctaaaagcaactaagatatccttcaataggtagataagtaaactgtattatatccagacaatggactcttattcagtgctaaaaaatgagctatcatgtcatgaaaagatatggagtaaacttaagtgcatgtcacgaagcgaaagaagccaatctgaaaaggctatacaaatttcaactatatggcattctagaaaagacaaaactatggggacattaaaaagatcagtggttgacaggggttatgggaagggaaggatgaataggtgaggtacagatgatttttggaacaatgaaactaatctgtatatattaaaatggtggacacaggccattataaatttgtccacacccatagaatgtacaacacccagagtgaactctaaggtaaatgatggaatctgggtgttaatgatgtgtcaacgtaagttcatcaattgtaacaaatgtagcactctggtgaaagattgttaataacaggagaggctatgcatgtgtaggggaaggaagtatattgagaaatttctgtaccttcctctcaattttgctgtgaaactaaaaccgttctaaaaaagaaaagagtatattaaaaacaaacaaacaacaaacaaactgagcagaggcatcagagaaagttgccaagataattcctgagtaaagattagtcttttcaacaagcggtgctggaaaaatttgttatcatgtgcaaataaatgaacttcggcccttactttattccacataaaaaactaactcacaatgaactatacacttaaatgtaggctacatatataaatatttcagaagaataacataaaagcaaatcattgtggccttctgttagacaagagttcttagatatgagaagatgctccacagcatatgtcttctggaaattaaaactgaaacaacaatgaaatacaattacacacttattagattggccaaaatcaaaaacactgacaacactaaatgctggcaaggatttggtgcacaggtactgccattcataatagcaccaaaagcataatccattaaaaatttgataaattggacttcaaatttaaagtttttattcttcaaaagatagattaagagaatgagtgaaaagacaggcatggtttggaggaaaatatttgcaaaacatatatctgacaaaagacttgtgttagaatatataaagaactcttaaaactcttatgagaacccagttttaaaaatgggcaaatgatttgaactgacacttcaccaaagaagatttatgaatggcaagtaagcacatgagaaaatgatcaatataattagtcataagggcaatacaaattaaaaccataaggagatatacccactaaaaggctataataaaaattacagataattctaagtgttggctagcatctgggaaaactgtaaccctcctacatggctgataaggatataaaatgacactactatttggaacacagtttgacagtttatcttttaaaagttgaacaataacatatttcctaatgatttcactccaagaaaaatgtattcatatgtccactcaaagataagtacatgaatgatcatagcagcattattcataataagtccaaaccgaaatccatccaaatgtccttgaactggagaataggtaaacaaaatgtggtatacctttcaatggaatactattcagtactaaaaatgaactactgatacatgctataatatttttgaggttcatccatattacggtgctaagtgaaaaatgcaagacgcataagattctgttttgaaatgttcagaaatggcaaatttatggtgtcagcagatcggcagttacctgcgactgggactggaagtgagaattaacaagggaactttttgagatgatggaaatgttctaaaatcaaattgtggtaatagttacacaactctataaaaatcataaggtactaaaaatcataaaattatccccttacaatgcataaattttatacactgcaaattatacctcaataaagctattaaaacaatagtaaaaatatctttctcatgatgtccttatcttaaatggcagatcacggttttaaatacatgttcaaaggggttttgttcagtaggtttaaaaggggctactggtaacaaaataaaatgcattcttggatgatataattagtaccagtaacaactatggccatagtgattgatagttctagcactaaaaattcaaaatcttccttcctgcctgctctccctgagatctagatgctggcatgtttagccttcccacttgtaattatcctcccttcgaattggaataaggattaactaattatactgatgccttcagacacaagccatatcaaataccctggtaactgagaatcaacttgtctgcaaaagtatgccagaaagccttaaaatctctagtaccttcatcaaggtccagaacagaggattgagccaacccacagagcttccctgatctagtccagatggcacaggtacaccctgtacttccattaaatttactttcttaaaatgctgctttggataaggtaaatccctttctcaaaaatctttttgggtgttaaactgtccatcaaagggccaggacatggtgttagaaaccatggttttaaatcttggccctgatatgaactagtcatgtggtcttaacgaagaaacttattttttatcctcagattatttacccccaaactgggacagttctgcctactctacaaaactattgtgagaaaaaaaccaaatagtctatataaagtaagaaacccggtatgtgtgttgtgttgaatctgaataaaggatgcagccaatatgaaaatcagggctttccagagttttgcccgaatcttcttgtctagcctaatcttccagtagccccatgaatttcctattccaatcacaccagacttctaaccaactaccaccatcaggcaatggctctggcttttcttgctttctgggctaccttattatcaactctgtattctgtaatcccacccatctttcaagatggcttaaaagcaaaatcttagcttttaaagacattctccatgatgtttatttttattattaacttcttaaaaaactcattctatccttaattatatatgttttaaagtatcagagctattttgagatgtcctttttcccctggtacagaatatacttctggaagtatatcaagacttgtatatataccttgtatatatacaagtacacagtgcctctcacaggctctgaagtaggacaggagtttcaaactattactttttccaactgaggaattcctcgaggataatttgaaaacttttattcaagtctaattttctgactttataggtgaaaaaaattatccccagaaagggaacatagaattcaaggtaatacaagtagtttcatgttagagctgaaagcagaattcagatatcctgtggcagcgactttaagctgtccctcaatatcaattctcccacatagttagaggaccaccaatttttagctaaaacttggctactcagaacaaagacttcatttcttttccttcctttagttaaatgtggatgagttctagtaaatgacagtgccacagaactgcttcttctttctccaccgtctccttcatcctgctgcatggaatacagatacgatggtagaattccatattgaatcatgaggttgagggccacatcccaaggatgacagagaagaaagctagaagaacctgactctttgaggctttcaaggagtagagtcataaaattagttgtggattgcctacatttagacttttacattgaaaagaaataaacgtctatcatgtttaagttgtaattttatatatgttattttgaatatctattattgaaagcttaactgatcctattgtttttcttattagctttttattgttttcagctcttcacactgcttccagacatgttcttaattcattttttcattgtttcaatcattcactcaataaacattcattgtgcacctacattctgcctagtcataaatctaagagaaggttggggtgggcacaggagtgaaatgtacagatcctgccttaaatgttatgagtaatgaatgaacttcccattctcttaaaaaagatcgcaattcatatgtctggtaaatattcatctcagaatttttctgacaattccttctcaaataagctcactgttcagtaatatactgttaattggaccaggtgcacttaatgtattatatttgttcctctgcatccactctccacctttctatatctttttattttccctgggaggatgatctgtatgaatcacataaatgggctcctttgttctctggattctggttgtgttggccaatatggactcctagaaggagatcagatgtaagtaagagaatgaggtctgtatatttatttttctcaccactctctatgggattatcttaggctaactgtgtaccttaactgaaggtcaccaattctttctgagatgacccactaaatgactctctactattgtgttctgttaaccttccttccctttattccctttgagctgttattagccctagagaatttcactgtactttgtcattgcatacattgcccacaccttgtaaataacccatttattaaaccttccttaaattatcctaatttgaggctgccatctgtttcctgctagcatgctgactcatataccatgtataccaattatcaattcaaaatatataggcaacagatacaaatgggaagataccatgagaagcactgttgggaagaaggttggagtagagaaaagatatttagctatgaaatcatagtgcacacagaatctcagactacaagaataacatgaccagatttgtctctcagtacctgagttgcacataggccctctttactgctctcttttttgaggtatcctggatttatttagaaatgcgtctcacttttatgtgaaactcacagtcactaggctgagtccatttaactagcaacacatatcagaaccccaagtaaagtatcttctgccaatttcaccagtatcctcatttagaatgtttagagcctgtccaataagcctcttttaggggcacaatccacactttttgaagagtaaaacataaaaccaaattagcacctgcttattctttattagcaaccaaagtattgctgacaacaaagagtaaaacctatgaatccactatgaagaacaacttcagatcctagtttgggcacaagaggaagagagggaagtaggaagaggcagggtacggtggctcacatctgtaatcccagcactttgggaggccgaggcgggtggatcgcctgaggtcaggagtttgagaccagcctggccaacatggtgaaacactgtctaataaaaatacaaaaattagctgggtgtggtggctgtaatcccagctactcgggaggctgaggcaggagaattgcttgaacctgggaggcagaggttgcagtgagctgtgagccaagatcttgccactgcactccagcctgggtgacagagcaagactccatctcaaaaaaaaaaaggaagtaggaagatgtggtaggcaaaatgatgcaacactccccaacccaagatgtctaactcctaatccccagaacctgtcactgtgttacctcacataacaaacgggacttcacagatatgattaagataaagatcttgctatatggagattaacctggattatctgggtaaatccactgtaagcacagggatccttataagtgaaagagagctcatatcaaagtgatacagcatgaaaaagactcaaccagccactgatagctctcaagatggaagggaactacaaactaagaaatgcaagcagcctctagaagctggaaaaggcagggaaataaattctcccttaaagcctccaaaagaaatgcagatctgctgataccttgactttaacctagtgagactcattttgtatttctagcccctggaattataagataataattttgtgttgttttgtactaccatatttgtggtagtttgtcacatcagcaatagggaacaattatggaataggagactgaaatctctagacccaggaaactaaacctggagcaggaaaaaacagtcaggaactgatggatgacagagacagggcacattgtggccatcacaaccaaactgcacaccacttgctaacctgtactgcaggcaagtttggttcactaagaaatgtattcttcctatcagaggctcacagtaataaaatgctttcataccttttgtaacacctagcaaaagtctccttttctctcagaggttttgggattcacttaaattttgtattttgctagagagctttatcagcttcattcagaaaaacaaccatctgtctcatatcttattctgtgacttcctggtgcccacagtcgcaataaatcacacaataaaaacaatactttaaagaattgttaaattaatactaattatataattgtttaattgtagttagtaaattattaaaagttctggaaagcaccagtattcattatttgcattgcataaaaacccgtgttaagtccctatcccaagtttgcctgtttccaaatgagtaacccaaacctggcacaggccttaccacactctggcccagctgctcccgaaagaagtaatccatgtttctcttttgcaggctgtcaaggtaatgttggaagcgagtgtatgtatatgggtagcagtaagcaaactggtaaatatcttcttctcggtcaaaacaaaaggcaaaggacatcacatagttcttcctatggtccgggcagcggtagtagtaaacatttttgggtggcagcctttgcctaaaatatataaacaaagaaatttgggcatatgagacattcgttcaagcttcaaaaggtaatacatataaatcaatgcctggagaaaaactgtaacatcaagaaccatgggtgatggggctgggagaatgacaacacaaaccacatattgtttaaaacagacctgaatctggcagctctttgctcacaatccagtgccaccctttctcaactgtctggaaaatgcaaagttaaacaaaaatagacacattctattcacttgtttatccttattttgagcacttaacatatgtggcatcaaatgcccaggccttgatgtacaataataaataagacaaggaagatctctgtcctcatggataatagtggggaagcggtcagtaaaatattaaaaataagtagacaatataattacagattctaaaagtgccttgaaggtaaataaagactgtgatgctatagagatataaatgggagaggcctacttttcctggggaagtcaagttttttaaattataagactaattaagaacttttaaaataaactcatatgcattgtatatattcaaggaaagggaaatattcaacatttctctaaattattactattattttctacagagcattccatgagactaattttccacagaagcactttgggaaatagtgctttaaaatatgctgtgtgggcaattttgctaagctaaacactgagatgcaaacaggaaacaaaaatgttgcagtcatagtttccataatgtctttgcatttacccactttaaagagttactctaccctctcattatttatgatatccaacctcttcacaatgtttccctgcagtgaatgtctctcatttctatcatttcaaatcctgctaatcctgcaaaactcatctaaaactgtgccctttccatgatactaactacatggacaattccaggccagttcagctccacattttgtgtaactcttgcttttttatcaattgcttaataagtcttaaccaccaaggttgatttggaagatccttaaaggaagggatgctcctggggagtgcagatacagtggatgaaggatgtaaggctcacctgtagtggcttggcattcaattgagaagccaaagactacaggggcatatgaagacaaatgtgaggaggaaggtttaggaggggaaattgagaaaaacaagaagggtgctgtctccaggtagaacaacctggagaaaactgttaacagatagaacagagcattataacatactagtgtttgttgcagaatcttgtttctaccttagtgtctttctgaagctaagtggccagggtgggaggtgtggctgtgggattcctttggaacagcagtggttacatggcattgatgcctgtacatacatttgattatattaaatttaattaaatattctggtatttgattatattagaaaaagtgactaaaatgatgggccatggggtctaaggtgggtaagaatctgaaagtgctgaggagaaagacaggatgatagatatgcagtctaagcaacaaagaaacagagctttcacataaaagtcagaggtagtatcaaaggttgtttaaaggtgtttggcccaccaatagagtccatttgcctcctactcccaaagctactgcccataaatacataaataacagtcttcttataatggaaatatatcttcaagacaaatcttataggcactccttcttctaactagattgctaccctaaattctggagttatcagtgatgaggtagagaaatgatggcttggaagttgcatgaggagtgaggaggaaaatgacccctcctgatccttctgtacatgcagtatagaagaatgaggatttcttgagagggcaattggggtagtaatgtcctccaagagggtcaggcctcagttcattgttttatttagcaaatatttaagcatcatagacttttaaccaagtctagtttggttaaaacaaggggtaaaggaagaagtgaacttaaagactgaggatccaagtgggattattaaccatggagctgagtaccagaggaaaaagtggaagatgaagaggtctgaagagggagagggaaggaagcagtgaagagtcaagattagagaaagaacagaccagtgcaaggatgtgggtatggagagaatacatgatgatctacatttgtgatggtattgaagatgcagttaagtgaggcaggctggtggcatacacgagtcccagggttcccgatttgtatttggggagaatgtctgtgaaaatggccttgatgtttccagccaaaggtctgtgatagtcacttcaggctctgacttgacggtctgagtttgagtctcttagagccctggatgagtatgtcttcattcacgagtggttcctacagtcataaggtctcagattatgatgctgttttcagctttttatttaccagtatatccaaccagggtatatgctttcaattctgtgaccacagttttctcctcttccagccaagttctgcaacttgactctgagagcctgctgtctccactgaatttgattatgtgctatcaggagaatccatctactgcctgcagctgtcgagctcctctcctgggtgagccgggatgcctaacctgattagcagacaaagtagagctaatgggctctagggcaatcattcagggaaactgagatgctgttcagggcttagattttctagactttcccaaggatacaaacagaaatctatttgaggagggctcagcaggcaaaattcaagactttcaagtaatgcaaagaataaagcaaagggggctgaaactagggaggaaaaaacgtctccttcatttgggatgtacttcttatttttctcttattttgtttattatgtctcagacattgtgttaagtgttttatatgcattatgatttgatcctcataataaccttatgagctaggggctgttatccctttacatagataaaaaaatttgaagccaagagaggaaaaaaaaaaaagattccctgaggtcacaagatcagtgagcagcagatcctgtattaagcctaggccagtgtggctcaaaagcctgtattcataatccctacagtatctttccactccccttttccccttgccatccaacttacagccttaccttctacttccagaaaaacctgattttatagtactctcttgctaaaaaccttttaagcaacttcctatcctcacatttcagtttggcccacaaggcttcctgtgatggccttgtgattccagcatcatcatccatttcaccctccttgaaacctttgctttgtttatattcaactactcataactccctaacacaattttgtgccataccttcaatatctctatgttttgtgctcgatctttcctctacctggtctgccttccccaccatcttgcatacttggtgaattcctactgatagatgaggcatatagtcaattgtcaacaaaggtttaaatatttcttaaatgaacaaatcaatgtataactgactaccctttaacacagctcttctctaaagccttccctgactattgagtcttccttatttttctctactttaaaaaattatataaaaagatttttatcatctagtttgtctcttaacaatgaacaataaaagtaaatggatatttggatatttcttcaaagagtaggcttcttgaaaatataaactgtgttacttctttacctctagtcatggcatagagcggtctcaagcaatacttatttatgtaaaaagcaatgaaaaaaagggaaaaaaccttcttatcccagaataacattggtaggtatcacaagaaggcagattctagttcagtataaagtagagactctttaacattcagctgaagagaaagtagagagggctgccttacagagaaaatacaagtattagaagctttaggggataaagatcctgtacttgatgttaggttagacaaggcagacttctgattccatttaacacagatagtctatgatatccatggaaaaataaaataataataataattattatagtactatttcctaatatctatatagcatggaccatatgctaggccattctaagtactttataatgtattttctttattcctctcaacaatcctctgaagttattcatattatatcaatggtatggaaataaaggtagagtcaaggacctttatgcttatgcaggttgttcacgactccccagaagaccccagaaagaaaatggcacaacactcgatcctgccagacacccaggaagatttcaggtcctgtagtgtgtgctttcaagacctggggactaaaggctgatccagctcttggaataaggccttgtcctgagttcagcatcctgaggacatccacatgaatgagggaggtctgtaactcacatcctcagattcagtcatgcatgactgaatgttctgagtaagcacacacacacacgcactctctcatgcatgtacacactcaacacattcacgaacatactctattataacttctatctcattacatcagtttaaacatattcctttctccactatgagattgagctctcctggatggcaggtagtacatattgttcatctctagttctccgggacctatacaaaggcttatagatgaagtgccaagaacacttatgaatggataaatgtttgtgaataaataatgtcagctccactaatatatatatacattgtactctctctagtgaaactttaagtcatgccctgaatatatcatattctcaaaaacctccttgcctttttaaatgctattccttgcctttttaaatgctattccttgcctttttaaatgctattcccattcttttctacacagtgcatctctgtatagagaagtgaggcctagctcaaatgatagttcctctttgaagtctttgtcaacaacttcaggatgaattaactgctctaaatactaattgcagacactgctgtttttctgatttacctcaaaatcctcagcattagtacaatacttggccttaaagaggagctcaacgtattttgttaaatgactaagttgacttatgagtgaatgagtgattcccctcccacctatcctctctactttctgttgagacctctcagctaaattcccaaagcatcattttggaggttaccagaacataaggaagaagagaagtcccagacctaatgcagtacataagtttctctaaaacagcagcattctctggtcctcctcaggagccttgaaagacaggagccctaatttcctctctaatcaagcagagaaatacagatgggaataaaggtgtttcaaccctagtagacacaagcatttttcttcaaattagcagaaagggacataataaaaaatcattctttccaggttgtaagtcttaaaaaaggtgtgcaaaacaaggggatcacaaagtcactcagatatccccaaaggaagtagcaaattttaagcaccttctgaatctcaatagcttgctatccgtttgatgcacactactgtctgaatgctaagcacatattcttcccaccattccaaggctgtgctacctcagatttatccaacaacggcagttatagtctcttggttctcttacttcatctactcaggggctgaaagcaaactggcatgtagtttctcaggcatatttgaaattgaggtaagatttcattccttttcccttcgtgagggcagctgaatctctcatttgtcatctatgccaacacatggcctttagtctacatttggctggaacaaccaaggctatcacctagcttgagccatttgcccccctccttttcctctttgatgtctggcatagccagggaccttggatggatacccattttctaaatgcaccctccctaggcaaacaggacctattctaattccaatcctatcttccaccaaataattataatagtactcctgtcaccagcacatctattcttatctctctccgcactttgtcacagctaatctcttggtgagtcacagggagagggagaaagagtaagagagtgctcagatacaggcaacacatttttacacccagtgtctaatcagattatcatcttatcaggggctgatgggcactcagggtgggaggagagagacagtgctacatattgccagctgaatttttgataacaaaaagacattgctcgattcttgaattaacctttttgtcctacacactgtattatttatttttcagagtttatattatatgtagggatttttttttttttttttggtctgtgccttctggagaaggacacccacacactgtggcagcagctgcttctattaattccaagccattaaaaaaattaaaaataaacccaattacttaggcttgtttggagctgaggaatagctgagactgattattccccctggtcatggacagcaacaatattcctacctatggtggctgctggcagaatgccaatgcagacagaaactccagggacaggcaccccatgcaatgagaggctataaatcacatactctatcttctccaatccagattcctgacaggcagcaagaagagaagactgaacaaggagctaggagttggattctagtccaagctcttggtatattcttcccccgtgcctctgtataaaatgtggttactaaaaagcatcctgtatccttcttagggttgttgtgaaactcttaggtgaaaaggactgtgttttcaaaactgtcatttgctggggtatgggatggtacatgaggcagtattagaattctgggtgctttgggattattaggtggtagaccatagctgaaatgggtcaggtttgcactgaagttttgtatccagattactttgttgttacatcatgggtggaataacaataatcattcaggctgtgaagtcactagactgggatccccttgtcaccttgcataaaacctagcatatagaggcaattgataaatattttgaatgaatgagtaaataagtcagtcagtgctgggttttgaatgaacagatagggctacgtgcaattctagctttggatgtcttttagaaatgcagtcattgtatagtagaactaatgtgggtttaggctgtaatcgatttccattattattaatcagtcatgtaaccttgggcctgggtttcccaatctataaaatgcaaatagtgtttagcttatagatttgttgtgaagtttggagattggtacctgacacatacggggtgcttagtaaatggtaaatgtgatactcatcatgctgtgtgtgatggatagttggcatcatgctctttcttggttgggaacaatgaattccaagttcacactaagtgtgcttagggtttgaaatggacagagcaagtcaaggtagggggtcaaggaaaaagtgaaaatggatggggtcttaatttaaatatatgcttattaactaaaaacagtgataacctgttttctcttcttgaccttttgcagacccaaagtaaccaatatccacctttcaaggaatgtgctgtctgataaaactaagtgtgtctggatacaggaaggcagttaataccttcagtttccaaatggtggtgtgagaagtattcaaagatgttgtccctgctggcagctttttgtaccagtcaattgtgctgtggcccatgttgtaaccttcaagatacatggagcctccaggttactagttagtgggatcaataggaaatgtggaaaataattggttaggagaatttgaaatatgcctgggaaatagagactaagcagtcctgcttatagggaatagtctgaatgctcttgacacatttatgctagggtataacataaaattatgcatttattttcttgtttagttaaaattcttaaaaaaattttttgtctgttacccttttatccgcaatgagctcaaaactacaaaagtgtatgttttaggaaagttaactattaaatttccatttctcatgacacgcaataataaatacataacgtgtataaaacatttgtcagtgtttatgatcctgatagggatgtactgataacatgcccgcataaaaatcagaagacacaaatctgctgaagaaacatcaacatctacttaaatagttaatacttatttttgaaaaacttatgccaaaatactacaatttacacatgtaaaagcagaagcatagaagaaatatgattgaaattattctagaacagtcatttgctctaaatgaaaagccagacatcagagctatactacatataacttctgatgtctggcttattatttacatgactattttaaaataattttgatcattaccaattccaagttctcttgggtatgaagtggtagctgtcaatgtctttcctcaattagcagaagaactaaaaccagcagttttatatcaaagtcaacagatatatcaaacaaaataatttaactgaattccaatataattcaattattttcatccaattcatgtaaccaaagtaaagcttttggaaattaattctattgaagctaaaatactgtcttggtagtgctgatacagcttattcattttcaaaagttaaacattaaagaaaaaattattttagggcaatatgaatacaattggtattttttgaaattggtgaaaacaatgtacttgttaaatcagcaaacctattttggtttggtgaaagcaatatacttgttaaatcaacaaacctatggagtaaaatttattttgaattggtttgaggtgtctacataattcataattgcatccaaacaagcttctattttctatcttcaaaatagaagccatagttgtcaaaatgtacccaaacagaactatacaatttttatgtgaagctaacattaaactatatgtgaaaaaaatgttttcataaagttttagaaagccagaccacactttctgtctttactgtctgacatcaatgtgatttcacaaattttgagtctttaataaaggctcaaaattttttttaatctacattgattttgtactttttctttattattgttaatgagacttttacattttggctgtcttttgttcaaaatcaattggcaatctttaatcaaatattcaataaatgaagcaccaaagtgcttcagcttttaaagcttttatcaatttgcaattatttaaaataaagcttgcaaacaggaagatacgacagttgtctttacaaaagcaagaaagaaattgcacaaattaaatggtgaaagcaaaattgaaatacaagattaaattttgaaattctatgattttaccttgggataacagcttattagtagagtcttttgatgaagctcctatttttaattgtacatttatatgttgtactacagtggaataaaattgagaaggccttcagttttataatatctacatttgatgaacatttaaaagaatgaagaagcacctcatttgataaattttgttttattaaaaaaatcaaagaaaaatttcctgaagggagcaaataaggaagtaactgtataaatatttggactgaaatatttatatatttcaatactaaaaggcttatttctaggaatgtcccttatttataaaatgtgctctaagtttatcaggcaggtacctgagtacctacagagaaaatgcctttttaatttaagtatagtatgttctataaagaataattaattgaatgcatcaacagtttcaaacttattcatcataatatataactctaagaagattaaaggcaaaggcaatgtcatcaagaactaaaaatcatgagaacatattagaaaaaatattcttcataaaaatactaatgacatagtgttagatataggtgtagctaagaaactgagtaaagcctgtgaatgtatgccaaaaataattactttgattttaagaaaataaatatgtttttaaacatttttgctttaatgtacatgaatgcctattaatcttatttttagattaaattctatttttaaaactagattttgaaaataattattttgtaactctactaacgtaataaaatcaattttgtttcaaaaaacagtatttcaaaaaatatacaattttttttagttctcctattcactttcagtttgaatgattaattatatggtcattctatccaactgccaacctgatcgctcctcttggatgtctcaaagttacctcaaatttaacctgattaaaattaatctcctgacatgccccaaatctgggcttctaaaagtgctcctgtctcagtgaatagcttcaccatctacatccaggcaattgtataaatcaggaacctgagttaactttaactctctttcacccttcaataaatactgcctgttttatttgtcaatacaaaattaaaaaaatatattgcccaagagcttcccatgttggcacttttctagctgttgtagaagcagaagggggaaaaaaaaaagcaattccatgctttcagggaacttaaattctaatgggaaagagcgataaacaaacaaatcaatgtataatatagtataaggtaatgataagaataatgaaagaaaaagcaagataaggggatagagggtaacatagggacttttaaaattaggatggccagggaggtaaccatttagtagaactcaaagtgaggaaataaactatatatataattggaaaaactgagccagagagaacagcaagcataaaggtccaagggcagaaataagtttttgtgtctctaggaatggtaagaatgtcagtgtgaataaataggaataagtgatgaggagactggcagaaaataagttagaaagtgggggagggtactagattatagggccttgtctttggtaagagttttatctggggattgggaggagtgaaagcgagaccagtgggtagctattgtggctgtccaagcaatgtataataatgggttaagtaaagcaagaagctgtggagggggtaaaaagtgagatttggaatctgtttcaaaggtagtctataggatttcttgatggattggataagaaaatgtgaaaaagtaagagcaaagtcaaaaatggtatcaattttttttggctagatatcatttactgaaattttcacatctcactaaggtcttaagttctctaaaagactttaaatttatctgtctccaaaagatatttccaatctatctacttgtctactacatttccatgttttggctagtttgctgaaaaaagtattctactctgccaagcttcctttttcctactcttcccctctcagttcccttctctgcatagccttttcaaagcttaattgggccagagtggtggctcatgcttgtaaatccagcacttttggagatcaaggcaggtggatcccttgagctcaggaatttgagataagcctgggcaacatggcaaaatcctgtctctaccaaaagagaaaagaaaagaaaaatataaaagttagccaggtgcggtggcacgaacctatagtcccagctacttgtggggctgaggtgggataaccacctgagccaaggaggttcaggctgcagtgagccatgattgtgccacagcactgcagcctgggtaacaataaaaccctgtctcaaaacaaaaaagaaaaagaaaaaaaagcttaattggatcatgtcacttcctagattaaaattcacaatttccagttatgctggaacaaaatccaaactctttaacatgacttttttacttcctcagatgcacccacttcatagttttatctcaagacctttgaacacttttccttccattcattccattctccacactaacttcttcctttgcctagctggtttctactcatcttttttgttttagctgctgttaatatccctcagagcaactagatcctttcctcaaagcattatctcaatttataattatgcatgtgtggtgcttgtttgtttatagtttatatttccaactaggttgtaatttgtatgtgggtagggacagtatctattttttgctcactagtgaataatctagtatatgatggtacctgaaacatggaatactcacaatagatatttgttaactgaatggagtgaatgtgtattggtgaggggataatgccagagaagtaagaaggctgactgtctgtgccctgacatttctaggtccatgattggctagagggtttcttgcagagctgggtagggatgggtattgtggtggaggggcttctccaggaagctgttccatgagtaagattttgcccaattttcacatagtgcctctcagagaaaggataaaggattaatcattcacgtgaaggcttcctcttcctctacagtgcagaatcctgcaaaatgtagtatcctgatttgtttctagattgttcttccttctctttccagcctgatatggtttggctgtgtccccacccaaatttcatctggaattgtagttcccataatcgccacatgtcatgggagagacccagcaggaggtaattgaatcatgggggcggttacccccatgctgctgttcttgtgatagtgagtgagttctcacaagatctgatggttttataaggggcttttccctctttgctcagcaatcctccttcttgccatcatgtgaaggaggacatgtttgcttccccttcagctatgattttaagtttcctgcagccttcccagtcatgtggaactgtgaaccaattaaacctcttttataaattacccagttttgtgtatttcttcatagcagcctgagaaagaactagtatggtaaattagtatcatagagagtggggcactgctgtaaagataccccaaatgtggaactgggtaacaggcagaggttggaacagtgtggagggctcagaagaagacaggaaaatgtgggaatgtttggaacttcctagagacttgttgaatggctttggccaaaatgccaatagtgatattgacaatgaagtctagcctgaggtggtctcagatggagatgaggaacttgttgggaactggagtaaaggcaactcttgttatgcaaagagactggtggcattttgccctgccctagagatctgtggaattttgaacttgagagagatgatttagcatatctggcagaagaaatttctgaatggcaaagggttcaagaggaagaagagcagaaaagtttggaaaatttgcagcctaatgatgcaataaaaaaagaaaaacccattttctggggagaaattcaagtctgctgcagaaatttgcataagtaacaaggagccaaatgttaatcaccaagaaatggggaaaatgtctccaaggcatatcagagaccttcacagcagcccctcttatcacaggcccagaggcctaggagggaaaaaatggtttcatggcagggcccagggacccctgctctgtgcagccttgggacatggtgtcctgctcccagctgcttcagctccagccatggctaaatggggccaaagtacagcttggaccatcgcttcagagggcgcaagctccaaacctgggcagcttccatgtggtgttgggcctatgggtacacagaagtcaagaattggggtttgggaacctctgcctagatttcagaggaggtatggaaattcctggatgtccaggcaaaagtttgctacaggggcagagccctcacggagaaactctgctagggcagtgtgaaagggaaatgtggggttggagcccctacacagagttcccactggggcactgcctagtggagctgtgagaagagggccaccatcctccagactccagaatggtacatccactgacagcttgcaccatgcacctggaaaagtcacagacaatgccagcctgttaaagcagccaggagggggactgtaccctgcaaagccacaggggctttggcagctctaaggccacgggagcccacctcttgtatcagcatgacctggatgtgagacatggagtcaaaggagatcattttggaactttaacattcagtgacgaccgaccctattggatttcagacttgcatggggcctgttggtcaatttctcccatttggaaggggtatatttacccaatgtctgtacccccagtgtatctaggaagtaactaacttgcttttgattttgcaggctcataggcagaagggacttgccttgtctcagatgacactttgttcctggacatttgggttaatgctggaatgagttaagactttggggggctgttgggaaggcatgattatgttttgaaatgtgagaatttgagatttgggagaggccaagggaggaataatgtggtttggctgtgtctccacccaatctcatctttaattgtacttcccataagccccatatgttgtgcaagggaccctgtggtaggtaattgaatcatgagggtggttacctccatgctgctgttctcatgatagtgagtgatggtcttataaggcacttttccttctttgctcagcacttctccttcctgccattatgtgaagaaggatgtgtttgcatcctcttctgccatgattgtaagtttcctgatgcctcccagccatgcggaactgtgagtcaattaaacctctgtcctttataaactacccaatatggggcagttctttatggcaatgtgagaacatactaatacacagcctcatgagataagagattttaagcaggagtattcattgtcactgagccctaacatgtgaggagccactgttagatttttcagcgtgtagacatagacctaagcctggttactaagagggggtgggggagtggtgctggtttttaagatctcaacataatgacctccagcacaaagtagttacagattgtccacctgcacacactgagtggggtaatacaggctaggtataaacaaggttgagtgtgcttaataacagacaaagaaatacaggaaaataggacaatatagagccctatctgatttatcatctccctggacccctgtcctccctccactcccaatcccagctcagggaatgcttgttcactgaactgagcccccagtggaaagactgaggagtagatcatgagagtagcttcaagtgatctggagtccaagaaagccaggaaatggcctaaattccaggttgtcaaatccagggagcttagccaaaaagtaatgtgaaaaatgagttggtccaaaaactaggtttccaaactcagtgggggacaggggatgagagataatgaggttggagccaagactgagtcagcagctgaggaagtagactgcaaaggagaagaatgaggaggggcagaaggcataagtagccaatgactttcagctctcctgggggcgaaagtacaatcacagtctgaagtggatgaagatgtgatcagaatcagtgaggaggggagtaggattacttagcagagatgacataccatgttccaagccaggtcatgcagaaattattctctatgataaaggaaatcaggagtgagggctaacctaccaggaataaaaggctggcatagatacatggggaagcagacgaggatcttgaggagataccccttgaatatcagtctccagacagcaggtgaggaagccaagcccagtccattgctccatgtgaaaagttataataatttgatgacctgtgggtgcatagggatggcaggctatcaggtatgagatctgggctggagaggcaaagcactgactgaagaacgatatggcacagccctgggaatgtctaatacagagaaaggaagtcctacctaatggtgccagaagaattactgtggtagtgtgaccagcaggctggattcagcaacaagcatcagattatcaaggtcagaacaagtagaggttttggaactgagattgacacagaagtcagaggtaagggcaaagcaaaagcccacaatacaagtaggagactaagtaaggtcaagacagttgtgattcttggaaaaaagtcctggggatagaagtagccttcatcttgttggcagagcctcttactgtctgtaggatgggactaagccccagatatatctaggattaagtcaaccagtgagctgaattatcaaaccacaggagcctaccaacacttaactctctagagcaggggtccccaacccctggggccacggacaggccacacagcaggaggtgagctgtgggcgagcaagcgttactgcttgagctccacttcctgtcagatcagcggtggcattagattctcataggagtgcaaaccctattgtgaactttgcatgcaagggatctagattgcactctccttatgagaatctaactaatgcctgatgatctgaggtgaaacagattcaccccaaaaccatccccacagccccaacccccgtcgatggaaaaactgtcttccataaaatgggttgctggtgccaaaaaggctggggaccactgctctagagattcttcgtaggtcaagagttacttatctttggtctcacttcctctaggaaatcctccttccacctagattagctatgcccactccttaccctgtctcagcccatgatcactttaataccctatctaacatgcatcatacttcattatgacttactattgctcttctttgttccattagagtaggtccatgtttctatttgtacaccatgaatccctactggctaatccaagtctggtacatagtaatcactaagtacataatttgaattcattgaattaatgaatgcatgaatgagagtgttaataagataggcagaagcaacagatacagttgaaaaggaaggtggaggccataggatacagcataacacgtaagccatgttgtggagtaaagatttacccctagaagagatgcagaggattttaatcatgttctcaatgacatcttatacacaaaggccattggcacccaaggtatcaccactgatacccagttaggctattccttcacagagtaactggttgaaatgctgattcaaaggagtcagctgtgacatcttggccttcatcacatgcaagaatgcctctaaatcaatttctcagtgcccatcatctccctgtgtatggcatagcttcctttctacactattgatcttcacacatttaaaaattacgtgaaaagctttcatacttcagtagatttattaatcttagaagctctgaattcatgtatttcacaacttcctactttttagggttattatgttaattaaaataataacatggactcagtaaagagcttttggtaattgaaatgagtaaattaactcatctaccagcctcctgaaatttggaaatcagaagtataggaggcaaggaatttttttttcatataagaaaagcataattgttacttgaaagactttctttgcaatctatttgggaagtctattaaccctttatgctgacacatctgcacacttttatagagatagagaactttaaggatcaccctgtgcagtgtctttcaaccattttttagctacaaaatgctttctttataagaaagctaggagagaagcacaacacgtaaaaccaaataaacaggtaaatagaatttggatggcaaaaaacatggcaaagaggtcgggggtttaggcttgatctggctcaatgttttttattttataactgaagcctatagagataaatgattgggctgaagccacactggagtttagaagcagagcttaagaactgtgcctccaattatattagttttgttcattcatcaaacaaatatttatcaagtcctgttcttgatgctaaagataaattagtttataaaacaaggtttctgtttttatgggcgagaacaaatatacaaacatatatggcaggtggtgacaagtgatatgaggggaaaaagacagcataagggaatagaaagtaaaagaagggatggtaggtttgttacacagggttgtgaagaaaggcccttctgatgaggtaacatttgaataaagtgaaggagtaggcctgttggatttctggaggaagactgttgcatgcggagggaatagcaagtgccattgatgtttccctgttgcttctgttcctccaggacagagcatctgctagctgccaggaacttcattagctcttttacatgcataaaggttcagagcagtagtgagaagagagatattagaggctaacaggtctggttttgaatccaggttttgccaggcatttaattatgcaatgttgggcaagtgacttatcttctttcacctttaattttctgatttgtaaaatgggaatggtagtatttttctcacatatttattcaaagcatctaataataaaatacaggtaaagctcttaatataaacaccagtaggctacagttggtagctgtcagtattgtccacttttctttatatgaacaaagaatttaggttgtagtggacgttactaaattttggatgatccacatctatttcctcttctcaatagcaatttatttcctatgtttaaatgactccttctctgttgggtatactttggtggggtcacaagtaaaaggccttgctgttccttgccaaagcacatgcactatctaggcaaatcagataggctctccatggaatctgcatctttagcagagagaaaataatgaaagactttgtgttcctttatattttgaccagattgttagacttaaggtccacttttgtggcttattctccctgatactaaagctctttgcttccttctcaccctcaggtctaggtctctacttcccatggattccgtgagtcctcaatatccttcaaatgtatttcttttttctaagttaaacgaaatagatttatattcttacaaattaaagaaattgtatcttaatacttatacctaaccaaaataattggagacaatgaaaaaaccaatataagccatatttgcctttaaatacttggaattacgttttagaacaataatgttgagaaagaaaaatttgaatttcatatatggtctttgtactcatttacctctctgaaaagcaatttctccaactaaaaaacaagcagattatattaaacgcatagcaaaacaagattaaactaactgattctaaaatgatcttactagaaatgacactttaggattcccaatctataaggttacaattctaagaatttcattataatgttattagttttataagtcatcttcaaaacttaaatcaaaggccaggaagaaaaaaatttcaggtcatattataacttcaaatcacaccatgtaggcagctgcctattttacctctatgtaggagtaactcagacattcaattgcttttttggttgaataagaaatagaatgtggtaggagagatgtgatgtgtccactgaaagatgtcatttaatatcacacagctagtcaatggcagctagacaggggcttcaactccagaggctaacacttaaacaatatactctcctgcctctatggacatactaaataatgtggatgatcacaggagacataggtggggtgatgacagaaagaattagggtgattcctgaagagagtggcttcaaactgaattttgacagtgggataaaatgtagttttattcaaatgggaagaaagacttctcagacagagggtatagcttatgtgaaggagcagagatgagagtgtacacaatgtttccaaagtaactgagcactgcagctgaagcataggtttcatgtgggaataattggtgagaagtctaaagaggagtctgaaccaagctgcagggaatggagtgggatttgaaggtcagactaatgaatatcatcaagcaactgtattatccatatgctctactttctccaaagtagaacattgcatcattgttcctgcattgcttctgcatcctctgtcttgcctaaaatggcaccaaagaaagttgatctagaaaattatcgaagctccacatagtgaacttttgagaagtgtccgctaaaatagaagaaaagagtaagattccttttccaggcaggactattgaacagcagccagcttcttaacagaagcattcacaaccagcccattcctttctgagagttctaggaggaatcctagttctaggtgtggcatttggggagaacacggggaaagtggtgttgagtgttaaaagaggatggttctgacagtagggtggttacaatccttctccttaagcctatcttctgtcttgaagcataagactgaaaaagtgttctgcaagctgacaagttattgctgtaaggggaaaaagaagaggaggaaaaaaataaatcccatggagtgaagacaaaggtgtgggatcaagggacaaatggaaggagagaggccttaatggaagattcacgtgagagcatggcttgtatcagttccagaggtagcaatgacttggagaataaatttggcagtggttcctgttcttctgggctgagaccttatagaatatgacacttcttaaaaatgagtcccacttggctgggcacggtggctcatgcctataatcccagtactttgggaggccaaggtgggcagatcatgaggtcaggagatcgagaccatccttgccaacatggtgaaaccccgtctctactaaaatacaaaaaattagccaggtgtggtggcacacgcctgtagtcccagctactcagaaggctggggcagggaaattgcttgaacctgggaggtggggcttgcagtaagccaagactgcaccactgcaactccagcctggtgacagagcaagactctgtctcaacaacaaaaaagagtcccagtccaactcaaggcctccaacttggctgaagatgaattctcagtattgcgaatgcgtattttgagaaagggtgtggaagtggtgaaaactctgctctttctggctaagttttaatcagaaatcacatctctatttacttgaaaatcagtcagaatgtagctataccaggatctatgtccctgggagcagcaaagccttagttgatcaaaagtgcctttgaatgcacagcagcccagagatgcagcctggagaagagacctggagccctgcctatgagagtagtatgcctcacctggctatctccaatttccaaattcagttaattttctattttctgactcaaagctgtatatggataatgctaaattcggcaacacattcagcatcttctccgcaccaacatctttctaagtagcggagattctgagatgaacaaaacacagtcccacccctcctacctcaccaagagaaattcaatcttgcaagaaatacaggcatcctgaccacggtaagaagtattctaagtgctgtgatagaagtgtgtccacagagaaattatgcattgggcaggagggtcgggtgttagcagacccatttgagttgggcctcgaggaatagatgattaagagctcaccaaagaatgatgagatgataaaggaatttctaagcagagagaaaagcatgggaagatggagcaaggattttgcatattgtttaaagaaaggatttttttaaggtaatatcagatcttttcacacacttgcttaaaaccttccagtgccttcccattgcacctaaacaaataggttagtctcaggactatgacatgacctctacctacttcatcttgtacttctctcgtttttgcttgctctgcttagcccactggcattctttctgttcttgtaatacaccaagtttattcctattctattgcctttccatttactgttctctcttttgaacgttcttcctcaatgccttctcttctttcagatctcatctcagatgccacctacacaaagcagtctttcctgaccacttaatttaaattagacctctgactgaaatcactctctctcaatcccttttattttcttcacagcactcatcaccatttgaaattgtttctctccacactagagcataagcttcttttttttccttcataggctcactttatttatttatttttattattatactttaagttctagggtacatgtgcacaatgtgcagttttgttacataggtatacatgtgccatgttcgtttgctgcacccatcaactcatcatttacattaggtatttctcgtaatgctatccctcccccagccccccacaccccgacaggccccagtgtgtgatgttccccaccctgtgtacaagtgatctaattgttcaatttccaccgatgagtgagaacagagcataagcttcttgagggaggcactcagtacctacacgttcctggtacaatgtgtgcattaaatagatgaattaaatggtgattagaaccttgcgtttgtaggcagggcgctcaggaaggcagtagtagatataaaggtggataagactagtagcaatgatttttatagtaataatatctaccaaataatggttcattttcttttttaatttttagaaatataaccctttttctcttttctttttttattataagttctggggtacatgtgcacaacgtgcaggtttgttacataggtatacatgtgccatgttagtttgctgcacccatcaactcatcatttacattaggtatttctcctaatgctatccctcccccatacccccaccccccaacaggccccagtgtgtgatgttcccctcccggtgtccatgtgttctcattgttcaactcccatttatgagtgagaacatgaggtgtttggttttctgttcttgtgttactttgctgagaatgatggtttccagcttcatccatgtccctacaaaggacatgaactcatcgttttttatggctgcatagtattccatggtgtatatgtgccacattttctttatccagtctatcattgataggcactccagttggttccaagactttgctactgtgaacagtgctgcaataaacatatgtgtccatgtgtctttatagtagaatgatttataatcctttgggtatatacccagtaatgggatggctgggtcaaatggcatttctagttccagatacttgaggagtcaccacagagtcttccacaatggttgaatgaattcacactcccatcaacagtgtaaaagtgttcctatttctctacatcctctccagcacctgttgtttcctgacttttcaataatggccattctaactggcgtgagatggtatctcactgtagttttgatttgcatttctctgatgaccagtgatgatgagcattttttcatgtttctgttggctgcataaatgtcttcttttgagaagtgtctgttcatataatttgcccacttcttgatggggttgtttgtttttttcttgtaaatttgtttaggttctttgtagattctgtatattagccctttgtcagatggctagattgcaaaaattttctcccattctgtaggttgcctattcagtctgatggtagtttcttttgctgtgcagaagctcttttgtttaattagatcccatttgtctattttggcttttgttgccattgcttttggtgttttaagcatgaagtctttgcccatgcctatgtcctgaatggtattgcctaggatttcttcaagggtttttatggttttaggtcttacatttaagtctttaatccatcttgagttaatttttatataaggtgtaaggaagggatccagtttcagctttctgcttatggctagccagttttcccagcaccacttattaaatagggaatcctttcccccttgcttgttttgtcagtgtgtcaaagatcagatggttgtagatgtgtggtgtttttttctgagggcctctgttctgttccattggtctatgtatctgttgtggtaccaatactatgctgttttggttactgtagccttgtagtatagtttgaagtcaggtagcgtgacacctccagctgtgttcttgttgcttaggattgtcttggctatgtgggctcttttttggttccatatgaactttcaagtagtgttttctaattctgtgaagaaagtcagtggtagcctgatggtgatagcattgaatctataaattactatgggcagtatagccattttcacgatattgattctttctatacataagcatggaatgttcttccatttgtttgtgtcttcttttatttccttgagcagtggtctgtagttctccgtgaagcggtccttcacatcccttgtaagttggattcctagatattttattctctttgtagcaattgtgaatgggagttcactcatgatttggctctctgtttgtctgttattggtgtataagaatgcttgtgatttttgcacattgattttgtaccctgagactttcctgaagatgtttatcagcttaaggagattttgggctgagacaatggggttttctaaataaacaatcatgtcatctgcaaacagggacaattttacttcctcttttcctattgaataccctttatttctttctcctgcctgattgccctggccagaatttccaatactatgttgaataggagtggtgagagaaggtatcattgtcttgtgccagttttcaaagggaatacttccagtttttgcccattcagtatgatagtgcctgtgggtctgtcataaatagctcttattattttgagatgcattccatcaatacctagtttattgacagtttttagcatgaagggctgttgaattttgttgaaggccttttctgcatctattgagctaatcatgtggtttttgtcattggttctgtttatgtgatggattatgtttattgatttgcatatgttgaaccagccttgcatcccagggatgaaaccgacttgattgtggtggataagctttttgatgtgctgctggatttggtttgccagtattttattgaggattttcacatcgatgttcatcaaggatattggcctaaaatgttctttttttgttgtgtctctgcccggttttggtatcaagatgatgctggcttcataaaatgagttagggaggattccctctttttcggttgattggaattgtttcaaaaggaatggtaccagctcctctttgtgcctctggcagaatttggctatgaatttggctatgaatctgtctgtcctggactttttttggttggtaggctattaattattgcctcaatttcagaacctgttattggtctattcagagatttgacttcttcctggtttagtcttgggagggtgtaagcatccaggaatttatccatttcttctagattttctagaagagaggcatagaggtgtttatagtattctctgacggtagtttgtatttctgtgggattggtggtgatatcccctttatcattttttattgcatctatttgattattctctcttttcttctttattagtctggcttgtggcctatctattttgtttatcttttcaaaaaatcagctcctgggttcattgattttttgaagggttttttgtgtctctatctccttcagttctgttctgatcttagttatttcgtgtcttctgctagcttttgaatttgtttgctcttgcttccctagttcttttaattgtggtgttagggtgtcaattttagatctttcctgctttctcttgtgggcatttagtgctataaatttccctctacacattggtttaaatgtgtcccagagattctggtgtgttgtgtctttgttctcactggtttcaaaggacatctttatttctgccttcatttcattatttacccagtagtcattcaggagcaggttgttcagtttccatgtagcagtgcagttttgagtgagtttcttaatcctgagttctaatttgattgcactgtggtctgagagacagtttgttgtgatttctgttcttttacatttgctgaggagtgtgttgcttccaatcatgtggtcaattttagaataagtgcaatgtggtgctgagaagaatgcatattctgttgatttggtgtggagagttctgtagatgtatattaggtccacttggtccaaagctgagttcaagtccccgatatccttgtgaattttttgtcttgttgatgtgtctaatattgacagtggggtgttaaagtctcccactattattgtgtgggtgtctaagtgtctttgtatgtctctaagaatttgctttgtgaatctgggtggtcctgtattgggtgcatatatattcaggatagttagctcttcttgttgaattgatccctttaccattatgtaatggccttctttgtctcttttggtctttgttggtttaaagtctgtttatcagagactaggactgcaacacctgcttttctttgctttccatttgcctggtaggtcttcctccatccctttattttgagcctgtgtgtgtctttgcacataagatgggtctcctgaatacagcataccaatgggtcttgactctgtatccaatttgccagtgtgtgtcttttaattggggcatttagctcatttacatttaaggttaatattgttatgtgtgaatttgatcctgtcattatgatgttagctggttattttgcccattagttgatgctgttcttcatagcatcgatggtctttacaatgtggcatgttttgcagtggctggtaccggttgtccctttctatgtttagtgcttccttcaggagctcttgtaaggcaggcctggtggtgacaaaatctctcagcatttgcttgtctgtaaaggattttatttctccttcacttatgaagcttagtttggctagatatgaaattctgggttgaaaattctttcctttaggaatgttgaatattggcctccactctcttctggcttgtagtgcttctgcagagagatctgctgttagtctgatgggcttccctttgtgagtaacctgacctttctctctggctgcccttaacattttttccttcatttcaaccttggtgaacctgacgattatgtgtcttggggttgctcttctcgaggaatatctttgtggtgttctctctatttcctgaatttgaatgttggcctgccttgctaggttggggaagttctcctggataatatccataagagtgttttccaacttgtttccattctccccgtcactttcaggttcaccaatcaaacgtagatttggtcttttcacatagtcccatatttcttgcaggctttgttcatttcttttcactcttttttttatctaatcttgtcttctcactttatttcattaatttgattttcagtcactgatatcctttctttcacttgatcaattcagctaccgaagcttgcatgtgcttcacaaggttctcgtgctacgtttttcagctccaacgggtcatttatgttctcctctacactggttattctagttagcaattcatctaagtttttttcaaggctcttagcttctttgcattgggttagaacatgctcctttagttcggaggagtttgttattacccatcttctgaagcctacttctatgagtttgtcaaactcattcttcgtacagttttgttccctggcttgcaaggagttgtgatcctttggaggagaagagacattctggtttttggaattttcagtctttctgcactggtttctccccatctttgtggtttttatctacctttggtctttgatgttggtgacctactgatgaggttttggtgtagatgtcctttttgttgatgttgatgctattccttcctctttgtcagttttccttctaacagtcaggctcctcagctgcaggtctgttggagtttgttagaggtccactccaaaccttgtttgcctgggtatcaccagtggaggctgcagaacagcaaatatcactgcctgatccttcctctggaagcttcgtcccagaagggcacctgccagatgtcagccagatctctcttgtatgaggggtctgttggcccctactgggaggtgtctcccagtcaggctactcgggggtcagggacccacttgaggaagcaccctgtccattattagaacttgaacactgtgctgagataaccactgctctcttcagagctgtcagacaggaacatttaagtctgctgaagctgtgcccacagctgccctttcccccaggtgctctgtctcaggaagatgggggttttatctataactctctgactggggctgctgctttttgttcagagatgcccagcccacgaggtggaatctagagaggcaccttgctgagctgtggtgggctctgcccagtttgaacttcccggtggctgtgtttacactgtgagcataaaactgcctactcaagcctcagcaatggcggatgcccctccccccaccaagctccagcatcccaggtcgatctcaagactgccgcgctcacagcaagaatttcaagccaatgggatcttaacttgctgggctctgtgggcatgggacctgctgagccaggcaccggagggaatctcctggtctgccggttgcaaagaccatgggaaaagtgcagtatctgggcatgagtgtaccattcctcccagtacagtctctcaaggcttcccttggctaggaagggaaatcccctgaccccttgcacttcccgggtgaggcgacaccctgccctgcttcggctcaccctccatgggctgcatccactgtccaaccagtcccaatgagatgaaccaggtacctcagttggaaatgcagaaatcacctgtcttctgcatcaatctcgctgggagctgcagactggagctgttcctattcgaccatcttgccagaaatccatggctcattttctttgtgttgggcccatgctaagcccattatcttgtttaaccttcagagtaatcttgggacataataattatgagccctcatttaaagaaaaagtatttgagagatagaggggagttcagtaatacattaacttcatattactcctaaaaaaataactagtatttgaacccagttctgtctcactccaaaggccaaattaaacaattacatagagaagggagattgagctaacatctcattactagtctgggggatcttctacaagcatatgattccaacagaaggatacctttcagggcaaattgtgggaatgggacaaatcaaactcagtagtagattccacatcttgccctcagctagcgagagattcactcttttcctaaactccatgtatacgcaccaagacaaaatattaggccaatatatccacttttacattaaaatatctagaaatatcagaaaaaattatttgatttaaatgaaacacttgaagagaaagggattaattcagttcattccctggacatttcactcatgatggccaaaaatgacattttgtcttttttgaacataatgttttttgaacatttgtgtatacgttcatgtctgtagttcttctaggtctaaaataaatttgaggtgactcacagaaatgcatataatacaaatgtaaataagtaaataaaagagaaaatgaagaccagaaattacaagtaggaaaatgaaacaaagtttgaagtaagattagtagaaatcaatgcatgccataaggttttgtacactcattagaggtaggctttattcctacaaatcaaagtaagcaaggaactgatttatcttatgattcttagagtccaaaaaataaaaataaataacccagttttttgggcaaaaaataagctggttactcacaatttttcctggtcatgaaacctgaaaatttttttgtatgctttcataaatgttttatcatcacctttagagtatatacattaaatgtttttgtaagattatttttatggagcccctaaatgcaggcaaacagcaatatactaaagtgccattctataaaagcaactctatgaggcatcaagatagtgcaggccagctatgcagctctcagattatccagattggtccgaggacagggaaactaatgaactgtgtttcctcaggcaggcttctattaatgttatttcttgaaactagacttttatttacaataaaatagaaaagtacttgaggttccattgcatatcaaattcctagaataccaaaatagatattccactatggtagctcaaggcataatcctgtattcttaatggtcacaaaagtggaaagtagatcttatatgctcttttgaaaattaagaaatcaacaaactgttgggtaggtaccaagaaagaacatctagatagggtgatgattattcacagaaaaatatataagatctaatctaatgccctggcaatcggcatagagttgcaaagttttctgctttcaatttaagtaaggcaatatattttctcttttaagtagaattcaattttcaatggaattgttgctactgcattgagctggccaagggttttcttatgcctcaaagaaacaaaatattggtaatcactacagttatccctcagtatctgtaggggatatgttccaagatacctaacaaatatcaaaaattgcagacgctcaagtcccttatagaaaatcacatagcatttgcatataacctatacacatcctcctatatattttaaatcatttcaagattacttgtaatacctaaatgctatgtaaatagtttttatactatatttagaaatttgtacttattgttgtattgttgaatccatggatgcagaaccagagacagggaggcccaattgtatacattcactattgagtgcatttgacctgagctctaaaatgctactctaagaaaaggaagtctggaaaagtttcctgttctgtgactgtgttttaataaataaaaaggcagctgtgatgaagagaaagcagcatatggaatgaaaaccctataagtaaattgtctgcagaatgttgcagtaatccccatagcatgtgcttcctagagaatgatgggacatttgtcaacacacattgagcaaatgatgggaaaagactcccatatataattcatctctctatcaagttaagtacacaaatacctaaattgtgggttggcacagactaaatatttaaaagcttcccacagtgctctaggtcctcattgttgccattcagacaacaccaggaaacaagcatttgcctcattcagtgtcactaacaaacacctctcctcttttagtcaacaagcaccagtcattttatgctggctattagtgctctctttggccaaaaccaattacagagaaacttcaagctttaaggaatgtacccacgttatgcttataaatgtgctttattttaaaattagttaggtgtaaaattccctacaattttcctaagaggcttttatcataacatccatatcgcttcagtgaacttctgtgtgcgtgtgtgtgtgtgtgtgtctccctctcatagatggaaactacttgaacagtgagctttccttatttgtcttggtacaaccagcacctatcacatagtgggtgcttaaagattgtcagtgaataaattaattaatgcaagaaaatattttttgtttataaaaatatttagattttgagtgtttaacaccatcaccatcatctcactaattcccatattgtagcctcctgaacatgtctgatttaaataaccaaagatacatcaagaatattccatacaatgcgttctgtgagagtttgcatattatctctcatttgaaatccaattccacttacaaaactgtacttcacatgaacattttttatatcatacctactataaaaatgtatcagatatatcaaactaaaactgtgtaaagtaccccaagtagatttggaaaaataaatggttttagtcaagtacatggatgatggcttcttactaacttgttagtaaggtatctaggtatgacacaaagttagtttcagaaacaaaaataactcattctttgaccaaacagtttttccaagtcaagttatttctttcaaaagaagataaaatctatgtaaataaacactaagtataatgtcagttgtaaaaccaaagttgctctctgatcaaataagatattgtgaagagctatggaagcaataattttgcttccaaatgtatttgtacccaaagatgaccaaagggaggagggaggaggaaaggaggaaggggaagtcagtgagttcctaatatgactactaaaaagtatgataatgttaatattaacagtcagcatttattaagggcttactatataacaggcattgttacattttattcattattattaatatacccctttaaagaatgaaaaaccaggtttgaagaggttaaacaacttccctaaggtccacaccttactgatggtaaaattaggaacaaaatcctgatgtgtctgactctaaacctgagcagatactcactaggctatgcttatttctgaccaatactctaaccctgtactaaggaaagagctaaatccaaaaggccttgtctcaagggtctcacagagtaggaggagagagaagcagggagaatgagctcctgaaaggcctagaatatgtcctatctcatgctgtaatccaatcctggggctttaaaatacatatatatgatgctaactccaaaatatgtatctcacgttgcacatttcccatgagcttcagacatagatttaattgtccactagatatctttacttggatgtctaatgggcatctcaaacctggtatgtccaaaacagaattcttgactgtctttcttcagtggtactaaccagtcactgaatctagaaacctagtagtcatccttggatcttctctttctgtcatatcctaccttaaatttacaagcaagtttgtttgatacactctcggaaatatatcttaaatccagtcactattcagctctccacctccagccctcactagctctcccctagaccactgcagatacctctttactggtctcctttaaaccaccattttctttcttctgggccactgtagcagcctctctacagcctctctgcccaaagtcctccttatctttctcctggaccacttcagcacctctttattgaccttttgtcttcaatcttgctttttccccttcactgcgcaattcagtctattctattcctagcagccaaagtgatgttttaaacataagtcagattcccatcactttgcttgttgtacatcttctagtggctttacattaaaaattcaaggcaaaatccaaagtccttactgcagacttccaagttctacctctcatccaacttgtagctgtttcacagatctctttcttaccacttgcccactctgttacaccagcaatcttgaaacatagatatgaaacacagcctagcacatattgaagtgattaatagacatctattaactaaatcctgtttctttagggtctgcacagggcctagcacatcatatttggcaaaaatatttattaaacccaaacaaacatgaatattaaatggtatgtgaataagaatacatttggagccagccagactcaaggttacaaagccacttttaaagtcctactcaaggatggtagacagtcaaggtgtattaatccattttcacactgctacaaagaaatacctgaaactgggtaattcataaaggaaagagatttaattgactcaccatgccacatgcctggggaggcctcaggaaacttacaatcatgatggaaggggaagcaggcatgtcttacatggcagcaggtgagagagagagactgtgtgaaggaggaacactatgaaaccatcagttctcgtgagaactcactcactatcatgagaacagcatgggagaaaccacccccatgatccaatcacctccctctcttgacacgtggggattacaggtccctcccttgacacatggggattacaatttgagatgagatttgggtagggacacagagccaaaccatatcactgggtaagtgggcttactctgaaatcctaacacttgtagtgtaggcactactggagaatcctacccaggtaaaaatggtggaattgagtcttgaactatgagagagggaatgaatctccattatctagtctgatttttcatttttgttctcataatcagcatccttgccaagtagcacccaccttgggcttaaacttcttcagtacctgaaaagtcactgacacatttgccaaagtttttcctgctttatcaattcccccaaattatttcttttcctttgacaaaaccagtgctaagacatttagaaaaaagaagggaagagaaggtattttctgagcatctattgtatgccagtaactgtgttaattgctttacccaacttagcgtatttaatattcttaactacctgaaaatccccaattaaagtctagagagatgataggacttgcctaaatcttaatttgaacagaggaaatttctcaattttgtgtgaaaaacaaccaacaaaaacacaacaaaacaaacagaataccacataaatgttaatagagtcccaacaggaaactagatggctcacacaaagtagttaatgttcaaggagagtacaaagctgaactattttcaaaggtgtaagcagagtagaagaacttgaagcaacaatatggtacccagaggttagagaacacctggaagcataaagagaaaagggaaagaggggctaccaggctctataagctgaggcgtcactttatattaatagcaactatgactttcaaccaaaggacatagccagccctcactgatccccagtgagggaaatgaagaaatgaataccccaactttgtttctcctccctttgattttttggaggtacccctgattggctgaaatcacaggtcaaggcagtctatggatgtgctccatacaggtcagccttggggcaggtggaagatagagataatgaaaaaagttagagagaggaataggagagacaatggaatatatgctccttacccacttgaagttcatggaaagctttaaataaactagaatttggattacatttctttgtctaaattgccatattgtatgttttaatctgccaattcttgttttgttcaccgtaatacttgaaacaaaagattctctttaaatgattattattttgaaattacagtccaatttaataaaaattatgtggtttttcatatcaacttttctgaaaattcctttttggtattttgtgaacatcccatagttcttccagagcatttatatatagcctttttaaattgtttctctaaaacaattagaatttcattattatatttgaaattttaatacagtcattataatgtcaaaggaaacttctctgagacacattcatattttcatattaatagaagtgctgttataatgttaatagaaaaatgggtttaatcaattatttaattcattcattaactacatactaccccaaaactcaagggaatataaaacaaacagctcatttgaacaacaaaaaaggattgtgctttggaaacattcaaggtatattcagtaactttaaataactgtaatctagattgactaattccataaaaatagaaagagcatcccatataaaaatgactcagctcctggagtcagacatacaagggataaagtcccagctctacagtttcctagctgtttcattttgcagtcttaaagtctctgagcctcagtttctttgtctacagaatgggtgaattgatttgaatctcataggattgtttgagaattgtggtaattaaaatatgtaagaattctactacagtgcttgacacattgaagatgctcaggaaataggaggtaatgtctgttcatttttattctcaaatagggcttataagagatatccttgcctctctttctacttaaggatatcttttacatcatctctcactccagagcctgaaagtagccaaaggcaagaagtcctctgcttcttcccctatgggctctgccccatcattctttattctttaagaaaaaggcactcaccaagccaaagttccccatcccccaaatgtgtttttccaagtcttagcatagtaaaggaaaaagccaaagtttttttatacctccaatagaaaagaaaccattcccaattctgttgcactctaagacccaagacagggtcagaggagctagagataggaaacttgaaaatgtcaatccatgaagagtaatgaccttttccacgtgtttggcacagtccttccctaaggaagttggcatttaaaaagaaggctggatttaggagcaacagtagatatcattgctccaatttcaaaaggtagaaaacaagatcaatgtcaaaccagattttgattaagaggagggccaccaaagcagatgccaaggatgttaatctctaagatgtgttcaacataaatgaaagtataatgagatgatgataaaaactgcatgtaatggaactatccactatatgtacttagaagtaatgccttataaactgctggggtagatgtgatgtaggagagaagacacccattcctaagttacaacaaatttttactaattggatagagaaaaaaggcaagcccttagtctcaggctttcattttgctgagaggattttacaaatttggggccaatgctgagtgtatcagtccattctaatgctgctaataaagacatacccaagactgggtaacttataaaagaaagaggtttaatggactcaccgttccacatggctgggaaggcctcacaatcatggtgaaaggtgaagaaggggcaaagccacatttcacatgtggcaggcaagagagcttgtactggggaactcccatgtattaaaccatcagatctcatgagactttttcactactgtaagaacagtaaggggaaaactgctaccatgattcaattatctccacctggccctgccctggacatgtgggtattattacaatttaaggtgagatttgggtggggacagagccaaatcatatcattctgcccatggcctctcccaaatctcatgccctcacatttcaaaaccaatcatgccttccaaacagtcccccaaagtcttaactcatttcaacactaacttaaaagtccatagtccaacatctcatctgaaacaaggcaagtcccttccacctatgagcctgtaaaatcaaaagcaagttagttacttcctagatacaatggaggtacaggcattgggtaaatatatccattttaaatgggagaaattggccaaaacaaagaggctgcaggccccatgcaagtttgaaatccagcagggcagtgaaatcttaaagctccaaaaagatttcatttgaccccatgtctcacattcaggtcatgctgatgcaagaggtggattctcatggtcttgggcagctctgcccctgtggctttgtagtgtacagccaccctcctggctgctttcatgggctggtgttgagtgtctacagcttttccaggagcatagtgcaagctgttggtggatctaccattctggggtctggaggatggtggccctcttctcacagctccactaagcagtgtcccagtggggactctgcgttgggactccaaccccacatttctcttcctacactgccctagcagagggtctccatgagggtcctgcccctgcagaaaacttttgcctggacatccaggcatttccatacatcctgtgaaatctagatggaggttcccaaacctcaattcttgacttctgcacacctgcaggctcaacaccacatggaagctgccaaggcttggggcttgcaccctgtgaagccagggctgaagctgaaccttggccccttttagccacagctggagaggttgggacacagggcaccaagtccccagataagagcggggggccctgggcccagcccacaaaaccattttttccttctaggttcccaggcttgtgataggaggggctgccatgaagttttccaacatgctctggagacattttggctcctcgttatttatgcaaatttctgcagctctattgaatttctcctcagaaaattggtttttcttttctacagcatcatcaggctgcaatttttcctaacttttatgctgagctttccttttaaacataagctccaatccaaattatacctttgtgaatacataaaactgaatgcttttaagagcatccaagtcacatgctttgctgcttagaagtttctttcgctagatactctaaatcatctctctcaagttcaaagttccaaagatctctagagcaagggcaaaatgctgccagtctctttgctaaagcataacaagagtcacctttgctccagttcccaacaagttcctcatctccatctgagaccacctcagcctggacctcattgtccatatcactatcagcattttggccaaagccattcagagtctctaggaagttccaaatttccccacatcttcctgtcttccgagccctccaagtctctaggaagttccaaactttcccacactttcctatcttctgagccctccaaactgttccagtctctgcctgttacccagttccaaagtcacttccacattttcaggtatctttagagcagcaccccactctaccattaccaatttactgtattatttcactctcatggtgctaataaagacaagcctgagactgagtcatttataaaggaaagaggtttaaataagtcacagttccacatggctgcggagtcctcatgatcatggcagagggtgaaggaggagcaaaggtacatcttacattacagcaggcaagagtgcttgttcaggggagctcccatttataaaaccatcagatctcatgagacttactgactaccatgagaacagtatgggagaaaccacccccatgattcaattaactccacctggccctgcccttgacacatggggattatgacaattcaaggtgagatttggttggggacagagccaaaccatatcactgagtttttcaagataacagagcagaaaccatgtctggtaacctgggatcttccttttggcctcttccctcctgcagcattcagactcttctctagaccaaactattgacaaaaatatgttaaaaaacatcagattagaggggttccaaatcaatgattggcttgagacagccacacgccttggtctgagcttatcagcaattaagtgatgggtctgagaccgtcatgttgtcctttttgactccaaattctaagttctcttcacttacctactatgaatttcaaggtgtgatggtttaattttgttgttgttgttgttaatttgactgagccaagggatgctgacagctagtgaaacattatttctgggtgtatttgtcagggtattttcataagagattagcatttgaattggtagactgagtaaaaaaaaataacctacgcaggtggacatcatggcatctgctgaggatgtaaataaaacaaaaaagcaggagagcaaatttgctgtctctgcctgagctgaaacatccatctcctcctgccttggacattgacattcctggttcttagctctcggatttagactgggactttcatcatcatcatcatcatcatcatcatcatcatcatcatcatcattctcttgccccaattctcaggcctttggacttacactgggatttatacacttggctcccctggttctcaggccttttgtgttggactgaattacatcgccaactttcttggttctctagcttgcaggtagcagcttgtgggacttcttggacttcacaatcatatgagccaattactataaaaatatctatctaggagttgggtcaagatggtggactacaagcagctcatgtgtgctgttctcatggagaggaaacaaaagggctagtgaacattgactctgcagggcaatcatcgagaaaccatgtcaggatccatcaagcagcagtggggcatagagagcagagaatagcgaatctggttaccagactgtctgggctcagtgctgaggcagaaaaagttatccaacagaagaaagggtgagtaagtgagggtcccctgggggattcatactctccaaagggacctatgcaagactaaaaatgggagaccctctctagctcccctgtttccccctaccacacttctatactgaggcagagagccacctggacattttgtgggggcaactcttgagtccaaggggaccgctacatgttttgggccccagagcagatcagcgttggtgtcatcaccccagtagaggctgcagtcatagtaagattggagcaagattgctccacccctttgttagacaaggtttggtgccagcctccagccccgtggtctcatttctatctgaactcaggcagtggctgcagactcctattgtcctgggaagcacctagacaaggcaggtgaccaccccctaccccaaccactggtagccaggtggcgataggcaatacctgctagagcttctagcccactggtcctacttctatgtgaattcagccagtggtctgagcctctcattgccctgagaaatagtcagacaatagggtaggcaaccttgcccattcccattgctagtagccagactggcaacacctgctacagcttccagtccagcggtcttacttctggctggactcagctggcagctgcagcctcctcttttcccaggaaagcaggggtgggggtgacctcacccacccctgctgctggtagccaggtgggcaatgtcttctagaacttccagctcagtggccccacttctgtgtaaactcagctgaagtttacagcctcccgttgtcctaggaaacaactggacaacagagcagacaaccccacccatcctgccactggtatccaggcaagctacatctgctagagcttccacccaagcagtcctacttctgcttgaatttgccaaggggcgcaggctcccattgctgcagaaacacctagacagcagagtgggcaactccactcacccttgcctcttgtagccagatgggccacacctgctagagcttccagcccagtggtcctgcctctgcctgaactctgtgggaaggcacatccccgtattcccccaggaagaactcagacagcagattagggctgacccagcaaagatgcagcctgcctgccaactgtagcccctgcctgagggagccccatggaccagagcacccaaacaaagaaatgcaagcatgaagacagtaattagtggaatctccttcaaggctcaggagtggtctagaattaaggccaatcaactgaaccccaccttataccacaatcaaattaccaaatcaccaagggcataagagaaggtaaaagaaaaaaaaaaagccaaaaacccacccaccaccaccaacaaaaaaacacacccaaagaacagcaacttcaaatactgagggaacatcagcccacacagatgagaaagaactagtgcaagagctctgacaagtcaaagagccagagtgtcttcttacctcccaacaactgcactagttctccagcaatggttcttaacgaggctgaaatggttgaaatgtcagaaatagaattcagaatatggataggaatgaagatcatcaacattaaagagaaagttgaaacccaatccaaaatatctaaggactacaataaaatgacataatagataaaagatgaaatggtcattttaagaaagaactaaagtgaactcataaagctgaaaaactcacttcagaatttcataatacaattgcatgtactagcagaaatgaccatgctgaggaaagaatcttagagctcaaagactggctctccaaaataactcagtcagacaaaattgagaaaaatcaataaagaagaatgaacaaaacatcttagaaatatatgattacataaagagacaaatctttaactcactgacatatccaaaagagagggagaaaaatcaagtaacttggaaaacatatttgaggatatcactcacaaaaatttccctaacctcactaggcaggccaacattcaaatccaggaaatacagaaaacccttgtgatatactatacaagatgaccatccccaagacacatagtcatcagattctacaaggtcacaatgaaagaagaaatgttaaaggcagctagagagaaggggcaggtcacctagaaagggaacctcaccaggctaacagaggacctttcggcaaaaaccatacaagccagaagagactgagggtctctattcaacattcttaaagaaaataaattctacttaagagttttatatccagccaaactcagcttcataatggaaaaataaggtctttttctgataggcaaatagtaacacaattgattaccatccaatttgccttacaagaggtccttaagggagtgctaaatatggaaaggaaagattgttcctggccaccacaaaaacacacttaagtatatagagtattgacactataaagcaaccacacaatcaagtattcacaataactagctaacaatatgatgacaggataaaacctgcacatatcaatattaaccttgaatgtaaatgagctaaatacctcaattaaaaggcacagagttgcgagttgcataacgaatgcccaaccgtatgctgtcttaaaagcaaaacaaaacaaaaaacctatctcatatgcaataacacccatagcctaaaagtaaaaggatgaaggaaaatctatcaagcaaacagaaaacagaaaaaagcaggaggtgctattctaattttgggccaaaaaagaaaggattttaaaccaacaatgagtaaaaaagacaaagaagggcattacatagtggtaaaaaattgaattcaacaagaagttctagctatactaaaaatatgtacacccaacacaggagtaccctgattcataaagcaagttcttagagacctacaaagagacttagctaatcatacaataatagtaggagatgtcaacatcccattgacagtattagacagatcatcaaggcagaaaatgaacaaagatattcaggacctgaactgaacatttgactaaatgggcctaacagacacctacagaactttccaaccaaaacaacagaatacacattcttctcacatatctcatggcacatattctaaaattgacctcacaatttggcataaaataatcctcagcaaattaaaaaaaatcaaaatcataccaaacacagtctcgaatatcagcacaataaaaatagaaatcaatactaaaaaagtttctcaaaaccatacaattacataaaaattaaacaacctgctcttgattgacttttgggtaaacaatgaaactaagacagaaatcaagaaattcttggaaactaatgagtgctaagacacaacatctcagaatctctgggacacagctaaaacagtgttaagagagaagtttatagcaccaaatgcccacatcaaaaagttagaaagatctcaagttaaccacctaatatcacctctagaggaactaaagaaacaagagaaaaccaaacctgaagcaagcagaagacaagaaatcaccaaattcagagctgaactgaaagaaattgagatgggaaaaaaaaacattcaaaagatcaatggatacaggagttggtatgttgaaagaagaaataagattgatagactgctagctagactaataaagaaaaaagatatccaactaaattcaatcagaaatgacaaaggaaacattaccactgaccttacagaaatacaaaaaacctcagaaactactatgaactcctctgtgcacacaagctagaacatctgcaataaatgattacatttcttgaaatgtctatacaagactgaacaaggaagaagctgaatctctgaacagaacaataataagttctgaaattgaatcagtaataaaaagtctaccaaccagaaaaagcctaggaccagatggaagcacagccaaattctaccagatgtataaagaaaaactggtacaattcctactgaaactattccaaaaaattggggaggaaggactcctatctaactcattctatgaggccagcatcatcctggccaccaaaacttggcagagacacacacacacaaaataaaacttcaggccagtatccttgatgaacactgatgcaaaaatcctcagcaaaatactagcaaaccaagaccagcagcacatcaaaaagctaatatgccatgatcaagcaggctttatccctaggatgcaaggttggttcaacattgcaaatcaattaatatgattcaccatgtgaacaggagtcaaaaactacatcgtctcaatagatgcagaaaaagcttttgataaaaatcagcatggcttcatgttaaaaatcctcaacaaaataggcactgaaggaacatacctcaaaataatgacatccatctatgacaaacctacagccaacatactgaatgggtaaaagctggaagcattctctttgagaactggaacaagataagaatgctcactctcaccactcctattcgatataatactagaagtcctagccagagcaatcaggcaagagaacaaaataaaaggcatccaaatagaaagagaggaagtcagactatccccgtttgcagactatataattctatacctagaaaaccccataatctctttccaaaagctcctagatctgacaaacaactttagcaaagtttcgggatgcaaaatcaatgtacaataatcagtagcatttctgtacaccaacaatgtccaagctgagaaccaaatcaagaatgcaatcccattcacaatagccacaaaagaataaaatacctaggaatatagctaacccaggagatgaaagacctctgcaatgagaattacaaaacactgctcaaagaaatcagagatgatgcaaacaaatagataaatattccatgctcatggataggaagattcaatattgttaaagtgaccatactgcccaaagcaatatatagattcgatgctattcctatcaaactaccaatgacactctttgcagaattagaaaaaaactattttaaaattcatgtagagtcaaaaaagagctcaaatagccaaggcaatcctaagcaaaaggaacaaagctggaggcatcacgttacctgacttcaaactatattacaaggccaaagtaagcaaaacagcatggtactggtataaaaatatacacatagaccaatggaacagaatagagagcccagaaataaagctgcacactcacaaccatctgatgtttgacaaagtttacaaaagcaaacaacgggaaaaggacccccattcagttagtggtgctgggattactgactagccatatgcagaagattgaagctggacctcttccttacaccatatacaaaaataaactcaagatggattaaaaacttcaatgtaaaacttaaactataaaaattctagaagacaacctaggaaatatcattctggacctaggccctggaaaagatttcatgacaaaaatgccaaaagcaattatgacaaaaacaaaaattgacaaatgggaacaaattaaagaggttctgcatagcaaagaaaactcaacaaagcaaccagacaacctatagaatgggaggaaatatttgcaaactatgcatccaacaaagatctgacatccagagtctataaggagcttaaacatattaacaaacaaaaaacaaccatattgaaaaattgggcaaaggacatgaagaagcatacaaaaaatgctgaacatcactaatcattagagaaaggcaaataaaaatcacaataagatatcatctcacaccagttattattaaaaagtcaaaaaataacaaatttggcaaggttgcagagaaagggaaatccttatacactgctggtggaaatggaaatagttcaactactgtggaaagcagtatggtgatttcccaaagaacttaaaacagaattttaattcaacccagaaatcccataattgggtatacacccaaaggaatataagtcattctaccataaaaacacatgcacgcatatgtttatctcagcgctattcacaatggcaaagacatggaatcaacctaaatgcccatcaatagtagagtggataaagaaaatgtggtacatacacatcatggaataccacacagtcataaaaatgaacaaaatgatgtcctttgcagcaacatggatggagctggaggccattatcgaagtatgaagaaataacataggaacagaaaaccaaacaccacatgtcctcatttataagtgggagctaaacattgagtacatatggacacaaagatgagaacagacactggggcctacttgagggtggagggtgggagaagggagaggatagagaaactacctatctggtactggtacctgggtaatgaaataatctgtacaccaaacccccacaacacgcaatttacctatgtaacaaacctgcacatgtacccctgcaactataataaaagttaaaacaaaacaaacaaatgaataaacatctatgcatcctattggtctgtttctctggagaactctgactactacaaagagaattcaaaatcttaagataaaggataatgttttagagtgtgtaaactcaggaagagaagagagaaagacttacaaggcaagtccagaaaatgtttgctgagctaaattccttagccaataacagagccatctctttatccaaacgttctgtttgtcctacacttggagcatcttattgttccccctacttcaataacctcaacaaacttgcttctaccttttcaatttattccttgaggctcattttctgaatctgacaaaaaagaatcatattttatggttattgtagagattaaacctatgtaaagcatctagactagtacctgtgcaacaaatgatggttgtaattatcaattttgttcttgtttctccttctaccatcattatcagactatcttggaattttctgtttcatacctgcccttctcagcagactgtgagcaactcagtggcatggggtccacatcagctcacctctgcatcttagctctcagcatagagcttggtacagagaaaattttcaaatatttgttgaaggaatgaaagagtgaatggctttctccttttctgaacactgttctgccaggcccaactgcttgcagttacttgaatggcacttgaaatttactcttcagaggacagtggtaaaggaggccttttgtgaagatgacctttaggttttggttctattcagttgcattttccttcttttatttcacaagaagagaaactggatgagacatcaagggaaaagacataaaatcctggagagcctagatggaatttgcacctccccaaattgccctgaggtccttagattgcaactaattatcaccaataattagggctgctcttcagagaagcagaaatagtgtcctgtagagagcataccatgttcctcaaagagaaattcaaatgggacagatgtcagtcccctcccagcatcttttgctgatgagggggctctagtctgcttcagtaactgacccagagacttactgcctggactgacaagataataatgagaaaacaacacaacgcatcttgaaagtgttttgaaattttaaaaattcttttatagccaatatcttactagattctcacaccagtcatataatggaaataagatttattaattcattgtagacctaccatgtacaatttacttggctaagcactgaaaatatagtagtaagcacatcacacaaaatacctgcctttaaagaatttgaagattcatgcataagacagtaaataaatgtcattacagtacagtgtaagcagtactataaataaaagtataggtaactatgctaaaaattatgttcacattgtgtgattctgtgactagatgacttggagaaggtagtatttgactgttacagcaaatgaaagtaatgtaatatctccaacataaaaaaagcaaattcacagaaatgaaataacttgttcatggttgtataataactagagagccaaaaccaaaacctaggttctttaacttcaaatctttggcttgttataagaaagcatctctattcaatatacaatttgcctctacagctttcctaaaaatgtctatctagactctgcttgaatacatttagtgacaaaagcttaccacttcataaggtagctcatttcatcataggatagagttcatctttaaaactttcttctttaacagaaatagcaatggggaggaaatattgtgtttaaagaaagaaggggcttgtgtatagctgtggatacagaaagtgtgacttttcgcatagttttgtgagatagacagaaaactagagctctggctaaaatgaaaaggatggaataggccaagagttgatacagatgcagagcaactaggattctcatacagtgctggcagaagtgtcaattggtagtactggcactatttataaaataaaacatatgggcagtaggttgaatactaccccccactcccctacccccaccaaagatgtccacgttctaatccctagaacctgggaattttaccttatatggcaaaaggcattttgcagatgtgattaaattcaggattttgagatggggatattatctgggattatctggatggatctcatttaatcacaagggttcttttaagagtgaacacaatgcattttgttaaaggccttttctgcatctattgaggtaatcatgtggtttttgtcgttggttctgtttatatgctggattatgtttattgatttgcagatgttgaactagccttgcatcccagggatgaagcccacttgatcatggtggataagctttttgatgtgctgctggattcagtttgccagtattttattgaggatttttgcatcgatgttcatcagggatattggtctaaaattcttaaaactctcaataaattaggtattgatgggctgtatctcaaaataataagagctatttatgacaaacccacggccaatatcatactgaatgggcaaaaactggaagcattctctttgaaaactggcacaagacagggatgacctctcttaccactcctattcaacatagtgttggaagttctggccagggcaatcaggcagaaggaaataaagggtattcagttaggaaaagaggaagtcaaattgtccctgtctgcagatgacatgattgtatatctagaaaaccccatcatctcagcccaaaatctccttaagctgataagcaacttcagcaaagtctcaggatacaaaatcaatgtgcaaaaatcacaagcattcttatacaccaataacagacaaacagagagccaaatcatgagcaaactcccattcacaattgcttcaaagagaataaaatatctaggaatccaacttacaagggatgtgaaggacctctttaaggagaactacaaaccactgctcaaggaaataaaagaggatacaaacaaatggaagaacattccatgctcatgggtaggaagaatcaatattatgcaaatgaccatactgctcaaggtaatttacagattcaatgccatccccatcaagctaccaatgactttcttcacaaaatttgaaaaaactactttaaagttcatatggaaccaaaaacgagcccacattgccaagttaatcctaagccaaaagaacaaagctggaggcatcacgctacgtgacttcaaactatactacaaggctacagtaaccaaaacagcatggtactggtaccaaaacagagatagatatagaccaatggaacagaacagagccttcagaaataatgcaacatatctacaactatcggatctttgacaaacctgacaaaaacaagaaatggggaaaggattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaatctactcatccgacaaagggctaatatccagaatctacaatgaaatcaaacaaatttacaaaaaaaaacaaacaaccccatcaaaaagtgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaagatgtggagaaataggaacacttttacactgttggtgggactgtaaactagttcaaccattgtggaagtcagtgtggcgattcctcagggatctagaactagaaataccatttgacccagccatccctttactgggtatatacccaaaggattataaatcatgctgctataaagacacatgcacacgtatgtttattgcggcactattcacaacagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaatactgcatactctcactcataggtgggaactgaacaatgagaacacatggacacaggaaggggaacatcacacactggggcctgttatggggtggggggaggggggagggatagcattgggagatatatctaatgttaaatgacgaggtaatgggtgcagcacaccaacatggcacatgtatacatatgtaacaaacctgcacattatgcacatctaccctaaaacttaaagtataataataaaaaaaaaacagtgaaggcaatgcaaagacagaagtggagagagatttgaaaatgctaagttgctggctctgaagatgaaggaaggggacatgagccaaagaatgtaaggctaatgtagctggaaatgaaaagaaaaaagactctcccctggagaaggaactagccctgccaacaatttgactttagcctcataagtctcatagtaaacttcttagcttcagaattgtaagagaataaaattgtgttgttgtatgccactaagtttgaatagcagcaataagaaactcatacaatatacatacttgatgactaattctactcctgtatacccaacagaactgcatacatatgcgtaccaaaagacatagaataatattcctacaacactatttataatacacaaaattagagagttccaaaattccaccaacaatataatggataaaataattgtgggattaagtcaggatagtcttagtggaaggggagtaaaaagagggcttctgagataatggtgacattgtttctcaatctgggtgctggttacactgatgtgttcagatcatgaaaatttatcaggctgtacacttattatatgtgtacttttatgtttgtctaatatacttaatttaaaaaaaccagtgttctgattcactgatgcacctggactctctggaggttacccatgaaggccataggaccactggggaaaagactagaaagactttggctctagacaattttttatttttgtgagacaagaatcttgctctgctgcccaggccagagtgcagtggcacgatctcagctcgcttcacctctacctccgaggttgaagctattcttgtgcctcagcctccggagtagctgggattacaggcgtgcaccaccacatctggctaatttttgtgttttaagtagagacgaggtttcgccatgttggccaggctggtctgaagctcttggcctcaagtaatctgcccaccatggcctccctaagtgctgggattacaggcatgagccactgtgccagcctctaggcaattatttaatgaggtaaaagtctttcattctgttacttaggcacagtcctattatggaccacctgattctacagacataatatactacctagttgaaaaattcagcttatgtgatgtaatggagttatgacattccttcttcaagagagaggtagctttgttgcagtggaatgaccatggatctgggaggcaagagatgtaggcttgaactgtggctctgttacttactgacttactgtggtataacaaatcacttcactctaagatcatctgtaaaatgaaaagctataggattaaccacaatctgtaagaaataaacatgatatgtaaaaactcccagctccactctgtgcctggcctgtaaagaaaattggagtacatgtgttgtatctgaaaaagggaggacgatttcacttaggaatgcatatagagtggaggagatgtagttatgtcccagcccttgctgtctgatcaaactggacatagaagacccaatatagcactgagaaaagtcccagagcctgatctggtttaggacagggctggaacagcctgagatatgagaagagatgtgatctgaggataggaaaatgccggaagagtaacatccatcatctctaaagggcaaaagtgtggtgcagccatagcaataggtcaggaagcagggattctaagaggtgtgtaagaaatatagcactgagtaggttcaggtaaaggtttcaggacacagaatgtgaagagctctccagggctaggagttcactgcaacctggcactggcctaatgacatgagggtggtcagagagtttaaaggggcaccactggactagaaaatctggactattaagaatttcagcaggaagccttctctttagctaaacccttcacaggtgaggctggagcttggcgcacactgcctttctcccacatgtgattttaggcattcacagatcaaataaaagtttaaaaacctattttgatacatggcaatatgcaatccaatggttttctgttgtgttctatggcctttctgctgtgtgtctgttttgctattgattttaattatggaatataatttccggcacgaggtctcaaggcagctccctcccacgggccaagctcttgctagagcctcccagaggaaggcgaatgggaaagcagtatgacttagagctatgtgctattccttacaaaggacacaatggttcttttcatataaatgtcactgcttcggtctgatgcttctccactatcccactaagcttgaagtaagaatgaaatgtgggactagaaatactgcttagctgctgggctcatttcaacaaaaagcaaaggaacttgcaaagcagagcctgaaaccaggtatatggtatgtccaaactgtgagggaggccctcagtttaccaaaagttcaggtctgaaaataatattagcatatgggacacacacacattataacctcttgaggcaaagtgcataattgtaaaaagtcatgaagtgtaaatctggagattgggttctcattccagctctgtcactaactaccaataggaccttatataagcaactcaatgtatcagcacctcaatctcctaagctgcaaaacaagatcatttgattcaacaattgcttcctctgtgctaagcattgtgctatgtggtttcactgtttcatttaattaccagaataactttgccatggaaacattataatccaagtactttgggccatgaactacttcttttttgtacttatcagtccatactataatttatttgtgtaatgactgcctgtcaccctagactgtgataccttcagagcaaaagtgggtctgatttgattctatatccctagggtctaggacttgtcagagtaagacacaggcaagaagaagagaggctgttagagatgaaagtcaaactgaaaactgacttcactaaaagacaacccaggagcagaaagtcatgagaaggccctggggctttggcttcttctataacagaacagcaaatttctgtctgtctctttaatatatgcacacaagcattcattctctttttctctctctctcattctagggtgtgggcaggaacagtccagggtctgtcagtcaaggtcagtactaacagtgttaggaactgggtacaacttgagggagcttgcagcaggtcagattctccatgaagcaaaaactgaagaggaaattagcactcaggatgtttaaggaacactcctgggttcaaacctgctgaaggaggagaaagaagtaggagttgatgaaggaaaaagtaaactgtgatgcaaaactaagggtacccttgttacacccttagggagctctggagctagaatggcttttcagagctgtcctaagttgggccgagataaccaggcctttatactccttcctatatgaatcagccgttggatgtagagtccttaggaaggaacacaacattggctgtgtacctctccgtatatgaagcaatccctgaagaggcttacagctgaaggctgtctgccgagtacactcccaggaactggggcaatatgtcgtcttcaaaggagaatctggatggtgcatcattgtgtccaccacagatctcaagatcaccaaatccggactggcaatgcataagaggcatgaagttctggtaagactggatagctagtggagaggaacaggtgaacatatgtcggggtagaagtcaagtcaggcagcaaggatcctgaaggctgcatgcctaggccagagattgtaagtccaagttggcaatgcctgagtctagggagtcgggcaatgttcacagggtcaggcagggctcaactaacatagcagaaacagttttaaaaccagcagctaagagggctccaggaagtaacaccaaggaattgggaaagaagaaaactactattattatattacgttcctactctgtgctaggcattttacataatttatctcctttctttctagtaactccaagttaagatgctatatttcaccatgctgcagataaggatgctgaggcttataagacttcagtaaggtgatttaatcagtaaatggtagggcggacattcaagtccaaattaatgtctaggaggaaaggacaactcaatgagcctgggttccagggcagagtttcttatgtgtatgagacactcaagtcccagctgaaagaagactcagacctacaggttctgtgaccttgtgtgaatcatccatctacgggtctcagttttttctcatgtttcaaatgaagagtgaaatgaatgacttctaaggaactttttattctttttttttttttaattgagacagagtttcactccatcacccaggctgcagtgcagtggtatgatcttggctcactgcaacctccgcctcccaggttcaatctattcttgtgtctcagcctcctgaggagctgaattacaggtgcgtggcagcatccccagctaattttttgtatttttaatagaggcaaggtttcgccatgttggctaggctggtctggaactcctgacctcaagtgatccgcctgattggcctcccaaagtgctgggattacaggcatgagctaccatgcctggcctaaagaatgttttagttctaaacatctatatatgtgaacctaatacatggttctaaataagaatactctatacagaataatgactaacagcatgaattctggagtcagagggatctgtgtttaaatccttactctttgacagtgtgaaatttagtaggggtgtgggtgggtggcacatgcataagtgtgtgtgtattgatttgtgtctgtgtttgaggtgtgatattttaaaaacatccagaaaagtatgagacaaatagagttcagagggtgttctgttccattttcaatctaggggttataaaacagactgcctctaggctgccccatagcaaattgattcctgtgggatatgaacaaaaattaggaagtactatgttcccccgtgagaggacacagaagttagctgagaatctggctgggagcttactagtgagaagtcctcatgtcaaaggagagactatctgatatagatcatagacaagagaaaatatgacaccagaaaggacttctaggccatgatcaactgagagagggagagagatagagagagagagagagagacagagaagggagacacagcaccagcagtaggttttagcagcagatacccttagacggccaaacacagagcttggacacctcattggtctcctatctgaggaacaacccagatcagccattccatagctaagatcaaagagaatccagagactatcttgtggatccaaaattcccatggccgccttcttctcacaaggtcagtactatcagacactattttagagtggaggaggaggcagggaggggaagtaaaaatccgagagatcaggcaattttacctaaagagcaatatatcagtataaaggggtggtttagttatggcacaggaccaagtttactggtttgaaataaaagttttgttattgttatttattttcaagcttcccagcacgtggggactcctgaggaagaccagagctgttttacagagaggaaaataccatattttgtctgtgtcctatgagtaaaatttctggactcactattataaaatattaacataagatttgatgttacaattttacagtgttagacttcatgtatctctaatgtgagtatagttattgacacataataggatcttagtatctgttgaatcagtctaatgaataaataaatgaatccattttgaaaagtcagcctcataacacccctgtgaagtagatagcagtataatatccattgaaaatctaggcttagaaaggttaactgagttgtgacaagccatatatagcatatacatttgcattggtgtttgaacttgggtctcttgactccaaggccatttcctggttccactatcacttgttctcacttcaatctcatgccagccacaaacccaccactaagatgctgaaggacaaagagagatttttctgaggcccattctaggcctagggtcctgtccactgactcatgattcagattcctattctgttatgaggcatctgtggttagcagttctcacatattcatgtctgatataaatttctacatagctcagcttaagaatgcataaaccacttccctggtacagacttcctgctcacacagtaaaagccaatctccctcagcattttcagcccctgttagtgcttacccaatagtttctgtctttgggaccccagattgagaatttgggattagagtctactgttagaggcttattatttttgtcttcctgcttatagcaatatttttgcaaagctgagacaggtcccttaacccaggactctcaagatgatgcaagcacagtcctgcgaacatttccagagaggtcagagggtcaaaggttagactgaagcccaggctaaaggattagattatgaacagggcgcctataagtaaaggcttgagaacagttttgaaaagtgaaaatttagaatgttaaagctgtcaaagacctaagaaaaacacctgatacaactgtgcagaaggggaaactgcagccccaaatgcacatgagactgcccacagtcacacaggctgaagttctatgacacgctggattcgcctttgaagagtcaagcttctgacttctctattccctgctcctaatctcacatctctctgttcatttcctagcagaagtctcttcccctaggctgctccctccaaatccttatggaataggtaactggtacttgtgttactaagaagattctacacaatccacttcaaaacctagggaaatttggatacagagactttaagctacttgctaatggtcatctagaaaaacatgttctgtttgactgatatccttctgacttctgatctccagaccccaaaatctctttcatctatgtatcatgcatattcatcataatcccccctttccagtgaaacaaaattgtgtcgactctttattacttccacaaaacattctgattttcacattcaaatcccttagtgattgggtcccaaactaatctgtgcactcgccattccaccgactcatgttcagcctatttggaggttccttaccaggttaggaacatgctatgcactagcacacctccaaaccatggctcatcctgatctcgccaacctctctgacttaagcttcttcttcctccttcttcacctgctaaatagttcttattcttcaaggctaacctcaaatggttcctcctctgggaggcatttctgagtcctcatgatagaatttaatgttcattcctttgtgtctccatatcaccctgtacctggattatggcattttaagtcacattttaattttatagtaatgtatgtgaatcccacagttgactgaatctccttgagggaaggatatgtttcatttttataaaaggaatgaacattatcatacattaaatagagaagcaggtacaattattttttttcagagattagaaaagcggacaaaagcacgaggatgtagaagatgctttaatatttattctcctttccccttcatttaatattgacactaacttcttggattacttatttccattttaccatggaagaaggggagatcagataattcaagtaattttcccaaggttacagagcttaaccttggcagatctgggattctactaaattcgtctgaatccaagttcaagggctctttctagtgtagttctgttgcctctcatgcactcagcccaaatccaagccatggaaagaaagctcagaactccaaatgccctctcctataatacatcactctaggcatgaacgggctccaggaggcactataggtctgagaacagtttttatagttttgaagtgaccaaatattcacctctaaatatggctgagattattttattatttgcatagaaaaggcaccacagactgccctgtttaccaattcttctttcctcccacacaagaatcctcctagagctgggagatatcacatttcttacacgaaaaatgggctaacagcaatctgaatttcaatctctagcctaaaccttctgtttcaaaccagtactaaatattttgctgatatgcatttgttattttaagtggaatgcattataccagactcacagcagacattatgcatttatttatttattttaggcattgacattaagagtatagctctctactaagcactgaatggcttaatgtaagcaagtgctgccaggtgggaggacaggcatggcttttgcagactttccctggatagagagggcgcagtgaaacggaactgtagaattatgttcccaagaaccagacccaagaagctctctcaagcacaatgtttgcgaacagcaagaaacaacaggacacagggattatttaagaggtctctgagagcctgtaggatcatagaactgttacttggaagggttcttagagatctgtccatgccccacctgttacagctggggaaagtgtgttacagagagaagagacagcgtacctaacattacacagtgagctagtggagagagttaggaccggaataaggaaatgctgatatcctggtcccaataccatccactttgcattattcttcaggaaaaaatatgggagcatctaagcataatattaatgagtgcaagctttagagtaagtgggacctgtgtctgcattctgtgtaactcagtagctgtgtgacatagtagctgtgtaacatgagaatgttcctcaatctcgctgagcttcagtccccttatctgcaaaatgaagtaataagaatagctacctcataagagtacctaattcatagaattaatctgaggataaaatgtgcaaatgtatggaaaactcttagcacagtgtctgacacaataaattctcaataaatgttcctttttttgatgataatccaattgctactacattctttttcatctcttgattaactccaagggcaaaattagaagtactgactaaactctttttatagaaaggacaaaggaacataaaaacccctttaaaatggaagaaggagctaatatcatttcttaagtgagacaaggttaatgtaacttgaaaacatatcttttacagccttatctaggagttcagtttacctaaccacagtagattcaaaatatctctttctttggtgacggaccccagtgctggctggttgttctcaaagcaattctgaaagactagagaactacaccacattccagatatatccataacgggcagtgaatgtttctagttaattctctcttgatactgcctttaccaaaagggttttaccttgcttaaatcacacatacatacctcacatatgcttgtcactccaatcatcagcagaaacaacactgagttcaataatacacatttttatttgtctttgtataccaggacccagggccaacttctgagtatgttcattttgaatttcagtgaagggtgttatcatatgtttgtcctaagagaagcagtgtggaagatactgcttggatggctactgaattcccagtgattctgcattccttggaaatgggcctagtgaccagaggtaggcacatggctgtgtctgtccaatatgatcctgccctaggcatagttcactgaaccataagtcaatatctgacctaagcaaggacccattccttctctgagaaatttagaactggaaatggagagacaagactagttttgttgacactgagtcatattcatgttaatatctgagtaggcattccatgaatttctactgctaaggttccccaaggagtgcctgaaggatttacccaaggctttgttcctcaactatcctttaaattctatgaaagaccttaatatccttccaatattattgtctcattttgttgttctcttttatttataaccaagaacaactttactagcaaaagtggggtagaaaattatcttgtaatggttaacactactttttcttgaaaagggaacttcccttttttggaaaaatactatgataagctacttggggatagaaaatgaaatcctaagatcatgaggttcaactgacaaagaaacaaaaggtgaagtttctgtagttcataagaaataaacaggaatttatagatggaacaagcagagaagaaaggaaagtgggagaaatgaattaaaatatatacagacagtcttcaatttatgatgaatcgaactgatggtcttcagctgtgtacttcaataattagtactcatatagccattctatatttttactttcagtactgtatttaataaattacatgagatattcaaaactttagtataaaataggctttgagttagatgattttgcccaactgtaggcacatttaaggtaggcaaggctaagttataatgtttggtaggttagatatattaaatgtattttcaatgtaatattttcaacttacaataggtttatggggatgtaacatcatttttaagcagagaagttaggagtatctgtacaaggattaggatatggagaagatgaagcccaaaataatataaatggttaaagatgtcttaagagcaggtgtgactaaaattaaagtttaatgttgtttgcattgctgtaacataaagtccttccatctccccaaatcttcaggaaagtctgttctacacataaagacttcatatagtggattaattgtctgtgtgtatatatgcctgtgggcatgtatgaatatgtgtatgtgtgtgtgtgtgtgtgtgtgagagagagagagagagagagagagagagagagagagagagacaatatttacatgtatccaagagaagggttgaattccttgcctgggtcaataagaacatcatatgcaggatagggggatgatcaataaactgacctaatacagggagctatgagccaataatattcagaatacaaaaatttaccccaacccacagaaacctctgggagagattggaagggatatagagctcccagtacccatagggtgggggctttgtgctaattttacttgaatctttgacaaataaacctaaaaacccacttcaggtgacatctaatttacagagcctatttggacaagtgaccttggcaagttatctctctttctgcttcagatccttagtccagccaggattgctaccagggatcttcactttcaaccctctgcactgtaagaacgttggggcagacaggccattccatagctacttctctgatatcagaatgttcgtatatattcatcctgttgttacctatgaattcttttgttcatgtatccactcattcaacaaatattaattagccatccattatgtgttagccactattctagatacctgggatacaccagcgaataaaacaggaaaatccctattcttcccttctgggacaccagaatttaaataataggaagttttggtacagtttaaacaagaataaaataaagtagaaaaaagaaaagcaggtaaggagaagggaaaggtgggggaatctctgtttaatgagagcacaggagcttttctggtgattgcaaaccaaatgaacaaaactgtatctagagtctccaagccatcatagaaactactttctgcaagtaatggttctggaagtacaaggcctcatactgccatcagagtgagcaaagcatgctgggaggcctcatctctttgcactgtcaggggagaacgttcagtgttattgacaaaatagtgaatgatttcttaatagaatacagtcagcagagacaggggttatggcataattaacataacatgaattttttaaaaccccatgtgccacctgccagcaggagataggccagagacagagaaggggtgacagccggacagaggtttgctccactcttcaccctacagcatttgttaaggccctaaatctgggtccagtaggtatggcaaagtgcactaaactgcagacaggagaacgccctcagttctgccatgaactcactgtgtgaccttcagcaagttccaccccttctctgggcccttcatccagttacctacctgaaaaatgagggggttggatcaaatgatcctctagacatgggtttttcaaacattctattataacttttaagcacaacctcctttttcaaaaaactttacctaaagccctataaccttaagcaactgaaagcagaactgctctaagtgtaatagcagcagctggggacagataggaattcatcttctctcctcggtagcatcaccttttacttccctggattggggagaaggtttccccagtcatcttagctacaccccttctgctctctgagggaacagctactgtggaagccatcacccacccagtgaatctagcactggagtgcactgtctgcctcaactggaaggctgttagggctcttctcaccaaacttgacctttgaatttccctcagtccctgctagaatctcaaaatccctctggcatctatcttgacctgactattactctccacctgggtggggccatcccttaatctaatccaatctctcaccttctccgtccttccttcctcccagtgtccactcagaataatgtaatactgcccacctcacagagtagttttgcaagtaaaatgaattaatatatgttagtatttagtagagtgcttggcacataacaagcattattagagtattttttactattgttaattttattgttgttgtgaatagtattttctaggtgccagcaataccatggcttaaactctggtgaatcactagattgactaatcttaatttacctaccaacagctttcatttttgcctcactgattccacctttccccgtccactttcatttttcttactgacttctatattcatgcatcatccaacatcacagattttaaccccaatactatgtttttagcaaatagaacaatgcctggctcacaataagccatcaataagtactttctgaatgaataataaaaaaaactccaattatcttttttctcactccatttcagctcccgtcacctcatctctcccccatcaacacacacattctaccctgtctacaatctcagatgtccatattgtgttctccaagtgcaactttcaaactaatttgcattggcatttacactacaataactatttgaaatctaatccattgatcttattacttgatagccatcagtccccttcctgttttctcctcccttcaatgtccacatttataattatttcctcacaaacactttcaattcctttgcctctagccatgtttttctcatgtggcaaaactcaaacccagaatgaattcttccacctaccttatccaggccccaaataatgagaaaatcacatatctaagtagaaggattacaatttacattcattatatcagtctgcacacaactgttatcactgaaacaattatacagggctatcatggtaagtaggtttctcatttttttctctaaaaaaagttcagaccttcttctatttattgaaaaccattattctttttcccttaccaccattcttagagggtaggagcatcctcttattccctcagccaaagttagaaacatgcctatgtctttctataatcctgttagcatggataaaggtgtccttcttaacaaaggccttttgcatgtcccctggatcccctgcctctcacttgctcaaggactgtactcttagttatctcccactttttctgaattgtcggtactgctgtctccctggatcattactattagcaaacaaccttgaccccgtgactcaacactccatccaccatcagctgctgcccatttctctgctcctcttcttggtcaaacttctgcatatgcatatgcttattcttcagtgacaattcaattcagtctactcttgattttcctcctacctctggccatttattttctgatttttatgtgggcctcttctcttctgtccaacctcaaacgatggaaatttcccagggtgtgatctccatagaagccaatgtattttttaaaaagcatatcaatttggataaatgtaagcctcctccccccaaaaaagtcttcaatgtcttctaatgtagatttcaagacctatctgactttagccctgcgtctctctctaacttcatcttctattacatgtttcctttcaattcgttgaattttttttttttttttttgagatggactctcgctctgtcacccaggttggagtgcagtggcgtgatctcgcctcactgcaagtttcgcctcccaggttcacgccattctcctgcttcagcctcccaatagctgggagtacaggcgcctgccaccacgcccggctaattttttgtacttttagtagagacgaggtttcaccgtgttagccaggatggtctcaatctcctgacctcctgatccgcccgccttggcctcccagattgctgggattacaggcatgagccaccgcacctggcccaattccttgaattctatataatgtctttcccactagaggctttcagccattctcttccttctatttggcatgatcttctgtgccccacacttcattccttctaaatattcaatcttcagattaaatgtactgtcacctccacagagaggcttcttttgaccatatcatctaagtatgtctctcatgccatcttctaacactaaacatgataagttataatagcttatcacagttttaaattatatatgtatttcattgcttacttgtgtacagtctctctttaccatcatattagaaagcccatgaaagattaaattaaaatcccatcagattaaataagataccatatttgcattctacttactgaagtatactttgtccccagcacaaagtctgtgctcagtaaatatctgttagataatgttcaataaactctaggaccacaaagactatattttgaatgatatttgattatactgtaagctttctaaggacaatgattgatctaatttatttctatttctccagcatttggcataggcagagtaggttatcagggaaggctttcagaattaaattgagatgcattctttgagtctgatatttcaagtaacataatgtagtagtttcacaatcctagcaactgcctagctttgtctgtgttctacttagttaaaattttaaagactctgaaaggggcaacatgtataacatgtgtgaggtctgagatttgaagtgattaaggcatacttggaattccaactttttcacctcagtagctaatagttgtaattggttaatgtttgaggatctgttttctggagtataacatagtgatagaaatagagttcctttgaagattaaataagataccgtatttgaaataacagacacatacaggcatacaatgctaacaaccatctgagccttcagagagtcatcatctttttgctggtggagggtttgccttcatgttcacggctactgactgatcagggtgctattgttgaaggttggagtagctgtggcaattcttaaaataaaacaacaataaactttgctgcatcaattgactcttcctttcatgaaaactttctctgtagcatgcgatactgtttgacagcattttacccacagtagaacttttttcaaaattggactcaatcctctcaaaccctgccactgctttaataacgaaggttagaatatcaaaagtagctttgatgtgatttcaaaaatgttcacagtattttcactgggggtagattctatctcaagaaactactttctttgctcatcaataagaagcaactcctcatccattcaagttttatcatgagattgtagcaattcagtcacatcttcaggctccacttctaattctagttatcttgacatttccagcatgtctgcagttatttccttcactgaagtcttgaacccctcatagctattcataagaaatggaattaacttattctgaactcctgtgaatgctgatactttgaccttctctcatgaatcacaaatcttctttttaattttttttttttttttgagatggagtcttgctttgtcacccagaccagagtgcagtggcgcaatctcggctcactgcgagctctgcctcccaggttgcgccattctcctgtctcagcctcctgagtagctgggactacaggcgcctgccaccacgcctggctaattttttgtatttttagtagagacggggtttcaccatgttagccaggatggtcttgatctcctgacctcgtgatccacccacctcggcctcccaaagttctgggattacaggcatgagccaccgcacccggccttaaattttttttgacaaggagttttgctctgtcacccaggctggagcgcagtggtgtgatctcagctcactgcaacctccacctcccaggttcaagggattctcatgcctcagcttcctgagtagctgggactacaggcacaaaccaccacaccaggctatttttttttttgtatcttttttagtagagatggggtttgaccatgttggcaaggctgttcttgaacacttgacctcagttgatccacctgcctcagcctcccaaagagctgggcttacagccatgagccactgcgcccagacacaaatgttcttattggcatctaaaatcgtaaggattttctagaaggttttcagtttactttacctagacccatcagagaaatcattatctatggcagctatagccttataaaatgtatttcttaaataagaagacttgaaagttgaaataacttgttaatccatgagttgcaaaatggatgtagcgttagcaggcatgaaaacagcattcatctgtatatctccatcagagctcttgggtgaccatgtgcattgtcagtgagctgtaatatttttgaagaattttttttttccctgagaagtaggtctcaacagtaggcttaaaatatttagcaaaccatgctataaacaaatgtactgtcaaccaggcttagtggttgcatttctggagcacaaacagaggatattttttataattcttgggattttcagaatggtcagtgagcattggcttcaacttaaagtcatcagctccattagctcctcacaagagagtcagcctgtcctttgaagccttgaagccaggcattgacttctcctctctagctatgaaagtcctatatgacatcttctttcaatataagatgtgtctacattgaaaatgtgttatttagtgagccaccttcatcagtcatcttagctagatcttttggataacctgttgcagtttctatattagcacttgctgcttcaccttgcactttttatgttatggagacagcttctttctttaaaccatatgaaccaacctctgctaacttcaaacttttcttctgcaccttcttcatccttctcagccttcaaataattgaggagagttagagccttgatctggattaggctttggcttaaggaaatgttgtggctggtttgatcttctatccagaccactaaaactttctccaaatcagcaataaggctgttttgctttcttatgatttgtgtatttactggcagaacactttttattttcttcaagaatttttcatttgcataaacaacatgactgtttggtggaagaagcctatctttcttcctaactcagctttcaagataccttccttactaagattaataatttctagcttttgatctaatgtgacagacatgtgactcttcctttcatttgaacactcagagaccactggagggttattaattggcctaattttaatattgttgtgtctcagggaatacaggggcctgaggtgaggaaggagaagggctgatcagtggagctttcagaacacatacaacatttatcgattaagtttgttgtcttttatggtcatggtttgtagcaccccaaaacaattacaatagtagcatcaaagatcactgattacaaatcaccatagcagatataataataatgaaaaagtttgaaatattgcaagaattaccaagatgtgacacagagacatgactaagtacatggtgttggaaaaatgatgccaatagacttgctgaacacagggttgtcacaaaccttaaatttgaaacaaaaacaaaaataaaaacaaaaaaccaacacagtatctgtaaagtgcaataaagcaaaatgctataaaatgaggtatatctgtagttggtttataatgaaagttaactcctcatttagcatttaataaagaatcctgtttgggctggaagtgttcttggagatcattcagataactcttctgattttacagatgggaacttgtttagggtcacacaaaatatcaatacaaaggctgaaattagtatgtgtatcttttctgtgtattatttttcttctactgaaaagagaatattataaaattctatggtgtagttttaggaacggaaaaggtactactgtaatatcacagtggacatgctcagaaaatgtactactgtaatatcattgtggacatgctcttaaagagaatcttaaaacttgtagatagacaaaatttttaaggcaatagcctgtatttatatcccaaagctgttatctactccaatttggtcaataaatatatacgtgtacatatgcatgtgtgtgtttggagggagagagagagagagggagagatagaaagagagagaaagaatccggtatactctatatttgggctgggatgaatgagacttccaagtaaaatcctcattgaaattgttataatattaagacaggcaaagtacacatgttattcaacacgaagttaatttcaattctaagatacaaatccccccccattttatatctctgaaattcagataaatcttacaatctctactgtgacagtcatgacccattgacattgcctgagtacacatatcaaaacctggtaatgtgtcggtggctggggagaagaataccaagatgacagtagacaatttgaagaaatgctgtatctccatgttcttaaaggcactgaagatgctactgtgtggaaaaatgtgtttcttggcaactctgagtccaaaagtaattaagagaaattggatcctgaatgttttcaaaatactttaaccttttatttgtatgtctttgaaaaattatgcacgagatatctatgattttttaaaaatctctgtataagtatgttttttaaagctctttcaaagagtagaatataaaaattcgatatattaagaaagcattgtgccagagtttaattggcaacatttttcttctttttaaaatttttttattatactttaagttctagggtacatgtgcacaacgtgcaggtttgttacataggtatacgtgtgccatgttggtttgctgcacccatcaactcgtcatttacattacatatttcttctaatgctatccctcctccatatccccaccccgccaacaggccctggtgtgtgatactccccatcctgtgtccaagtattctcattgttgaattcccacctatgagtgagaacatgtggtgtttgattttttgtccttgtgatagtttgctgagaatgatgttttccagcttcatccatgtccctgcaaaggacatgaactcatccttcattatggctgcatagtattgcatggtgtgtatgtcccacattttcttgatccattctatcattgatggacatttgggttagttccaagtgttagctattgtgaatagtgccacaataaacatatgtgtgcatgtgtctttatagtagcatgatttataaacctttgggtatatacccagtaatgggattgctgggtcaaatggtatttctaattccagatacttgagggatcggcacagtggcttccacaatggttgaactaattcacactcccaccaacagtgtaaaagcacttctatttctccacatcctctccagcatctgttgtttcctgactttttaatgattgacattctaactggcgtaagatgaaatctcattgtggttttcatttgcatttctctgatgaccagtgatgatgagcattttttcatgtgtctgttgtctgcataaatgtcttcttttgagaagtgtctgttcatatcctttgcccactttttgatggggtttttttttttccttgtaaatttgtttgagttctttgtagattctggatattagccctttgtcagattggtagtttgcaaaaattttctcccattctgtaggttgcctgttcactctgatggaagtttctctggctgtgcagaagctctttagtttaattagatcccatttgtctattttagcttttgttgccattgcttttggtgttttagtcatgaagaccttgcccatgcctatgtcctgaatggtattgcctaggtgttcttctagggtttttatggttttcgatctaacatttaagtcttcaatccatcttgaattaatttttgtataaggtgtaaggaggggatccagtttcagctttctacatatggctagccagttttcccagcaccatttattaaatagggaatcctttccccactgcttgtttttgtcaggtttctcaaagatcagatggttgtagatgtgtggtgttatttctgaggcctcttttctgttgcattagtctatatatctgttttggtactactaccatgctattttggttactgtagccttgtagtatagtttgaagtcaagtagcgtgatgcctccagctttgttctttttgcttaggattgtcttggcaatatgggctcttttttggttccatatgaactttaaagtagttttttccagttctgtgaagaaagtcattggtagcttgatggggatggcattgaatctataaattaccttgggcagtatggccatcttcactgtattgattcttcctatccatgagcatggaatattcttccatttgtttgtgtcctctttcatttccttgagcagtggtttgtagctctctttgaagaggtccttcacatcccttgtaagttggattcctaggtattttattccctttgtagcaattgtgaatgggaattctctcatgatttggctctctgtctgttattggtgtataggaatgcttgtgatttttgcacatggattttgtatcatgagactttgctgaagttgcttatcagcttaaggagattttgggctgagacgatggggttttctaaatatatgatcatgtcatctgcaaacagggacaatttgacttcctcttttcctaattgcataccctttatttctctctcttgcctgattgccctggagagaacttccaacactatgttgaataggagtggtgagagagagcatccttgtcttgtgctggttttcaaagggaatgcttccaatttttgcctattcagtatgatattggctgtgggtttgtcataaatggctcttattaatttgagatacattccatcaatatgtagtttattgagagtttttagcatgaagtgctgttgaattttgtcaaagcccttttctgcgtttatagagataatcatgtgtttatgtgatcgattacatttattgatttgcatatgttgaactggccctgcatcccagggatgaagctgacttgattgtggtggataagctttttgatgtgctgctggatttggtttgtcagtattttattgaggattttcacatcatgttcagcagggatattggtctaaaattctctttttttgttgaatctctgccaggctttggtatcaggatgatgctggtctcataaaatgagttagggaggattccctctttttctattgattggaatagtttcagatggaatggtaccagcacctctttgtacctctggtagaattcggctgtgaatccatctggtcctggactttttttggttggtaggctattaattattgcctcgattacagaacctgttattggtctattcagagattcaacttcgtcttggtttagtcttgggagggtgtatgtgtctaggaatttatccatttcttctagattttctagttgatttgcgtagagatgtttatagtaatctatgataggagtttgtatttctgtgggattggtggtgatatcctctttatcattttttattgcatctatttgattcttctctcttttcttctttattagtcttgctagtgttctatcaattttgttgatcttttcaaaaaaccagctcctggattcattgattttttgaagggtttttcgtgtctctatctctttcaattctgctctgatcttagttatttcttgccttctgctagcttttgaatgtgtttgctcttgcttctctagttcttttaattgtgatgttagggtgtcgattttagatcttttctgccttctcttgtgggtattcagtgctataaatttccctctacacactgctttaaatgtgttccagagattctggtacattgtgtctttgttctcattggtttcaaagaacatctttatttctgccttcattttgttatttacccagtagtcattcatgagtacgttgttcagtttccatgtagttgtgtggttttgagtgagtttcttaatcctgagttctaatttgattgcactgtggtctgaaagagagtttgttgtgatttctgttcttttacacttgctgaggagtgctttacttccaactatgtggtcaattttcgaataagtgttatgtggtgctgagaagaatgtatattctgttgatttggggtggagagttctgtacatatctattaggtccacttggtccagagctgagtccaagtcctggatatctttgttaccctgctgtcttgttgtgcagtgttaaagtctcccactattactgtgtaggagtctaagtctctttgtgggtctctaaggagttcctttatgaatctgggtgctcctgtattgggtgcatatatatttaggatagttagctcttcttattgaattgatccctttattattatgtaatggccttctttgtctcttttggtctttgttggtttaaagtctgttttatcagagactaggattgcaacacctgcttttttttgctttccatttgcttggtagatctttctccatccctttattttgagcctatgtgtgtctctgcatgtgagatgggtctcctgaatacagcacaccgatgggtcttgactctatccaatttgccagtctgtgtcttttaattggagcatttagcccatttacatttaaggttaatattgttatgtatgaatttgatcccatcatgatgttagctggttattttgcccgttaattgatgcagtttctttatagcattgatggtctttacaatttggcatgtttttgcagtggctggtaccagttgtttctttccatgtttagtgcttccttcagaagctcttgtaaggcaggcctgtttgtgacaaaatctatcagcatttgcctgtctgtaaaggattttatttctccttcacttatgaagcttagtttggctgggtatgaaaagttgaaaagtcttttcttgaaaaaagttgaaaagtcttttcttcaagaatgttgaatattggcccccactctcttctggcttgcagggtttctgccgagagatctgctgttagtctgatgggtttccctttgtgagttacctgacctttctctctggcttcccttaacattttttccttggtgccttaacatttcaaccttcgtgaaactgacaattatgtgtcttggggttgctcttctcaaggagcatctttgtggtgttctctatatttcctgaattttaatattggcctgtcttgctaggttggggaagttctcctgggtaatatcctgaagagtgttttctaacttgattccattctccccatcactttcaggttcaccaatccaacatagatttggtcttttctcatagtcccatatttcttggaggctttgttaatttctttttcctctttttcctctaaccttgccttcttgctttatttcattaatttgatcttcaatcactgataccctttcttccacttgatcgaatgggctactgaagcttgtgcttgtgtcatgaagttctcatgccatggttttcagctccatcaggtcatttcaggtcttctatatactgtttattctaattagccatttgcctaacctattttcaaggtttttagcttccttgtgatgggttcgaacatgctcctttagcttggagaagtttgttattaccaaccttctgaaggctacttctgtcaactcatcaaagtcattctccatccagctttgttccattgccggcgaggagctgcaatcctttggaggagaagaggcactctggtttgtagaattttcagcttttctgccttggtttctccccatatttgtggttttatctacctttgatctttgatgttggtgacctacagatgaggttttgttgtagatgccttttttgttgatgttgatgctattcctttcctttgtcagttttccttctaacaggtccctcagcggcaggtctgttggagtttgctggaggtccactccagaacctgtttatctgggtatcatcagcagaggctgcagaacagcaaatactgctgcctgatccttcctctggaagctttgtctcagagaggcagcaacctatatgaggtgtctgtcggcccctactgggaggcgtctcccagttaggctacacaggagtcagggacccacttgaggaggcagtctgtccattctcagagcccaaacgccatgctgggagaaccactgctctcttcagagctgtcagacatggacgtttaagtctgcagaagttgtctgctgccttttgttcagctatgtcctgcccacagaggtggagtctatagaggcagcaggccttgctgagctgcagtgggctccgcccatttcgagcttcccagctgctttgtttacctactcaaacctcagcaatgtcagacgcccctccccaagccaggctgtcccctcacagtttgatctcagactgctgcgctagcagtgagcaaggctccgtaggcatggtaccaaccgagccaggcacgggagagaatctccttgtctgccagttgctaagaccttgggaaaagcgcagtatttgggtggaagtgtcccatttttccaggtacacactgtcacagcttcccttggctaggaaagggaaatccctcaaccccttgcacttcccaggtgaggcaacgccctgccctgctttgcctcgccctccatgggctgcatccactgtccaaccagtcccaatgagatgaaccaggtacctcagttggaaatgcagaaatcaccagttttctgtgttgatcacgctgggagctgcagaccggagctgttcctatttgtccatcttggaacagaccccacatttttttttcttagtaatacataaagtaatggtatatcttaacagttgatggcttcctaaatttgatgaaatgtggtatgtcacaccacataaataaaatgctgcaggccacatgacactttctaacaaaaatattccaatcacattaatcttgtactgattaacaacaatttaggtttggttgtgactcttaaaataatactaatcaatttatcaaatactgcatatggttaattatcacacagttgttaagtgtaaaagctctggaatccaagcaacctgcagtttaatcctaactccctcttttactaaatccatgaccttagacaatttacttcagctctctgagccccagtttttgatttttcaaattggcacaataataatcctaacttttaatgttttttataaggattgaatgaaataatgtaaataaggcagttagcaatgcctggcaccctggaatggttcaatatctgttagctactatattgtttgtttgtttttgttttttctgagacagagtctcactctgtcacccagggtggagtgcagtggtgcgatctcggctcactgcaacctccgcctcccagattcaagtgattctcctgcctcagcctcctgagtagctgggattataggcacccgcaaccatgcccagctaattttttgtatttttagtagagatagggtttcactatgttggccaggctggtctcaaactcctgacctcgtgatctgcccgccttggcctcccaaagcgctaggattacaggcatgagccactgcgcccagccctgttagctactatattgttattgcccactattgttattatagtatcgtattatttgatctttacaatatccatttgaggctattattacctctaatttatagatgaatatttaattcttagaaactttctcatggaaaagggttatacagaccacaggttatttagaaaatttgtggttagtaaattatattagtcagttaattgtcagaaagtcaagcttaagtaacttgccactcaatatttatgaaaagctcagttgagagaaaaaatacacagaaaatagcctaaaattatatatttcatacacattttgagatattctaaagtttatctttgaatcaagccaagtttcaagagaacaacagtttgctctctcataggattgcttttatcaatatggcagataacaaaggactaaattgagagctggtataagaaatagccccatgaaatgtttttcctattgctagggtgtgtctaaggatgtggtggagactgttgcttatcatataataaactctactccttataaagattgcccactctctcctactctccttgggtctcagtgtcaataaaagctgtgtttgtcctaagaaacttaattgagttttgtaatggattgtatgagccatgtgtctgtttctatatctcttgttgccttggttgctaggaaactcaaagttaagtttattactcaacccaataagtacagacattatccttactcctggcttcttctttttcctactctcattttgccagaagggacagcttgcaatatatctaaaatggaaaagagcttggtgccttcaaggtactgatagaagatgtactgatagaagatagaagattcaacatgtagttggatcatttttagaatggctagagatgaagctggaaagatagacatggccagctggaggccttggaggtggtaagaagttctgtatttttataatacacttcaaagagtctacggcaaatgaaatataacaaatcagtcaataaacaaaatacatatataaataaattctaagcatgtatctgaatactatagatttcccatggagaaaaattaattaaactatatttcccctgcctccaatcctggtttgcaatgaagagtcctctataatcagcagaatgaagaacagaaaggtaagggtcaaatgatagaagatagaacaatttttccaaaaagaatggcataaacacattttggaagagaaattttctaccagcatctgcctggctggagccctccctcatcagctgctattggataattaactccacccacacgagcatgctacatttgccaaccctgaccgtagcactgctttacaagcaacttagaggctttacaagggcagcaggctgatgtagctcaatggagaggaacaggatctggatttgaaaccaattcattaaccaactagctgtgtgaccctaggcaagtcacccttctgaaactagtttcttcatgtatcaaatagagaaaatggcactaacattcttatcatacagggttgttaagattaactgtagataaagtagcaagattttatggaaataaaacagttgaggaaaccaggagagctgactgctccaactatctctgaaatttaatttctgtgaaatgaggcagttggattagaaagtctcatagtgggattatatttcaactttatgggttgcaaaatagtcgtacaaaataaaagactatctggatataaggagcaatcaaagaatgggtgcctgccagggctcaaagagtatgtttgctagtctcttgaggagtgtgaattagcccacaggaccccaaagtttgttctcagtcagttggtgactttggagtgttgacagatttgaaagggaaacatttcaccaagtgaatgtgtaagatacttttaaatagatctataaaactcaaagtgcaccacaagaagaaaaaatgaggaaaaaacctgggcatttaatattcaatagcaataaaatttcagaaaaaaagcatattttggtgcattttctggaaaacacaaaaaggcctatttttgagaatttagatatctgaaacaatagaatatttatttggtaccttttatatgtaggtacttaatatatatatattacttagtgctcataataaccctgagatgtagggtttaatgtttgttttatagatggcgaaatggtattaagaatgttcaaataattttcccctagttgtatggccagcaaatggtagaagtgtcatataaagcacaaatcattggcttcaaagcccacattctttctatcataactggctgcttcgcaaggagaactagggctgtgctcatcaaatagatcaagtgtatatggaacataattaggataaatctgaagagaaactaagcagatgagatatgttaagctctacactggaaagaagaaaagtgtaaaaaactaataaaatattatagaaaataatagaaagtagctgattgtacattatagattacaaaacactttcccctacccatttaattcatttgttcctcacagtgatgcaagcagtattatctccattctcaaatgagaaaaaaggctcagagagggtagatgactttaccaagggcatccagatactaattagagtttgagcccaaatctttcttccaagttcctgtcttttccaccacaacaaatcaacggggttcttactctcatggcatggacaatgtcagtctatagagggataattgtttccagattcattttcattggaaaacagcccttattcttaggcatgaaaaatatcagtcccatttttgtctgctcccaagtattctgagggaactgatattgaacagtgctagctgacaaaaacagctgttgtaaagatctgaagagacccacctaagcttagcaaaaccccacaacacaagtccaagaatccatagcacataccctttgttcctctaacaattaactgatgctgctaggatagggcttggttatacgatgaagaacctaacaagattatcacttctggaaaggaccccacgtgttgggaatagaaatcagtttaccgttccaagcagcctggaaattacagaaagcataatgtttaactaacttgcccaggctgctgcttagaaaatagagaaaattgccaagtgcttcagagttcaatagtgatctgaagactccatagcactgtgaagctcataatctctaatcttcataacagtcctacaacctaaaacagacctaggagattattgcaaatgtatgggtgaggaaactgagtgatagagacaaaggaattaaactaaactggggatctattatagggcaggcagtttattcatataaacttaatcctcataatcacccaaagaactattataaataggcatgataaggaaaaattgaagtttaagcaactttactaactttcccagatttacacagatagtaagtgatataatcaaataatactcttggaagattctgcactgtataatcaagattagtcttgggaaattggtagtaatgttgtccagcccatactttctcaattataacatggtgcctcttttgatagattgtaaatgattttcctaagatcatttactcatctgttttccctgactagacatagctccctagcaatgggactttctcagttttatctttatatcaaaaaatacagtacaaagcttagcaggttggaagtgatttatttcacaaaccaaactgaaatccagctctgactatagattctgtcataaaagaccctagacagttttagccatagtatatcacattcaaaagcacattcaaaaagacttaaaggtatgcttccagccataataaaataacaggaaccagatttactctactgtcttaaataattagaaaactgaataaactatataaaacattttatttcagattttggataataggtagtaggtagactctaattcttgaaataaggggaaaatatgaagtgagccttgtcatcaccaggctttttgcctgggggcatattttggattgtgaagaaagaagagggacccaagcatagcttgatggtggttttaaattaagaagatacagattggactctgcagggggaaaggatgggaagcgagtgaaggataaaatactacaaattgggtttagtgtatactgctcggttgatgggtgcaccaaaatctcacaaatcaccactaagtaacttactcatgtaaccaaataccacctgttcctcaaaaacgtatgaaaatttaaaagaagaagatatataaatggccaattggggtctggagattctgaggtaatgaggggtagttttgagaggagacatctttgcagaaaaagagcttcagaaatatgcatggggtgaacttgaaattttactgtcttccaaagtgcatacaagggtaaaactccatgagggcaggcaaacagcaactagggagaactgaacaactcctagagataacagagacattaggatttattcaagtttgaacagtggaaatttctcattgatcccttgggttattcattgaaaactccaaaaaagctaggcttcagtaacagggccaaactatccgtagagtaaaaagtactctgtaacagatatgcctaaaatatcttaaaacaaaacttcaaaaggattaaacttattacaagtaactcaacttatagccaaagaaaaaccaaagacgacaaaatacaaacacacaacaatgtaaactctacaatgcccaacagtcaatcaaaaattaaagatatcaagaagtagggaaatgtcagctataaacggtagaaaaacaagtcaacaggaacaaatccataaattgtagttgtaatgaaattagcatataaaaacattaaaagagcaattataattatgtcaggtatttaaaggaaaaccaattataataaggaaagaagaaagatataaaaaagaatcaaatgaaatttctagagatgaaaaaatccatgaacatctgagaggaaaaattcactggatagaattaatctcagattagacactgcagaagtagtcagtatattaaataagacctaaggaaatgaagagatacattatgccatatattggaaggttaaatattattatgctatcaattatcctaaaattaacctataagttaaatataatcccaattgataaatttactctgtaatttatatagcaatgcaaagaaactagaatagctacaactattatgaaaaacaaggttggagagcctatactacctgattttaagagtttttataaagctaaaataatcaagaatgtgcaaaattggtctaaggattggcatatagatcgatggaacagagtcgagctcagaaatagaatacaaacagaaatagaaacagaatgtggtcaattgatttttgacaaaacagccaaaataacttaataaggaaaggattgttccttcaaccgatgatgctagaacaactggatatccaatggaaaaaataaacctggacaataatatcataccatatgcaaaaatgaacttaaaatgaactataaatataaatgtaaaaaagctaaactgtaaaatttctggaagaacacataggaaacaaatttttgaccaaaggtttggcaaagattttttaaataggatacagaaagcataaaccttaaaagaagataatatgataaaaatggactatataaaaattaaatatgtctgatttttgaaaaaaattcagaaaatgcaaaataaagccacatagaaaaaaattaataaatcatatacgtgataaaagacttgtatctagaaaatataaagaactcatacaattcactagtaagataatagaatcagaaaatgggcaaaagatttaaatagacattttaacaaaacccacaaacaaatggacaaaaagctcatgaaaaatgcttactatcatcaggcactaaaaatatccaaattgaaacaacattgaatactactacatacccactagaatggctacaattaaaaatattgacaattacaagcattgacaaggatacagagaaacctgaacttttatacactgctggtaagaatgtaaagaatgtactaatgactgtttttgttttttttgttgttgttgttgttttttcattttattattattatactttaagttttagggtacatgtgcacaatgtgcaggttagttacatatgtatacatgtgccatgctggtgtgctgcacccattaactcgtcatttagcattaggtatatctcctaatgctatccctcccacctcccccaaccccacaacagtccccagagtgtgatgctccccttcctgtgtccatgtgttctcattgttcaattcccacctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccagattttcttaatccagtctatcattgttggacatttgggttggttccaagtctttgctgttgtgaatagtgccacaataaacatacgtgtgcatgtgtctttatagcagcatgatttatagtcctttgggtatatacccagtaatgggatggctgggtcaaatggtatttctagttctagatccctgaggaatcgccacactgacctccacaatggttgaactagtttaccgtgccaccaacagtgtaaaagtgttcctatttctccacatcctctccagcacctgttgtttcctgactttttaatgatcacctttctaactggtgtgagatggtatctcatagtggttttgatttgcatttctctgatggccagtgatggtgagcattttttcatgtgtctgttggctgcataaatgtcttcttttgagaagtgtctgttcatgtcctttgcccactttttgatggggttgtttgttttttcttgtaaatttgtttgagttctttgtagattctggatattagccctttgtcagatgagtaagttgtgaaaattttctcccattttgtaggttgcctgttcactctgatggtagtttcttttgctgtgcagaagctctttagtttaattagatcccatttgtcaattttggcttcggttgccattgcttttggtgttttagacatgaagtccttgcccatgcctatgtcctgaatggtaatgcctaggttttcttctaaggtttttatggttttaggtctaacgtttaagtctttaatccatcttgaattaatttttgtataaggtgtaaggaggggatccagtttcagctttctacatatggctagccagttatcccagcaccatttattaaatagggaatcctttccccattgcttgtttttctcaggtttgtcaaagatcagatagttgtagatatgcggcattatttctgagggctctgttctgttccattgatctatgtctctgttttggtaccagtaccatgctgttttggttactgtagccttgtagtatagtttgaagtcaggtagcgtgatgcctccagctttgttcttttggcttaggattgacttggcgatgtgggctcttttttggttccatatgaactttaaagtagttttttccaattctgtgaagaaagtctgtcagatatttataaagttaaaaatatgcttactatataattcattaattaattcctaggtggaaaaaagggaaataaaattgtatgccttcaaaaaatcttgtacataaacattcatagtagctttattctttaatgaaattcaaatttacatcaacaaatgaatagataaaaataaattatagcatatgtatcgatggaatgaaatgctactcagcaattcaataaattattgttatctacaaaacatattactgactgaagaaaccaggcatgaaagaatatatattctatatttccatttatattaaactcaaggaatgacaaatctaatttataatggtagaatgtagatcagtggttgcttgggtcagaggtgtcagagctgaagttgacagaaaaaaggcacaaaaggacttttgggggtggtaaaaatattctatcttgattgtggtggtgattacatgggtctatacatttgtcaaaattcgttgatcactacccttaaaaggtatgaaatttattgtacagaaattacatctcgataaattgaattttaaaggacaatggtattatggagcttcttgtctactataagagggggaatcaaaggagaagtaacagtgtgataactgctatgttggggaaatcaggcatgaatacaacatagaagcagctaacccaaattaggggcttaggaagatttatcaaggggagctcagatctgaagacatcataatagtgtgttaaatgaacataacagcatgcacaaatacccagaaacaagagaaagaatggaatgtttaaaaacaaaagcagcaagttttgaagagatatttaggaagcatgagaattgacaggattgacaggatttagtgattgattgagttctaggaagagcagaacaagaataatgttctaatttctgccctagacaactaggtgagtgttgatgacatcttctgaaataggagatattgaaggagcatcagattatgggggatgataataactctaattttgaattctatttggagtgcctataatacatcaaagacaagatatggaactggaaaatggtaatataggtctgtatctaaagacagagaaccaggaagcaacatacagctagtagttaatgacaatggagtagatgcatttcccagggaattcataaactgataaaagatgaggaccaaggacaagttgcagaacattaatatttagaaaattagcgaagggagaggaactatataagagctactgaggaaaaaataaacaggagtgtgtggtcacatggaattcataaatttaggacagtgtggttaacacgatcaaattcctgaaaaatcaggaattagactatctcttgggtttggtgacaagaaggtcattgttggcctatacagagcagttttattggagtggtgggagcagtgttgaagagttagtgaaaaatagaaaataagaaaaggagcatgtagaaaggaaaaaagaaaatgacaactttttatcctccagctagctcgatccaagactcagaggaataaatagactcttcagtgtctgggtaaaacttttgactctaagtcattaaatctcctttagtggacaaggagaattatattgattataaattacagtcatttgatttgagattggaaaagatcttaaaaagtgaccaagttctatgccactggaagcatgtattttagagccagaagacaccaaaagattttatatggcaaatgttttttgccttcatgatacagatcgagcagggtattattgttaatctataaaagaaaatgcaaatcaaaaccacaatgagataccatctaacaccagttagaatagcaatcattaaaaagtcaagaaacaacagatgctggtgaggatgtggagaaataggaatgtttttacactgttggtgggaatttaaattagttcaaccattgtggaagacagtgtggcaattcctcaaagatctagaaccagaaataccatttgacccagcaatcccattactgggaatataccgaaaggattataaatcattctactataaagacacatgcacacgtaggtttattgcagcactatttacaatagcaaagccttggaaccaacccaaatgcccatcaacgatagactggataaagaaaatgtggcacatatacaccatggaatattatgcagccataaaaagaaagagttcatgtcctttgcagggacatggatgaagctagaaaccatcattctcggcaaactaacacagtaacagaaaaccaaacactgcatgttctcactcataagtgggagttgaacaatgataacacatggacacagagaggggaacaccacacactggggcctgtcaggggttgtggggctaggggagggagagcattcggacaaatacctaatgcatggcttaaaacctagatgacaggttgataggtgcagcaaaccaccatggcacatgtatacctatgtaacaaacctgcacattctgcacatgtatcccagaacttaaaataaaaaataaattcttaagaaaaataaacacagttttacagatttgaacagccaattcattaaaaagggataaaaatatcaaaaacatatgaaaagttgttcaatctcattagtatttaaatacatgtaaaacaaaactaaaataccatattcctccatcaaattgtcaactattaaaaatagtataatatgtagtatgtcaagggtgttgagaaacaaacactcttttaaacagttcagcatggctgtatattggtaaacatattttctaaggagcagtttgacaatatgtggatgttcttctttggttcggtaatatccctgctaaatatttatcctcaggaaacaattaaaactgcatagaaattcacatgcaaaaatatttgttgctgagataataggtgatgtataagagcaatacttagaaacaatgtaaatgaataaaaagaatgcatttctttcaaataagtatgtatgtatatgatgtgcatctgtataccaatacatatgtatatatgtgtatattctaatacatatatatatatatgtatcgggcgaaccagcccccaatatttcaacagaggttcttttctattttccctaagtgtcagccattctaagaaattaagggaaagagtccaaaagagagaaattttaaagctggatgtctgggggagacatcacatgtcggcaggttccatcatgtcccctgagccgtaaaaccaataagtttttattagcaattttcaaagggaagggagtgtacgaatagggtgtggatcacagagatcacacatttcaagggcaacaaaagatcacaaggcagaaggtcagggcgagaccacgaggtcagggtgaaactagaattactaatgaagttccatgtaccactgtgcacacattgtcattgataaacatcttaacagggttcaagagcagagaaccggtctgactagaatttgccaggctggaatttcctaatcctagcaagcctgggggcactgcaggagactagggcgtgttttctccctatctacaactgcataaggcagacactcccagagcagccattttggagggcccccccccccccaccccaggaatgcattcttttcccagggctgttcattattaatattccttactggggaaagaattcagtgatatttctcttacctgtttttggcaataagagaaatatggctctgtcctgcctggctcccaggcagtcagacctaatggttatctcccttgttccctgaacgttgctgttatcctgttcttttttgaaggtgcccagatttcatattgttcaaacacacatgctttatgaacaattcgtgcagttaacgcaatcatcacagggtcctgaggtgacatacatcctcagcttacaaagatgatgggattaagagattaaagtaaagacagtcatagaaattataagagtattgattggggaagtgataaatgtccatgaaattttcacaatttatgttcttctgtcacggcttcagcaggtccctccgtttggggtccctgacttcccacaacatatatgtatatgtgtgcatacatatatacatatgaaggtacgtatacatatatagtatacatatattgtatgcattcttttcccagggctgttcattattaatattccttactggggaaataactcagtggtatttctcttacctgtttttggcaataagagaaatatggctctgtcctgcctggctcgcaggcagtcagacctaatggtatagatataggtatacaatatatgtatatgatgaaatatttgttgtcattaaaattatatttttgaaaactataatgatatataaaatgtttgtgggttattgctatatgaaaaaattgttttaaaaaacagcaaaaacccagagtatttttataatctaaattttatagtaaaagatatatgtgcaaacatgcatatacacaatatatgcatgtacactgctgagaccagttcagtctgggagaccctgacccagcagtgctagaggaattaaagacacacacacagaaatatagaggtgtgaagtgggaaatcaggggtctcacagccttcagagctgagagccctgaacagagatttacccacatgtttattaacagcaaaccagtcattagcattgtttctacagatattaaattaactaaaagtatcacttaatgggaaatgaagagatgggctgaattaaaggaataggttgggctagttaactgcagcaggagcatgtccttaaggcacagatcgctcatgctattgtttgtggcttaagaatgcctttaagtggttttccgccctgggcggcccagtgttccttgccctcattcctgtaaacccacaaccttccagcttgggcgttagggacattatgaacatgttacagtgctgcagagattttgtttatggccagttttggtgccagtttacggccagattttgggaggcctgctcccaacagtacacaaaatgagtaagtgtaatacatcatcatgttaacagtgattgtaactgaattgtgagaccacaggtgattttgttttctcctgtaggcttttctatattctctaaacttttttcagtcaatatatactactataaccagataaattaacagtaattgtgaaaaatatggcatccaaaactgtaaagaaatatgtttattgcaaggcaattaaaaacaagatcccaagtttaaactttcatatgctgtctcattgagctgcacatggaaaacacaactacaacaacagaaaatcttctgtgttaaaagtaagaaaatcttgtctcactgataaacataaatgtagataatttgaaaaggaacgtttactaggtgctggtcatttcactggcttcaattcatttgggacaattatcctgaaaacaaagtcttattagtcccattttactgacaaggaatgtgttcaagagattaaggaatttgcctaaagctgaattcaaatatagacccttctgaccttcaagatgcaccttgtccactacatgttgctgttcccatagttgacaggcaacatattaaataattatatttctaaatattaccagaggctatttgaaatctctaaaataaggcatcaggaaaaatggttctgtaaaactattttagatttcttgctggaaaattacaactacaggctcttactaagaaaatggcaccaaattacaaattcttttcaataagccagtctttaatagctctaagcactagactctttaatttgaatttggctgttatgacaaatacaataaattaagttgtgaaattaatcattttgtttttaatgaaaaaacataaatacagaagctttgctgtgtctatacatatggctggcaaggataatggtttatgttgaaaaatactactctgcaggaattcccactgctgtttatactgtaattcaatttgttctatttagctacaaaaatatgctagtctttcagataatcagtccactgttgaggttcacagcaggttaaaactgaaaccctttccacttaataaaaatgaaatctatgatctaatttttgttcccccattagttcgtaacataagaagcagagaatgctttatgaactggaccaattcaatgaaattgaatttacaaatacttactgagtaacttgatatgtatccagcagtctgccagatgttttacatttttcatttcattttttcctaataaagtttctatgctatagatcataaaattaaggatcagagacattacataatcttaaccaaggtcacatagccaagaaacagcagcaaaagaatttgaaccctcatcttcctgaaactaaatcctatgctattaacatgacacaaaaccatttctgatgttatcgtataatagaagactgattgtatacgaaaataaaatgatggaggtttgtacaagatgatgttgatgtggaagtggaagatgctggtgtgggaacactaggaagaatccttacaggggatgacatttaaatagctggtgtaatcattggtttcagaaggattttattgttaccctcttctaaagtagagactgtaatcctcatttgcataagatgaatgatactcaggttaatatgcatgatactgatattgatactaatacttatgatctgccaataaatcaagaaccccaaacctggttctttattcttaggccagtggagtgggtggggagagtccttataggctaccgagtagtcaaatgacatagtgagtgagtggatggataatgtcataattgggcatcttcaaaacaattgctaataagagaataacacagaatctcaatacttcagaaattacctctgtaacttctttgctaagaggtcatccaacatcttctcagacatttaaatcaagacctacaaaaccatttatgctactcttggacaagccgaaaataataattacaataaggaaaaaatagagaatatgatctaattcctcagttgagggaggggagattgaagctgcctgaaagaaatgacatttgagcagaagcttaaacaaggaagatttacatacacgaagatagggagcaggcagggattctgggcaaaatgaagaatatatttaaagacatgaaagaatgaaagtgaaaaattctggaactgggaaacaatcaagtagtttgagcttagcttatatgggagagtatgggaggaagaaacttgtactagtataccagagccagacgttagagagccttgaatgccaggtgagacttttataagttgtccctgccaggtgagtaaacaacgtccaaagagaaaaatactgcaaacagagcctttaaggagacggtagaggaaaaagaaccaaaggaggaacaggtagggatagactttgcagaagctaatggagaaaagtatgtcaagaaatatgtagtggtcaatagtaccacaacaatccacttaaaacatcgtttcttcttcctaaactcctcccttttctctttccctccactaccaaaatactgagtaatccacatttactattgcacttctttgatgccaatttgttccttaacccactgctttctccatcacatggagtctggcttctttctccatcacatcactgaaatgactgaaaatgtcacctgtaattttggttgtcaaaggcaatgctgtcctcatcctatttgatctttctgtggctctgttggccaaacttatatctctggttcaaacctcctgccacatttccagactcatatatccaactgccacctcaacatttccatgtggattcaaataaacttggccaaaaggaatggtttctcaaatatacccaggcaagttagatcagagcagatagtatccagggagaaacttgttgtcagcactggattagaggaatcaggagttcaggcactgtattagtccattctcacattgctataaagaactacctgagactaggtaatttatgaagaaaagaggttgaactgattcacagttctgcaggctgtacagaacgaatggctggggaggcctcaggaaacttacaatgatggcaaaaaaggggaagcaagcacctttcttcacatgtcagcagtagagagagagcaaagggggaagtgctgcacacttttaaacaaccagatctcatgagaactcgctatcccaagaacagcaaggggcaaatccaccctcatgatccagtcacctcctaccaggccactcctccaacacttaaaatcataactcaacatgagatttgggtggagacacagaaccaaaccatatcaggcatagccatatttgttggcatgcaacttacagaaacactttttaagtgcaataattcaggcaaacctcacaatcaccttggaatccaggggtcattatttccattttataggtgagcaaactgaggctcaatgaggtagagtggcaccattcatttattcattcatccatctaccaatccattcatccattctcttactatttatgagagcttgctatgtgctaggccctataacttagtcaaagttcctcggccagtcctggtagagtgggaattcaaaccccaggctgctcacctttaagtccaaggatcatttcctttccatacagttgtatggaggccatccaatcaggaccttttcagatttgcttgtggataaatgacacatatttataactggacagcagttacagcactgtatgtataataattggtactggataaatgtgtcaagtgaacaaatggatggatgaatatgaggataacaataatactgttcgtcctatcccataggattattatgagggccaaatgagattttagtggaaagggtcttgacaagcggctattttaatattcttttttattgtttgttgcctcaaatcctgtttggaaatagcaatgatgcaacaatctggtttgaatccccttctctatggaacaacagcatttggttataggttataaccttgtctgtttttgcttactgtctccttctcaagatataaacacctatatttttcatatccacatactaccaggtccacaaaaagggggctcaaaatctgtttcttgaataaatttatgatttccagttttatagattagggaatcaaagttcagaaggctaaatgaatagcataaagtcacctggtaattaagtggcagaactaaaatttgtactcaggtcttctgactctaatactttttacaatatacttttttgactgagtgttaggcctcactagcaatttagataataataaaacaataaaagttaggtacaacttgatcatttatgaggtacattcccatacattttctagctgactctcaaaacaacactgcaaacacaaattatagataaggaaatctaggcctgaagccctcaagatatgtaaaattgcctaggggcaaagaactaacaaattcagaagccaggcccttctccaggttcaacatctctggcttcttcaccttcatattcacacctttcttccatcaggctgccctgccccaggaaaacaacccaatctttttaagacagtgtattcacaactgtactcattgtgccaggacaggccagcacagaagaatatggcctttcaacttgcacagatttccagaagaagatattttgtcatctaaaaatgctgccaaggttccaggtacatgattggtgaggaaccaggccagttgacaaaatatttgacaaaattccaattgctggtgattctcaagttacaggagataaggacttcttggatgtgcccattggcctgcatgcagtataattgaaatagaatgtgcaggtgctgtcagggtaatatgacatgtatccagatctttttccttttcttttatttttaggcttaaagtctagtcctctttctttggcagtttttggagccatgtgactggcacaactctggcaaatactataaatgcaatgggattgtgatgaagggaaaattgccatcatgcaaaactagaattaaatatctgtactccttcttggggcttttaaaggtgggtgccatttcttagcattaagaaactgctttaattactgagatataaaatcaagagggaaactcagttttaatggaatttatatttaaacacaacaggaatgagcaggaacattaattggtactaaaaaaagaagatattattaatttcaccctactttgagttatattcagtgtaacaaacattgcaaatacaaagtaaattgtatttcttaagtgtaaatatccttaaatataaatattttgaattcaaatgaattagagactgaaaagtaatattttatgcattcattcattcatttatttatttattcaaaaaatatttattgaccatggactctggaaccaaagtctaggtgtaaatcaggtatctgccacttaatacccctattctattattttaaatcactatcattattgctaacacatgtcaggccctattctaaaaactaaatactaaatgagaatctgagtatgctctggaggaccccagaggagaagacatggtgcttatccttgcagaacttgaggtgacacccttgtaaattgtccctttattaaattatcctcaaattcctgccaagactctgacataagacataaggatagaatatataagaaaactgaagaggctagatataagaaaactgaagaggctagtgtggctagagtttatgagaaataagaagggaaagaaagataaagttggagagacaggcagagatcaaattatgcacagccttatagattatggtaacaagtttgaatgttactttaagtataataagaagtcactggaaatagagaaataaggagtagtatctgcatcagaatgtaacacgatgactatgaaaactgtgcagcttctgattatttgagggctatagaacactacaaagactaaattttctgctggctttataaagtcagaaaagttgatgtcttaaaaaagggttccccaacctctgggtcatggaccagtacctgtttgtgcctgggctgctaggaactgagccacacagcacgaggtggtgggggggtgggagtgagcatgaccccctgagctccacctcctgtcagatcagcagcagcatcagattctcataggagtgagaaccctattgtcaactgtgcatgtgagggatctaggttgcacgcttcttattgagaatctaatgaatgcctgatgatctgaattggaacagtttaatcctaaaaccatctccccgctctcccacctcctgtttctggtccatggaaaaattgtattccacaaaaccagtctctggtgccaaaaaggttggagactgccatcttgaaatatcccacctgtaaacatttcctgtctccctccccctcactgtcctccttctcaaaaaaaaactcaacatatagagaagaatggcaggatttggactaatgcatattaggcttccaatcctggctctgccactcactagctgagtgactttggataacttattacaaatctttgagccttactttctgcatatataaaatgaaataagattaataacacctgccctcatgagagtagtaggagaatgacttaagtgggagcaaagaagctagcatagcatttggcacataaatgctcaataaatatcattttctttcccttcttttctcctatgtctatgtctataatagtgttagggccatgacatttagtattaaataatatccctggacagtaatcataaaactttgtattacagatgctagtcctataatctaaggaatatcaaaatatcattgagaatagaaacttaaattaataataaaaaggcataataaataattataataacaaaaagttttataattcatatattattttctattcctttcttcattttcttctcaaaatacccttgtacaatgggcaagtcagatattattcccattttataggtgaaggaacagacttggagatattccaatacttacatatgttcactcaatctgcaagggatagaaaaataaacagaatctaggtattttaattcctttacaaggattaattccacttcattactaacagactgggaatatacattaaacgggaaatgttgctccccctgagacctgctgttgccctcaggacaagccatcaaagtagtctgtgatacatgcctactcccacctcccaatactttatctatagccttatctctccccatgtcctattcattaatttaaggagaagccatactgaacttgttgcttgtttttcctggaacacaccaaactgttagttctgggcacatactgctgcctttgcccagaatggccttcctgctcctgaacagctaggtaacatctcctcatgaatatttcaagagttaactcaagggttgctgcagctaggagggtcttcttgataccccatgtaaaatggctacctcatcttcagtgtccctaagcacagccttttaacaaataattgtatcttgcatttggtgtaattctgtctattctgtctatctctgcatcagttgcatttggtaaaaatgtgtcttctgcttctggactgtgagttccgtgagggcagggaatgtgccatgcttttaacattcttcttgtccagacagggtctggcatggaacaggtgctcaaggaatacttcataatacaatgaatgaattaagttccctagggtcctttaagtttgatccagaagtcttatacataaatagaaaacagtaactcacagatctcctcaggaaggagtcagtccaaaccatctacttacattaaagcatggagaacaaagtggaaaaacaaaaacaaagatgtagaagtcaacaatgactgaaattactgctctttgaggaacagccctaacatatcattttcccagcagtgactctcaccattttatctccatatgccatttttcaatccagactgagctggttctctagtgtaaaatagccccaatgctattgagaatggttctgtcaatgaaaaagcaagaccattcacagtgaaatgcattttaccaggcctatgcacatatttcaacagagattgtctcataagttctctgaaccttggttttcctatctgtaaggtatggattatatcctgtcttagcgcctatactagcaaggctaattcatgacatgaggcatctagtgtaaaaatgctccaagcactgttaacttgctctatcctagaacctgtggaaagaatatcagaaaaaaagtttgaccaatgtgttgctggctgatgatggctatcagtggtcgccaggtactatgttagaactctgcaaaagacagaagagatggcctgaggggctatgttggaggactctagggtgactgagtgagcccatcattgaggaagcttcataaagtgggtaatatgtggttaggatcaggggttgctcttctgtattccagcaccgaacacaaaatagacatttcataattttaaaaggaaggaaaggaaatggaggggaggggaggggaggggagtcatgcttaaaggcccagctcacttctgtgcaatcctattcagtttacctaatctacacacacacacacacacacacacacacactcaaacacaaatacacatctgctgctccctcagacctaagctgggttctagtgaccctgatatggatgagacatagtccttacttcaaggactaaactgagacagacccagaaatagacaatgataatttgatgataaatgctgtgaaagagaaattcaggagaaagggagacagactgagcagggattgactaactctacctgcagggtcctggaagacttcccagagaggaagacacgtagttaggttaggctctgaaggaagagtaagagtttccaggcagagtggccaagagaggattctaggctgaggtcacattgaaagcaaaggcaatggggttggtggtggtggtaacacaatcagacattattgggaagcctaagggtgagtgtctaatggcagaacagaagatgtgggagagaaagttgctggagctaaggtaagaaagacaggatggggtcagtccagccttaccccggatcaggcataaaatgtgttctaggaaagggaaacaatagcagcaaaaatgaccggaatccaggatttgactagaggaactatttttagaaaatcatagattgaaaaagtaagggaggaaaggataagatttaaaatttgagacaagcaacttcttatggctttttttccttttatttgtctaatctcacatcattctctactcaccactcttgccacctaaccctatcccatggctctgctacatatattaaagataattaataagactgcctggttttgtatcccacctctatcatttattagtttgttgaacttgaaaagtttcccaacatttcttaccctcagtttttagagccaccaatgagtatccattgtatggaatgctatgtgctttaataatttctattgatcattttgtatgtgtcaggtcccattccaagtatttttgtgtattatttcatttatttccagacaattgttttaatgtaggtagtatttgtgtccctattttatagatgaagaaagcaaaacacagtttgagaatttggtctcaggtaacaaagctataggtagaagacagggttggaatccaggcattttgatgaaaaagcctgtgtttccaaccacagtgagtaagaacctcgacttcacgtgcctaaggttcttcaaaaaactaaaaatagagctatcataagatccagcaatcccactgctgggtatatacccaaaacaaaggaaataagtgtatcaaagagatacctgcactctcatgtttgctgcagcactgttcacaatagccaagatttggaagcaacctaaatgttcatcaatacatgaatggatcaagaaaatgtggtgcttatacataatggagtactgttcagcaataaaaaagaatgagatcttgtcatttgcaacgacatggatggaattcgaggccattaccttaagtgaaataagtcaggcatagaaagacaagcatcacatatactcacttatttgtgggatctaaaaatccaaacaattgaactcatggagatagagttatcagaagatgggaagagtagtgggggttgggggactggttagggaggaagtagggacagtcaatgggtacaaaaaacaaattgaataagacctagtactggataatgcaacaaggtgactatagtcaataataatttaattgtacatttaaaaataaccaaaagattataactgtattgtttgtaacaccaaggataaatgcttgaggggatggatacccaatttcccatgatgtggttattatgcattgcatgcttgtaccaaaatatctcatataccccataaatatatatacctactagatatctacaaaaattaaaaataaaaaaattaaaaccataaaaaataaaaaggtatctagcattgtgggggatcacagaatccatgtgtctgtgtggtgtgatgaaacacagaactctaatgaatgagtgaggaaatgaatgaaaaaatgttggttgaaacggaaaacacctagctgagagaaaaactcttcttccccaggtagctagccaggagaatgaagagttggtagctataaagtgggatggtggtggtgactgtctcatttcatcagatatacttgtcatacatgcaccattgtcctgagcccatgaataaaacactgagaagtgccccagacaccctccaaggagcatgatggggcctcagggcccacaccaggctccctgtgtagccctatgattgggcttcagaaagtacctgttgccattcttctgcctcatccatcatcattacagccaacccaaacatctgattatgaaggcacagcctggtagcagtgagcagccagggagcacaatgcctccaagccagaagtaaaaggactgggcatggaggaaatcataattcatcagcttcagaaaactcagaatgctgaaggcagcacaaagctaatgcttctgaccttatagagaagcagaaaagccaagggagcaggctcagtgagggaggcgacacaggaggtggagcaggagataggtttttctgtccacagatgtctgcaaggtggtggggtgggggaggagacatcacagaaatatctgctagtcttaatcattctgcagaatgacatctgaaaatccatgccctggagactctggggtaggacacaattgcctgaactgtcagacagtttaaatgactgtcccgaaatcatacaaatagaaatagaaaggcagatttaaacccagagctctgtgactccaaagtctatgctctttctcttctaccacactgccccatgattacacaggagtgtattctaagatgtgtgtgcccaatttcacaccactgctgcatgtcagcttgagagagagagagaacaagctagcaagttgccactagctagatcttatctactccaaatttcctattctcatccccgttttatactgatccaggcagaagcagtaatgtgaccaaggtcacacagtagctagtataaaggtctctgaatttccacatacctcgtaagaggagaaaagttgccacctccaggtttccagtgaaaactatactttccaggccagctaacagtttgaaggtcatttaccaagatgcttcacacgcatgcttgtttacttaaaaaaaggaaagaagcctaattatagcccactgagaaataagatgttgatgtataaatgaaattatgaaaaaaacatctaatggcatgcttgggaagagcctataggcttgaaggatggatagtgcttcaagcagggaaggagagggggggtgacaaagccctgtggccaggtcttaggctgggggagaggagtctcaagtcatgcaagttgcttccagtatctccctatgcactatcctgtctgtgtccaaagcagggatctttctgcatcctcagagggtacctgcaaaccaaaaggcagcgagatacaatgcaaagaacttgggtaacaaaatcacatgggcttggctttgcaacttatcaactgagtggccatgggtaaatcacctcacttctctgagccttgatttcttcatatcatcaatggagataatactttgtaggactatagtacaattaaaggaaacatacataaagtatttagcatgttcctcgaatacattaggtattaataaactttattacactgattagtgtcgttattattactatctatccctcataatgtgaggagcatgtcactgggtttccagtggtttccatggtagtctccaggatttggctattttctgttaaaaggacatggcttttctttaaaaacagtgggaattgcatgtttctctgaagtaaaaatgttcagctcccactcaacaccctacctacctattgtgggtataattctgagggggaggtgggaattatttctttgaaacttatcactgagccagaactgaaactgctgagccaggcgcagtagtgccttctgactgtggtaagtggggaccctcccagactttggagtgtcttttgaaaaatgtctatgtccttctttagtacctgggctggctgtgcagtccaagcaggatgtcctgagccctggttcctctgggtcctggtcactagacgtgcctaacttgaaattttctcagtcctcttccagtgctggagatcaaccaggactagcagtgacaattgggcagggcatatctcagccctcctttctcattctcagggtgttcgcaatctttctagttccccagatgtagagacaatcagatgctctgagaaggcccagaacttatggttatgggcttgtcccatgtcccagttccaggataagatagatgcctgggtaagcgatcacttctgtgtatttccttcatggaatcatacaagattgggccaccagaatggtgccaacatactgaatttgggtgactctcatttatcttggacacaggaagcgtctagagctctgagatactgatagtccaccactgacctctggacttgagctatgtatggacccaggcattggctcttgcccatctatgttctaatcaaggtgctgtctccaggtttacagcaactgaagatagcatgggtggcagcaggcatccttaaccctgtatcctcttctgctaagtagttaccagtctctttacagtgctaagatgttctccagaagtagctgtccctatcatgagatatctatcttctttgaagtctttcaaaattgttactctgtatctccaataagcctttctcattgtctccaatccaagtgtgaatgttgtggtctcttgggccattaatgaggtgtgccatttgagaacacactttccttgcacaaacagaacagtttctctctgtatctgggctccttgcttattcttcctgctgatggtggtatgtgaaaggcagttaacattgtgcagtgaactctgacagagtacattctaggaatgtagggactacaacctaaagctagaattcaagataaaacattgttggaagatgtgttaatctacgtttatgctatacaattcctaatggtacatttaacataaccagcaaataaattatttattcacatttttctgtatacttaagatgagccctgcatttgtgtacatcattaaaaaccagtatttgtagcggtaccatgaatgctgaagcatcacgagtaatgatgtaaccagtgttaagtaaatagtattaggaaactgctgaggcaagaagacctatattgtttcattacaaatatgccccaaaaagccatgcattgtgagtaataacagtagtgctagctttttctgcatgtgggagatataaaattgtcttcagaaactatgcatttgacaacaaagaatatgaaaagatggctccggatacttcacatgcactcattgaacaataaacaaatacctaagtatcttctctacacattattctacatcttcatctaaattcatggacctcacatgaggtctataaatatagacacatgaggtctataaattttgtaatacaatttttaatcaaactgtttatatagacataggcatcacaaaaaatctttgcctggagccctgcacgccttaggggtggccttggtgagatcagtgtaaaacatgtctagctagtgacttaactatggaatcttgtcaccagagacaggataaaggaaaatatctgaggactgcttggtacattgtcgttcctcccttacaactgaagggtcactacaagtcgcacctatgcacctacaggtatatcataatcagccattaaaaataaagtttcaaggcaatctttcacaatttgtacacattctcacaatataatattacaagtgagcggcagaattttatatatattctaaaattctactatgtaaatggaaaatgcatagaaaaaaagacaaaggaaataggatacgatattgacttgtctttaagaggagaaatctgaggggattttgctgtttcatgtgtacttttcactactttcaaaatttgctacaataaaatgtactattttcacttttatttttcagttcactgaatttctttcaacatgcctctctcactactctgcacatgatgtttccttttgcctatatactcattctccccaactacttactttcatttggctaaatcctatttatctttgagattccatcagcaacatcacttcctccaggcacccttctcggatccctcaaagctgcattaagtgttcttccaatgagcttccacgttatcctatagattcttatcactctacatgtaactgaaagtttgtttgcctctttcctatcagttctacactccagtgatgtccattactgtgcttggcaaataatgaatactgagaaatatttctgaaattaatagattaatgaaaattaaaatacaatttaaaactctctttaaaaatatatacatataggccaggcgcggtggctcacgtctgtaatcccagcactttgggaggccgaggagggtggatcacgaagtcaggagatcgagaccatcctggctaacacggtgaaacctcgtctctactaaaaatacaaaaatattagccgggcgtggcagtgtatgcctgtagtcccagctgctgtgaaggctgaggcaggagaatggcatgaacctgggaggcgaagcttgcagtgagccgagatcgtgccactgcactccagcctaggtgacagagcaagactccgtctcaaaaaaaaaaaaaatatatatatatatatatgtatatgtatacacacacacatacacataaacaaaacctaggagattcagggaagtttttgtcaccattatttgtttaagttttccaatgatagtttaaaaaatttgttaagcatgatgattaacttttcacaataatgcaataatgtgtgagctatgcctctctcaaaccttattatgatgttggcccattacccatctgatgtgaagaaaaaaactgtcattgcgtgcttcagtaaataaaaagagaatttgtggaattgttgacagttacaaaaaaaaaaaaaaacctggtaattctttggggcagtgttgagcaaataagttcctaagaacactaattccataagatattctggcgaaaaaagacagagagagggtctataatcaaataacttcaggaaatactgtatgcactggtcccctctgaagaattacaacgtgtagtagcatatttcagtgttgtaaaaagtcctgctgtaaagaatatggttaatttatttttaatccagtacttctcaaacgtatttaaatatgaatccttccccctttatgtaatacctattaacatctatttcccagaacatttttggaaatgctgggtttcagagataaaggcttccagaggaaggaattttctggctcacagtgaaggcaacaaataggaaaaatactggaaagagagacaataagacttaaaaaaaaaaacataaaatgtaacatttattgaccacttgctatacagcatatagtatgtcaagtatcttacatatactagcttaagttttataataaatttaaaaagtagaaactatcattcccacttaatgaaaagtaaattaaaattcaaagggattaagtatgctgtagacagcaccatgtctgtctgggttacttcacacacttcctctaaccactatgctatgagcactgagccacacaaaccctcctttccctggtggaataggtgactgaatggaagcactcccttcctgtatttattttcccttctcttcccttcttttctccctttccttccttcttcaaacatcctgagtgttcactctgtcagtcacgtgtggaacctgtggtttcagagatgaataagaaatgatccctattctaaaaaagcatccagtctcgcccaccaagttagtaatcttccaagccctgggatagacaaacaggtggataagaggaaagatgaccctgtgagttgcatcaaaagcatctgaaaggctgctgaggtaaagatgacaaccccacctagggattcttcccatacatttctggggctggagccttagaagaggtatttagcagatggggtgaaaatgttcatgcacaaatcaccaaattaatgcagttttcattaactagatttattagtgaacttggggcaagcatacctgtcccctatttcaaatattctctggagttctgggagatgaacaatatgccaatctggccatatgccaagaagctacctgggaaaacaagtgtattaataaaatttcacccacacagggtttaaaaaataaatataattctgggcagaaataaatacggtctttacttttaaactaatatattagtttaaggtaaagggagcttttatcttccgagatcatactgccagtcacactgctctgagtgtctgcctcacaatcagaatggagaggtccattgacaggaatgttttaagaaggaaacatggaaggggagaggtgggaaggaagggagggaggagacttggatgagacaatagagtcataggagattaagggacgtttggggctttgataccacctggattctccactacaaggtttaggtttagaaagatatccaccacttcctcacagatgcctcatgatgccctaatctcaaaaagaattttggactgacatagggaggcatttttgatctcccatgtggataaggagtttcaggcctgccattcttcttgctgaagactgtcactgaggggaggagaggtgaaggtaaggttctgcttgaaattcaactagtgctgcataaagaatgatacacatgaaaaattgatcatgacacggcactcaggcaaatattattaataatacaatatttaaacacacaatatatccctcttaatgatgaaaagaaatccaaggtcaaagcaaataaaagtcattccaatgttaacaaaaggaaaagagagaatttctctatgcacatcactccacaatagcttcctttataccaccatctaatagagtaagtagcccttccatcaatcaagagaggtagcaaaacccttctcaacaggaatatttcaaaccactaggcagttctagaaaagtacagaattcaggagttttagcccttcttttctcatcttctctaatgtaaaatgaaggtaataatacctaaactctttctgggccttgttttcccatctgcaaaatgaggaggccactagataatctccaagttaacaaattgcaattttgaatatttataattatgtagatacatttggaagcttctgatagagttggatacaagctcagttccttcacatacttggagtaggaccttggtcaagttacttaacccctctaaaccccagattcataaatgataaaatgagacaataacattcctacctcagagatttattttgagtactaggtaattcaagataatactgctagcgagagaagacataaaaatcaagcccaggtctgtttaacttcaaagactatgctctttccactacaatagtggagaataccaacaagaaaaaatgtctacaaagccaagcagagtgcagcagaagcacaggctttctgctgtagaatgccagaggcaagaacaattaacgttgtctatgggtgaaggcagcaagttgttacatcaggaaaagagctctggagtcagaggccagtgattcaaaacatttaacctttcttggtctcagtgtcttctcctggaaaacagggaaagtaacagtacctgctttacagagtcattaagaggaaagatgtaaaggttatgtatataagcattcagcacagtactcaggacataataaaatgcaataaataatagctattgctattattatagtaggttctttaaattacatgaaattaaataatattattataagtgatcaaaacttctagactgacctcaacactgcacaaaatactggtaaccctaagagaatcgttaagtctagaatagcattgtctattggctttccaacttctgtatcacaaaagaaaaagtctagaaaacacaaactgtggccttcaaccaggctttattctcagaggtattatttacatttcagatttattattgtctcccatggtgctgacatgaaataaccttccattctcttccatgttaaaagagtacagtgtttcttggctccataaataattcagggctatattaatattttaagaagaataagcaatatatttgaatcctagaaaaaccatgaggattgaaattagttatttgtagctgaaaacttaattgctccaacatattgattgttttttcttccaggttttattgcccacacaatgaagagtgcctactctcattctaaatgctgcatacttaattatatctgttagattttatttttatgaaaactcaaaagcatccaaccatgaacttaaatgcttttgcccatctgatgctaaacatagaaccatttaccattctttaaaacagtgcactcttcttcacagatatttttcttaggatgacagatgctacttttcaaaaatataggttttagagttagcacttataaccttgctaatgaaagagaagaaaactatgatgcaaatatgtgtatgcatgatcttatttaacccttaaaataacctccaatgtagataatatcttacctttttacagattaaggaattgaggttcaaagacatcagtaacttgttcaaggtcacagagccaaaatgtgcatccaaccctaaaacccaagctctttcctctaaaccagggtgcctcatagtactaataatgacagtaataggtaagatatattgagcatttactatgtgccaggcactgttttaagatgtttacttgcattaactcatttaattatcacaacaatcctttgagataggggctatttttatctcattccacagttcaggaaaataaagattagatagttcaagtgcctcttccaagtttctttgatattaagtgatgggccagaatttcaagtcatatagcctggttctagggtttatttatcctatagacactatagtcctagatagcaaaatctaaaaaatagagaagtgggcttccatcagtaggtgagtaaagtaagatgtcagggggcatcttctcagttccacatgggacaataaacagatatctaataacaataaggtggccatgacaggaaactcacagatgataagataacagtgttaacaacacctattcctgaatgtggtcttggatctttatagcaaacatgatcttcctggctgatctaccaaagttggcctgcccagtaaatggtagtctaccagggacctctgtactacatgtggttgtaccctaatgtttcttaaattgtatctagacagggtattgcctctattatctatgatgacagagttccaggaagaggaagacaggtagaattagctcaagagtgaagaatctagatcatcagacgtttattgaataccaactaagtgtcaggccctatgctgaatctctgactcttgtttgctaccactgcagctacaataatctaatatcaatcttttgacttcaacctggtcatgcacttctagaccacacatttcctttaactcaacacatcacggtaacagctccctatcttacatttgcattcatcctgatgttaatcatccctagagtagacaatagatgggaaattcacaatccccgatgctaacacaagagatgagtcaaagctctgagaaagagctattgaatgtaaatgtccattttccttggacttgagtaataaaatagtgcattggctatatattgttgtatacaacttactccaaaatctctagtggcttaagacagcaaacatttattatctctcacagtgtctgagaatgaggaatctgggagtaaattagctagattgttctagctcaaggcctctcatgaggttttcatcaagctgtagcgctatagacatctgaaaactttactggagctagaggaactgcttccaagctcattggcatggcttggaaggcttcagttcctcattacataggcctttccatagaacctcttgtgacatggaagctggctttacccagagaggaaaaaagagagtgagtgcaaccaagatagaacccatcatatcttttataaacttatttcagagtaatataaccttatcgattaatataaccttatcatcactaatgccagattttatttatcacacatgctaactatggtacagtgtgagtggagactcacaagagtttagggtgaagatcactgggagccatcttgaagggtagctatgaataccataaatagcaaagaacacaatctttagagccaactgaaaggtattacttaacattcaggcaaacatactttggaacaaagaaacaactaaaataatttgatttaatttagattaattggttgctgaatgaatttagttcaagtgggggttaactatatttatgattttcattcttttaatgagaaaaagtttggcagatacttttttcatttttatttttttttattatactttaagttctagggtatatgtgcagaacgtgcaggtttgttgcacaggtatacacgtgccatggtggtttgctgcaaccttcaacccatcatctacattaggtatttctcctaatgctatccctccccttgtcccccaccccccagaaggccccagtgtgtgatgttcccctccccgtgtccatgttctcattgttcaactcccacttatgagtgagaacatgaggtgtttggttttctcttcttgtcttagattgctgagaatgatggtttccagcttcatccatgtccctgcaaaggacatgacctcatcctttttatggctgcatagtattccatggtggatatgggccacattttctttatccagtctatcattgatgggcatttgggttggttccaagggtttgctattgtgaacagtgctgtaataaacatacgagtgcatgtgtctttatagtagaatgatttataatccattgggtatatacccagtaatgggattcctgggtcaaatggttttctgggcctagatccttgagaaattgccacactgtcctccacaatggttgaactaatttaaattcccaccaacagtgtaaaagcattcctatttctccacatcctctccaacatctgttgtttcctgtcttttaatgattgccattctaactggcatgagatggtatctcattgtggttttgatttgcatttctctaatgaccagtgatgatgagctttttttcatatatttcttagctgcacgtatatgttcttttgagaagtgtctgttcatatcctttgcctactttttgatgggattgtttatttttttcttgtaaatttgtttaagttctttgtagattctggatattagccctttgtcagatggatagattgcaaaaattttctcccgttctgtaggttgcctgttcactctaatgatagtttcttttgctgtgcagatgctcttagggaaaggattccctatttaataaatgttgggaaaactagctagccatatgcagaaagctgaaactgaaccccttccttacaccttatacaaaaattaactcaagatggattaaagacttaaatgtaagacctaaaaccataaaaaccctagaagaaaacctaggcaataccattcaggacatagacatgggcaaagacttcatgacaaaaacaccaaaagcaatggcaacaaaagccacaattgacaaatgggatctaattaaactaaagagcttctgcacagcaaaaaaaactatcattgagtgagtttcttaatcctgagttctaatttgattgcactgtggtctgagagactgtttcttatgatttctgttcttttgcatttgctgaggagtgttttacttccaattatgtggttaattttagaataagtgccatgtagtgctgagaagaatgtatattctgttgatgtggggtggagagctctgtagatgtctattatttttgcctggtcaagagctgagttcaagtcctgaatatccttgttaattttctgtcttgttgatctgtctagtattgacagtgggatgttaaagtcctccactattattctgtgggagtctaagtctctttgtaggtctctaagaccttgctttatgaatctgggtgctcctatattggccgcatatatatttaggataattagctcttcttgttgcagatccctttaccattatgcaatgcccttctttgtctcttttggtctttgttggtttaaagtctgttttatcagactaggattgcaactcctgcttttttttgctttccacttgcttggtaaatcttcctccatccctttattttgagcctatgtatgtctttgcatacgagatgggtctcctgaatacagcacaccgatgggtcttgtctctttatccaatttgccagtctgtgtcttttaattggggcatttagcccatttccatttaagttaatattgttatgtgtgaatttgatcctgtcattatgatgctagctggttattttgcccattagttgattctgttccttcatagcaccgatggtctttacagtttggtctgtttttgcactggctggtactagtttttcctttccatatttagtgcttccttcaggagctcttgtaaggcaggcctgctggtgacaaaatctctcagcatttgcttgtctgtaaaggattttatttctccttcatttatgaagcttagtttggctggatatgaaattctgggttgaaaattcttttctttaagaatgctgaatattggcccgcactctcttctggcttgtaggatttctgcagagagatctgctgttagtttgttgggcttccctttgtgggtaacccgacctttctctctggctgcccttaacattgtttccttcatttcaaccttggtgaatctgacgattgtgtcttggggttgctcttctcgaggaatatctttgtggtgttctctgtatttcctgaatttgaatgttggcctgtcttgctaggttggggaagttctcctggataatatcctgaagtgcattttccaacttgattccattctccccccgtcactttcaggtacaccaatcaaacatagatttggtcttttcacatatcccatatttcttgatggttttgttcattccttttcattctttattctctaatcttgtcttcatgctttatttcattaagctgatcttcaatctctgatatcctttcttgtgcttgattgatttggctattgatacttgtgtatgcttcaggaagttatcatgctgtgtttttcagctccaggaggtaatttatgttcttctctaaactggttattctagtttgcaatttgtctaacctcttttcaagcttcttagcttccttgcattgggttagaatgtgctccttaagcttggaagagtttgttattacacaccttcaaagtgtacttctgtcaatttgtcaaacacattctccatccagttttgttcccttgctggtgaggagttgtgatactttggaggagaagagatgttctggtttttggaattttcagccttttttgcactgttttctccccttcttcacggatttatctacctggatctttgatgttggtgacatttggatggggtcgattggacgtcctttttgttgatgttgatgctattcctttctgtttgttagttttccttctaacagtcaggcccctctgctgcaggtctgctggagtttgctggaggtccactccagaccctatttgcctggatataatcagcagaggctgcagaacagcaaatattgctgcctgatccttcctcaaggggcacccaccagatgccagctggagctctcctgtatgaggtgtctgggtcggtccctactgggaggtgtctcccagtcaggagacatgggggtcagggacccacttgaggaggcagtctgacccttagcagagttcgaacactgtgctgggagatccactgctctctttagagccatcaggcagggacgttcaaatctgctgaagctgtgcccacagccgccccttcccccaggtgctctttcccagggagataggggttttatctataagcccctgactggggcttctgcctctttttcagagatgtcctgcccagagaggaggaatccagagaggcagtctggccacagcggccttgctgacctgtggtgggctccaaccaattcgaacttccaggtggctttatttacactgcaagggtaaaacggcttactcaagcctcagcaatggccagtgcccctccccccaccaaacttgagcatcccaggtcaacctcagactgctgtggtggcagtgagaattttaagccagtggcttttagctttctgggctccctcggggtgggagtcgccaagctagaccacttggctccctggcttcagccccctttccaggggagtgaacagttctgtctcgctggcatttcaggtgccagtagggtatgaaaaaaaaaactcctgtagctagtttgatgtttgcctaaatggccacccagttttgtccttgaaaccagggcgcctactctgtaggcactggagggaatctcctggtctgccagttgcaaaggccataggaaaagcacagtatctggagccgagtacatggttcctcacagcacagtccctcacagcttcccttggttaggagagggagttccctgaccccttgcacttcctgggtgaggtgatgccccgccctgctttgggtcaccctccatggactgcaaccactgtccaaccagtcccaatgagatgaactggttacctcagttggatgcagaaatcacccaccttctgcatcaatctcactgggagctgcagaccagagctcttcctattcagccatcttgccagcaatctcccaatggctatttaaacacctatttatgattttcaaaggttcttgagactttcttaggtttggacgattagcacctcagggctaataatatttttattctagtttcacatctggacactctctctatacctagcccctcctggcctttgtgattggctgttcctttggtgggtctactggctttttgattctgtaactcacccaagattctgtctctcaattttcccttttggttcttcacactgaagtctgtccacggggaagcacacatactgcaatgttccaaccatagcttctaagatattactccctgctcagagcttagcagtccctctcaggatcatgcctcttgggaaggagccatttgagaaccactttttaattgtgtggtcttgagaaattttcagttttcttgactttctgagcctcattttcctatctgcaaaatgaaggtaaaattacttagctacccaacaagtgcaatctcttactaactgtttgatcttgagaacttatttaatctcacttttcttcatctgggcaacagagataggggtacctttctcagagggttgtgaagattgtgataatatatgttaagcacttagcattatggtcagtaattagtctgcaatcaataaacactggccactatgttaataaatatcataacatactataataataatagcaattatgatgatgatgatggtggtgatgatgatgatgatgttctgtcttatttttctattatgtccctaaaattgacatttactctgtccagaaattggcatctcatccccaaacatgtgccctatatttctggagttactttaaaaggaacatcatatatttgcatgtataaattccagatcatatatgaatcacatgacatagtcatactcagtaaatgtctgataaatgaataaatgaacaaatgaataaatgtgttatatttgctaagaattagggttggtatttacttgttcttgcctatgagaacaaaaataaatccacaacttagtatttatattttcatggaactgccttcaagttgatctttcatgaatgcccacacaaatctgccattccagtcaaaccaatataataagcttatcctttctactttgtgtagcagtagacaggttttggactttgaaatctttgacatgaattttaattatagctctgtcatttactacctcggagacctaagacaggtcccttaacctttctgagttttggttttctcctctgtaatgtggaaataataattagtcctcaatataattgtgagattttggtaagctgatatatattttaaaatgatagcacagcaattaacacataatagaaaatcaataactatgagtttctttgttgttttgcttgatacctatttttgaaaagcaattcagtaacatgtatcaattctgaaactcctccttctatccaacaattccatatctgggtattttcctcaggaggtgacctgaacaaagacaaatatttatatatagatatattttatcatgtctgcattcttaatggagctcttcagcaattggtaaataggctttcacaaagaagacattcatttaggataacgcttggaactattttagtgtttgcctcatcatcaagctagcatttagaacaagtactctttcacacattcattcccttactcattcaacaaatatttgagtgttaactatgtgcagggcagagtgaaagagaataaagagatgaataagacactttcctccttctcatcaagcttataatgttgtaaaaatccaggttgctgatccaccattcttgcctgattctggcagactcttactcatccctttgtcacagttcaaatgtcacctaacgtttggtagattctctgatattcctagtcatcaaagtacttggttccttcctatttgcttccataggattctgtacatgcctatttttatggttgaccacattatattgttagcgtatgtttacaaatatcttgtctcttttgctggactatgagcctctcaatgcaaaaggctccccagttttgttcaaattttaaaggctgcagcaacaaaacaggtaattattctcaataaacgtctgttgatgtatgaacgaattaataaacaaatgaaaatcaatcacacattataactatgacttaattcaaaattttaggatatttcctgaaagatgaatacagcttaaaaggaggctaaagaagagatagtttaccaggtttggaaagcaagaaaggcatgatggagagggtagaagttcataagagcctcaaaagatagaaaggatcacaataaaaaaatgaatcttggggtattctgggtctatggattaacccgagcaaaagcactgggctgcgaaagttggaacaggggtatggtttatgcatgtttggaggccagtatgaaatcccattcacgaagccgttagaaaaccaggataggaagggaggttagaaccattttgaaggaccttgaaagagtgaagaatttattgtgaattttataggttgtgtgcatagtatatgtgtgtaggaggtgacaaggaatatattttaggaaaataaaagttactcaggaaaatagttccagcaatatataaattatacctggatgtaagggtcgtgtaggagtgagaatgcagagatgcaggtagagaccaaatgggaggctagaggaaggaaatttaggttagggtagtggggtcagagacacacttataggaaaactaccaggtcaattgccttagctttggggcaccacatattacatagcagcatacctcccaagtattcacaaagggaatacattaaaacctctatcccccagtaactcgagagcaagatttcagtgctgctgctatataaaatgaatgaggaccagctctgattttacagagcttttttagcccaaaaaggagacaaagaagcgcacaagcaactgtaatcttagatagggtatgataagtgacaaaggcatatgaaaaagagatcccaaaggttcagagctctagttcttgtgagctgctttgcaatcttaccttcttaagacggctttactctgtattcatgtctaactctgctagttaatgttagtaaagttaggaaaggtataacctcaggaatgtcacttaaccttcctgggatttattttgtcatctgttgcctattgataacttaaattatgtttgtttgcttcagttatggaatattatctatcttcgatctccagtcactatgcccactcacttgtgggatactccacaggtttcatcttccctgtgcagagctgaccattcaactggttgtgaccaagggtttctataaattttgagcaactggagaacttttcagcacaaggagcttgcttagctccctgttgggtggggtttagagccagctccatagtctctctactccttttatggaaaggctcctgcctttccataaataatcagtaggaacatactccaaaacagctcctaaatggagcaatgtataatgtgtatgcctgaaacattccagacaatgacatgtccatctggttggtactgactaggagtgttaagcatttggtgaggtctagataagtgaggaagatatatgatacttaaaggatatagacaaggggaagaatttctggagggataataacaagagcaaaggcacgaaggaagaaattgatatggatagaatagtaaagaaatattctagatttagaaaaaaggtttgtagaaagtcataaagaaaataatatgaggagagaaacattcattcaacatggaagcacagggagacaaatttgagtttacttcaagaaaaactttttacattatcaccagagatacatttgttaagagaaagactgggcttccttggaaggtgatatgtggcttgtggctaaaagaatatgagtggagactgaatgtcaactttgggaagctgttgtcggggatattcctacctcaactaggcaactggcattaaattatgaactccaaaattggaagggaatttaataaatagtataatcttgataatgtgataagaaatgagaaaaatggtacagaagaacagacaagaaagggaaaagaaggagggagggaatgagggaaggaaagagacagagaagagatggaggaaaggagggaggatggaaggaaggaattaaataagaaaaagatagaaagagaaaaataagaaagttattgagggagggaagaaaggagggaaggggatggaggaaggaaggaagaaagggatgcatggttgaatcatgcccaaattggtacactaagcacaggtcctctcaactcaatactattaataataataaactcctggggtctatccacccatgaatttatgattatgtaaccaaccatgaataggacatggatgcttctagtaatgaaaaataaggaagaggggcccagctttagattctggaccctttcaagaagaaaaacaacagctagctaacaaggcattctaattgactgcatcttgtggaccttaaaagtgtcagagcaatttaacatttaacaactaaataatatatttcacatccctgcctgggaaatttaataaactgtggtgccttcagggacccagcttcatataaattaactgccttcaacttggagcatcggggtctttatcttttgtcagcttaattatgtgtttaattttacttttaacatttttaaaaatgacccacactaacaacagcctcaattgtttaattaaacaaatggatactgttatatctggcatgatcgaaactctaatttgtcatgttaatgttttgtagggagccaagaactccatgatggtactcaggcaaatcatgcactccaaagtctatctgcctacctttccagagtaatttagtggtttaacttggttctgtagctatcttaatactaatttgtaaccgagtctcccggaactctagtatgttattaggtatttatataatttatctttgtagaaaactttgcatggtgtagattatagacttgagttgaataaagtatacatccagaacaatttaagctcccaaagtattaaagtccataggcaatacatcagtctatagccactagtcctctttacatccttatacctcctgtcaaaccattactcacatttccaaatatatcacctttatgccaattctaacctggctcttcatagttctgttcagcttttacttcataattacataaaagcaggagtcttaaccctttgttacacccagaatcttagccttgacctcttgcactggcttgcttactagtctataacctaacttactgataatcctcatgacttttaacttcatgattcttttcttccccattttggatcaagattaatttcatgtttcaggaacacattaatagccctttcaatatagcttggtgtccacaacagtctagatgaccacacccaatgtttatactgtggtttcttgtagagcttctgaatgtctcttacctaaccttttccacacataattgttagttttcctacaaaaagctttgatcattgccttcctgcctaaaagccattcagtaatttcacattgtcacccgtataaaatacaagtttcttaacaagataatcaatacctttcaaactttagctcaaggccaatatgttaaacttatctgcctctagttttctattactatatttatatgttgacagaatatagacctctcatttttgctggaatgtagtctacacactctctctttcacacttttgctcacattttttccatatgcctagttatcattatttctacttctctatctgacagaagagataccctctactagaaagcctaccataatttcttgattctattaacatgagctgggtcaatgatcacatcaccatatcattcattactcaaagaaggctggcctcatgaatggaccaggcacctgcctaggtctttgagctctataaaggctccactgctccttcccaaagggaggatatttccttaggctgaggcctagagaatgaaaaggagtggctatagaaagagcatagcaggccaaaggaccattatatacaaaggtagaaaataaatcattgtattctaggaattccatgtgctctatgttatgattcaactgagattcagaataggaagaaaaaaattatatttgttttagagaatgttgcgtacaccgaattaaattagtgcaaatccatgcttcatgaaacactctcatcatctgtctgcacatgaccttattgtactttattttgttttgtctacagttggttctctgcaggttctgcatccacagattaaaccaacagtggattaaaaatactattttaaaaataataaaaataacaatacaacaataatataattctattaaaaatatagtataacaactatttacatagcattcacattgtcttaggtatttaaagtaatccagagataattttaagtgtatgggaggatgtgtaggttatatgcaaatgctatcccattttatataagggacttgagcagccatagattttgatatccgagggggctcctggaacgaatacctaagaacactaaaccatgcctatatttttttttaaataaattctagattttaccattatgaccagggctactatgatcaatcttgtatcttgatgcacatgttaagagtttctttcgaatacttacctaaaagtagaattgctggctattaatgtaaatgtccagtgtttacaagataatgccaaattgctgtgatctggaggatagcaattagagaaatagtccagatgagaatactcaaccaagttattcacctccccagattgctcaagcatgttttttccttgatgctaccaataaccctatggaaagatcacctggcaccaaccacagtcttggaggttgcagaagaaagggtttatcttagttagagtgaggcttttgagctcctttgctacctttatggtgggggtcatgttgccttggcactctgcctgttcagctagctaggcctattgtgggtgcagccctagatttttgttttaggaatgacccagcagagcttggcttcatgtcttgcttcatgcaactcttgccacctgcaccaaggacttccctgttgttgctgaggtacaataactatggtacctgcttgatgcccacacacttatattggctcacctaactggatccatggggcttcaggccacaggtgggccaggatggagtgcactggttgcataccatccatctccttagtggctcattctgtatcctatgattcactctgctgatgtctctgctgctgtcagcagccgctggggaccaggtggcacaacctaatgtatggagggattgatgctttatagggcacatttttcactaatgggaaatgagaaagactgagaaacaaagctgtggtcagctggtaacctgcatatgtatgcttcctatatctcttctccatattaattccctttttgtctcactcttggtgccctgagattgcctccaacccaaattgaaaagccgtattagcataagtttttgcctcagggaagccaagtagcattttagactagcaaagccatataagagaaagtataatactaaagcagtggaagtgtcacagttgtaggaaggaaggaaactcagctcagctgtagcacagtacttaccctctgctctaactcacagattgcctggccagttaaatagctggttatatcttgccccatgatccctcctgatctgtataacaactggattattccttgctgaatggattacatcggtctatttctactcctataagggcttgcatttttctgtttcactttttgcagcttcatcagttccaacccagatcatccatgtcatgtggtcacatattttgttttattgaggtgaaactcatataacaaaattaactgcaattttaaagtaaacaattcagtgacatttaacacagtcacaacaatgttttgcaaccaccacctctatcgagttctgaaacattttcatcacttcagaaggcagcccattaagcagttatttcccatcctgcttaggggatgaagtctaaatccatgtgtattgagtgattctatgtgccgggcaccatctgccttactacttttaggtcactccatccatacgccaagcctataaagttagacttttttctctggttttgcagatgagaaaactgaggttcaaagaggttaggtgagatattcagatgaccagaatccaagtttgcataaagacaaaccccatgcctttccactaaaccatgctgcctcaaaattgtgaatatttttctcacttataagtgggagctaagcaatgggtatgcaaaggcatactgagtggtataatggattttggagactcagaagggggaagagcaggaggggagtgagggattaaaaaagtacaaattgggtacaatgtacacaactcacgtgatggatgcactaaaacgtcaggcttcaccactgtacaattcatccaggtaaccaaaaaccacatgtaccccaaaagctaatgaaataaaaagtatatataaatttatattcatataaatatattataaatttatattcatataaatatgttataaatttatattcatataaatatgttataaatttatattcatataaatatattataaatttatattcatataaatatattataaatttatattcatataaatatgttataaatttatattcatataaatatcatatattatatatttatattttgtctcactcttggttccatgagtaagttattgtatatttatataatatatatttatgtaaaaatatttatatataaataaatatatatgtttatataatatataaatttattttatataaatttatatatttatattcatatatatttataaattactataatatatgtatatataaatatatacattaatatacaaatatgtttacatttaaatatttgtatttatacataaacataaacatttatatattaatgtgtatatattcattaatacactgaatgtcaaatatataaactatatatgttttaaatatgtgtatatatatatatatgaattgtgactattttgagaacatttaaaacttatccttggataaatataacaatattaaaccttaaatagttgattctttgttatggtagttatctatttctatatgacaaatcacccaaaagcttagtaagttacagtaacagcgccatttatttgcacaaaattatgtccattaggaatttggtctagactcagctgggtagtttgacagcttcttcacataataacagaagcattctaatagcaccgaagcagatatggcaagggctcttaatgtccgtatggcttcagaaatcacaaagtgtttcttctgacacattctagtggtcaaaacaagtcttaaggccagtccagactgaaagcctgggaaatagattccacatcttataagaaagtgttaatgtcacattgcaaaagggtatgaactcagggaggtgtgtttcattggaggctataactgtaagaatctaccatacatattctacagttaattccctaaccgattgcttttcactttgtaatgttccaggcacaaggaccccttcaagtgttatttggggagaggaaacaaaggcatcattcaaaatcattattctgctgcctatagtgggtggacagatatgaggtctgaatattctgtttccatgtgtgtgggttacacaccacctatattcatcagtgtactccagtacaaggcttgatcacagcccatatttcaagtgattttcagatccaaccaaaacacttcagttccaaatgggtttagagtagaaacagattaacattttaaaaagacttttttttttcctgcaaggatatatctagaaataaaccctggaaacgagtgatgtaggagaataactcacatatgtttctaactattagaagtgaaggaactacaatatgatagtcattccactgaccatcacccttccttgggtgtcttgttccttccttacatgccaattcagaaagtatgatcaatgactgtaatgttgcttgctctgtggcctgaaattatctctttctccagtacctttgtatatccttcagggagacactcactttttcctctgtgcccacgccctaatatactacatgtatatgattatcacagtttatcaatatgtttttctatggaagccaagagaaatttgttgatataccatgggcagatactagactaagagctaaacaagaattattgcatttaatccttataccaatccctattatcactatcttagagacagggacatttaagcacagagataataacctgtgcaaatcacataaatagtaaatagtggagctgatatttaaactcaaaacaactaatgctagagacagaccataatcttagtcaccaaaatatatttcttccctatgttccagctattatagaggataaaaaacagacacagatgactaagaacgagtaacaaatttccagatccttatgatctaatagaggagatggacactttgttctttcattaatacactgaatgtcagttatcttctaggagccacactaagccctgaggatatatattacattgaccctgtcttcaagaaaatcacaattttgcaggaatacagacaggcagacatataattctccttacagtggtaaatgctagagcagaaggaatgagccaggatgagccagatgtgtgcctccaaaaaaattggaagtgggaggcgtaggagggaatgtggcaaggaaagcttccctgagaagattatgctacatcagaagctttatgaaccagtaggaagagagagagagtaatttatgaattgaggtagtgtctaggaatttgttaatttgacagggacttaaataatgggcagaactttaacaaaggagaggctgggaaaggacattgtgagcagagccaaacaacatatgtagaagtgtggaggtaggatcctataccatgttgtcccatgaataataaatttagatgaagcacagggtacacagaagaagatagtaaaagatgatgtctaaaagaccatacaagttcgttgttgggttctgaaaatcagtgtgagaaacttgaatattattgtagcaacagggaagcatggtaggggtttaagtaggataaaagcatcatgagatttggatataatagtactctaggctgggcgcagtggctcacgcctgtaatcccagcaccgtgggaggctgaggtgggcaaatcatctggggttgggagtttgagaccagcctgaccaaaaatccaatttctactaaaaatacaaaagttagccaggtgtggtggcacatgcctgtaatcccagctacttgggaggctgaggcaggaggatcgcttgaacccaggaggcagaggttgtggtgagctgagatcatgccattgccctccagcctgggtaacaagagtgaaactctgtctcaaaaaaaaaaatagtactctataccaaaccaaggatctatatgggtagaagagcaaaaatacatcttaagacagaaaggaaaaagaacaatcttttattcaatgcctattacgtatgaagcctaaggctagttgttttgtttatatttgttcatttaactcaaaaaataatcgtgtgaaatagatactcatgccattattttactgattggaatacagctcaaagaggttaatttaactcctccaaacccaatagtaaactagaaaagagtagagctagaatttgaacccagtctatctgtatctggagtctgtactttttgcttacactatactgtctctaatcccaagaaggactttgccattgtatatttattgtattagtcattaagccagtcagaccatgttctagttggtaggaatacagagtgatccatacagacaaatctctactcttggagttcacattatagtgggaaaagactgacattatactaatgaaaaaagatatgtcagcatgttataaatgctatatggagtaataagtatggtaagagaataatgattgagggttggggttacaattttaaattgtgtggtcaggaaaggtgacatttgagcagagacttcagtgaagtgggtaagtgaaccatgtggatctcttggaagagcttctagatagaggaaacacagtataaacaggatacacaaaaaagaccaaggcgtagttaagagataaggaggaaaatcagaagaacatgcagtttcaagcaaagtaaacaaagtgtttaaggatagagtgatcaactgctgctgagtggtcaagattgaaaactaagcatatgatttgtcaacattggaaataattggtgaccctgagaagagtaattttagtgaaatgatgggataaaaggccttggagttgggttaagaaacagtgaaaggaaaagagagatagaaaatagtatattctttcaaaaagtttttctatatcagagggaagagaagtggggccacaacaactaaacaaaaatgggcaatgaagttaatttttttaaagttgaaacactgtatcatatttgtatgctgatgagactaatccagtaagaactagaaaactgtgaagttagaaaaaatttttataaaatctctatataggtgagttgagttgatattcaggagaaaagatagccttagataaaagctcaaataatttatcaattctaaaagagaaggatggcaaagtttcaaaaaatggatagatttgcaggttgaaggatgttctccaggattgcttctatttctcccataaaattaaaataaatgtcatatttagcaggtaagttccttttccataatttcatgtttaatatgcatggtctctttctaagtattcattctctcatccttaggggcatttttgattgatgaatttgaaagaacaaaatgaaattgtttaggaacagccaacagagaatgtatattccactgtgctcctccatgttgttcaatctataggagaatactctgtttctgggaaggaagtaggcctgcagctttcagctacctttgactgactgaattctctattagaaagtccactgatatgcagatacatgtaatattttctttatcagcaataaagatgatatctttaatctctatctgctgactcttgtgcctttctctctagacatcctaaactcaaatggcagggaaaaaaaaacactgccatctattctgacctctgaagtcaccatgcccattaactgaggatgaagaagacagaaggaatactgaatgtctgaagagagagaaaacgttataaaattatcctttcaaaagatggaagaataaattcacttggcaaatgtgatatggactcacctgaggtttgaagtcatccaaaaagaaaccaaaaatcatggttttgagattttgtccaaattccttcattatctcaggtacaaatgaaaaaaaattattctaatgtagttgggtttaatgagagttgagatttttctaagaagtaaggtataggggaaagaaggtaaggtagttaaaggtacctaagaaattattataaaaataaatcatgaactgtaagttgataaggagggaaatgggcatataagggggatcaggggcattgaaaggatattaggatcaatggtttgactttctaatggtattgaagaattataaaagcaggaatatggaagggatggactgaaaagaaaggagatgatacaagtattattgtatgttttcacattttatcatttctgaaaaaggaaagataatggcaacttaatttagtaaaatatggtaataattgataaggtctagaatatgataataaatagtgttgctgaggtgggtgaaaatcaacaaactgaatgaagatcaacattcattaaaacattgaatgtgacattatcaaatgacaggagtagtgataagaacatcggaatacaggtgttttctaaagtgatttctaactctcatatgctatgattctattattaaaacaagtacaggcaaactttttacttgatttactttctatatacaatgagactaaaagatatccatcaactgaccagggtctacagggtatattataagttgaattgaaatgtcacggggctgtcctaagttcaaatcaaggtcaaagagaaagacagacctttacttttggatctgtcacaataacaagtaagtgctatgaactacctgcaaaaaagataagatgctacctgtgtagatgacatggtgatgagtgacaagtcgtggatactgttccatagtttcattcttaatctaaatcacttagacaagaatcattaactcctttgatcagaagtttttcctgcccatacaattatatacaatacacaatcactctaggagggcatagtgtcatgaaggagaaaacgatagacttgtttttccatactctgtaggtacatagttaagtattaattccataaaggtttgatgatgatgaccggtggtggtgatgatgatgatggtgatgacaatgatgatggaattaaacagccagattctccacacttgtaaactatgtaccatgttggccaattattagtaaactggcatttgttgattattaactgtattcaaggtcttagtctcaagttgcagtaaggtaggtaaaaagaagtgaagtctccaaaaataaaacctaggtaaggagcccagacatatgtctatatttacacatacagacatgacacttccagaaaccatgcatctgcatatttagtcatgggtaccaacatacacaccacactccacgaaaatcaatggcacatgtagaatcctccagtcccattagtacagctatccttataatgggacaatccctgaagtcataaaatagtatctcaattgctcttgctcatacaaacgatggaagcaatcctgaagtaatgatttgacttcccatgttgtttgataatagaggctaatgcacagatgatagaacacatggactttgcgcaaactgcttctaatgagagttatttctcaagataaattcataaattgttacactgatgcctaattttaataccctatataaagaattttagctaacataggtctacatttcaggccctgatcactcctgggtactatcaaaaaaatctcttaactttctgtctctctctctcttcctttctctctcatacacgcataacatgtgcatactaagtcctataatgtttatggaaaagttcgaaatggggttactggaacacaaagttcagatcatgatgtgctcccatattaaattcaatagcaaaagaaaaggctagtcaggaaactggctggatcctaggccagaaaagagtaaccggtgacaactcaacaaagctctgtcttggttttcaagggtcatccccatccaaacaatctggccactagatcccattttgattatatcttgtgaagacacatggtacagcaggaaaagtgctggaatagttaaacccctgagttccaattcagactctgccactgaacttaatgcatccttagtcgagtcattttgcctcataatctagtacagaaacataaaaataatgtcttgagtatggaataatggggttcctactgtactgtagaaacatagatgaggacttgactagcttttcctagccacattcagccagcaaaatgaacattactattttccttaccatctaatcattcctatgtgctcttttaaccagtcacatcacaatcataatccccaaggaacaatatgtgatgtgaataacactttttcagttagtaaagcactttcatggtgatcctccacaaatcaatgggtttgacatgcctatttgctgatgaaaaaactgaggcccacaacagcaaagcaactcatcagtcatattgaaacagtaaacctgagttccatatggtaaatttcttttgactcccttcagtgcccagcgtgaagctctgcactcagtggaattgagtgccatgtcttctgcctggatgtgctcttttgcacaggactattaagattattaaggccattaagaccaatctattgatttcatattccccctgaaggggtaatcatatggcaggggtcaattttgtattgaggagtggggagggcatagcacctgctgcatagaaagacagcatgatatttgccagggaaattcagttatcactgagatgggtgggaacccaggaaacaagatgagaattaatgtcaactggaataccaattttcctgaaacaataaataccttttccaaaactttggacctacagcaggcctacatcttcaggtttcacatggaaagcctcaaactgaagatgacagttagagggctgtggtgaacaaaaattataaatgaaattataacatgtcctaagaggccaaatgacagagtctagaaaaagtcagtgtatttagcagggtagtgtgaaaagagcaaaggctttggagctaggcagatttaagctggaatcctaattctttcacttactagctttgtgactttgagcaaatgacttcacacccctgaacctcaggttcctcatcaatataatgcatattataataaatgtttattatacacatgcattagagataatgtcctctgtaaaagagcagagcagaaatgtcaagtgtacatgttacttaaatttggtgctcattaatagtacctaacagtaatacagtatcctatatagttttaaggtcaattcctagcagttaatttcaatgatgtcatcccagctctgcatgcggaattcaagtctccctcttagggttccattaccccttgcacagaattctgatcttgtacttaccacgccatatagtaattatgacaactctgtgtctgtttcattcagcactatattcttagggcttgacacagggtagatacccagcaaatgttaggtaaataaatgaataatgtattccctaatagaatacaaacctgtcaagaatgggaactaggtctcattctcaaatttaatctttatgagaacaaggaccattcctgctttgtgccttgatcactgctgaaacactagtaactaggacagttactggggttgagtgagctgagcctatttttccagcagccagttcaggacctgaaacagagtgaatgctctgtgaatgtttgtcgaatgaattaataaatgaatgaatataatctttaattagtcttgtcactaaagtaggtaaagattcatccacttggggtgactagagaacggtcagtaattactgggtacatcttggttagagatggtatcaaagctgcatagttccatcaagatgaaggcaaatcttggatgtcagagctacaaaaatccataaagactatccagtcatcttatgctagtacaactcgcttatgcttttttaatttttctcataaattgaggctttcattattatttccataatgctaagagtactgggaaaccattaaagcattttaaacagattttcattttccaagaccaatctggttgcagtattaataatagtttggaggtcaacacaacctgaatgcaagtaaccagtaaggaggctattgcagtagctcaatgaggaatgatagtaacttaaataccagtggagatagtgagaaatgtacagattcaagagccaaaggatacaaaatcaactggacatagtaatgaattatatatagggggttataaaagaaaaaaatgggttagaaatatcagtggcattattctgtttttgtttgtctcccctactggaactgactttttaaaaaatagtagttctgtcaaattggttttggtattcctggtgcctcatactgggccttgaacatagaagatacttggtgaaagtttgcggaaagaatgcacaaatcattgcacagcaagcagaggacaaaaggagcaatattcagaagtcaacactagcaagggagaggccaacaggtctgtaactacttggctgcaatttataggaagaaccagcagattcaagacaatactagatagactattaaggaaaagctatgacacagagaaacagacagacataaggcataatgtgatatctctgtcttagtaagagaacagatgtagtagttatgaattatgataaagccaatgaagcagttatgaattcaggctttcagccacactgcatgggttctaactctagctctgcctcctcctgctgtatgaccttctttggacagttacttaacatctttattttttttattttttttttattttttgagacggagtttcgctcttgttgcccaggctggagtgcaatggcgcgatctcggctcactgcaacctctgcctcccgggttcaagcaattctcctgcctcagcctcccgagtagctggggtcacaggcatgcaccaccatgcccggctaattttgtatttttagtagagacgaggtttctccatgttgaggctggtctcgaactcctgacctcaggtgatccgcccgcctcagcctcccaaagtgctgggattacaggcgtgagccactgcgcccagctacttaacatctttaaatctcagcttctttatctgtaaataaggacaataatagtaccaatctcatatgatggtaatgaagattaaatgatataacacatataaagtacttatcaacgactagcacaatttcttaatactaaataaatattaggtatcaaccaatatatgaggtcaaaacaagaagaaaaataataatagcaataactgtcatttatctggcccctgctaaataatagtctctttccaacaaccattttacagatgggaagagtgaggctcagaaaggttaaatcatcttctgatagtaagtggaaaatttgacaccaggtctgtctgaacttcaaggcccatgctatactgctaactttactgaattattgaattgggtctccatttagtccctgatcaaccatggccttggtatatctagtacagaagatactgatccagaagatgggaatcaaattgcccaagtaaaagcataggagcttgagaagggggtggcaacaaggagccagacagaatctggtaccctgcacagatgcaccatacatccatatactccatgaaccaagagcattgtgagccacatacatgggacatgcaccctgtaattcattctggaaaatggataattataggaggttgtcagattcaataggcaaatgctggggaaatcaaaacaacaaattatgtgagagctgatatttgttcaggcagacatctgtcttctgttagagaatttagggatgtttttcaacacaatgttttaaatatggcttggaaaaacctctcctcagcatggtctgcatgatagagccaaattcctgtttccagtgggtcttttcacactcacagagggctggttcccacagtcatggtggaggcagggagggacaaggacatatttaggctgagatccctctacccagacaaaccaagctgtcctcctcctcaaaatgcactttctgctcctgtaaggccacgatccacaccacctccacatgtgcccaattcattcctacctccgcagccttgtacactctgttcccatggatggcctccttccttctctctgtctctccaaactcatccttaaacattgaggttcttcagaaaaccatcccacactactccagaccacccccaacctgggttccaacacttggcatcagagctgcattgtctagaacttgatcatctactgcagctttggagtaagagaagagaatggtgcattcagtcagaagaatgaatcctcagccacagctctactacctcctggctgtggggacttgggcaaaatcccaatatctctgtgaacctcagttacctcatctataaaataaaaatactaatatctactcataggggtattgcctaggttaaatgagataatgcatttaaagcagcactcaagataaaattttcatgtgctgcctagtgaactcatccaagtgtgtctcatctccctgggagcaagaattatgatgcactcttcttcacttcctcagaataacaacctgcttagttgtagttgattctttttctctatatccccacatgtaagacaagccagtgagaagctccaaaccaatgaaggccctgggtcagtgccatcataaatctggttttgcctgttctccttaaagggatttctaaagatgctggggagagaactgcacaaaagatgaggaataacagaagaatagaggacaacagaaaacaggagttgtggttttccctgggaaaatttaggaattcaaatcacagtggtagtcagcaggacgtaggcagtggtatctggtggatcttagccgctgaggcatacgactaactgctccagatggctacagtaagcaggggtgagaatagaagaattggacaaaaaatcctgggcatattagaccagtttctagggtattactggaatcccaccctaagtgagacaggggcagaagaccaagtgaagaatgaccatccttagaagtggatcctgaaagatagcacaaaattatactaaattgcagagttccaaaaagaacagaccctttctctccaaggttcccttccttagcattttgtttctacaataaaagtataaactataaattctaccattcataggctaggatttggttcatatggtaccttgtacctaccacagggtaagtgcttgatatgctgacctaccttgaatcaatctttaacggaaatatccataatctggagtgaggtaggcctgccctgccacttggtaacaatttggtctttagccacttaatctccctgaatgttagtttccttatctgtttaattgggctaataacatgccttgccctggttacttcaattgatagtagaagcttgacatgaaatagtggatgcaaaagtgatttataaactgtgaaacattagaaagattatttttattcattgtattttatctttctaatgaggctataaatcccagtgggtataagctgttttttttttcatcatccagtccttgtctcctaggggtaaaaaagaggagatcattattatttgagctgccttatatcaggcactgtgctaggcaccttacatatctcatataattttatttagttctcctaacaacttcattcatttttcctgtagacctgactgccttccaagaaataacagatattcagtaaatactttcaagattgaaataccatagttccatttttcacactttggggtttgaatgatgccattaaagaatataagtgctatgaagggtaataagtgctaataagtgacaaaatggcaatttcaccaagaaagaagagtcccttcctaaacataatcctgtcttctattctactaaaaagtgtcaaattcctgctcttaaatctaatcaaatgtagtgagtgattcttctgtcccaagaagtctcctggccagaagatgatgtttttccttatattcacattcaatcctaaggattacaaagaaatgtagacattccctctgtatcccagacggaattcgaggagagactgtagtttgcttagcacatgtgtatattaaaaactgacctctacttttaattttgcactaatcagaatcagaaatgattctgccaccttctagttctgtttgagaatctttgacatgactttactggcctggcctttctcatttccccctccatctcaggggaattaccgtagcaattggtctcttcattgcccataaatgtgccttgctcataccaagggtcttggaattgcctcctaactgttcttcttgcctctctttggcctatcacaacccatagtcacaaaagtgctatttctaataatccagtctgatcatgctgcctctccacttccaaagctcctcatcatctatgaggtgaagtccaaatgtcttcatactttaagctttcctatccctacctccacccacacaatagatgcatacatacctatataacaatgttacatgtttcacttttatttacccacttgtggttttctgaatctttcttgctctctcactttcaggctgtaaataaactgaaaaatagcctgccctattatttgtttagatagctcttatattactccaagagtcaactcaaacactgtcatctcaaagaagacttccttgacctgaccactccatgtggtcactggccactccatgtggtagacctttggcttttgacagatataagacctgaacaaaatcccaacattaaaatatagactatctacctgaattacttcattacatatgaagtgattacatatgaaactgaggcccagaaaggtgaaggtttctcaaggctgggactggaacccaaatcttttgatctttagcaattattccaaacattaaagataaataaaagaagaaaaaaactaacatttacaaggtgccagatgtagaactcactctcatacatactgaccctctgatatacttgccttaaccattttgctcttgtcactgttctacagaggagaccaagtctctaagagtccaaggtccccaagctaagtgagggtagaattgggatttcatacatgtctctgcctctaaatacagtgcttcccctttaattagagtatgtttttatctcacttgaaccactcaagactgttttaatcactataggaagaacaatgcaagaatgtggggaaaagcagatttacaccaaatatagtgtacattggcaaattgattctgccctcagcacactgaatgtacatctctaaatggagagctgagcataaatgaggaaaagtaccgtcaacagatgcaatctgtgtttgcaaaaccactcttaccctagttcccacagacatgattgcaaatgtcatatacaggttgccaggaaccccgatactaattagggcaaagatgtctctccctagacaaagtcaggtgccattgctatgtcatttaagaatgacttttgaccttatatgatagatttctgcaaaggcttacattgaaatgtcagtatttctataaaattacatcacatttgtgcagtatagaggataagaacatgggtttttgcaatcaggcacaagaggctctgccaattttggcttgccacttactaagtgtgtgaccttggcatctatgagcctcaatgtcctcatatgaaagatacggacaatgaaaatgtcctataaaattgccatgagatttaaacatggtgttggaggcaaagtacttagcacagggcacaatttgtgatgaatctctcccctttatctccttctgccaattttaatgtccctccaagtgttttcatatgtatttgatccccacaataatcgttggcattaaacaggacagatgctgttttcccattttacagagactcaggaattctatatgttttgcttggaagcacccagctgataattatgtgacagaactgggaaccaaacccgggttttcttagtccatattgtgttccataggctctgtggagatgcccgtaagtaagacagaccaggtctctgtccccatagaaaatccacttgacataacagattctacagaaaagggcacaggaaataaccatagatggcagaaatgccttgccagagacgttataaacaggccagctacaagcaaagcatcacaactcttgtgtaaatcccctggctgctgaacagggatccacaaaactctggctggaggtgataccacttgtccatagttaacgatgtgccaaaggaccagttagatgtcaccacaagaatacaacaaaccctccttccctttcaccaccctcagaataggctgtgatgttactttagaaatgtttcaatgtgtctatagagctattttagcattctcttagttataccaatcaacacttcaaaacaagagaaacttggacatatgttcttcctgatcatgcctcacattgaactaaaacagtcttaacacattaaaaacacgaaggaagttcttgctacttccccctcacacctccctgcttcatgacccagtttagggactcattttacttggcttatgcaatactctgcctagttccccgccctcgcatctcttttcttcccagaactggtggtccttgacccaatcctattcttgcaactatttaaggatccctccttcagtagtaggaaaatcagcatcaaagcaatctcagcttgttctgtgtcccaatgccaggcaatgcccaggtgaccagccaattaaaaatgagttgtgaactctagccctgtgcccgggtactttccctgtatcagaatgagctctctgtatacactcctgcctccatccagggtctcagcttctccctccattcttggacctgggactagagttccccgatgctccacaccatcataatctgggcataatttggccattcatcttatgtcttttctcatccttcataagagctttggcagtaaccagcttgttgagcaaatgctccccaacaccctgcctcccctatgcatacatatttcttcattcctatattcatatgcccctctccctagaatacaccccattcagcctttgctttcagaatgcctaatgaatttattcttcaaggccaatctcaaatatgccctaccctgttatcctccaacaatgggaaaataaagcaggaaaactgtcaaatgtggttaaaaatatgaacttttagtagtcatacttccatactaaaagtataaactttcgtagtcttatagtcatatttgtccctacctagctttgtggtccttgggaaactcaatgagcctttctggtcctcagttttatcacctgtaaaatggtgataataaaaccaaccctacatggtaacaacaataccaagcctgacacattgcgggttcaataaatgacagctattgtaattacaagagagtgtgtacacaaacagctgtcaaaagacttagaatgtaatgggtatcacagatccagaaggaggaaaatttacaattgctttttaggctggaagccttcttgaaggacaaacattttactcagccctggaagatggctggaatgccaacatattataaagataatagaaaaacactctaggaagaaataataacataagtaaaatcatgcaagtgggaaaatgggcataactggatggttgaaacacacaggttgaccgaagccaacctggggaggggagggtagtcaagagacaaattgctagaaatgattttgctggagattaaaactatgtcatctacaatgtccatgaaatgaagtgaatataaaaattcttaccaccagaaaatttggaaaatataccaaatttctttggcatagatccatgaagaggtccagtgagaacaatttggctttagccagcattcataaaaggtatgaataagattcagaattaagtacaaagggaaagctaaagcaccctttttttgttaagacacagcagcctttttggggctttattagaatattcttgtgccagctgtctcttttctccaactcacattcacacaatatgcctctctcttgtttctcgtcagcactgcactaggatactaatgagttttcgggaacagaaaacccaatggaatattaaaattggaaagaagagctccttgagttaatttcactgaagtgcatcacaacacactgcactgttgtaagaatgaatattcaaataggaatccagtcatgggaaaattaattaaggaaaatgttattgctaatatttctttttatgaatatacatatgcggagacacacaaccatctattggctccacactgacaataataaaagccaaacatttatgagagtcaaatgttcaagatctcttgctgagttggtgttaaaagattttaaataaaaaaattatgattccagagaattgtttctaaaagacaaatcatgtcatgtcactcctttgcttaaaattcttcaatggatccaaaacattcttcagaataaagtcaaaatcatcagggaattcaaggcccttcactatgcggctcatgcatacttcccctcatttcacctactgcattctcctaaatacattgtgctcttgcaaatctctgtctttgaacatgctgttcacattgtgcggaatattcttttaccccttgatatggtttggctgtgtccccacccaaatctcatcttaaattgtaactcccacaattcttaggtgtcgtgggagaaacccagtgggaggtaactgaattatgggggtgagtcttccctatactattttcatgatagtgaatgagtctcacgagctatgatggttttaaaaacaggagtttccctgcacatgctctctctttatctgctgccatccacgtaagatgtgacttgctcctccttgccttctgccatgattgtgagtcccccctagctatgtagaactgtaagtccattaaacttctttcttttgtaaattgcccagtctcaggtatgtctttatcagcagcatgaaaacgggctaatacacccattttatcaattcatttctgcagatgctgctcagtatcatctcctccttcctctgccagagaaagggactctcctgggcgttcccatagcacactgagctcagtgttagttagaaaatgctgtgcacctatacaatgctggagattatgccaggcaattgcacattttattgtcatagactatttacttggctgctcacccactagacagaatatttactgattaattaaacaaataatatgtaactgtactatgctcagcactgggattcaatggtgaaccaaaaaacagtccctgccctcagacagattatagtctaattatatactgcagacaattattacatgtcctttgagtaataatctctatccccctagtagctgaatagttcttgaatgaacaaataaacaaatgaataagtgggtaggtagataaggtgcttcttacttgaaaggagcagcacacagatcttagggagcatgaaatttaaaagcaacttggtacatcagtaagacaattgaattcagaatcaaaatactgattcccactccccagatttactaaatgtgtgactttgagcaagtctcttaacctctctgagctttaattttctaattcataaaatattaatgccggttggtttagaaggagtgcaaagttttcacttttctcgttaatatccaaagagtaaaatcagaaagaacacagtggaaatactattccagggggtcataggttttatggccaactctgatcaactggcagttgctttctagagcactatgttgagaaggtttctgagacagaatccagattcagcaggaagaagtactgtgatcaattagcaatgtctgcccagaaggaaagaggagggtagctatgcatgtagccaggtatttgttaccacacagccagtgagcatccatagaaagctcctaaggagatgagtggcatacatttgagggcagtatggaatggagagcaaaccatagtctggcaaactggaccatcagagagaatcctccttctcataatgtccttttagctacctagagtaatctttctcctcttatagttgtctggaattatccttttttatttgtagactatgaacacctcgttcctggtacataggatagggctgatgtgttgaacagatgagtgagtgaatgaataaaagaatgaacagctggtttcctctctgcatgaccttggccagatccttaatgtaacatatcaaactataatttgatagagtttgttgagtagtggtttacatagcacattcaccacctttagctcatttgatccttactgcaatccaaacaggtggataattatatgactattttataagtgagaaagctgaggctcagagattaaatgtcctcttttgtatttatcctatttggtcatcagtttcctaatcagtgaaaaaagagaaaaatacatcctagttttcttacctcactggtttgtagtgaggctcaaaccactgtcaactaaaaagcactgtgaacaaaaggcaagatcctgataatgctttgcttgctgagaactttgcattaattaccttttttcatgagaatttttcaggtgggtatgaaaaagtgggtatgatatccaaaatttactgatggaggaactaaggctccaggcccaaggtcactaaactattaagggataaaatcaatgtttaactctaaaacccatattcttttctctatatcataagatctttccttcaacaggacactcctgttataataatgcattctttgtttttatttttcctccaaagactagagatattagctgtggcatattgcatgtgtaaacacaatttcttcaagagagtcaggttgctagcctgttctatgtgattctttagagaactacgtaaggcaaggaagggttttcagaggcaaatgggtatatgtactagaggccagaaaagtggtttcctctagacaacatggctaagactgggcctgcccatgagtctaaagccgcacacaaagtttctaagataagcagggctacaaaaggcctgtgaaatgctgcctattgaaatgcaggtctcacaaaataatctatagctcccttgtctcctcagggcctgcaggtctgggctttgttcctaggtacacagatgagtcctttattatattgtttaaacaagaaaattatggttccctgaagggaaaaggcttggatctgagcttaactttttatcaatcatgttaatttggaaataagttattggtttgactttgcattcatcagagtaaagggtggactgtgttcctttggtctcctttgtccttaattaacagccattgaatacccatattaattagtggggctgagagatattttgcctcacccttcaccatggtgggtaattaaaagtcccattaataaaatagttgcactcttaatttctataaacctattattaaaacaataatatgattatagagtaacttcccttcctctcccagcctcctttcactgtttttgtccgtttccacaaagttcttagaattgtacaggaaggacaggctcacacatattatatgtgctaactttggatctaatcacttagggtatataattaacagaataaaacaaacaaaagtgttcctgagaagtgaagaagagacccactagaactagaaatgtgatgtggttttacaggcctggaactcctgcctcttttggaattaatgtcaaggaaaatgaaaacctttgttctcaattggactggaaatatccataaagggttccaaattggatgctctgacatcttttgctcaactaaatttagcaaatattgttaagtatacattttgtgttgagcacaatgcatgagagatacagagatgaatcagaaacagcctctgccctctcaaagagtttgctatctggtggaatggaaagttccttaaacagtcaactcagatacaaagaaggtcctgtacattaagggaaggacgaagtctccacttacaaaacattctctaaatcaatgtctcccactgtccaacagactagacttggcatttcctccagattctcccaccacaccgtgtacttctccaattatatcacctagcacaagatgcacatttagtccataatgcaggaaagcttcattatgacagcaactaagtttgtcttagtcagtttagtattctcaatgctggcatactatgtgtatgtaataaatatctgttgagtaaatgaatgaaagggcacttcttttaaacttttattttacgttcaggaagtacacgtgcaggtttgttacatgagtacactacttgtcactgaggtttggggtataaatgatcccatcacccatgtcatgagcatagtacccaataggtagtttttcaactcttgcctcctcacacctttgtccctctagtagtccccagtatctgctgttcccgtttttatgttcatgaatactcaatgtctgctcccacttataagtgagaacacgtggtacttgtttttctgttcctgcattaatttgcttaggaaaacggcccccagctgcatcactcttgctgcaaaggagatgatgttgttcttttttatggctacatagtattccatgctttatatgtatcacattttctttatctaatccatcattgatggacatctaggttgattccatgtctttgctattgtgaatagtgctgcagtgaacatatgcatgcacatatatttttggtagaacaatttactttcctttcattatatacctagaaatgtggctgctgggttgagtggtagatctaagttctttgagaaatctccaaaccactttgcacaattgctgtcctaatttacattcctaccaacagtgtataactattctcttttctctgcaacctcaccagcatctgttattttttgactttttaatcctagccattctaattgggatgagatggtatctcattgtggttttgatttgcatttctctgatgattagtgatgttgagtattttttataaatttgcttacatgttttatatatttgttttatatttatttatatacttgtatgtcaacatataaatttatttatttatttatttcgagatggagtttcactcttgttgcccaagctggagtgcaatggcaccatcttggctcactgccacctctgcctcctgggttcaagtgattcgcctgcctcagcctccagagtagctgggattataggcacacgccaccacacccagctaaattttgtatttttagtagagacagggtttcaccatattggccaggctggtcgcaaactcctgacctcaggtgatctgcctgccttagcctcccaaagtgctgggattacaggcataagccaccatgcccagcttataagcatatgtttataaacatgttggcttgtatgtcttcttttgagaagcgtctgttcatgtcctttgtaaaagggcattttagtattagccaactatgctaatatgaatagtaaccttacacagacagaaccaaagctctaaaagacaccttctttcactacttgatactcacaacagcccttgtactattatgaaaaaaacctgagatgcaacaatgataagttggtgaggtaacaccacaacccagagtacctgacgttaaactcactgctctttttattactgcttcaatttcctactcattattggtctgtccaggatttttatttcttcctggttcaatcttaggaggttgtatgcttccagaaattcatccatttcctccatgttttctagtttgtgagagtttgtccacagtattctctaattatcttttgtatttctatgttatcagttgtaatacctttctcatttctgattatgttacttgtgtcttctcattttcttggttagtgtagctagcagtttatcaattttaactttttaaagaaccagtttttcatttcataatgctctgtatttttttggtcccaatttcattttattctgccctgatctttgttatttcttttttttttctggtagctttgtgtttagtttgttcttgtttttctagttccttgaggtaacattatattgttaatttatgatctattttttgatttagacaatgctataaacttccatcttatcaccacttttgctgtatttcacagattttagtatattgtgtttccatattcattcatttcaaaatttttttttaatttctatattaatttcatcattgacccaaagatcattcaggagcatgttgtttaatctccatgtatttgcacagttttgagagttcttcttggtattgatttctttttttttttttgagatggagtttcactctgtcactcaggctggagtgcagtggcgttatctctgctcactgcaagctccgcctctggggttcatgccattctcttgcctcagcgtccagagtagctgggactacaggtgcccgccaccgtgccaggctaattttttgtatttttttttttagtagagatggggtttcaccatgttagccatgatggtctcaatctcctgacctcgtgatctgcccgccttggcctccccaagtcctgggattacaggcgtgagccaccgtgcccagccttggtattgatttctaagtttattcttctgtggtctgagaagacacttgatataatttccattttaaaaaatttactgatacttgttttgtgacctaatatatggtctatggagagtaagtatatttcatgggctgatgatcaaaacatacattctgcaattgttttatcaaatgttcttcaaatgtctgttaggtccatttggtctaaagtccattttttgtccatgtttctttgttgattttctgtctcaatggtctgtttattgctgttagtaggatgttgaagtcctccattattattatattgctggttatctttctttatgtctagtaatacttgttttatgaatctgggtgctcctgtactaggtgcatatatacttagggttgttatattctgtttttgaattgatctctttatcattatatactgacctttcttgtctttttttttaccatttttgatttacagtcagttttatttgatataagaagagcttctcctgctcatttttggtttccatttacatagaatatgtttttcacccctatactttcagtgtatatgtgtttttacaagtgaggtgactttcttgtaagcagcatataattggatcatgattttatttccattcatccagtctatattttttaagtggatgatttaatccatttacattcaaggttaatattgatatgtgaggttttgttcctgtaatattgttaattgttatctaatattttgtagattctgtttcttgtttgtttttttttctagacacagagtcttgctctgtcacccaggtgggatggagtgcaatggcttgattatagctccccacagccaagttagagatcaagtaagagacagacttgtatactgaggggactgtacacagtttacttttttgtggagcagaatctaaagaacaaagtcttggcaggctgtgtaggttttgtaaaggagtatgatctttatttcatagataattgggaatcattgatctgttttttttttttttgagtcagggtatttctctgtctcccaggctagactgcagtggtgtgataatagctcactatagcctttaactccagggctcaactgatcctcccacctcagcaatggagtagctggtactacaggcatataccaccataactggctaattgtttaatttttttttctgcagagatggagtcttgcttttttgcccaggctggtattgaattcctagcttcaagtgatcatcccacttccaccttccaaaatgtcgagattgaaggtgtgaaccaccacacttggcctctttttattcctatgtctgtttgtctttgtggttttgcggagttctgttatgtttccatttgattattttctcttcctcttttgtgtaattgttttataagacctttcatgttttatactttgatgtgtttttatgaatgtgaatattgatcttttatttccatgtttagaactcctttgagcatttcttgtaggactggtctagtgatgatgaagtctctctgtatttgtttgtctagaattgactttattcctccctcatttatgaagtttattctagttggatataaaattcatgactaacactctttttcttttagcactttgaaaatgggatcccattcttttctggtttgtaaggtgtctgctgagaagtctgctcttagtgtaatggggtttcctttattggtgactagatgcttttctcttgctgatattagatttttcttcttcatattgactttacacactcagatgactacatgttgtataaagtcaattttgcaatgtattttccgggtgatcttggacctcttgtatctagatatctaaatctcttgctagactagggaaatttttgtcaattcttttcctaaataagctttctaaactttttttcttctttgggagtactgaagatttgtaagtgatatggtttggctgtgtccccacccaaatctcatcttgaattgtaatctccacgatcatcatgtatctagggagagatctggtaggaggtgattagatcatggggacaatttcccccatgctgttcttgtcatagtgagtgagttcccacaagatctgatggtttcataaggggcttttctcacttcgctcctcattcttctctctcctgccgccatgtgaagaaggtccttgcttcctctttgccttccaccatgattgtaagtttcctaaggcctcctcatccatatggaactgtgagtcaattaaacctttttcctatgtaaattacccaatctcaagtacttctttacagaagtatgaaaatggactaatacagtaagtttggtcactttatatagttgcatacttctcaaggctttgtttattctttttcattcttttttaaaattttgtatgactggattaatttaaaaaacctgtcttcaagttgagagtctttcttctgtttggtctaagtctgcattttgtaattccttaatgaatttttcattttcagaagttttgtttgtttgtttgaatatatctgtctccttggtaaatttctcactcatattctgaattgactttctgatttctttgtattggttttcagatttctcttgcacctcattgagattctctgaaatcaataagttttttatctggcatttcagaatttcttttggttaggatccattactagaaaattactgtttcctttgggggtgttataataccttgttttttcatactttctgtattacattgatttcttcataactgaagaaatcataactatttcttcttatttttgaatttacttttggtggggtgagactttttttgtcataactgaagaaatcataactatatagcttcttatttttgaatttacttttggtggggtgagacttttttgtcttgaggatgttattataatgtattttttgtttgtttttgttgtttttgagacaggatctcactcttttgcccattggtttttgttgtttttgagacaggatcccactcttttgctcaggcaggaatacagtggcatgatcttggctcactgcagccttgacttccccaggctcaagcaatcctcctatctcagcctctcaagtagttggaactacaagcacacgtcaccatgcccagcattttttttgtctttttagtagagatggggttttgtcatgttttccagtctggcctcaaacttctgagcccaagtaatctacctgctttagcctcccaaagtgctgaaattacaggcacaagccactgtgcctggcccgatgtatgttggtagggccttttggctttgtttctgtgttgtacattcagtggcaaagaactctgtataatttccttgtttataaatagctttactgtggtggctttcccaaatgccagttttatgagtgttgtatcatgctcgtggtttaccatgagcaggctcatgacctcctgagtagctggggttgtgtgagcaacagtggtagcagaggtcaagagaaacttatctctttcccaaccatggtacactttgtgttggcagatgttgtattaggctgtgcaggtcaacctccaggccagtaggtggttcttgcagttaagagtttgttacaggggtagcagtagagtttatgctaaatccccgttaaccaggaaaggtactcaggtgttacagacaatgctgctgtgctgaggtgccggcctgggcgggaacaggtattgctggcctttaagccaggcagttgggactggaacccaccttccttccctctcaagatgcagtggggctcaatcacctgtcctgaccaagggagcttttcgggatattcagtaaaaagtcacacattgtttactttcagtctacaaggctgccctggaccataaaacttgctacccaggccaaaaccatgcctctcaggcaaatatcttccttctctagtcccatgaaagggagcccaagttcatcatccatggctagagtccacactatattcatttcttggttctggctgtgggagcccctcccccattcaagacacaatattccaatccctggcctgaggcttcctaatgccagtggatgctgctgctgctaggtcatagtatgccacccagcttgttatgagctgagattgagaatggtgtccacacccagctctgggaaaacatttggtgtgctttctggcgccatgtcttctcacagtcttctgattgcttcccaagttagatccagggattgggagggtcaaggtgctctcctgtggcctggattgcttagttgcccagtggaaaggtgcatgacagagggatactcacactccctctctcgtattggggcttcactcgcagttttctgctggattatacaatgcagactactttcccactttctctttcccagtgtctgaagttttcttttgtttttctgtcaaattcctacattatttcttggataaaagttcatgatgtgaatcttttattttacttttttaattaattaatttattcgaaatggagtcttgctttgtagcccaggctggagtgcagaggcacaatcttgactcattgtaaccttcatcttccaggttcaagtgattctcctgcctcagcctcccgagtagctggggttacaggtgcacaccaccatgcctggctaaggtatgtatttttatagagatggggtatcaccatgttggccaggctggtctagaactcctgaactcaggtgatccatccacctcagcctcccaaagtgctaggattacgggcgtgaagcacacccggccaacggtgtgaatctttacaagctattttgtttcttccaagtgggtgaggtatgctggaaaagcattgtttgccatatcacggttttttgataagtttttaaaaacttgcgttttttttttttctagttacctgaccatttcttctaagtttcttggcctatcctaaggaataaatatagttctaagccttcagccttgctttttgtcttctcctattatatttggcccgtctacctatttctgaggagacaaacaactaattagagtaaattccaatctgcacatatgtgcttggtatgaatttgtaaaactataagaactcagtttacatgcacacagaaaaaagttactctgccactgtcaacatcatgaacatcagctttgtcttccacttctgtgtccttcacttcacttctgtcattatcatcattgttaacatttattaagtgcttcctatatgccgggaccagtgttaaatatctgtcatcatatttaatccttacagctactaaaagtaccattattatgcccatttttctgatgaggaaacggatgcagagaggttacacaacttacaagagctaaaaatgacagaatacagagttgaacctatagttgtttaatttcaaagatcaaacttttaaccacaatgctatattatcagcagcaagactacttttgtatctgatattttctctatagaaagtatctgaagattacaaactaagaagatctatgaaaacaggagagcaggaagtatccctccaaatgatagaaagtctcaggattactgaaaggggcatcagaaattatttcatttggctgtcctcttaaacagaaaaaccgtgtacggcatctgtatgtgcctttctagtggcaggaaccttacactactcattgagacagccttcttcattactgggaagatctcatttttatccctatagaaaagtaaaatctgctttcttatgtagactactagtctagtcctattctcttgaaacagtcaaaacacacttagtctcctggcaccataattggcttttagaatttttaacattctcctccctgaaccttctctccagactaattagttcagttctccttggctggttaatatttaaccatgatgttcaactctctctgatccagatactgcattaaaaactcctacatccagtgttgtagttggcaattagtccttgtcttgaccctggtctttcccttgctgtttgttataaacagctatctcagtctattcccttgctcctcctcagagctgcatccctgtcccatagccatgatatgtggggaggcaagtgtgactacttgatgctggagggcagatatgacaagctctggtgaaacgctaaaaaagcagcctccttagaagacttccatggggagacatggtcatttctgcagttcctgtgtactcaggattcttttaccttgggtaaaggcatgaaaacaaggcaggcagggtgcctcctgcatctgctcagatttctgcctagggcctgctcaccacttaatttgtgtgggtactgtctttccttgatcttctcctttccatgttttcccactttcccacttctacccttatcttcctaccccaagctcatttcagatactttgtaaaaaaaccaaaagaacctaaactgtgtttcttcctactttactctcattccacagaatgcttttgacaacagctgtctaggggtttacccctacatacatcaaggaagcaatcaattctgcaatggattatcaagtaaataccagctaggtgtcctctaatttgattctgatactatctgaagatagtgtcagatcccacaggttgagggctcagtactacaagactgcccctctaatttcagatgccaatcgaaagcacaggttgtggcctgcacttctgactgactggctataaaccaaggttcctataaaccctctttgagttcagttaatttgcttcagtggctcacagcactgagagaaacagatttactcatttattataacgggtgttacaaaggatacagatgaatagacagatggaagaggtgcataggacaaggcatttgggaagggatgcagggccacctccatgtgcttagcaatctgtaaactccctgaacccagcctttttggatttttatggaaacttcattacataggcatgattgattaaatcattagccattggtgctcagcttaaccttcagcccctctcccctccctggaggttggggggtggggttaaaaagcccaaccttctaattgcaacttgatctttcctgtgaacatcccccatttggaagctacctaggtgctgtcagccacctcattaacatacaaaaggcactcttattcttattgccccagatagtccaacggttttaggagatggatatcaggaaaaaagagggagactaaatctatatatcctgatagcacagatatattcccttagagaaaagggctctatattagatgggcttgaaagatccaccatctccattctcacttttgaacctttatccccttcccattttccttggatctggaagcactctgggcaacaactcctcttcttggacttggtcctgcatcccctgttaactttctgttcactccatattctcttaacttggctggagttcattttattcccttgctggggagcaccttacgtattagtctaatttaaaaataaggaattgacatatcagaaaccttagtgagttgctcaaggtggcgtagcttaaaaatgacagtgttaggatttgaattcttgacaggtcaaaaaactttcacaatattttacaattctggtcatgttccactttgtcaaagtcctttttaatgtgcaatgaataaagcttaatgcaatttcttagaatgtgtgtgactgtactgaagtgcaaaaacatctgtgttcaacaaataagaaattgcttcttaaattttatttaaaatgcaatgacatttcatgccagatctttaaaaaacaaaaattaaatgtcattcaagaagtcattacagctttgttaccaaataaatttgtttgaaatttcttgtataaagttgaatctaattttacaactttttaattaagtaatcctcagcaatttacactgaggatttgctctccctcctgccttcccaaagggctggttagacttggtaaatttaaatttgataacagtttcctgaatttgtgctctattcccagccagaaagagagcacatgtatatacgaaatgagtgtgggagagatggaaaatcccatcccatctcattagcaaccaatgagtaccaaaaaaaaaagtacaatgaatgagaattcattatagtaacaaccaacagaagagtacagtaacactttaattccctcaggagatgctatccatcaaagggctctccttagcagtagaataactgctaatgcacagctgcgtttgtataaatgaaacattgtgagtgagagttgtatttaagaagagctattgctaaaatataaaactcagataagatgttcaattgaaatgagaacttagatggaaatcaatagttgtttaatgatgaataattcattcattattccaggagcatttcgctatttgcaatatatatatttgcccatatagaatatcaaagaacctcaaatgatcaaaaccatcttgaaaaagaggagcaaagctggagacctcacacttcctgagtgaaaaacatactacaaagctacagtaatcaaagaggtatggtactggcatcaagacagacatgtagaccatgaaacagaatagagagccaaaaaataaaccttcacatatatggtcaatgatctttgacaagtgtgccaagtctgcacagtggggaaagaatagcttcttcaacaattggtattgggaaaattggatatccacattgaaaaaaatggaaccttatcttaaaacaaaaagaaactcaaaatgggataaagacctaaatataagaccttaaactataaaactcatagaagaatcagtagaaaagctttatacattgccataggcaatgctttcttggatatgacatcaaaagcacagcaaaaaaagcaaaaatagacaaatgagacaacatcaaagattaaaactattacacagcaaaagaaacaaccaacagagtgaaaaggcaacctacagaatgagagaaaatatttgtgaacaaaatatcaatgaggggttaatatccagaatatataaagaactcctacaaatcaaaaacaaaacaaataatctgattttaaaatgggaaaaagagttgaacagacatttctttaaagtagatatagaaatggccagcaagcatataaaaagatgctcaacatcactaatcatcagaaaaatgcaaatcaaaatcacaatgagacatcaccttccacccactaggatggctactatcaaaaaaaaaaaaaaagaaacaaacagaaagaataaattttggtaagaatgtagagaaaatggaacttttgtgcactgttggtgggactgtaaaatgatatagcctcgatagaaaacagtatggaggttcctcagaaaatttgaagtagaactacagtatgatccaggaactccacttctggatctatacccgaaataattgagaataggatctcaaagaaatatttgtataccacattcactgcagcactatatacacaagagccaagttgtagaagccttaaatatccatgaataaatgaatgaataaagaaaatatagtatatatgcaatggaatattatttagccttaaaaaagttaggaatcctgccatatgctatagtgtggatgaagtttgaggacatggtaagtgaagccaaccacaaaaagacatatactggatgattctacttatatgaggaatctaaattaatcaaactcatagaaatagataatataatgatggttgtcaggggctgaagggaggggaaatgggaagttgttgtttaatggtttaagagtttcagttggctgggcatggtggcccatgcctgtaatcccagctactcaggaggttgagttaggagaatcacttgaacctgggaggtggaggctgaggtgagccgagattgtgccattgctctccagcctgggcaacaagagcgaaactctgtctcaaaaaacaaaaaaagagtttcaagtcatgcaagatagaaaagtgttagagatatgttgtacaacaatatgcatgtagttaaaaatactatattgtacacttaaacttgttaaaagggtaaatttatgtgctttttgtcacactaaagatttttttgaaacactcactatatgtcagcactgacgccacaaccataaagaaaatggataaagcatcatgggagaaaagcaaggtagacagggccctcagggcagaaagtattaacaggtaggaatatagaagccatttcaaatagaacagcttgaataaaggggccaagtaggagacagacttgtggactgaggggactgtatgcagtttactgttggtggagcataatctaaagaaccaaatcttggcaggctgtgtaggctatgtaaaggagtataacctttattccatagataactggaaactatttatctattttttattgtttatttttttagtcaagttcttgctctgtcatccaggctggagtgcagtggtgtaatcacggctcactgcagccttgaattcctggcctcaagcaatcctccctcctcagcctctggagtaactgggactatacacatgcagcactacacctggctagttaagaaaaaaaaaaattgttttgtaaagatgaagtctctctatgttgctcaggctagtttaaaactcctggcctgaagtgatcctcccactttggcctcccaaagtgctgggattacaggtgtgagcctctgtgactagtcccaagataagggaaatgataatcgttattatgaatacattaactaggcattcatgtttgatacttcataatgtaaaacacactttcacattttttcctcttatttggtcctccctagatgctacattttatgggtaaggacaaatgatattacccacttacagctagtgacagactcagaatatgattccaggtcccttaactctgaaacccctgcacagacacttgagaacatgtcacagtatttgatgagctatgagtgctattcagatgtgagcactcatcaccaatgggacttatatctgtacagcttttctaatgacatcatagattcagagaggcaaaatgattgcccagggtcatacagctagtgattggcagttgttgtctcctgatgctttatcacatgattgtttccttcttcctgggtacaactactcagagaagatatactgattttgtgtcagctggctcttctgtgctctgagcatcaagatggtgggctataaaccatagtctagacgaactccatctgtcctgtgcttcttatctccttatcaaactagggttttgattaaatagcttcccaaatttcatttcttattgattccccacatggctttaatttattgctaaagtgactctttggaaatcccatatttcctctttcaaggacacagaggagggcagcatagaatctttcctttttaaataaggttgctcctcttcttcattgttccctgtgccccttaaatgacctccatccatctatttttagctgctattgattctcacttaacggtcttgttcctcctagatgctggaaaacactttgactctgtagaaactaagtgtatgcctgcttcctctgattgaatgtgtaagcaaactataggtatgtgcagtataaatactccatcctacccctggaccctgggttggtctcactagaaaagtggtgtgggagtgtaagtaggtaagcttcctgtttaaaagagcattagaccaggagtcaaaagactctggtacaagccccagttccagcatatcctagtagtatgattatgttcctctgtgggctcaagttccatgtctgaaaagaaaaggggtggtaataggtgaccctaacagctttttaatgtttcctttcacaaattatgtttctgaaatatctgttgcataatgttaatacattgtaaaattataaataaatgacattttggaaaagtatcttataaatggaaaagactttcacagatgcttattgttctgatgatgctataactgaattcctaggtctccacaaacttccagggacccaatatcttcacattaggagacaattctaggtttctcctaatctttgctctgatttagccatggagcaaagctgctagaaaaataaacttgatttggcagaaaaaggagatcatgtcagcattagccaaggggaataagaaggaagatttaggaaataagttttggcattagccaaaaatgaatacaggtcaagtttagaaaagtttcaaaatcacttcagtacctcagttgagagaagtgggcaaagaaaagtctagaactgttgggaagaggggcaatctgtatgtgtttgggggaaggagaaagttttggagttcacaatcagcttttctattcctctgttttcagcctagctcccttaactgagactgggataaatatactgaattacaacaactggttctgaaattaaaacaaaaacaaaaacaaaacaaaacaaaaaataaaccctctaactactgggatggccctataaaggggcagagccttaggaatgaaggtctaatacaattattataattgctgttattattattacttcctccattgcctacttttcttcattacatttctctccaataaaaactgtcttttcagttaaggcaaacctgcttttgaccctttccaaacacaaaccccttccctgacactatccttatacatattcttttgctgcattaatagaaatagagtgtataggatgaagaaaatgaaggttctgcttcacccttcccccagtgagtaggctttaggaatttgttatctgcatttgggccatacactgcacctgcgtcactgacaaaaaaatcaagtaaaggagtatcagcatagagatgagtctggaggccagtacattctggaaagagtagaaataattgaaaaagtaataggtatcccaaataggactaggaccaatgggtgaaaactttataaagaactttctgagcattagactttagatggagaggagaggagaggagaggagaggagaggagaggagaggagaggagaggagaggagaggaggtaggaaccaggtgggcggaatgggaactgagggaacaaacctatttgatggattgttttttccgcttgattccccaatctggggagagcttatgatctcaagatgaatgcactattcttagaagaaaataaaattctagcataatttctgcaggtattgttatgtgattagggcaaatagcttttttaaaaaaagactatttagaaatggtctcaggaggctctgggcaggagcgaactataatgcagtctcaggatgatgatcctgtcattggaagtctatcagtggcagaatccaaattctcttaccctacctgatttagcagaactgactgactggcacaacacatctggaaaggactgcggcagatcaaaaagcagaatgatgctcctttgagggaggatcaaaagccaggatggtgctccattgagttgatgctccattccaaacaagagccaaaaaccacacagctctgtagacatacattcaccattcactgagtatctcctttctttctttttctttctttctttttctttctttctctttctttctttttctttctttcttttctttctttctttttctttctttctttctctctttctttttctttcttttctttctttctttctttctttctttctttctttctttctttctttctttctttctttcttctttttattttcaaggtctcattctgttgcacaggctggagtacatacttgatcacagctcaatgcagccttgacttcccggggtccagtgatcctcccacctcagccccccaagtagctgatattatagcacataccaccatggctggcaaattaaattttttgtagagatggtgtctccctatgttgcccaggctagttttaaactcctgggcttaagcgatcctcccacctcagcctcccaaagtgctgagttactccactcaacctcattcctgctcttgattcttttagccactaactttgccatgcatgctattgatattgtctttcactctatattatcctttacttcaactcttacttctcattttacatttgtataattaattataataacaataataacagctatacttttagaatacgtagcttgctccatggcttcttgagagggattatatgtattatatatacatttcatttaattcttacaactatcatatgcctatgagttagttatggtgttaactcagttttacagatgaggaaactgagaactgaggctaggagaggtttggtattttgccccaaatcactcaagaaggaagtggtagagtcagtttagaaaacataccatctctctgacttgaaagcccatgcttttctacctgggctatactgtcacactaaaaattgattttttttcttaatgattctgatgatttttattctccttgtaggtgaccttgcctgcttggtctgcctttgatgaagccttaggtcataccctatcagcagtactccccaacctatcacctccacccacagcccagcttctcccaccttgcaggcagctctcagacaacaggcactgaaaagctagaagttcaaggaattcaaaatgtattttctagaacaaggagtttaccacagctgccccttctgtggacacatgatgcctgtctcagagaagatgcattcttggttgttgtctaacacagaggggatccaagaatttacttcactctaagagatctttatcttctcaccttaccatagtgcatttgtcccacagaattgctggttttataagtgatgagcagatttacttaaatatatttatttaaagctataaaaataaaattaattcaaatcattgttccaaagaaacccagaacagggccgtgcctgacttggcttccaaggagagaaaattattcgtgatatgtcagaatccagctcttaccggaaccacacatgcatgtaggcatgcatatacgcaaacacacacacaaacaacacaccacccaaacctgaaggtgttttccaagaaaaccagatgaagagaatcttcattaccagaagcagggagtgagtcagtgctgggcagaacaactaagcaggcagtcttagtaggagaaatgccagggcatgtgtaaaagaaaagcagcaagttcacccatggggaccctggaaatcatttaatccagcactaacacatatattccagtaattttaaatgtttcaccaatttaatattttaaaactcatataattactgatctctaacttggttaagaaattaaatgtatatcatctcatttcacataaatgagtttgaaatgaaacagataaagaagtaaagaaactatatagatgaagtactaacttcctatctgtccaactttaattttcttcctaaattatattttggttgaaagaaataatttctactcccaattcttgtcactctctgctggacctctgtcaacatcaaatttactatgaaggacccagatatagataacacagtacagtgggggaaaggtggagaagtatcttcctctccctcatttttgatactctatttctatttatgttgcaaagatatttaatagtgggtgcattaatagaggacattatggtatgggaagaacaaagtttagcctagtctggtaatgtgcaattcacagagataagacaaacaatggtgaaggcttgatcagagaagggcagattggccagtggggattatgagttgaggactgattagagattatgcaaaagtggtcagctgggaactttattaagattttaactaccatgtttacaaataagacaattaatcctataagtaaggaaaaactttacataggttttcagaaaaggatcaacataatctgattcatgttttgaatagctcatactaacactagatggaaaatagatgtgaaggggacaaattaaaggtagggaaaccaatatgatgactggtacaataatccatgcaagagaataaacttcatgagagtcattggtattcccagtgtatcactgctatatacatctccaggacataaaatatagaatatactcaataaatagctattaaacaaaaagtggtttatgttcaagtgaaaagtgtaagacggggagagattggctagtggtcatagtggtgacattcatccataggtttccagataactctctttccaggtcattgtccagattgtgccagctagctgcctagattgagctccttttcattgagtatttattattttcaggccccattcttagcatcattgtacaaacatgatctcctttcatctattttttaaaagtctctaaggattaaatattgttatttctcagtttatatgtgaacaaagcaaagtatctcccttaggtcatgcagctactaagttataccaggatttgatcacaagactgactcttaagcttctgattgctccactgtagtcagaagtgtgggtgtcacttgcataattaaacaggaaattttacgtatcatatttccatacacattctgaagaggtttctatctcacagtctccacaaacaatagcagcacaatatgaacactgtgcaaatgtatttttaataaactgcctcaaaatttgctatatgccttaacaagcttttgtaatctcaggaggccttattagataaagatgttttagaaaatcccccatccctaactacttgaaaatgcgttaatcattttaaatctccccaaccccttgccaacccccaacagccacaggcaaaaagtcatattgtttggcttaatgaaaataaatgttgccccttcccttataaaatatctttatatgaacttacacaaatactgaacacaaggtgagccctgaaaatcttctaaacaaataataaacccaacttagccctgctgtgagtcctatgtggttataattctaccctttcctttgctctagctaagttatttgaaagtatattactttttcaccctggatatgctattttatgtgcctttgtttttaatatgaccatggaaatagcagcataatatccttttccttcctgatgttgccctctcctctttagaaaatgaattttccacctttcacttagaagtaccctgccaaatgggtgtcctgcttagtgcccaagtccgtccccagcatgcaggcaagatgtctctcagggatagaaaaacaacattccatcacatccatgtaattgcttttaaaatgcccattgcttttattagtagctgttccattgctgtcataggataatcatagtttctttgaaatgtctctcttatttttcatttatgtgttcagaaaatatttcaattacacaaacatgcagttgatttagaaagacagttctcattcatccacaaccaacccacaatttcagaatttttagtaattgagtgaaagaataaagtttgcttccaacaaaaggcataagaaatacaaagagtatgaggaaaacactagttttgtcaacaggatcacaacaactctgaacttatggttcttcatgtgtaaaatagggataacaatcttatagggtttttatgaaaattaaatattatatgtgaaaatgcaggcacagttcttggtaactaaaaaaatacctcaacaaacagtagtaatactggtagtagtggttgttactgttgttgtttcaagataaacattaaaccttcattctttatttatcacatttttttgaacatatgtcacacagtcccccttggaagaagctctcagtgtagtagggcagacagacaagtaggtagttaactactctgcaatttaataactcttattataatagaggtatataagaactgctataaacacagatgtaagaatttaaataataacatatttatttagcattttcttgctttatcattttcaaatcacacaacaaccatttgaagtaggtttaaactaccagtttaatagataatcatcatcaccaccctggcagctaccatttgctacacgactattgtgtcaggccatgaactagaagctttacatgtattatcacatgtgatgtcactcaatcatcacaaaaaccctgcaaagtagctactctgatcctgattttacagatggtgaaactaagattcaatgagttttagtgacttccccaatcatacaactagtgagtgatgtagtctggatatggaaacaaatctgtctgtctccatgtcacagtatttcctctattcacagttgagtcacagatacaaaccagctcagagaaaattacactggcaagaagaagaaattttctctcatattttctaaatatccatcttgaataaataatgtgtaaaagaggatgacaattagtaccctgatcactagactagatatgaatcttatccttccaatttatcccattagttgcaattcaacaaagctacggcatataaaaagattagtttcacaaataagtggccattgaataagctattacaccagctcaaatagtctatgatcgagtctgaacactgacgttatcaattctggcattctatcttccagaaattatatttgccatctagaatatagattagataactttcagatggcttccaaacgaaaccaaatgtttaaacaagctgctaaccctcagacatgaaagctaaaagtgttaaggaaaacctttaattatattactgcaaaccaaaccaagacaagaacaaatttcattataggaacctggtagttcagaggtagtctgcaatactctctcagatcactgatgaccacacccttgcttctgccaaatgttgtccccctgaggtaacaattaagttatttaatttggccctgtatagagttgtgtagtctatcatgctgcttttagtccttggtagctaggaaacttataattgagttttctattaattaacagcatctaggttaattgtaaggttagcatgtttaccttttccatcctttacgcatgttaaataataggactccatttttaaaacaagtaatagcaaaagcatttatttttatttattattgaattattttataaaataaagaacagtctgatttttccacatactgaatttatcatcagtgtttgaatttcatttattcttttaaacaatatttactatatacttacaaaggactatggctttgtctatgctgaacactgtccctttccttcaatggtggagaagggtaaatagataaaacacaatatgacaattactactagtactataatatgataattactaaaattatttgtgagctgcacagaatggagaacaaattcatcctttcacatctacatttatcttaggcttacctttcttgattagcagagatattgactgctggatcaatgtggcattttgaagtatatctgacatagtttgaatatacatgcctgccaaatcttgtggtgaattataatcctcagtgttggaggtggggcctggtgggagatgtttgggtcatggcggcagatccctcatggcttggtgctgtcttcgtgataatgagtgtgttctcatgagatatgcctgtttgaaagtgtgtgacacctccccccacccttgctcctatttccgccatgtgagacgcttgctcctcatttgcctactgccatgattacaggcttccttaggcctccccagaagcagttgctggtgctatgcttcctgtacagctggcagaattgtgagccaattaaaactcttttctttataaattagccaccttcagatatttctttataacaatgcaaaaacagcctaatataatatacaagaaactcaagctccttggtgctctgagtgaattaagaggtttgagatccgggcaggccagcttatatacctccttaggaagatttctctgtctcctgcaatccatagggatctctctagctctgcatcctgaggtattctctccagaccagacacaaatggctctgagtatttgatgcagcccaccatagcagacagttcctgtggccccccaacctgggtataagccattaagagcttaagtttaatttactttgtatgccaagcacctctcttcaagcttaaaatttaaatcagtttagcaataatttattaagctcctactttttcttggacgcacagtaataaagctccctatccagagttcaagactagcaggagagacagacacataaacagagttagaactgtgtataatggtagtagggtatgtctagggtgtctagcccatggtaggtagggcttataatttatttgggaaataattttagtaatgctaggcaattcagaatagtaagaaacaaagactggaagaaaaaggttgggaaataacccagtaacctacttaacatccagtacacgatgcacaaaaatggggctggtgtaattggagcagaattttgtcctaagcatcctatgtggtaaacaatttgaatggatatgggatccaagtctgaggctaaataaaagcaggtggtaaagattctgggagaccagttctttcacggcagtacagagagagaattctgcctctccaggtgtgggactgactgtggcaggtttatcagaactctagctcaacatgttgagatacagacttgagcaccagtcttatccagtcctgtggaaaattgtaatgataaacaatgaaactgaggcacaagtcaagttgcttgtggtacagaaaggctctccatgaccatgcaaattgcttaggttcccccacttatccttatatccagacacgttggagactatgtttatagcagaagactaattttacacaccatctgctggtagactgagactagtaataagcctcctgtttagaaaaaagattgaaatgtagtcttgacctgaaaaccttgagattgaagcggtgggtaagggataaagggagtatcaagtatatttgttgctgaaacatttttgaaagttgggaaaagcaattctcagtctctttcttatgaagacaaagggaagttatttgttctcatttgtctgaagttgtcagcagagacaccatcattcactgccattttaaaatttgagggtcatgaaacagttgtgatagaaacttgagaaagtaaaaaactcactccatttttctccactgaaattctctcatcttctacttatatgtagattcatgattttttttgtctctcaggagagccacaaggaacctgtcagaaatattccagcatatgcaaatcctaactagacagacaaaaataatatttgttctgttcctcatgtgctctgtgggagttttgccttgtttgcatgattgatcagtttgcatattacttttaaaaatcatttttcaaaggcagacacaaagctgaaattaagaggagtatctagggctgggctgaatgtaagggcaccaaatctagaataagtccttttaattacttatgaatattcctcctgcacatatcagatgatcactcctcaaagatgaactgaatggtaaacagcctctgtttttttgctgattgattagcagtactcctatgtctaaatatgctggaggttatgtaaactgccaaagacctgccagaattcctatacattctcagggttcacttctgttttttctcaagagttcatgatgtttctgatcttccttgctagccagtttctgtactctttttcacattctcttcccatatcaaactttaacaaagaacctccatcactgtggattcttcagacaggtacccctctttgcacaagtctggacacaatatgctgggttacaattcctcttctctatcttcacctcgaccgcgtttgctcaagcttcatcatccctttcttgtattactgaagtagtcctctaatttgccttcctgtggtcattatccttccttctccctctttcccccaattttttcctcctcccattccagaagtgttgattactccattgatagtgacatgatatattattatccctcatttatcatgaggaaactagaattcagggagctctcataatttgctcaaggccacatggctagtagatacagtataaaacatctgagatctgcaagcatatactgacttccgttactttgccagtatcaattctaggttctggaagcacaaatatgacttaagatatctgatcatatctaactctgagaaccccaccatggaggagacactcatactaacagtaaattacagtacaatctggaaagtgcaaggctaagtggcaatgtcagggtttgaacttaagtctctcccagttagaccactggttgccaatctctgcaaagacaaaagcttttattatttaattttattcatttttttctaatttcaacttttagactcagagggttacaggtgcaggtttgctacatgggtgtatgctaaggtttgggatatgaatgatcctaacacacagatagcaagtttagtacccaaaagttagttttcaaccctttccctaccctccttcccctctctattagtccccagtgtctactgttgccatctttatgtccatgagaacccaatgtttagctcccacttataagtgagaacatacagtatttagttctctgttcctatattaatttgcttgggataatggcctccagccgcaaccatgttgctgcacagggcatgtgtttgctcttttttatggctgtgtagtattccatagtatatatttccatagtatatatatatcacattttctagataaagggcttttaagtgtttcctcaagtttctcataatattatttgtatttttattcaactaagaacaaaacaatggcaaaaagttacaattaagtcagtaaggctttcaaatgaatttatattttattaataacaatactatcaatgtccatttgaatccacatctttgtgagatatactattgtttcagtgtaacagagagtgagtgcccagccatgtatgaatttgggacccacttgcaataaccgtatggctccccctcggtcctttgcccattcactgggaattaatgccagccttgcaacctcttctcatacaaaatacctcctaacagggttctgcactgttgacaactagagagccaggatgtaacatgcttatgtagaagtcaagcaagcatgtgcccctattagaccttggagagtgacaagaaccttcaatttctcctttaacccatctagacatccatacacagaaaacgaagcagagagagagagaactactatttcttggtggctgctctgtgctagttatgtaatttataatctaagttatatcaagtctggtgtttaaagccttttagcagaatcttccctcctcctatttagcctaagttctgaactttcccttcctccacccccatttacgtttttctttcttatttttcccaaacataatttgctcttttacatttcaatgcctttgctgaagctattattttgtctggaaaatgcatgaccagttcccattttctttttatcttgcttaactctttcacacttcaagattcaatttctttttgaaaccatcataatctacataaaaagttgttctctctctgatctatgcacccaccttacacttgatctgtccttcttatagcactgagcacattatatgatattcacttgtttacatgtatcttaatcactggcctatgctctttttgtggctgagtgcatctcatttttcttgaattgccagtgtataagattgtgcctggaacataatacacactcaataaaagatggttgaatgagtgaataaacaaatgtcttcataatctttggctgcatctgtcaacattgatagaatcttttctgaaactttctgctttaagtctggagaatgaattatgacttttgtcctgttatttgtcattttctaacctattcatctgttgatgatcataaaagtctaggatattagtgtgggaagagatcttaaaggccctctaatccaatcttcctaccagggcaaaatcccctttctgtgatcagaagtcattcattctctgatgaacagagttgattgccttataagggaattcaatccttctttagtggtattattaggaatgtcaaactgtatctataatttctccctactgattctgtttctgctcttgagactatactatttacatgtattttcatcttcatgtcatcctttcacctatctgataacagattgagaaactaaggagtcacttgtgaaggcattctgggacctcagaaacccaccctggtttctggggtcaagctaaaaggaggcagattgagctttagaggcagctggcaagaacagtcaagtgtttagtgaccaagacattggcaaatgtgggcttaaccctggaaggcaccaagattccaggagatagaaaacaacagatacagcctagctgaaagaaggggagatagcataggcaaaaacaatgatgctatcaaaagcagtccagtaatctaagaggataaagtgcaagagggtacatagagtagtgaatgtaagactggagaagtagtcagaaaatggaatctcagagaagtgaagtaacttatccaaagttacatagctggataggggagcaagttggctctagcaaaagtcttttgggtgcaagtcatttttgctagttaagtagtctttatattgtctcacaacaccctgttagctcacccctcagtaccagtcataaaatgattattcaaaaataactcactagattaagtttaactgtctcactagaacctctgcattgcagtagcccctctgatatggtttggctatgtccccacccaaatctcatcttgaattgtagctcccataattccacgtgtcatgggagggacacagcgggaggtaactgaatcattggggcaggtctttcccataccactctcatgacagggaataagtctcacaagatctgatggttttataaagaggaatttcctgcacaagctctctcttgcctgccaccatgtaagctgtgcctttcaccttctgccatgattgtgaggcctccctagccatgtggaactgtgagtccattaaacctcttttactttataaattacccagtctcgagtatgtctctatcagcagcattggaatggactaatacaccctccatggctcccatggctggctcctaaaacaggtttataccataagggcacttagatcagagtttccagatcagaagcccatccagtactactgtatactcccttttctatgatgcacaggattgtcacccatcatgggacaacacattcttctttaaatatgtcagtttactgttagtcttatggatctggaagcatctttaaaggtagtttgcatatgtctccccagtgagttttaagtttaacttcaggaaaatctaatatccattgttctattcttattaggagatgcctcatttttctccttttataatacaatacaattatcagtcttttcttttgaaagaaaatatctgagttttgccacagtttcaccccatatcatgatattcatgaaagcagccgaaaagtgacaaaaaatttatactatatggtgcaacctatttaagataatgcatgatacacataaggctgacatggacaaatgattcctatattgttactgtaggcaaaggattcaatacagacataaaagaaaacctcccatcatatagcaatgtccagaatccctaaataaatagaatatttgctggcctgagaaaagcttatagatgtgaccatattgaaagagcagttaatttctaagcaatgtgtttaactcacttcttgttgattactttcttggaaaatcagcagaaaagtttcgttgtcaaagattccagaaatgctcctttgacatagtgctaagcaagacatttgggttgctttccattagtcaatctaacaacactccctcacttttctctgaaatcctttgcaaccatttatttttgtttaggtaataaaaggaatcttgtctcataatctaagggtagcttcaaaacattttagtttttgtttttttttcttttcatatggacagagataacctatgtaaagcatggctaagtatctggcccacagatagctattaacattcattggctgtattttaaaataaaccacaaaaagttcaacttgattacaatgtctcagatacattctcaaatagctacagatttttgtcttactgtccagaactcattgttctcagggctaaaatgaattggaacttggaaactaacatgatgaatctcttaataattgaattatacttcctttttccctgttgcttttgcaggtcactgcttttcctgtgtgataagttctgtgtaaaattgttcccctgttcaggttctttccatcagtatgtaatggaatgaacatgatccttgtcatcatgaagacttgctttgaatcctggctatgccacttaccaactacattgctttgggtaatttccttaacctctttgagattcacgttcttccttggtaaaaggagaatatctgtctttaaaaattatagaaaagatttgattataagacatctatgatagagcttaatataattcttggcatataatatatgcttaataaatattactttttcttccctttttccacctattgcccaccacaacatccagtggtggttctcagaagagagtcaactactctgctctgagcagatcttgtcagcatgtctggtgccttaggacccaaagaatctctttactctgcagttctcagagagaccagtttttgaagccacaaagatataggtttgcatctcagttccctcacttccaagctgagtgtgaactcaggaaaacccctaaactttcagaggctctgcttcttcatctttaaataaaaacattacctatgccataggtttgctgtgctatgaagattaatgcaggaaaagcatggaatggagatcttgaccatcataaacaaactgtaactttttcacttaattattaagaattcatgagggttcctttgtctgcccagtctaagctaaatatagtgggcagaaatttaaaagaacgcaaccaaaaacctatttcctggtctccaatagctcacaatcagaaataaggtgctcagtaaattaaagctaaagaaaacttagggaagtatctagaaatgcatttagagatatctcctcacagtgcatttagttttaacgggattccattgtgctatatggcataaagggcaaacatcttggctttgtgaaagatttttgtttcaaaaaaaacaaaagaatcaatcaatcaaatctaagcattatagctgagtcttaaaggtcatctctaactccctgagattataggatccccacttcaacatcctctagaggagacagagtgctcaatgccttcagaggcactgaagtcctcactgacagcttctgattgctggaaagtacaagctcacatggaactacaagatagtactctccatatttcatttatttaagtggcttcctcatccttaagaaagttctttgaaaggaaagattaaatttcttcaaaagataaaactaaaatgcagaatttacaaaggagaatgcactatcaatagccatgaacttctcttgcataatattcccttgcatcgcatttcaccgtttacaaaccatattcttatttactgtcttattgatgatcctcagagaaaccttgtgaggaaagtatcttcactatttaaaaatttattttttttcacattttattttttctttgaaagagaattttgtcttacagtcaacacagtatttccttttgtcctgaaaagttgatagatcaatataaacctcattaaattattgtatattggacataccttagcataaaaacatatacactttttaatttttagagacactggaagctaaaacacagaaaaagtgtttaacccaatgacccagagcaagtgagtggaagaatcagggctgaaatatctacttctgcatagcattcttttttaccattcagctctggttcagggttagcaggcaagattgctcttactaacggaagggcctaattcctaattagggcctgtctgaatcatttaattgcaagaaccattctatcaaccaaaaatatcacttgacctattattctgttcattctatggtctgaaatttccatctatggcctttctatctgtctatataagcaatccctgatacaatacccatattatatatgtctttatgtatgtactataattttatgccccaccttattccacaaagcattttaggtgacttaaagaaatgtaaaccataaaattgtaaaaccaaagaatacaacttaaaaaaaaaaaagcaagattagaaaaacaggtcaaaactagaggcagggaaaatagagcacaatcagaaaggccatggggcctatacagaagatattcttaggtcatgaacttggccacaaatttcctgaacttataacaaaaataaagacttattctgtggatatgcacgttctgcatataaaatttacttaaactcatctaataaagcaaaatttattccctaaaatgagctcatgtggatcttcatatagggaaatagatgccatggccagtgatatcagtgaagttcctaagaggaaatacatgaacatttttttaagattgttttttctggtttccctagagaaaacattaaaacaaatcctgtgaaagccaactgtacattagacaaaatcatccaaaacaatcttgtccaaatgcatggcttccttatgataaatctttattttgtaataattcatataatttaaacagtaataaatggactgctcattctctaaataaccatccaaaagtaccatttaacaaagtaactcattttattaataagtagataatactgaacccagagcatagtttttggcaagggtctagagtacagacatggtgtttttttatttgagggaagacctatatcctcaaacaagtgtggctgagctccacagacagtgagaagcctaaaaaagctcacctgtcagagaacatcccatatccatgtggagagccttttaatagtgagaacttatggcaggatctagtagtcacatttggctgctattgatcattaatatattgtatattactttttgtgctttatcagttaagacctgggccttcagactcaggatacagaaaaataaatttcagtaaaagagtgagttgaatctcagaaggttttaaggttgagcctttaagtttaggaatgaagagttgggtacctggaaataccaagatggtaagagaaaggaaaatattgaataacaggagagtatcacagaaggggagaggaagcaggacttggtggtataatgggaaggaggaggatttatcagtgcaaataacagtaatgatatttgtttcctgttttactgaatattctaaagcttcttatacaggtatatgcatagaaggttttctgtcaagtgtaaaagtttatgtggggcagccattctttcattttagctccttctcagctgttatgtttcgtttctttgatgctttcttttgtgtttgaaatgacttcttacaagactaactacataatttgtgaggcctagtgcaaaatgaaaatgtaggcctctttttcaaaaattattattaatttcaaactgacagcagactgttaagttgggtatgcgacccttctaaatgcagggtcctgtatgacggctcaggttgcatgcccttgaaaacagtcctggattctttctgttctctggatctaagcagctgttcattaagtgttcctgaattaggtcacgaatacttcttacgtattaagggaaataattttaggcagttttacatcagttattgaccagccctttctatctttcttctcttccccttgatgtctgcccattgattctgacagtaacatgttgtgctaatgatgacaatttcagaaagtaagcatggcagtaaggaggatgacgatctttctctagctctgatacaggctttattattaaatcattgtgtggtcctgggcttaattggacttttatgaatttcaactatcatatctgttaaaggagaacatctgccatactactaaaggacagttgagaggatcaaatatgctttgcacatagcatacgtgcagaaaatattggctaaagagacacaaatctgtatcattgactctttcctgtgaagtctgtgctttctttctcattgggaagtctatttcataaagatgaatatgcatccattaaagggacttcagtcatcagtgagcaaatagaagaaaattggaagaaacagaagagtagtgaaggagctttgaaagctcacacaccaggcctgattacatcaaattccaattggccggccggacgcggtgacttatgcctgtaatcccagcactttgggtggccaaggcaggcagatcacgaggtcaggagatcaagaccatcctggctaacacggtgaaaccccaactctactaaaaatacaaaaaattagccgggcatggtggtgggcccctgtagtccccactacttgggaggctgaggcagaagaatggcgtggacccaggaggcagagcttgcagtgagcccagattgcgccactgcactccagccttggcaacagagcgagactccctctcaaaaaaaaaaaaaaaaaaaagaaattcgaattggccttaggattcagcagtaccaaaaaactcagtttctctctgctgtgcaaccaaaataacatggggccagctctgcagcaggccttgtactggacaccaaaggtagagagacaagtcagacacagtctctactctttagggattcacagtccaaaaatggctcacttaaaaaaggagtcaaaggagaaagtggggttgggataagttgacagtaaattgtagcactgagccttttaatcaggttcatgatacatccagcatctgaagagtgtatacgtatgcgcatgtggttgtgtgcccatgtacaaatgaatacttctctgtgtacttacacttgtacatgtaataaaagagcagatagtgggaaagttattaaaaggaaagcaaagcagtcagatgatgccaatatgataacaacggaaaaataagaagggccgtaagactcattattgactcctttcattcactagtttattcattcaatcaaccagaatttattgggtatatctacatgcaaactactgggtgaagaattatgcacaaatcctaccttcagtattgaactcatttaagtttctttcttgcccactagactataactttctcaaaatcagagaccttatgtatatcaacatagaaaatatctgtggaattgaattgatagtgaagaaatagaaatgatcttctcttgcatatcttagaatgctctgctcaatatctcattcttaaaaatggaaagggccacaactgcaaagatacacgctatttagcttgctccagtgatagccagaacaaaatactaaggaactatgcagagaagccattacacaggcttccagtcaggcagattaatcacagagttccaccagacccaaggtgggactgcttcatgctgatcccacctaccttaacaaggatacactctccaggtggggtgaagctaagagaagctgccaaattggctttggtacattattcttacattggcacggctcacagaattcagttaactggaagttaattttcagtaggcaaactctggtgtgggccaactatgacataagcaaactggattcctttggattataaggtcatctcagatatatgttccatttcctaggggctacaagagctagtggtcaccaagaatcatatttgactctcctactagtttactgtaagccaatccagagccagtagtgtctgagctacagtaatgaaaggtgctcagtacaaagacagcaatcagcttgagaactagattcacatcagtacaggatttactgactggtttctaataactaggcaccatgttgagtgttttatgttatcttcttttaattctcaagataatcttaagtttaaggatgaggaaactgaggctcagggagattaagtagtttgtctgtcttagctggaaagcagaactagaaatgaaacccaggtccatctgttaacaaagtctatattctttcttgtcagtatctttaggcaatgcaacagcaggcaaaagcaatctactagtgccacacattttcaattcattcacatttccagccttaatgcatagtgagatcagatgcaaaacagcaaaatcctgaaaaataagtgtgtgcacaatacttaacttgaataaatgtttatgataatgaaaggattaaggtgcacaaagatattaatatttagggaaattagacaaaattgattttatctattataagcaatattgaatatttaatgatcttctctgtaattatgcctattggagctgctatggaaagcatcacatctctggaggtggtttgaaccatcacccatgtcttactaacaacaaatctctatacccttccttaatgtctctcctgatctccatatttataggtttgactgcagctggattcttttacctgaatgcttcagaagttcttgtgcaaaaatggacaaatttctttccctcacctcaaacctgcttgtccttcaataatacttatgctttcactgcctctgtgaatggcaccatcttctactttagcccctaaacaaacaactaagagtcttcccaaactccttaggtccccttttttcccaatcactaggtccttccttaaattcaaatttctatctttgaaatatgtacatgtcctttaaagttgtcttagtccatttgtgatgctattaacaaaatatcataagctaactggcttataaacaatagcaaattatctctcacagttctggaagccaggaagtccaaggtcaaagtgagggctgactcaacgtctggtgagagccctttccctgcttatagctgtgtcctcacatggagaaagaggcagcctctgttagaagagcactaatcccattcaccaaggctccacccaaattacctaatcacctccccaaaggtcccacctcctattaccatcaccttggtgattagatttcaacacatgaattttgcagagatacaaacattcagaccatagaatattgcttatcaaattttgtaattatatatttcttttgtatttatttaaataatatttgttccctctattagactttcagttttataataagaacaaaatctctttttttcctcgtcatttcatcctctgcaccaacaatggtgttgatacacaataggcattcaatgataacatgtagataggatgaacaaaacgatttcttccttgctatccctggtgccacacatctaatttagactcttaacattttttttcacctggattacaacgaatgtgtcctaactcatccctgattcatcaaaaaagtcatcttccattcttctgcaagaataagatttctcaggtgcatatctgatcactgatcctgtccttttttccccaagtaagagcccattcagtcaaacagcttgcaagttggtatagcctcaccttgtaatgaaaaccactctgtactataaagaagccttatgtctatgtccagttgtcttctgtagcttatttagcatattctaaaatttcttacataacaaaccctcttaggaatcagttgtatgatttatgtagaaataattttaatacaatatcaatattttcctaggtgcaaaactgagttctgatctcatcataagacccctgacttagctgcatgacattaaacaatcactcaatattcatggctgcagtgccctattctctaatcttcagccatacctttattatgctggtgacaggagcttggagttcctgttcaagagtctcctgtcttctgcagtctatgttgttgtagattactccctgtcccttccttacatcctacccttccagcactcaagtacatgagaagccccaaattcaaagatctctatactgtgatatccatagcatcttctcatgtggcatttatcgtcttagattagaacagaggaacatgtatcagtcctgtcttccttaaaagcctgaaaattacataagcataagggaaatatgttattaatctttatgtgtataaaatacctactacagagaaggtagtcagtaaatatttattaaaggtcatactataaatattttgtgaacacttattatttgtcaggcactgttctaggtgcttaggatacatcaatacacaaacgaaagatttctaactttgtgaaacttacatcttagcaggagaagacaggcaataaacaacaaattttcaaagtaaattatacatgttcctttgaatatgataaggctataacaaatgaaaaatagagcagggtaagagggagcaataatggtgaggtggacgtgctttgaaattttcaataggataagtagggtagatgccattgaggataaataagagtaaagtcaaaagaggtgagggaattgctatgtgaatatctaagaaactttccaggcaaagggaatagccagtgcaaaggccataaggcaggattgtgtctggcatgtttgaggaacagcagtggtcagtgaaactggattgctgtgagcaagggggaaagtggtaagagatgaagtgagtagaggtgtgcagtgatgtgacttgtgttttaaaagatcatgccactgtggagaacagactgtgaatacaagggtaaaagcaggggtcagttaggaggtcatgaagtaattgtgaagaaagatggtggtggctcagttcagttcaacaacattcacagggcatctacagtttctggctctctgagagtataaagatggcaaaattgtctcctcctgaaggaactcacagacagcaatatgttcctaacctaatttccagcctcatcacctagcacaggacccaagctcagctcatcttctccattctcagcatgccgtattacagccagccaaaattgctcattattttccaaacacaccatgctgtctcatgcctttgcaatacccttcccgttgccagggatccatttccccagcttgctaaactcacaaattgcaactccttcttcaagactcaactcaaaggccaatttctcagataagttttccctaacaacctgtgaaaaattggctgtgcaccttcctctttctttccctggcatcctgtgcataccatgaatcaaggtgtattataaatagattccttttagactgtaagccacagatatatgatttattcaatgtctacatctaacaaaagtatttgcctttggtagcactttactaaacacagaaaagacgtaagaaaggaagaacattttttaaaaagagtaaggaaggaaagaactaatacaagtcatttatgaaaggttgccaacatagtctagaaaaactacctgcacgtggtcctgtttaaagaaacaactgggagcaagcagggtaagaaccacgcaggttctcggcatatttatcagcaaatgttcagctccagaaatagcctgaaattagggtaggatgacatggtcagtgggaatcagtcatctgtaaaattcttctgatcagaaaaaaacatttgtattccttgattgaattcaaaaaaagacttgtcagtatctgggtcctgacctttgaagattgcctgaggtgtaatgggaacacaaatatgctgagcaggacaaatgagtaaccagatctgctttgggaagtgacttggcactggctggggctggctgtcatagcactaggccaacaccagggctgggaagaggctaagacgccctggaaaactaaccatgcctggtgtgaaggataaggtctaaactaaaggcaggtgtgtagggaaagcagctgtcatgctgcaatgggtgactcaccccaccttatctaacttaatctactcaattacaccaaaagctagatataataatcttttatagacacaaaaattgaggcatagagatattaagcaacttgtcaagagccatactgataccaggtagagcctgtcttcacacctgggtctgtcttcatatctatttcagtccaggactgaagctacccatgtagctgctcagcttaggagtacggctttggcctgagaggagactcaagtcccagacatggttctgtccaccttgcttatgtgcctccaggcagatcatttctcctctctgagccttgtttttaccatttgttcattgagagttagggtcaggtgatcattaaggtctctccaaaatctgaaaatctatatttagtaagaattttaaggatgctagtttcttctctccttccccttctcccttaccatacacccaaatgccctctcaagaagcagtgtataaagaatctttttatactatccagtttggaaagagaagtttaacaaagggtagagcctccagagacattatcactgttgattcactgagaactacatatatcctccccacatttagtgtctcatccgctttgtttttgtcaggaaaactcaccctctgcctagcaaaagagagctggctttatcttcctcaattcactctttttaaatctatcttggggtttcagttgcactaaagaactctatccagcacataattggaggaaatataatggaaatattgaaacaaaaataatattctccctaatatattcattttaattgttccttttcttctcactagagtgagtgggaggttatcccttctatttcagttacctcttctttcaatgactgggttttataatgtgctattttgtgagcttatgttttttcctccccacctccaactccctaatattaaagcacatctggattccagttaaatcattttattctttctgatatacttgatcataagccaaagagcaaaaagtattctgtttatgatccaaatacccttattaatttcttctatcaaattaaatatttctagaatgggtaaaaaaaacaggtctggtaataaaagcagacattcatagattggccttaggttctggagactatgtagggttttatgaaaaattagtaaattgaacagtaattcttatagctacaatatttaaggagggtcatatagccttaattcttaaacagtaagatttggaagaaggatattattggttccattttatatctaaggaaacaaagcctcaggaaagttacacaaattgctcagtcggtcaacaagtaagtggtagaacttggcttcagaagttggtttcataaagagggatcaggaagaaaaggtgaattgctagggaaggagtttgtcttcttcaaaattctctataataattaagcgcaatacttaggagactcgtggcagtcgaaactccaagactggatcctatcccagaccactttgctagagatactgtttttcttcaatcttggagaccctgggggaccaccagcacaactgcctagttagcagcagatcatagggtggaatgcaggctgctaccaagcaagatctgtctcagcaagactctttctttgggagatgcagaaagtgcagtatttaagtggtgtcaccagcctgaatctgatgcaaaagaggcatatatgcaggtgcacatacacattactcactcatacacatacacataaacccatacataccacattcacctcacacacacatataccatacacagaacaaaatacagacagtctctaacttatgatggttttacttaggagtatttgattttgtgatgatgtgaaaatgatacaaatttagtagaaactgtatttcaagtacccatacagtcattctgtttttcattttcattatactattcaataagttatataaggtattcaacactttattataaaatcagctttgtgttacatgactttgcacaactataggcttttgttaagtgttctgagcacattactgtaggaaagactaagctatgatgtaggttaggtgtattaaatgcagttttgacttccaatgttttcaacttatgatgggtttatcagattgtaaccccatcataaattctgggaggttgggtaagtgggagtagctactaatgcatacaggtttccactggggggagtgatgaaaatgttctaaaattaattgcagtgatggttgcacaactctgggtatattaaaaaccattaaatgtacacttcagataagtgaactatatagtatattaattatatcttgataaagcctttatgaaactaaaagacagaaacttgatcagacccacatctggttggcacatatggagagattgcaagattataaaccctaaattcaagggtctttctaatattaataatctgagtaactttggactcaagaagaatatgatctgcataaaaggactacagaaagttggctgggcgcggtggctcaagcctgtaatcccagcactttgggaggctgaggtgggcggatcttgacgtcaggagatcgagaccatcctggctaacacgttgaaaccctgtctctactaaaaatacaaaaaaattagctgggcatggtggcggatgcctgtagtcccagctacttgggaggctgaggcaggagaatggcatgaacccaggaggcagagcttacagtgagccgagatggtgccactgcactccagcctgggtgacagagcgagactctgtctcaaaattaaaaaaaaaaaaaggactacaggaagtcagagtgtactgctgactttatggtttttttgttttgttaatcataaataaatttaaaattatgaaagcaatgatatttagttttaaatattttgcagaacacacaaaagaacacacaaaaagaacacacaaaaaagagaaaaagcactcaagccactaaaaatatttgtttatatcattaaatgtatatatgatatttagctttgttttaaaatattcttttgtttaaaagattttaattacttcatcttaggatgctccaaatatatttaaccaatcactactgatgggtacttggataatttataatttttcccaattacaatgtacactgccatgaacatccttaaaaacaaatctttgagcatatctctgattatttctttcatcatcacaaatctgaacccccaaatctagttgaggtaaatatctgatcatactttgacttcataaatcacagggaaaaacatggcctttggaaatccctggtttctgttcctggtccaaccacttaattaccctaaaaggtaaacatatggccccaaataaatccaatctgatttaattatcatgcttaaaagttaactactaattgaaagacaattcaaggtgttgatttataaccaaaaagatcagtagaggcccaaaagaaatagactaaatagagtgaatattaataacaacaactgaggctcagagggccaaggaaagtgcccaagactggcagaactgggatacttgcaataactggcagaactggtactcagattgaggctctatgactccaaagtcagtactttccctattggacttcactgcttcacataacagacactgtcctcaaggaatttgcaattggaatttttgatggcaggtaacatatgtgcacaaataactgtaatttaggcagagtaagctaagtgccataaaaatggttcagacatagtattttctgggtagaattaggaaattctttatagggacaataatatgtgatgtgtgctattaaggatgaattcattcaatcatttaataaatatttgagtaaatatttgaagtaaagcagactctaccagttaactaccaaaatccatgttctccacttcttcctgcacacacagctaaatgtcatttcacaaattccttttgttggatgtggccattaaactacaggttagccaatgaaatttgactgaaagtgatatacgccactttcagtactactaatagaaagctcccatgtgggctgtttctacattttcccatctggctggctagaatagagatgatgcccaggtgaccgtggaaactatgaattgaagatgatagtcagtctgggttcctgaatgatggtatgtttgaaagttgccctgtccatctgttcatgtggaagaaatcaacttgtatttgcttgatccattagatatcttatggtcaatccaatattacagttggcctacccaaacataggcaggcactgggacacgaaaaataaatttgtcatatgcccccaaggaacttaacatttgaagggaaggaagtaaatccataggaaaatctgacacagcattgcactgacaggaggaaggtctgtatatgggcacctaatcccatcttgatagttcaaatgatgaaactttctaaaaagaaatggtatataagttgaggcctgaagtatatatagaaatcctctagggaaaaaggagaagtgaacttgagaacatatttcaggcatagggagaatatgtgcagtttgaggtatataaaagagcattggtgtacaggatgtctacaggtagagaaagcagggagattaatgataaaactgattatagagtatcagtggactatgccaatttgttttttgtggcctttgtgttttatttttccagggtcttttccctgttttgtctccacagttgcctccctaagtcttcatttctccctgctcactcaggagttgggtaaccaatttgtcttgattttctccagggacattcccaatttaaaactaaagcctttacttctacatctcaggaaagcccagagttccaggcaaactagaaaggttgatcaccctatgcatcaggagtaggtaatggaaacagcatagctaagggtcatataaatttgggacggagttctggctctgcccctgactagctgtaagaccgttttctgagccctggtttcttcacctgtaaaatggtcataacaatctctgatttttctgtctcttagagcaactatgagaatatcatgatccaaaatcattttgtgacaataaactattatgtaggctgtttcatattatggaaaaacattagaaagcctgggttcaaaactcattcttgtatagtagttggaatatttagacaaatacttctctgtcccttagtctctttgtgtgcaaaataaaggcactggggtggctaatcagtaaggctcaggtccttccttccaggatgtcagtgataacagcaccacgccccacaaatactaggttttctcactcatgttctggcctgtctgctatgagagagagaatttaagcagcacaatagcacaatctctgtattatttaagattaactaatggtagctattattcctgttgcccaagggcaggagctaagatttgaatttgggtttgaccatttgatggcaaagtcagtgctttttccctgcatcaagttgtcacatttcatccccttttcttggagtaaaggcaaacagaagcagtgtgaatgcattcaggaaagtgattggcctgcaaatcagtcccatgagggcccaaggctctgttgtgtacttacttgagtaagccatatatcttctagattctatttccccagatgaaagactatgaataataatctctattttatatacaaggtggaaggaagtagtatatctctttaaataaattggttcctatcacttataaggggagcagaaaaaagcacatccattctagtggaaatagaagaggatggcctacatcttccctgggtttctttcttaccctgtacaagaactctccagagagcacagtatgaaaatcatctagagtggacaacctcactgtgctctgtgtgaaaatggtggctcagagaggttaagttaccttactcctggctcattccatgagttagtagaagacccagagataaaatataaactcaagtctatattatctccaccaccctaccctatttctagttgaacatgtttctttttctcaggtcaaattattcattttgaaggatttatttatttatttatttatttatttatttattgatgattgattgattgagatggagtctcactctgtcacccaggctggagtgcagtggcacgatcttggcttactgcaacctcctcctcccaggaacaagtgattcttctgcctcagcttcctgaatagctgggattataggtgcccaccaccatgcctggctaatttttttttgtattagaagcagggtttcaccatgttggccaggctggtcacaaactcctgacctcaactgatccaccctccttggtctcccaaagtgctgggattataggtgtgagccaccacacccagctcattcttaaggatttctagagttcttcattttgtaacatctatggctataaagggctcctctccatgtgtcttctcacccctcattcaatctctgggaagtctcagatccttctgggatttttgacattctataaaatatttgtatggtttggggacatttttgtggagagatggtagttaggtgaagtaatgtgggttttattttgttgctttttgtttggagataattcaaaattctcaggaatttggaaaaatggttcagcaaggtcttgtgagctcttcaccatggttcccccaaagtttccccaaagactgcatcttttattagtatagtacaatatcaaaccaggaaatttacattgttacaatatgtgtgtatagttctatgtcatcttgtcacctgtaaccaccaccacaatcaagatacataattatcccattaccaaaaaatctaccatatgctacccctttatagtcagtgatatggtttggttgtgtccccactcaaatctcctcttgaattataattcccacaattcccgcatgtcatgggagaaacctcggtggggaggtaattgaatcatggggtgagactttcctgcactgttatcctgatagggaatcatgagatctgatgatggttttaaaaaatgggagtttttcgcacctgtaatcccagcactttgggaggccaaggtgggcggatcatgaggttaggagatcgagaccatcctggctaacacggtgaaaccccatctctactaaaaatacaaaaaaaaaaaaaattagctggacatggtggcaggcgcctgtagtcccagctacttgggaggctgaggcaggagaatggagtgaacctgggaggtggagcttgcagtgagccaagattgtgccactgcactccagcctgggccacagagggagactacgtctaaaaaaaactaaaaaaaaaaaccccccaaaaaatgggagtttccctgcacaagctctctctgcctgccaccatccatgtaagatatgacttgctcttctttgtcttccaccatgattgtgaggcctccccagccacatagaattgtaagtccactaaacctcttcttcttcccagtcttaggtatgtctttatcagcagcataaaaacagactaatagagtcactcatcctttttttcctcaatattacattatatatatatatatatatatatatatatatatatatatatatatatatatatatatatataaaacctatcacagtctactggtgttgacatttaccaatttgagtgaggtgtagaaactctaccttattttaagtccctttacctttccacgtgtaattctgttaaatatttcttctacatatactgagaaccatgtcaatgttataatttttgcttcaatataaggcatatttagaaaacacagaaaaaaaggtctacagtatttacctatatttttattctttttgttgttgtttcttcctgatatactaagagtccttttaaaattttctttctgtttgaagaacttcctttaccattcttttagaataagtctgctggcaaaaatacctttagttttattttatctagaatgtcttgatctctccttcattcttaatggatatttttgctggataaaagggtccgggttgatgttcttttagcatttgaaaaacatcgtgccactttactcaggcttcaatagtttctgttgtgaagtctgctgtattccattttattcctattgataaggtatcatttttctcttattgttttcaagattctttctttgtctttaattttcacacatttaattatgacatttctcggcatggattttctgtttgaggttcacctggtttctcaaatttgtaggtttatgtgttttgcaaaatttgggatgatttcatccattttaaacatttatttttagtctcactctctcctatcgttctgaaactccaatggcatgaatgctataatcttttgttagcatcccataggtccctgaggctctgttcatttttcttttaagactgttcttttcattttcattcatagtgggtaacttctattgttccatattcaagttcacttattctcttctctgtcttctgtactcagctattgagcccattcttaagtgggtggtggaaggtcacattccccatgtgatctgacaccacgaagaggaaggagggaattcattaccacccagcagaacgaaagtcctgtttcttatttttttctgacaccacctattggggagtggggtggtggcaaagacaaaagtctatgcttcctactagccctttgttggtgaaagtagaaatgtggatgcagtttatttattttccccattgtgtttggctggagtaggtgatcattgtctcacaataatctctcatgctagactgccctttttctggtccttcatttagtatgaaaatattttggggagcaccttttatttgtctgtacctgtggcatttccaggttgccagcttctccaataactattttggcatacatgtggcaaaaaggaaacccacagaactcacacaataccatttcttaggtcctaaggaacctaagtagtcttccctcttttctccacctttcagagttttctatgtttgtttcataaatgctgtgtatagttttagctgcgctctagaaatagagggaagtatgtctactccatcatgtcccggaaccagactgtaatattttaccttttctttttaatgcagaaatatttgtttttgaaaacttgattttagggcattacattaatgtcaatactcttaagatacaaaattgaaataaaaaaaaacatagatcattttatggctcctaaagtaaccattttttaaatgccaatttttaatgctgtccaaatttgcaataaaactgatgcagtgatagaccaatagcaatattttaaattggtacaacatttttggagaacatgtataacaggagtttatagacattaatcttagagtctatctcttagaagctgcttgtaaaaaattatttaacaaacctaaaacctatgtgatatttattatctattatactttagaaaaatatggaaaatctaaatgcccagcaataggaatatgatacaggaaatcatgatacattaaaaaagtagaaatcattattattcaaacatggtgtgattaacacttagagaaaaatattaaaattgtttttgatacaatgtcaaatgaaaagatcaacatacaaatgagtacatacatttagctgtttccgtgttaaaatgtgtgtaagaaaaaaactaaaaaggaaaatgtaaaattaaaaataatcattaggtttagtggaagatactgaattaatttataaatagacatttattgaatacctgttatgtaccaggcatagttctagagctagaaatatagaagtgtatagaaatgacaaaaatccttacccctatggtgcttagtttgcagcagagggggagacagataataaataaataatatattgtagtttgctggatggtaataagtgcaatgtaaaaaataagacagaaaaagagagtaagtatgtgtggaacagaggatgtaatttaattttaaatgtatgactttttttagctatgagaaaaaattaagtatgactttgttttacaaaatattaatttataaatttataatttctcaagtaaaatataaatttttgtttttaataatagagtaaaggccccattatttcagaaaagacaccactaatttcaaaattttaaaattttgacaggagcgaggctaaacattactacattaagacttacagaaagtatgaatctattgctaggtgtacatacctctatcactgcatttcattcaaagaatgttaaaattatgtttacttgctgtctatcccataaacctatatctttttcatttaattttgtagctaaatgtttgagagagctgtccatatttattgtctccatttcttcatacattctccatcctccaactcactccttcatccacatgacctggcttgaactcctaccacccaccaggtcactaaaagtgcactcacgaaagcctctcaagacctccatgtcactacatgctttaattatctttgacctaggtagcagttggcagtattagtccctccaccctgttaaaaaagacttcgctctttggtttcatgacactgcattttcttttttttttttttttttcctatctctgtggctagtccctctcatcctcctttgtgggcctcttatcctctacctggcctttaaatgtagggatttctcagagccttatcctaatctctcttctcatggcctccctgagaaatcacatcttctcctaccattctggttatcacctgtagactgatgacaccttaatccgtacttccatattcctctcttgagtctcttaccaatataccacactacctacctgacatctctgcttggatgctttccagacacttctagcttaatgtttcccaggctaaactcatcatctcccttatccagccaaatcttcctaaactgtttctcctcctatggtccctatcttcagtaaatgacatcatcccttctgttgttcatgccagaaaatctgggaatcatccaggactcctccttctcttttactctccacatctagtcaaccacaaagctaaattgattcaatcttccattatccctgaaaaccatccacttgttttatcactactgttaccaacccaatccatcattagctgtagcctaaggcatattgcaaaaacatccaaataattttcatcctctccaaaatattccccattcagcagcaagactgatctttctaaactgccaatctgatcatgtcctgcccccatttaatcattttaatttatttccattgtcattagaatcaagtcctactctttagcttggtttataaggctcacctcaataatctctccaatcactttctcctcagaatttaatgcttcaattatgttggccttttctcatcaaagatgaaatgttctctctcatttttttggccttcaagcacattctgtttcagctcttagtacaaacaatacttcctaaggaaggtctcttatccttggtgtatatgaagtcttaaattctatgtagtatttaaattataactgttattacaaagttctcattataacagttatcatactttactagagctacatatttaatgtttagcatagtagactataagctatgagactatgaaacatatctctcttgtcactgttatgttttaatgccttgcatagttcctggttcattttaactactcagtaagcatttattgataagcagaaggagggaagaaagagaggagggagaaaaagaagaaataatactcaatcagtcttgggtgaattacaagaaaggagaaaaacaggacatttgtttaataacacacttcagactttaaaaagtatttacacattcagttcacatttgtttcttataacaacgctgggaggaagtattattatgtactttttacagtgagaaaacaggataatgaaagaggtagcatggctcatcatgttatttcttccacccggaatcccatttccttaattttatccactttccattccttgagatatagctgaaatatcacctggtccttagcatgtctccttttcccctcgtggccttaatagtataattttcttcctcttctctaatcccactgcatgctttatgtgctactgattcttagcacaatgttctctacattgtacctgtttatttttgtgtttcattccaacctctaaaaaagtaaaatctttaaagaaataatcctaatcaactgatattaatcaccccaagatctagcacagagtagatgatcaataaaaatatgttaaatggaagccatctctaacagctagtccaatcttttcaatctgctataatgaaaaagccaatccaataagttatttcagattatccaaaggccacacaatagcatgctactccttgcttctttttgtctccttcttccaacatccccatgcatggaatgtgagaggaacagtaaacttggaatcatgtgatttctggctggtgctaccacttactagtaatgtaaatactcctagcttcagtttctgcagaggtgaagatacagttcttagttgtcttgcaatgccagttcctagcagtgcctagcacacagtaatgaacacggttaagaaatattaatgagttatgagacttggatactgttaagaaatattaatgagttatgagcatcagaaacctgatgctacagagccctaaccacaatccttaagaagtctaatatgtaattatttaatccttaggaagtctaatatgtaaataaaattggagtgaactaaaacaggcagaaaacttctgaatcttccagcttctccatttgctgctagatgtctcctcaaggcagaacagccttgaatggccacatatttacataatggttttccagttgtatcttgtgttaatttgctttctataactaattaactaccggtctatgctaagacttgaaggccttggtacctgttacagccccctatgagaggtgaagaagaatgtttgtttcatcttgaaaaggtgaaaaaagggtgttttcccaatttttatacatatatatatatacacacacatacatatatatatatacacacacatacatacatatatgtattttaaattatatatataatatccaggaaatttcagatttttagtgtttatcctaaagtaagaatttttccatgacttatttggaatatcgaaggaggtaataccctagacaagtaaagtattacaaactttttttgttatagtgcttgccttggtattgggaaagctagaattagaaagacactggagaagatactataaatttgagatctacgaggtatttttcaggtttgagttaggtcattgccaagattcctaaattgggatagactccttggagccaataaaatctaatattctgagagcccatagccaattccttatcaaaccctgggaacatttaggataatggctgctgggagataggcttgggtgtaggtaactgactcaaagcataaaaggaagtcctagacatagagcaccaaggtggaagaaaagatgttcaaaattcaacagtagcaaggagaataacaattatgatttgtagagattagttaataaaaattctaaatataaagttcccttttggaacagatcttttatagcatattcatcctgtatcccaatatctacaacagtgcatagcacatgaaggtgctcaataaagtcctatgaagtaaaaaaaaaaatctaaacatctggcttgaggaaaggaaactctgaagcaatgtaagtagctttgtatccaagttctggggatggtaaggtaaaaaataggagatattacgtatacagtgtgatgtgctatggtaccttatgcctaagtggcttaataaactacaacaaactcaattctgaaactttaggctctttcagaccattagaggagtccaatgactggataacggctgctgctgattgcctgccaacattgcataagagcaccaacttaattctaaagcatcataatccaaaagcaaggacccaataaaatttcaaaatcttatcaagagccctagcagagaagacacaacatagttcatgagaaaaaagaagcaaagtgaaataattaaggcttatgcatcttcaaaagcacaaaaaaggattctagaacttaacatttgggaaaaatggatggtgattattattgctgtacaagatcccaacacagaatatggaaaaatatatacaatgtcatttcgaaggccctcatgagcaaatcaacagtgatgtcctgttacttgcaaggtttatagtactaatctatatatatgcctattaacagagaaatgatttctattattatctacttgggctggaaccagagactcaaagcaaaggcctaccccttgcccagaaagactgagagaaggagcagcagattagttgatttgatacaggaaagcaaaaaatcatgcccaaggagatattttcacctttcataaacagtgtttattattgtcatcaaatgcctacacttttataaacctgagcttctcagcccaacattaatagaaaattgccaagtatcatttggagataaaagcgcaattcagtatttatgaattgctagtttgctataaatatagacatttggagactatcttctcactagtcattaatatttgaacagagatcaaagctataacaatattaacaattcgttgcatttgtatagggttttatataatactattaataatagatgccatttattgagcacttagtaagtgccaggcaaaactttacatgtaaattctcataacaaattcagttcatcttaacaggcattcacttaacacctactgtgtgatagatgaataggttaataatactaggtttttgtctttgaagtctttcattttgttgtactcaatcaatacttgctgaatgaataaatgaatgaatgaattggctgaaaaggtattacagggtaacataaataacacagggcactcccttactctttatggtcttaacaaagtacttaacttatcctagcctcaattttttcatctgtaatatagggatacttaaaatttcctttgcaaaaatgtggaaatagtaacaacaaatataaagcatctgacccaaatggatttttaataagtgaggtagttattattactagtattattaatattattattaccatcattattacaattattaaccaatcctatccaactcccctcctcctcactatagcaatggtacaaatagaactttaaaatacacacacacacacacacacacacacacacacacacacaaaacacaaaaaccatgcaaagcaagagaaagctactgaactgtagtccctaatgtcctcctaagttactaaacataatctatgcttaggctaggaaaaaaaaaaagaaccaactttatttatgtttccaaagataccataataaaagccaaacaggacaggaagcttaccaaataacagactgccttttctcataattgaatgctggtcatcccaagcacaggaccatgtttccaacattctcaagaacagtacccaaagaatggccatacagaaactcatcctcattcttctcagtgacagtaagtctgatccccagctgtacagcagataaactagagttctgggtaaaattttcttttaaaaatttttatttttaattttttttgggggtccattagtaggtgtgtatatgtatggggtctgggacaaattttctaaccaggaaggggtcccattctgtagatcacttaccattttggtctgctggtagatttcaccataggggccatcccatctctatagagactcttggttttactgaagttaacaatgttgaaaatgaccctctgaaaaagaaagagggagaagttcatctttatgctatgcaaattgtaacttcctgataattaagacaggaaataagaaacagggttaaagaaagccatatggactagcaggcaactgtatagtgagagtacacagtgctcatgagaatgtaatgtgtttgtgccagctaagcatagcaattaagcattagctctggaacctggaaacttgaattttagaaccaactctactgcttttcaattgtgtggccttgccaagctactaaagatctgtttcagtgtcctgatctgaaaaatgtgaataataacagtacctacttcacaggactctgatgataattaaattaatatatgtacagtatttggtaccatacttggtacacaatgaatgtcacataagttttagttattaagtgtatcctttctcttggctgacctagaatttacatagaagtaaatcatattatcatcagggtaagagtagtacatttaaagttcaaaaacactaaaaatattaactaagaacaaaattgctattaaaacattctacaactacttgaaacccctttgactagaactgaaggatatacatcctctttcgtaccctctttgttattttctactaggggtcggggtactaggctcaactataatctcagcatacgtttatagcgccataagtacttgggtaaatctctccccatctctgggtcttatctttaaaatgagtgattatgacattctagatgcctttccaagaggatagtataattttaaaagctcagatctttgtttcagcaaacaactttgttataagaggggagggaagattgtgaaagagaagagaaatatgataaaaagacacttcaaaccactgaaatagtccaaaggagagatgatgagagctacgggtagagcagccagaatagctggagagaagaaaagatttcaagaggttaccacaggctagcctttctttccagggacagtgaaaaaaacaaaaccatcaaaattcatgtattattttattcaacaagtatttactgcgtgaggtattatatagtatcaagtgacagtaattgtatatacttttttaaacattggaaatattcttctataaccataaaaataaatattaacaccctcatttaataaatgtagacactatggctcagagaggttacctaacttgattgaagtcatactagtagatgacagaattgatacttgaattcaggggataaacagataagatgtccatgatttttactcttgagttaatcactaagattccaaaattccataaccctaaacaagtctattttccaagggcaaaaaataaatttaatggtaattattcaagtctttaaaattttgttttgttaaaaagagaaaatcaaaagtatatcctctggcctcatgtttaggactataataaaatgctttgttccatgaaataagcttttagggataacttgtgttttcctttctcctcagagaccagccatttaccgcatctctaggccttttggtttcagacctctcttctgtcattaaattaagtcatcaagaatgtccaaggctgttccattattaataacctagacttgccttttgtcaattcaattacttctctcagggtcttggctagtatctgatttaagaaaatcaatattgaggggacaaatggcctttgaacctcagagggcataagcccccccttttttttctgagattccagttgtcagatccatttccagtgaacctggaagccatactgcactttcaggttctagattattgataaatacagagagaaagctaataaagcaatgatgtaaatatgtgaagctggaataaagaaatgagaaataaagtgaaacatgcactgatcattaacatcctactgtgtgcctaggaaatttcccaggtattttaaatatgctacattatttgtttactccatttataaacaaaagttgtttattttagcccgattttagatgtgaggaaattgacacttaaacaaagtggcttgccctccaaaaatccccaaactattggtagagctaggacttaaatcttaggtgttttggccataaagatcataccttctctataatattacatggaaacagtaacatcatttcttaccattccctgttcaagtattttttatgttttccagccatttagcaacatcgcttgtggtggagagattcaaaattataagaaagcagacagcgcaggaaaccctgaatttccatattttgtacttaatcattagtttttactcaaaatgaataagaagatgtggcatccataagataatggtaaccacgaaaataataataatttctgagcacacactatgtaccatattctgaattaaacacttcattcacattagaacaatgttttatatattagaataacctaattgtaaattagaatcactagtatagcttttaaaatgacagatgcttgggccccaccccagatattctgatattgatgcattatctcatttgttttgaggataatgaattttttgagacaggaactatttgtcacctcttgtttacagatgagggactggtaatgtgattaagtaaactaaaatcatataactaataagtagcagagctagtatttaaaccaagtctgttgcctcagaggaataagattatagactttttagccagttacccttgagattgaatcccagttccctacacgttctgcgagtttaggaaaggtaattattcttttttttttggacattgtttacatccaaaattgagatggtgacagtatcctaccacagttgttgtaagaatctgtaagattatataagtaaatcacctggcatattgtatctagatctaaacaggtgttcaatatttattgagcgtttcctcttctcatcaataaagccagatcttttggtacattacaatgtctttccttctttctttttattttttctttagatttaaatttttaacctgagcttcttgtttcagtaatacggtgctctatatcagagctctgtaaatagtgaccacagtacactgttagtctaagagtaggtataaccttcaaggcagtcatatgtgaggaatggagtactgcccatcctgaccaaggggctcatggtgctactgaaaatgtgaaagctccattccaggtataggccaaagagtggtccaatgtgggtaaaggtatcgtgaacagcctgcgtgcagtcctaaagagtggccttgattctgtcttgtcatatatgcaatacttttgtccaatcataagtacatttcccatttaatattgttcacgttagttgcagggactattctaatgggattataacaagctaaaaaagcttatgcacagcaatgaaaaccactaacaaaatgaagagacaacctccagaatgggagaaaatatttgtagactatccatcctacaagggattaataaacagaatatataaggaactcaaacaactcaatagcaaacaaaaaaaattaaaaaatgggaaaaagacctgaatagacatttatcaaaaagaagacatataaatggacaataggtatatgaaaacattatcaacatcattaatcatcaaaaaatgcaaatcaaaaccacaatgaggtatcatctcactgcaattagaatggctattatcaaaaagacaaaaaataaaatatgttggtgaggatgtagaaaaaaaggtacactcatatattgttggtgagaatggaaagtagtacaggcattatggaatactgtatacaagttcctcaaaatactaaaaagagaactgccatgtgatctagcaatctcatcactgggcatttatccaaaggaaaggaaatcagtacatcaaagaggtatctgcactcccatgcttactgcagcattattcacaatagtcaggatatggaatcaacctaagtgtggatcaatggatgaatggataaaaaatggaatattattcaaaaatacatacacaatgaaatgttattcaaaaaacaaattaaatcctgtcatttgcagcaatggaatgaaactggtggtcacaacattaagtgaaacaatccaggcatagaaagataaatattgcatgttttcactcagatgtgggagctaaaaaagtagatttcatagaggtagagaatagaatgctgattaccagaggccagtaaggaagttggaggattaagagaagttaattaatgggtacaaaaatacagatggatagaaggaataaattttagtatttgatagtacagtaggaaaattatagttaatgacaatttattatatatttcaaaataggtagaacagaattataatgttcccaacacagagaaaagagaaatgtttgagggagagggcaaaatggctgactagactcaaataagtggaatggctcccatggagggactaagatgactggcaggctttaaacagatctttagaggcaaggaactgagagtggatggaggaaagacacacaaactgggctgaagggagaaagagctgggaaccctgaactacacacaggaactaattttttttttttttttttttttgagacagaatctcattctgtcgccaggctggagagcagtggcttgatctcagctcattgcaacctccacctcctgggttcaagcgattctcctgcctcagcctcctgagtagctgggactacaggtgtgtgccactatgcttggctaatttttgtacttttagtagagacagggtttcaccatgttggccaggatggtctcgaactcttgacctcatgtccgcctgccttggcctcccaaagggctgggattacaggcgtgagccactgtggctagcacagaactcattcttgaaccacaacagctctgggggaatggagtcacccactctcactaccagcctctggaactctggcaggaggagaacccttgaccaccatggacaattgaggtggcagggagagctgctttgagaagtggtagaagtagcaagccagctgatgtggagctcacagggtttggtgcaggggcatctgtagtggagcaccgccagggaccaccatccccctaggcttgacttggtcccataagatactttatcactaagggacctgatctttgcaggacagtcttccatatcagatggggctggtccaatatgaacaccctattgtctgctggccattcctgggtccccagcctggccacatctgcttacaggacagtcttgggttccctggggccccaaaccatatcttctgtgtgagcagaccatgcctgactggtgaagagctccagtgaggcagtttcaatggccatgcaccagctgcccacaccttccccatactgcagcttcccctcggcccaaggcaactccccacatcactttgctggtgtgtgtctgcatgggtggattttgttttacttgcccttccacacataaagtgcagtctgctccctctcccttgctcatagccattgcaaatggaggcttggtgggcacagagccagcaagccccacccctgccagtgccccacccttgcagtaacactgctcagagcacagtggatcctctcacaccattagcaattactcttgcttgaggggcacagagaaggcacccagacctgtgccagccagaaccgcatccctgagccaacaccacctccaatgcaaccatgcacagtctccagcaggggccctgcctcttcacaaacttcattgccttgtcactgtagtgaatgcctgcagggaagcaggcacccctgcatctgccagcactctgctgcagatgctgtacctcagttcccccagcacagtgaactgcaaaccttgagcagctagaaaacaaagttggggcccaatacaagtcccccagagttagagcacacagtccaggagttgggagctgagtggtggctctctaaaatctaccagaaacgaagccagttggctaaatccaccttataccacaaaccctcaaggtcatcaaacaggataaaaaaaatccaaaggtcaacaacctcaaagactgcaggacacaaagatgagaaagaatcagtgcaataacgctgaaaactcaaaaagccagtgtgtcttctttcctccaaatgaccacatcacctttccagcaagcattcaaaactggactgagatggctgaaatgacagaaatagcattcagaatatggataggaatgaagatcattgagctaaaggagtacattgaaacccaacaaaaggaaaataaaaatcacagtaaagtaactcaggagctgacagacaaaataaccagtatagaaaacaacataactgacctgatagagcagaaaaacacactacaagaatttcataatgcaattgcaagtattaatagcagaacagaccaagcagaggaaggattctcagagcctgaagactggctttctgaaataagacaggcggacaagaatagagaaaaaagaatgaaaaggaataaacaaaacctccaagagacatgggattacgtaaagacatcaaatctacaactgactggttgtccctgaaaaagatagggagaatggaaccaacttggataaattattttaggatatcatcaattagaacttccacaacttatctagagagaccaacattcaaattcaggaaatgtagagaactccagtaagatacttcacaagaagatcatcccaagacatgtagtcatcagatcctccaaggttaaaatgaaagaaaaatgttaaaggcagctagagagaaaggtcaggtaacctacaaatggaagcccataagactaacagcagacctctcagctgaaatcctacaagacaaaagacatttagggccaatattcaacattattaaataaaagaaatttcaacccagagtttcatatctgaccaaagtaagcttataagtgaaaaagaaataagatccttttcagacaaacaaatgctgaggaaatttggtactaccagacctgccttatgagagctcctgaaggaagcactaaatatggaaagaaaaaactatgactagccatgacaaaaacacactgaaatacacaggccagtgacactaccaagcaaccacataaacaagtccacaaaataaccagctaacatcatatggcaggatcaaatccacacatatcaatactaactttaaatgtaaatgagctaaaagccccaattaaaagactcagagtggaagctggataaagaaccaaaacccagtggtatgctgtcttcaagagaaccatctcacaagcaataacacacataggctcaaaataaagaaatggacaaaaatctaccaagcaaacaaaaaacagaaaaaagcaaaggttgcaatcctagtttctgaaaaaacagactttaaaccaacaaagcccaaaatgacaaagaagggcattacatatggtaaaaggtttgattcaacaagaagatctaactatcctaaatatatatgcacccaacacagggtgttatgtcccctatgcacataagctagaaaatctagaggaaatggataaattcctggacacatataccctcccaaggccaaaccaggaggaaattaaatccctgaatagacaaataacgagttctaaaattgaggcagtaatacatagcctaccaaccaaaaaaagctggggaccagatggattcacagctgaattctagcagatgtacaaagaagtgttaccattcctactgaaactattccaaaaaattgaggaggaaagaatcctccctaactcattctatgaggctggcatcatccctataccaaaacctggcagagacaaaaaaaaaaaaaatcaaggcaatatccttgatgaacactgacgcaaaaatcctcaacaaaatactggcagagagaatccaggagcacatcaaaaagcttatccaccacaatcaagtaggccttatccctaagatgcaaggttggttcaacatacacaaaccaataaatgtgattcatcacataaactgaattaatataaaaaccacatgattatttcaaaagatgcagaaaaggcttttgataaaattaaacattacttcatgttaaaaactctcaataaactaagttttgaaggaacatacctcaaaataataagaaccatctaggacaaacccacagccaacataaatattgaatgggcaaaagctggaagcatttcccttgaaaatcggcagaagacaaggatgccctctctcaccaatcctattcaacatagtattgtaaaacctggccagggcaatcaggcaagagaaagaaataaagggcatccaaatagaaggagaaagagtccatctatccgtgtttctagatggcacgatcctctcatctcagccccatcatctcagcccaaaagttgcttaagctaataaacaactccagtaaagtcttaggatacaaaatcaaagtgtaaaaatcactagcatttctataccacaaaacagtcaatccataagccaaatcaggaatgtaatcccatttacaattgcaacaaaaagaataaaatacctaggaatacagctaacaagggaggtgaaagatccctacaaggagaactacaaaacactgctcaaagaaatataaaatgacatgaacaaattgaaaaacattccatgttcatggataggaagaatcaatattgttaaaatggtcatactgcccaaaccaatttatggattcaatgctattcctattaaactaccattgagattcttcacagaactagagaaaaaaaattttaaaattcctgtggaaccaaaaagaccccaaatagccaagataatcctaagcaaaatgaacaaagctggaggaatcatgctgcctgacttcaaactatactacatggctacagtaatcaaaatagcatggtatttgtacaaaaacagaaacatagaccaatggaacagaatagagaacccagaaacaaagctgcatacctaaaactatgatcttcaacaaacctgacaaaaacacgcaatggggaaacgattacttattaaacaaatggtgctggaacaactggccagccatatgtagaagattgaaattggaccccttccttacaccatctacaaaaatcaactcaagatggattaaagacttaaatgtaaaactgagaactataaaaaccctggaagacaacctaggtaataccattcaggacatagtcacagtcaaagatttcatgacaaagatgtcaaaagcaactacaacaaaagcaaaagttgataaatggcatctaattaaactaaagagcttctaaaagcaaaataaactatcagtagagtaaacagatgataacctacagaatgggagaaaaaaatttgcaaactatcagtctggacaatggtctaatatccagcatctataaggaatgtaaataaatttacaagaaaaaacaaacaaccccattaaaaagcgggcaaaagacaagattacacgcttttcaaaagaagacatacatgtggccaaaaatcatggaaaaaagctcagcatcactaatcattagagaaatgcaagtcaaaaccacaatgagacaccatctcacaccagtcagaatggctatcattaaaatgtcaaaaaatagataatggcaaggttgtggagaaaaagaaatgagtatacactgttggtgggagtataaattagttcaaccattttggaagacagtgtggcaattcctcaaaaacctaaagacagaaatgtcatttgatccagcaatcccattactgggtatatattcaaaggaatataaatcattctgttataaagacacatgcatgcatgtgttcattgcagcactgttcaaaaagcagagacatggaatcaaactaaatgcccatcaatgatagagtggataaagcaaatttgatacacatataccatggaatactatgcagccataaaaagaataagatcatgtattttgcagggacatggatggagctggagaccattttccttagcaaactaaagtaggaacagaaaaccaaatattgcatgttctcacttataagtgggagctaaatgataacacatggtcacacagaggggaacaacacacactggggcctatgggagagtaaaaagtgggagaatggaaatcgggaaaaataactaatgggtactaggcttcatatctgagtgacaaaataatctgtgcagcaaaccctcatgacacaggtttacttatgtaacaaacttgcacatctatccatcaacttaaaagttaaaaaacacaaaaaattataacaaattttttaaaaaagataaatgtttgaggtaatgtatatcttaattaccctgattagatcattatacattctatacatatatcaaaacatcacatatacaaccaaaaaatgtacagttgtaatatatcaattaaaaaattatataaaattcaaaaaggcatttattgatacaaagtcaatacttaaaaatcaattgtatatctatatactaacagtaaacaattagaaaataaaattttattgtgataccaattatgatagtatcaaatatcagatacctataaataaatgtaatcaaaagtgcaagacttcaaaacgcaaaactataaaacattgttgagacaaatcagggtgttaagtaaatggaaaaatctatcatagacatagatcgaagattcattattaaaatctatgtaattcactaaaaacccattggaagtgtctgtgtctatgtgtgtttatgcatgtaaaagttgataatttaatcagaacgtttatataggagtgcagaaggccaagaaaagcagcaacagagttttagatagcaagacttactgtaatgttatagtaattaaaacaatttagtttacattgctgtggatttgtatagctagaccgatggatcacaacaaagagcctgggaatagacgcaatacatattaaaaacaatatcgtagatcagatgaaaatttgaactataaatgaatggtcctggatcaatgggtcatccatatggaacaaaccaagctgggtctctacctagcaccaaatacagaaataaaacccaaatagattaggaaataaaatgcacaaagcaaaacacagcagattagtttatggactcaaagtatgtacagtttttttttttacaaaaagcacagaagcattaattatgaaggaaaagatagacatatttgagtattttacaaaaaaaaatactatgcaaaacgataccacagaaaaatgaaaatgaaagtcaatgattgaaaaaaaaatagaaccactgctctcttcaaagctgtcagacagggacatttaagtctgcaaaggttactgctgtctttttgtttgtctgtggcctgcccccagaggtggagcctacagaggcaggcaggcctccttgagctgtgctgggctccacccagttcgagtttcctggctgctttgtttacgtaagcgagcctcagcaatggcgggcgcccctcccccagcctcgctgccgccttgcagtttgctctcagactgctgtgctagcaatcagcgagactccgtgagcataggactctcctagccaggtgcgggatataattctcctggtgcgccgtttcctaagcccgtcagaaaagcgcagtattcgggtgggagtgacccgattttccaggtgctgtcacccctttccttgaccaggaaagggaactccctgacctcttgcacgtcccgagtgaggcaatgcctcgcgctgctttggctcatgcacggtgcgctgcacccactgtcctgcgcccactgtctggcactccccagtgagatgaacccggtacctcagatggaaatgcagaaatcacccatcttctgcgtcactcacgctgggagctgtagaccagagctgttcctattcggccatcttggctcctccagcacggagctggagatctgagaacaggcagactgcctcctctagagggtccctgacccctgatccctgagcagcctaactgggaggcaccccccagtaggggcagactgacacctcacacggctgggtactcctctgagacaaaacttccagaggaacgatcagacagcagcatttgcagttcatgaaaatccacggttctgcagaccccgctgctgatagccaggcaaacagggtctggagtgaacctctagcaacagacctgcagctgaggatcctgtctgttgaaaggaaaactaacaaacagaaaggacatccacaccaaaaacccatctgtacatcaccatcaccaaagaccaaaagtacataaaaccacaaagatgaggaaaaaacagagcagaaaaaatggaaactctaaaaagcagagcgcctctcctcctccaaaggaacgcagttcctcaccagcaacggaacaaagctggatggagaatgactttgatgagttgagagaagaaggcttcagacgatcaaactactccgagctacagaaggaaattcgaaccaaaggcaaagaagttgaaaaatttgaaaaaaatttagacgaatgtataactagaataaccaatatagagaagtgcttaaaggagctgatggagctgaaagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaataaaaagaaacaaacaaagcctccaagaaatatgggactatgtgaaaataccaaatctgtgtctgattggtgcacctgaaagtgacggggagaatggaaccaagttggaaaacactctgcaggatattatccaggagaacttccccaatctagcaaggcaggccaacgttcagattcaggaaatacagagaatgccacaaagatactccttgagaagagcaactccaagacacataattgtcagattcaccaaagttgcaatgaagtaaaaaatcttaagggcagccagagagaaaggtcgggttacccacaaagggaagcccatcagactaagagcggatctctcagcagaaactctacaagccagaagagagtgggggccaatattcaacattcttaaagaaaataattttcaacccagaatttcatatccagccaaactaagatccataagtgaaggagaaataaaataccttacagacaagcaaatgctgagagactttgtcaccaccaggcctgccctaaaagagctcctgaaggaagcactaaacaaggaaaggagcaaccagtaccagccactgcaaaatcatgccaaaatgtaaagaccatcgagactaggaagaaactgcatcaactaatgagcaaaatcaccagctaacttcataatgacaggatcaaattcacacataacaatattaactttaaatgtaaatggactaaatgctccaattaaaagacacagactggcaaattggataaagagtcaagacccatcagtgtgctgtattcgggaaacccatctcatgtgcagagacacacataggctcaaaataaaaggatggaggaagatctaccaagcaaatggaaaacaaaaaaaggcaagggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagttaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagagattataacaaactgtctctcagaccacagtgcaatcaaactagaactcaggattaagaaactcactgaaaaccgctcaactacatggaaactgaacaacctgctcctgaatgactactgggtacataacaaaatgaaggcagaaataaagatgttctttgaaaccaacgagaacaaagacacaacataccagaatctctgggacacattcaaagcagtgtgtagagggaaatttatagcactgaatgcccacaagagaaagcaggaaagatccaaaattgacaccctaagatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaagaaaagagagaagaatcaaatagacgcaataaaaaatgataaaggggatatcaccaccgatcccacaaaaatacaaactaccatcagagaatactacaaacacctctacacaaataaaccagaaaatctagaagaaatggataaattcctcgacacatacaccctcccaagactaaaccaggaagaagttgaatctctgaatagaccaataacaggctctgaaattgtggcaaaaatcaataacttaccaaccaaaaagagtccaggaccagatggattcacagccgaattctaccagaggtacaaggaggaactggtaccattccttctgaaactactccaatcaatagaaaaagagggaatcctccctaactcatttgatgaggccagcatcatcctgataccaaagccgggcagagacacaaccaaaaaagagaattttagaccaatatccttgatgaacattgatgcaaaaatcctcaataaaatactggcaaaccgaattcagcagcacatcaaaaagcttatccaccatgatcaagtgggcttcatccctgcgatgcaaggctggttcaatatatgccaatcaataaatgtaatccagcatataaacaaaaccaaagacaaaaaccacatgattatctcaatagatgcagaaaagtcctttgacaaaattcaacaacgcttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccactcctattcaacatagtgttggaagttctggccaaggaaattaggcaggagaaggaaataaagggtattcaattaggaaaagaggaagtcaaattgtccctgtttgcagacgacatgattgtatatctagaagaccccattggctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactgcaaaccactgcttaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactgtctgatctttgacaaacctgagaaaaacaagcaatggggaaaggattccctatttaataaatggtgctgggaaaactggctagccatatgtagaaagctgaaactggataccttccttacaccttatacaaaaatcaattcaagatggattaaagacttaaactttagacctaaaaccataaaaaccctagaagaaaacctaggcattaccattcaggacataggcatgggcaaggacttcatgtctaaaacacttcatggcgacaaaagacaaaattgacaaatgggatctaattaaactaaagagcttctgcacagcaaaagaaactaccttcacagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcaaagtatatgaacagacacttctcaaaagaagatatttatgcagccaacagacacatgaaaaaatgctcatcatcactggccatcagagaaatgcaaatcaaaaccacaatgagataccatctcacaccagttagaatggcgatcattaaaagtcaggaaacaacaggtgctggagaggatgtggagaaataggaacacttttacactgttggtggcactgtaaactagttcaaccattgtggaggtcagtgtggcgattcctcagggatctagaactagaaataccatttaacccagccatcccattactgggtatatacccaaaggactataaatcatgctgttataaagacacatgtacacgtatgtttattgcggcactattcacagtagcaaagacttggaagcaacccaaatgtccaacaatgatagactggattaagaaaatgtggcacatatacaccatggaatactatgcagccatagaaaatgatgagttcatgtcctttgtagggacatggatgaaactagaaatcatcattctcagtaaactatcgcaaggacaaaaaaccaaacaccgcatgttctcactcatagatgggaattgaacaatgagaacacatggacacaggaaggggaacatcacactctggggactgttgtggggtggggggagtggggagggatagcattaggagatatacctaatgctaaatgacgagttaatgggtgcagcacaccagcatggcacatgtatacatatgtaactaacctgcacattgtgcacatgtaccctaaaacttaaagtataataataaaattaaataaatagacaattaaatgaatattgatgactttctgaaaaacaaaaaaagataaaaaaatagagtaatcctcacaatggtttaatatgcaaatttataaagaactattataaatcaaaatataaaagaccaacaatacaatagaaaataggccaagcatataatcagacaagatatagaaggaggaatataaaggtttgtaaattaaatatatgaatagatgattactccactagcagttgaggaaatataaattaagaaaataatgaaatttctcatccatcatatcagcaaaaaagtaaatctaatatcaagtattagcaaatctaatatcaagtattggtaattatgaaagaacaatgattttgaacattgctggtaagcatgtaaaatagaagagcctctttagaggggtacttgacaataaagatgtttataacctataacctagcaattccacttctatgtgttctccttaaacaaattttgcccattgtataaggagacacatgcagagttgttcactgtatcagtattcatttataataggaaaacaaaaaagtaactaaaaccgcttaatttaaaaaactggataaattgtggttcattagtacaaaatacttttgagcatttaaaatgaatgcattagagtgacatttatcaacatagagaaacttccaaaaactatgtttaatgaaaatggcaagcattttaacacaaaacagtagtatatttgtatacttatatataatccaagtataataaaaatacaaaattatacatggtaataataatttcagaaatttggtaacttctgatagaaagaaagaggtaaggagagaggatgttaggtatatccgtaatgacttatttatcaaaatcaataaaagcaagcaggatctgaaagatgacaaaatgttaatatctgcttcattttattgagtgcttttatgttattttatgtatatatgaaatttccctaatttaaaatttaaaaatttaaataactttaattcatttgacactttagtgtaaaatatgaagtagaataatgtagttttttccaaacggttagcaagttgtgccaatatcatttattgaataagtcattcctttctaattttaaatgctaccatttccatataataaatttttatatgtttgggtttatctctggacttcaatttctgttccactgatctgtatgtttatcctaatgacagcctcccataagtttttttttttttgagacggagtctcactctgtcacccaggctggagtgcagcggcgctatcgtggctcactgcaacctctgcctcccaggtgcaagcaattctcctgcctcagcctcctgagtagctgggactacagtcgcatatcaccacacccggctaatttttgtattttagtagagatggcgtttctctgtgttgcccaggctggtctcgaactcctgagctcaggcaatccgcctgccttggcctcccaaagtgctgggattataggcgtgagccaccacgcccggccctcccaataattttgataattgtagtttcatgatatttttcaatttatattatggcaaatctctagtgaatgttttccttttaagatttatttggtttcaatcacactcagtgatcttttcttatcttttatggttattttctttcataattcattttgtttatgcttcctcactatgttttaaaattttttgttatacaacatttccttaaaatattttcatgtttttccttctttatttagtaatttccatatcattcatcctagttttatattacaaatggttatatttaaacttaaaaatgaatttgagtccataacttaggtatgagtagtttttattatgaatgatgtcagtaactcctttgagactaacgcttggcacttaacctcctctgataatacagaaggtttataactcagtggggaaaagctctttggagtacgtctgacaacatgttctaatcatattgcaccatgtacaaaggttggtgtgaaatgggcagaactacacaggagtttaggatcaatctgccttggtgtcatgacatatcaaaggttatatagataatatggtatggggctgagttggggataaaacctagatctctatttgttcaaccaatcagctcctttacttcggagccatattcccagtttttatattacttattgggagtgcagcctgattcccagcattgtggaaagaaatgctggagtttcaagcctacttcttactgtgtgatttatcatctttctgagcctgttatttgtagggagaaaaatcatacccatctggtagagttcttagaattaaatataattgcccagacaatgtgtttagggaacaataaaagactacatatatatgtatataatgtacatatatacgtacatgaacctatacaactatatacattacatacaatttatagatatgtttcctatatatgtgtagcttcatgtacatatatatgaatatgtacgtgtgtatagacacatatgtatacatatatgtgcatgtatgtatgtaaggatatagagagacagatcatatgtatgattatgctaagtctcctgcccatgaagaaccaaaaagttgccacctaaagtcttcaaaaaatgctgaacaatcctgggcctcatatatcaaaagcatggagtctggataatcactatgtgaaaaacgaatccttatctattataagttgatgttgaagagtcacagggaatcaacaaagtttgttaattagctgcacctgtgtcttgttaactggaaattgtcaatcttcacacagatactgcagtctgacagagatggtaaaaaaaaaatggcttgcagattgcacattagaagattcctctccctcactgaaaacttgtgagaaggcagccaaaagaggtaaaaggggaatggagcaaaacattctcatcaaggggagtttagcatatcaaacaagggcatttgtaacatgacagaaagaagaaaaagatctttcagggagactctttcttctcccttctcaaaataaatatccaccaagatacagacaaaaaaaaagcctctcttttcctcaatctgacagcatttcctacatggaattttgttctaaattttagcactaattcaaacatattcatttaatcataattttaatatttattaaataaacagttatgggtttcctactctgctatgtgctgagattatataaattaataagactgggccctttgcccttaagtgaggaaaataaacctgtaacacacacacacacacacacacgcgaaggtagagtctgtagccagcctaagggaaggagaggtgaatttttgctgaggaataaggactggccaggcagtagagaacacatggaagacatttcagtcagagggagcaacaagaacaaaggctaagtggtaattctggggctgggtagggcaagagatcagactgtgtcattaagacatatgagcatgttaaaaagttttaactttcactgaaagcaatatgaagggcctattgaagggttttaattgtaggtgtgaaaggttcagatttgtgtttcagaaaaagcacctaaggctgcactgaatgactgttccagggtttatactggtctctgtagagtcagctgaataagtaaatgctctactctgaggaaacgcatactgttatggagaaaacaagcaagtaaacaagttattgcaaacccagtgtcattaatgcaaaaatagaagaatatgtcaagaactcttggagctttgggtatagtgcacagaggacagtgatcacatctgcctgaatgggaagagtacactttcttttgagccacttcccaaaagatgatgtgtagttctgagtcaaatcactttgaaattagtaccatagtacatttcccctcctagttgtagctatgtatggtttgtaagatgactgagatcagggcaaaatccttcacatcttttgtaactgcaaagtaggtactgacagggctgaagtcagagtgtatgtattagtctgttttcacactgctgataaagacatacccaaggcgaggcacggtggctcacgcctataatcccagcactttgggaggccaaagcgggcagatcacgaggtcaggagattgagaccattctggctaacacagtgaaaccctgtctctattaaaaatacaaaaaattagccgggcatggtggcacacgcctgtagtccaagctactcgagaggctgaggcaggagaatcactggaacccgggaggtggaggttgcagtgagctgagatcacaccactgcacttcagcctgggcaacggagcgagactctgtcccaaaaaaaaaagacatacccaagactgggtaatttataaagaaaaagaggtttaatggactcacagttccacgtggctgggaggcctcacaatcatggtagaaggcaaaaggcacatcttacatggcagcaggcaagacagaatgagagccaagagaaaggggaaatctcttataaaaaccatcagatctcatgagatgtattcactaccacaagaacagcatgggggaaaccacccccatgattcaattatttcccactgggtccttcccataacacatgggaattatgagagctacacttcaagatgagatttgagtggggacacagcaaaaccatatcagtgtatattaaataaaatctgatttattaggctttctttaaacctattatttattaaacaggttctccttcctgcgtgatgggaaagtcaaggataataaatagaaaaccagccgagtggatggcttcaatactaggccaacctataatgcaccccatgaatgaatttccacctatactcacttcatgtttcccctgcacagaagtgctacggagttaataggacagatgaaataacaggtatatacatctgtttttttaaatgggctattcatcaggcacaggggaagaagctataggttttctcagtgcttctgaaattctcaaacaggaatgcataggtttctaaactcaggcaaaaccaaaattcctttccttttttttttttaaacacacacacacacacacacacacacacacacacacacacaaatacaagatctcactctattgcacaggctggagtgcaatagtgtgatcatggctcatgcagctttgaactcctgggctcaagtgatcctcctgcctcagactcccaagtaactggaattataagtacaagcacagtgctttgccttccttttaaaaatttcttcagtacatcccttgagggggcctttctacctgctgcatgatttctcacactgctacccacttctggcttccattaggtatatacttctattggcttttgttatcattttataataaaatgaggaaggatgtgagtcctagattaccttgcttaatggtggcacagccttttcttgatgagacatttaatggtagtctattttcttataaatgcatacaaatcatatgtgctagactgaaaattgttcagaactattctgcttactctgtatccatattctttatactatgattttgctgctcctcccatcaaaaggtgacacctttgaatttgggctgatctggtgattggttttgcccaataaaacctggtaaaacgatggtacagcagctttaagccaagacctcaagaagccttgtgtagttccatattctctttgaaatcctactatcagcatttgatcaaatctagggtagggtgacagtggatgagactacattgactaaagcccaatgattccaactgaatccatcttagaccaacatatagacggttgacttccaaatatatgagagcacccagacaagatcagcagattaatctacagttgatcactaatacagaaaaaccatccggttggcccatggacttaacgagcattaataaatgtttcctgtcttaagccactggtttttggtgctttgttattgaaagaaatcaaaatattttatccaaaaatatatttatttgacatattttgagatggctgttcaaagagccaacaaatagaaataaccctgtaaagctgtattttgtgtgggaaatctgtgtctgcagagaatttgaattgatacaaccaggcctttccttgcccagatccagaaaagattaactgagagtctgacacttttaaaggtctgataataacatttactatctattctctctgaaggctactacctgtgaggtttcatttacataaaagaccatgttgttagtcaagtcccctcttctttctctcccataagctgtcttgccatcatgtcctgatttaccaccataacctgttttggccatgctctgagctcccattcttcccataagctcaaggtggtatataaggttctgcatcccattgggggttagggtaatccttttgtgatttttcctctatgtacacgttaataaatttataatccttttctctgattaatctgccttttgtgagttgatttttcaaagaagctttagagagtgaaggggaagttttcctttaatccctacaattttggcactgtgagcagaataccaaaacgccactcttcttgaacctgcagttaagggaacctaggacctcataaactgatgaaaaaatatgaatttcttaacagctaggctccaacctctctctgtgcaatctggtcaagcagatggtaaaaaatcactgtctctttttcctctgcaaaattttgattaacgggagaaaaggatttctgtgactagtcttggggatagtgactctggtgtactttttggtgctttctggcatgaatattcatattgtttggtctctcttctcccagaaatagtttttccttgtccttgtttttctgtgctattctgtcataaagaggggtagtgagtgagattctctctcatcttgttttatgtccttgaaagcttccttgtgaccaagtaggagctctctctcttggtttccaccatcggggggacatgattttcaggtcacgtcaggtggccagtctcaaattggctgggtacccaaacacactgtttattccaagcatgttaagctctcagggggatatttttttttttctcaacctttgttgtttggttagttctgggaaagtctaatcctaggaggctctacatggtgttacaaattaacaggtctgtcactggtggctcctcacaaattcatgggttacataaacaccaacctcaactgtctgtgacaagatccttttgcctactcctgggagtaaaattttttgtggggtgggggatctttaggattgcctcttctattccctctctagaaaacacctatttttctaaacctagaaaattacatcctgggctttccataatgaagttattaaactgagtcactactggaataagtacatcattgggaattctaattatcaatggcaaaaagataggtcctttaagtttgactcctgaattttaaaaaaggagagatttcttattccaaacaattgacgagaatatcaaactaaaataaaaacataatagtgccatgattagtcttaaaattctctttacaaaattaaagaacaaaaatctaaactaaaataaagttaaagtcctttgaaagctcaaactgccagctgtgggtttcctatgggattcgcaatgaaggctactccaccttgtagtctagtagttaaaattccacactttcactgccatggcctaggttcaattcttagtcagagaactagtctctttcagttgatatttatgtaactttttatttttgaaggtaactatttattaatcctgtccttccatgagcagcttttgatttcttatattcttccatctatggggacatatgggacttttgggactttgtgaatagatggtcagttaagaagctgagaccccagaaaatatggccagacagatgtgggttgtacaccattgcacataaaactttcctttctgtaaactctctttggggtggttctagatcttatgaggtagaagggtactttcgatttaaaaaaaaaattcaaaagccagaaatttcagctgtttgtcctggctaaaatctgataataagagatttcaaagcgttgtgttttctctaagagctccatagttcaaagtcaactcaattaaaagatagcacacacacacacacacacacacacacacacacacacgtacatatacatatctaaaatacttttgacgttctctcttttctgattctgtttttagatttcttagttgactaaaaccctttttaaattatgtatttggtctgtctgttcactttctttcttacaaaatattctaccatttacttttattcctccctacccctccttcttctccatctttggtactacataaaaaatctaaaagagatgtccaatgactcagcgtcttaatgcagaaaaaggtaccccttcaccccatttgtggggccttctattttccttctagtttcaagagtcatggaaaggatactctcaggtctaaaactctgctgtcttttataatacattatttcatctctttggcttttgagggtaccaaaagttacttcatgctgtgacagaaaacttggcctttgtgtgtacaatggatgtgaggtcactggtgagaactacagttttggaagtggctggcagtggtacaatgaatgttatttgttacattgtcacactaatgttattactacaggaggccactcatttctttgtgcacttagttttaaaaacatgcagtttaaatacttagaaaactgtctttataacggagtaaaatataaaactgttgtgtagcccagtcccatggtgtttccctctttttggagacccaggattcagtgtaaaaataaaatccttgattttaaaaaatctaaattctctgcctcctagctgtgtctacttttcatctatctaaattattaggctctaaacatgacaaatgctaataatttaaattattgggccatgttccttaatgggctccaccctgagcacagtggtccaattaaaaaacaaagactaaattaaaaattacttatctaaataaaattagtcttcttataaaatccagtggtaaattcctatgattttatgttaccttgacaaatgtttttagtcttcttatgtctaacacacctaaaatttttatttaaaaagttaaaattgtctctgtactttacatatatatttactaccctgttttctctaaatctcagtaaggggctttggccatgtgtgacagataaacattaacatttcccatttaaaaagacacaatttaaatccagctatccttttatattagtgacttataccaatctcataactaaaattttaaaataaaaactggaaagtctttatgtctatatacacacatgtatatgtctgtttatatactgtctgtctgataccattgacttataaataaatactcattaataaaccagcctaatacttgtcaagttcatataattttaataatctatagtaaataaagataattttaaaaattgttagtaaaataaaatacatcttaagaatttagtttacacatttttcctgggtattttagtcagacgagtttatactgtctctactagatgttttaaagttataaatgtattacttccataatattttcaaatacttaatttgtctgtgagcttatgtcttcaaatgtgagcctttaaatcctaaggtctagagaagtggctatggcaaggctggggacactcatgggcagtattctcacaggtccagagcagtgcctcctggaaaaagttagatccaccagacgttgtctttattactctaactttggtcattggctctaaatctggcacatgattaaaattacccacttcctagatttttcaccagaaaataagggttactgagagttaacatcataagtaatatacataataattaaaactactaaatataaaatagtctatatacaaagtatattaaaaataaaaacatttttataaaagaatataaacgtggtttttgttaaaaaataattttgtctagtttataaatttttatgttactttcaataaaaaataaaactaaatataaaaaatttaaaaattataagaggttatacaagagtttatcaaaatctcttgtgtatattcaaaactcattaaaattaaatttgtttataagattttattaaaattaaatttaatattaataatataatatgaaggaaaaatctaattttctattttaagtaacattttcatacaatattaaaaagatttttgtttactttttattttattttatttttatttttcgagatggagtctctctctgtcactcaggctggagtgcagtggtacaatcttggctcactgcaagctccacctcccagttcacgccattctcctgcctcagcctcctgagtagctgggactacaggcacgtgccaccatgccctgatgactttttgttttgtatttttttagtagagacggggtttcaccgtgttagccaggatggtctctatcttctgacctcatgatccgcctgcctcggcctcccaaagtgctgggattacaggcatgagccaccatgcccagctgatttttgtttacttttaaataaacgcccaaaaaagagagaagagagacagatttagtttgcctcatgctgtctttactaggtcttttgattatttgggaaacagcctcttctctattaataaagttgttgctgtttaaaatgtctgaattatcactttggctaaatgaatattttacagtgacctgtgctcctattttgatatcaactgttttaaatctttgatatttgacatacttctcacagtcatatttcaaattctaaattcagtctttagacctgaaattaacttttcatatattaaggcccaagagagtccaagagagatatattggaattatatagtatgttataatcatataaaaaattgtcaaataaaaaatgatatttaactttttttgagttgtacttgtaaaaatgtattatcaatatgtgttctaaaattgtatgagattactaacatactgatgtgttttggtatatgttaacagtaacaattatgattattatgtcaaattgtatgccatagaaataacaaaatctcattgtcaattgttatgattattctaagactttttaaatccacagacaaattattgttttactttgattcttcctaaaaagtaatttgtaatcagatacagtacaaaatttgcttatttttcaaagaaattcataatatggaccttgacaagtactcttaaatacatgcttctgataactttagaaatcatactattggagtaggtaaaaaattccaggactctaattaaaaagctaatacattcatgactattgctagctcaacatcaagcagaacaagagttaattcatggggctaaactgataaaggactcaaatgatttttataactttttaatttaaaacattgctgattccttttatgttttgttttccagcattaagaaaacttttttgaactatttagagcttgtaacaattgggtaaagtatatatttgtgaacaaaaataaaacatttatctttctcacataatttctccagaatttaaaaattatttgtgagtattcttaattaatgacagcacagttatttacatttgttccataagaatctgttttcttttgtcacaggacataattaatgacactagttattttaccaagactttgactggaatgatatattttcagatatggctaaactactctgagaagttgagattaacttcacagagctaataaaaagctcttgaaaaagagtggcctgatgtcttatctacatggtttctttataaggttctagacctgtggaaaataaaatatatcactttctgacaggcccatgcaccccaagattttggggcctcaaaaagagagaagttcaccagtttgtacaggtattacaggcacactctgatgacaaatccttggcttggtttcttagcctcaaggcttttaaatgtctaatctgagattccttattaaaaagttccaacaaagtcaactttaaaagagcctatatggccaatcactattgttactacactttatgcaaatagtcatgccaagaataataagactaaaagttacttttaatttcataactaaattagtcccattataatttaaccttagtaaaaatgggaactagagagagaaaaaatgtttcagaaaaaacctatagtatacctgttattacattctagccttgcccatagtttttgagtttttattgttttcctataatttacactgtatcctaaattctttcttgactacaagtctccaaacaatttttttcaagttattctctgatttttctcaattaaaatcactaaaaattaaaattacttttcttaaagccctataaactaaagttaaacaacttgatataaactttggggaaaatcaccacaataacatgtattaccagtcattatacctgctgatgtgtaaactactccggaaagctcacttgaacatctcagtcaaactataacccagaaaaatctgttagattgccactgcaatctgaagatatttcaaagtcaaatctggtctgtagactactccagacattaaccttcactttcttttgtttccatagaaatgcctcttattatagatattctcctacattatatatatacatatatatacacacacacacacacatatacatatgactagctcatctacaagatcacctcctagaaggagattcaattatttaaccaaactaatctattatcatgactaagagactgatttaaaaagccatgagatgatatatttaaatttactcttttctgcttattccagtttgttttctcccgctcctttgcctatctgtacctaacaatctctaaaccaaaactctccaaaactatcaacttgactttaaactgtgaaacttttcaaagtttcaaagtagagactcaaggatatcaaaatattttatcccaaaatatatttatttggcatattttgagatggctgttcagagacccaacaaatagaaatgaccctataaagctgtcttttgtataggaaacttgtgtctgtagacaatctgcattgatacagccaggccttcccttgcccagatctagaaacattaactgagagtctgacacctttaaaggtctgatagaaacacgtaccatctattctctctgagagctactacctgtgaggtttcatttacataaaagaccatctttgctagtcaagcctcttctttccctcccatagcctgtcttgtcaccatgaccggatttaccaccataatctgctctggtcatgcactgagcccccattcttcctaaaacctcaaggtggtttataaggttctgcaccccactgggggttggggtaatcattctctgatttttccccatgtgcacattaataaatttgtatgtcttttattaatctgccttttgtgtgttgatgtttcagctaaacttcagggggcaaagaatgagttctcccttggtccctacgttatttagcaatagccaaaggatatactatttaatgtttcagtaatcaaaccatgcagaaaaaaaagactaaaagaaagaaaaactgaaaaagggaaagaaaataagagaataaaaagtaaagagtcatttactttccattgtagtttatagtcccaatatactagaatattcagtattaaactgaatttgatattcttcactatcttcataattatttaacataagcttatccttgctcacatattaaatctagctattttaatgtaccatttgaatttgatcatactaacatatattttttgatcaattgttatcctttaaatttcaatttcccacttttgttaatgaggaaaagagcatttcctgtccttgagaattttgcagtttggctgggttcatggggtgtgacatgatatgttacaaatcaatttcagtttcttttcttgatttatttgttaaatgaagaatttggacaaacaaagtcttaggaggcataaacctgagttcaaaacttgtctccaccactcactatctttgcaaactttagtatgttattttaccttagttgatccatccataaaatcaaaataataatactttactggttggaaagctaaatattccactagatagctaaagaaaatactcttcttaggtttttttcagctccaaaaaatatgcttctttcaatctatttagaagtgggaaaattgaagatcagagacagcaagtaattttcctaaggtcaaataagttggcatagctgaaaaaaaaaaaaaagacgggtgttctttttcccagcccaactgtcctcccactccaacttgccccataccctgcccaaagataggcattttcccatattgttttctctgtttgtttccagaatccactgaatggtgttcaataaagcaagcactactttttagtacaagtcaacctttttctaattgatttttcgttctattttgttctgttttgttctaagtacttattatatcccaggcactttacctacaaaatctcatttaacaatcataacaacatggcaagaaaagtattcatatttccattttacagaagaggaaactgaagctctcacagaaattaaccatgagaagttgcccaagggcacaatactgacaatgtggtagaagcagcatccaaaatcaggtttatttgactctaaagctgtagctctatataacaaaccattctgtgtccctcttttttttttcattttgaaaattattctctaaacaaaaaagtagaaaatttatctcctctcctttggaatcacgtcccaggttaaaaggaaatactaaaacagccatgctttcaatttgcttctcaggacagacgaatatttttttattaaaagctttggtggataacaaacagggcagtaaatctaagagagagagagcagcacttgttcataagaaacctttccctttctcaaagcacctgggaattacaggacgactgatctactttacagctgtatggtactgctttttagggcagagatcaagtcatcaggtactgtcagaccagatgcttgaagctatctgcctgcaggaggtaaaccaaccatattctttcatccagttttcctgaagctaatggcaaatatttatgagctattaataggtagaggtctaggttcagtctcagtctcagtcagtatccaggctataaccaggcccatattgaattttgttgctggcgtcagggatagagccaagataagagccaagagtccttcttcagatggactgaagaaggaatcagtcactccacaaccagaggacaataaaaataaatatttatttattaaaaaccaaaatatttataatttgcaacatcaaataagcatgtttagtaaagctgatgtaacattatcctaattgtatttacaccattaatctgctatgtttagctgagacatttttcatcactaatgcaatgctcaagttgaacttttataaatgtcagattattagaatccacattcatgaagcttcaccttacagcagttttccaaagctgagaattggaatagatcaattttaaatgaaaaaaagagagaatatattgtggattgcaaacagcagataaaatattttcttattaaaggctgctctctccaatgaattttagagaacactgagatctcccctttgtttaaagataatcacgtttttctcagagtggttcacctagggttttaccttgggcatgaatttttcatgactgattgattgaaaagacaatgccaacagagcataatataagcgtggggacctgtcttacaaggtagagttaaattactccaaggattaggatgacaaagccaggcgctgtcttcaactcagcaagtaaattaacaattacaaatctgttgaaaaatgagaaaaatcaattagaaaaaggttgacttgtactaaaaagcagtgtttgctttattgaacacctttcagtggattttggaaacaaacagagaaagcaatatgggaaaatgcctgtctttgggcatggtatggggcaagttgaagttgggggacagttgggctgggaaaaagaagacccgtctttttttttttcagctatgccaccaacttatttgaccttaggaaaattacttgctgtctctggtcttcaattttcccacttctaaaatgaagataaatgactaattccaaacctgctaaaaccattttttgaaaaaattatgtcactgagaaaattatggtaatgggggagatctgatctagccaactcctatcttgcctttagcctttaagctgcacttaattattcctgggcttaagccaaactaaccttgggggacatttagtttagtaaatagttgaaatgatgatattccatccccagaactcaactgcctttgcaaagccaatgagaaaccaccatgctaggaggatagcgaagcctgaatgctgctaaagcataactataatagatttccagccataatttcagaggtcacaagatatgtaacttccccaattactcctgcagataacattactattgtagaacctaagattggcctttcgagatatcttttcaggatttttttgcatgtctggcaccaatggctccacttggacctgccagctactactgtggccccacctagaagggactcagcacgcagaaggaccatttcccacacccctatgattgcacccccaaccagttagcagtaagaacccattgcctagccaccctcaccacttaccgcaaactacttttgaaaaaccccagcccccatgttctctgagagattgatttgagtattaaccccatctcctaaatgttgtggccatttttgtgtcagttaaactgtttctttactgcaatgccatggtctctgtgaattggttttgtttgtgcagcaagcaagaagagcccatcactcactgcctaaggagggcagtgagtgaatgtcagtcacggggctacagtcaaatacacattctagagaatgggtcccactagaaataaaccagaggactgagtgccaggagtttaacagacaaaagtctttaggaagaaggaaaggagaggattctaaaaagttcaactccaaatgtcaagttcaagggccagaggtagatattaaggtccagagcaacgaattaaggagtatagacaaagtaacacagttaattgaggtcaaggtgaaaaaggcagctctagattctacagatacctggctgattaatttctttatttttaaaaaaattgtttattgaactctgcttatacgatctaaactgtttcatgtgctgaggttacacagatcagacatacattgttcttgtcttcaaatactttacattttagtgggggagataaataaaaaaccagtaaataaatagacctataattcaatgtcagatagcaataattacaacgaagaaaaagaaaacagtaaagggtaagaaaatagaatgggaaataggctatagtttatttggctttaagttattattaccgtatatataatttgttgaacactaagttccaaagaaataattaggcacttttacattgcacattatttctaatcctcaaaataagtattacaggcagacattatttctcattttacagatttgggaactaataagaaaaaaagaccctaaaagatcaagcaacttcttgttttggtcactttcacagatgagatgggctctctcacacaaaatttggtttggatgttgagaatgatgatgccacatatgcaaaaagagtacgaaaaaattaattactcacatgatgagactttctggcaagagtagaacagtctctcaaactggtctgacaatgactcgagagagcaagaaagaaggctggcttgggggtttatggtggttaggagatgaagccatcatgaggattcccatgtgcacacaccaggacttgtgtggtttgaacattctgccagtgctaaaggaggatgcagtgtgctttcctgtctgtttgctcagacatgcagaaggagaaggaaggatagggcttaaaaggtgttagcagtcaatgtcaaaaatagagtcagactctttactcaactttccaatgataatacagctgtatgtggcaacacgatactgtgatttataataaatacatatttggctttgtcctcagtttcctggcatacagctactaaaacccttggaatcttcagagtgataaagtcatcacaatggccaataatgaagcatccaaaagaaatcttaaaaggacaggattcagaaatcttctgcgctgctgaacaaatggaagtgctgggagggttgcttgcccagaaagcacagaagccccaaacccttttctatatcttgccccatatatttcttcatgtggcagttatatatgtttcccacagttctgtgagctgctttagcaaattaatgaagcctgaggaaggggctgtggaaactgccaatttataggcagttggttagaagtatagatggcatcctactacttgtgatgggcatctgaagtgggaggcaagcttgtggaactgaacacttaacccctggcatctgactatctccaggtagatagtcagaattgaatgaaatcataggctactcagttggtgtccattggagaattgcttggtgtgtgtgagaaaatccccagacatatgttggttaccagaggcgttctgtgttgagtgttgtattaaaagttacagtaggaaaacctactttttttgtatgtcttacaggaagaatgaactgcaggtctgcttttgtgttgctctaaagtccatgcttttttgttttacactatgataactcaaatgaagagattttgtcatttctcttcaatgaggctctttgtctcaaaaaaaggagtaggggtatggtactattcaaaagacactacagagatggttagatgatgggtaggtggactgattatactatgtaaaacaacttaaaatgctcttaaaacaatggagaactaacaaaatattaagaaagtagggggaggacccaagatggccgaataggaacagctccggtctacagctcccagcgtgagcgacgcagaagacaggtgatttctgcatttccatctgaggtatcgggttcatctcactagggagtgccagacagtgggcgcaggtcagtaggtgctcgcaccgtgcgcgagccaaagcagggcgaggcattgcctcacttgggaagcgcaaggggtcagggagttccctttacgagtcaaagaaaggggtgacagacgcacctggaaaatcgggtcactcccacccgaatattgcgcttttcggacgggcttaaaaaacggcgcaccaagagattatatcccgcacctggcttggagggtcctaggcccatggagtctcgctgactgctagcacagcagtctgagatccaactgcaaggcggcagcgaggctgggggaggggcgcccgccattgcccaggcttgcttaggtaaacaaaccagctgggaagctggaactgggtggtgcccaccacagctcaagaaggcctgcctgcctctgtaggctccacctctgggggcagggcacagacaaacaaaaagacagcactaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcacccccaagcaggggcacactgacacctcacacggcagggtattccaacagactcgcagctgagggtcctatctgttagaaggaaaactaacaaacagaaaggacatccacaccaaaaacccatctgtacatcaccatcatcaaagaccaaaagtagataaaactgcaaagatggggaaaaaacagaacagaaaaacgaaactctaaaacgcagagcgtctctcctcctccaaaggaacgcagttcctcaccagcaacggaacaaagctggatggagaatgactttgacgagctgagagaggaaggcttcagacgatcaaattactctgagctacagaaggaaattcaaaccaaaggcaaataagttgaaaactttgaaaaaaatttagaagaatgtataactagaataaccaatacagagaagtgcttaaaggagctgatggagctgaaaaccaaggctcaagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggaagccagagagaaaggtcgggttaccctcaaagggaagcccatcagactaacagcagcggatctctcggcagaaaccctacaagccagaagagagtgggggccaatattcaacattcttaaagaaaataattttcaatccagaatttcatatccagccaaactaagcttcataagtgaaggagaaataaaatactttacagacaagcaaatgctgagagattttgtcaccaccaggccttccctaaaagagctcctgaaggaagcgctaaacagggaaaggaacaaccggtaccagccactgcaaaatcatgccaaaatgtaaagaccatcgagactaggaagaaactgcatcaactaacgagcaaaatcaccagctaacttcataatgacaggatcaaattcacatataacaatattaactttaaatgtaaatggactaaatgctccaattaaaagacacagactggcaaattggataaagactcaagatccatcagtgtgctgtattctggaaacccatctcacgtgcagagacacacatagggtcaaaataaaaggatggaggaagatctactaagcaaatggaaaacaaaaaaaggcaggggttgcaatcctagtctctgataaaacacactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcacaccacacctattccaaaattgaccacatatttggaagtaaagctctcctcagcaaatgtaaaagaacagagattataacaaactgtctctcagaccacagtgaaatgaaaatagcactcaggattaagaatctcactcaaaaccgctcaactacatggaaactgaacaacctgctcctgaatgactactggatacataacgaaatgaaggcagaaataaagatgttctttgaaaccaacgagaacaaagacacaacataccattatctgtgggacgcattcagaggagtgtgtagagggaaatttatagcactaaatgcccacaagagaaagcaggaaagatccaaaattgacaccctaagatcacaattaaaagaactagaaaagcaagagcaaacacattcaaaagctagcagaaggcaagaaataactaaaatcagcgtagaacagaaggaaatagagacacaaaaaacccttcaaaaaattaatgaatccaggagctggttttttgaaaggatcaacaaaattgatagaccgctagcaagactaataaagcaaaaaaagagagaagaatcaaatagaacaataaaaaatgataaaggggatatcaccaccaatcccacagaaatacagactaccatcagagaatactacaaacacctctacgcaaataaactagaaaatctagaagaaatggataaattcctccacacatacactctccctctgaaactattccaatcaatagaaaaagagggaatcctccctaactcatttgatgaggccagcatcattctgataccaaagccgggcagagacacaaccaaaaaagagaattttacaccaatatccttgatgaacattgatgcaaaaatcctcaataaaatacgggcaaaatgaatccagcagcacatcaaaaagcttatccaccatgatcaagtgggcttcatccctgcgatgcaaggctggttcaatatacacaaatcataaatgtaatccagcatataaacagagccaaagacaaaaaccacatgattatctcaatagatgcagaaaaagcctttgacaaaattcaacaacgcttcatgctaaaaactctcaataaattaggtattgatgggacatatcttaaaataataagagctatctatgacaaacccacagccaatatcatactgaatgggcaaaaactggaagcattccctttgaaaactggcacaagacagggatgccctctttcaccactcctattcaacatagtattggaagttctggccagggcaattaggcaggagaaggaaataaagggtattcaattaggaaaagaggaagtcaaattgtccctgtttgcagatgacatgattgtatatctagaaaaccccattggctcagaccaaaatctccttaagctgataagcaacttcagcaaagtctcaggatacaaaatcaatgtacaaaaatcacaagcattcttatacaccaataacagacaaacagagagccaaatcatgagtgaactcccgttcacaattgcttcaaagagaataaaatacctaggaatccaacttacaagggatgtgaaggacctcttcaaggagaactacaaaccactgctcaaggaaataaaagaggatacaaagaaatggaagaacattccatgctcatgggtaggaagaatcaatatcgtgaaaatggccatactgcctaaggtaatttacagattcaatgccatccccatcaagctaccaatgactttcttcacagaattgggaaaaactactttaaaattcatatggaaccaaaaaagagcccgcatcgccaagtcaatcctaagccaaaagaacaaagctggaggcatcacgctacctgacttcaaactatactacaaggctatagtaaccaaaacagcacggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactcaagagcttctgcacagcaaaagaaactaccatcagagtgaacaggcaacctacaaaatgggagaaaattttcgcaacctactcatctgacaaagggctaatatccagaatctacaaagaactcaaacaaatttacaagaaaaaaacaaacaaccccatcaaaaagtgggcaaaggatatgaacagacacttctcaaaagaagacatttatgcagccaaaaaacacatgaagaaatgctcatcatcactggccatcagagaaatgcaaagcaaaaccacaatgagataccatctcacaccagttagaatggcaatcatcaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaaacatcattctcagtaaactatcgcaagaacaaaaaaccaaacaccacatattctcactcataggtgggaattgaacaatgagatcacatggacacaggaaggggaatatcacactctggggactgtggtggggtggggggaggggggagggatagcattgggagatatacctaatgcttgatgacgagttagtgggtgcagcacaccagcatggcacatgtatacatatgtaactaacctgcacaatgtgcacatgtaccctaaaatttaaagtataataaaaaaaaaaaagaaagaaagtaccaggccaaaatttaagttaattctagatccaacagagagcatttgctgaatctggtgaatctaagcttggcaaaatagggattggttttcagggatgtcaaggccattgcgaattttaaaaatcatagaaaagtgagaccaaaattctgtgcaattttccttcaattcacttgcaaaattctaagctgctcatatacatggtgaaatgctaataaaacaagtagaaagtggtacctatgaggttaaaatgctaagtggagctttcaacagtctcaaagtgctgcagaaagacagtttggagttcaaggcctaccaagttggaaaattgtggtaaatacccaatactgtttgagatgccaagggactgtgcacttgagatgaagggctatgcccttggagtaagggcaagccaaacatatacctgaattgatatatttgaaattcaacctcgactggataaacatgatcttctcaaatgctgtctgcctggtaaaaaaaaattaaatcctctctagaggaaaataatatacataaaagcctccacattttccaagcacaatatcctgcatcaactaaatttacagacatgtcaagaaatagtaacaaatgagacacacacacacacacagagagagagagagagaaagagagagagaggaaggaacctgaccatctgacccacaggccaatcaaatatttaaggtattgacaggggctttaaaacaattataatgaatatttttggcaaaatagagggaagacagaaaaatttactagacaactagaatataaagaattaaatgaaaattacagaattaaaaatataataactgaaattaagaatttaacagatgggtttaaataacatattagatcctgaagaagaaaggaatagtgaaatgacatacatatgctggcatactatgcagtaatgaaaataaatgaattacatgcaaaatattcatgattgtcagaaacaaaatatggagcaccagaaaccagacaagccagacacaaaagaaaacctattatatgattctatttataaaaagcgatagtgctatcaagatgaatctatagtgtttgaagacagtataaaagatgtactgatttgaaaggaggaaaaattagggcttctgaggtgtggctcaaatagtggttacatgtctgtgttcacttttgtagttcattgacagttatatttataatttgtacattttctacccacatattcactaaaatacttattaaataagtaaaatcatctttactgagataaatactaataaaaatacaacatttaaaaacatgtaggatgtagctaagagtattcaaagagaaattcatagccttaaattgcatatatgagaatagaagaaagggtaaaataaatgatctaagctcatctcatgaagctaaacaaaacaacccaaagtaagtagaaggaagaacacagtaaatataggcaaactcaatgaaacagaaagttaacaaaatggaaaaaactcaacaataccaaaagattttctttaaaagggttaatgaaactaataaaaccctagaaggcagtttaataaaaagggtgaaatatatgaagtatcaatattaattttttaaaaaggacatcatttttgatcctaaaaatataaaaagattacattttttaaactttgcccaaaaattttcaaaatttaaataaaatcatcaaattactcaaaaacacaatttattgaaataaattagaaaatatttgtatatgttaggcttttgctgagactatggcatgtaataaacaattctaaaatttaagtgacctataacaacctctcttataagtctgcagattgactatagatccactgatgtctgagatcagctagggttggctccagacttctgggttgggtttagtctgccacgtatttcctcaatctgaaactagcagcgatctgaggacaagttcttctcattttagatgacaggagaccaaacaaaatcactgaaacatatttaaagcttgtgcctgagtcacacagtctaatattctattggctagagtaagtcacatgtctaagcccagcatcaatgagtcagagaaatatactctgcttactctagagaaaggcatggcaaaatggcatggtttataattgtattaagaaggggaaaggatttggaaaaaaaatatatcaaagtactatagctgccccttgaacatgggtttggactgctgaggtctacttatttgtgaatgttttcagcaaataaagttggccctcaacatggacagtttttcatccacaaccaaatgcagatcacatacatagtactctggcctggcatagatgcctgtaattccagcactttgagaggccaagataggggaattacttggggccaggatttcaagatcagcctaggcaacacagtgagacctcgtttttacaaaaaatataaattaattaattaaaattagccaagcatagtagcacatgcctgcagtcccagctgctttggtggttgaggtaggaggataacttgagcccaggagtttgaggctgcagtgcaggaataccaccactgcactccagaatgggcaacagagcgaggaaaaaaatagtattacaggacatgaaacccgctgataggattgggagggttaacttttatctgcaggttctgcagagctaacagcagatttgcggatgtgcagatttttggtatccaaggaggtcctggaagaaatcctctgcagattccaagggatgactgtatatttatcaaaataataaattaataatttaaaccttctctcaaggtattttagacccaggtagcttcattgataaattcacccattcattttcagaagactctcttatataaagtgtttctgagaatagaaaacaagggaacactctccgaatcattttattaggccagcataaccttgataccaaaacctgatgaggacattacaagaaaaaaggataatagtccaatgtttttcatgagcatagactaaaaaatcctacatcaactattatcacagaaaatgaaatagactgtggtataacaatattatacatcagtgagaaataagctattgctaaacacaataatatggataacagattgttgaataaaagaagccatatacaagagtatatctggtattatttcatttatagaaagttttagaacaagaaaactaatctgagttgatagaatatcttgcaatcttagagagtattaattggaagaagaaaccagggagtcttctgcataaccagcaatattctatattttgatcagggtcatggtaacgctagtgatggcagtggtggcctgtctggagtggctgctgccatcatgccaggtgcagcagggaggcatggctggggctgcacattccacagagccagagggagccagggacaagtggcagccccactccttctgagttgttgaagcaggagcttcccaggtgcagctgcagatgcccaagccatcgatatggaactgggtctcacactctacagagcaggtaggagccctacccccaccttgggcacagctgcagctgctcaaaccgtgtttgcagactccctgcactcttgagggcccaggaaggccccctgccctcttaggcttgaaaatgcctactcccactgcctggcttctccctgctgtcagcacccactccgatctcagagtaaagccagggctgagcctgggtgctgttgcagtgcagccaggtgtgcacacacttgaggcagtgctgacacaccagccccctgccacctcagcccactccagtctttgggcaccaacaagcataggaaggaagccatggcagggctgagggcagctcatcactggtttgcaggcactccttggcacctaaagcctggatgtcatgaacagcagcaggaggcagacaggttcctgggcagaaggggccaggtccccagttagaccccaccttcaagccaaggagggcttaaaggttgatggccatgctgccagtcctgctgactagagggggaacttacggtcccttttctggacccacccatggccacccatgggccaatcagagtgcatcttctcccctctgaggcccataaaagccctggactcagccagaactgagcagacatggggatgactagctgcagagaggagttacccactacaggacctcgtctctgctgagagctaaacaatccatgtgatgaccagctgcaaagaggagctaccctctccagggcctcctctctactgaaagctgcagacatcaggattacctgctgcagagaggagctacccactccagggcctcctctctgctgagagctgaacactcaacatgatgacttgttggcagagaggagctacccactccaaggtcccctctgagctattctgttactcaataaagctcctgttcaccttgcttaccctccacttgtctgtgtacctcatttttcctggacacaagataagaactcggaacctgttgaatggtggggctgaaagagctataacacaaacaggactgaaacacatcccttgcttgccatgttgtgggcaaagaaaaggagaaaagagctgcggccctttgggaagcccagacctgggagctccctgagccacggctgtgactccctctttggggccctgcagttcctggagtctccaagcctccatcacatttcctggtgccagccatggaagttgcttgtgttgtgcctggtccagccacagccacacagagagccatctgtgctggcacttggagctgcctgcctcactgcagcagctggcatgtctgagtgtgtgcagtggtcggactccatgctcactcactcacacactccttgccactccacgcctggcttgcccttggcaggcataggatccaagccagtagcatgagccgagtgtagcctgccagactgagtaggcagaatgagcccagcaggcctgagcaaaactcaggcaaaggtgccactggtcacagaggtttctggccagaaaaacaacaacccaaggatcctataacactatttatttgtaaaaattcattgagttattatatacgtaaaatttgagcattttactgtatatatggtagtctccaataaaaaaagtttccaaaaaatttcccactaatatttatgactccctgaggagattctgaatatgcagttgttaatgtctctttgagcactaagtgtctgtaattctattgacaacttttactggctgattagaaattttataatatctccttaacaacagtagatcaacactaaaaacagcactaaaggctcaagataatatacaatgtatgtagaaatagttgtcaacagcttaagggagaaaaatatttgaaagaccataaattattttgaatggtaggcagtttcattgaaaatttctgtagtgagaggtaagtcagtgctttaattaggacaatagggtattttataccagggccaacaaaaaaaattaaagctgaaatattacaaagccctattagtagacgcagatatgatttttcagctctggagcagaactaaatctaaatgtcaactgaatgttttaccctctatggttttaaaggaatagaaatgccaacagcagagttcctgaagtttagagacacacaatttatgaagtactagagaaagcacaggattgagagtaggaaaatctgtgtgctatgtcacttagttgcatgtttttggaaaagtcatttaaagggtctgagtttttgttccttcacatataaaattgatattaatggtatgtaactcccaatgttatagggagactacatttcctgcagatgatttttgaaatgcttatctttagtttggtttttggaaacttcagaaatccacatggatccctctgggcaaatgaaactacatgctagaagttgtattctaagaatatgcttgtggaacacatcatggggaataaactgaggtcattctctttccaaaatagaacaattcttcctaatgaaaaactttcctctaagtttttgtttaaagtagagtgagggactgctacaggatcagaccaattcaacatcagctaagtcttcccaaactgattctctctgccaactgtggcatgcctatgagaccaccccaattttgagtttaattgtgctttcccacatctaaaaatggttttgaatcctatgtcactaagtcaatctctccaacctcatgtagcccagcttttccagactaagctctctatttctgccagatctggctcttcaacagccccaacatagctctagaatgcttttcctcctctgccagcctggttcactcctacgcatgttctgagactcagctgaggtgtcatttcctccgaggagctttatttaatcctcaaactcacataggtacctcctcttttctccctctgcaacctgtgcattctatcacagcaatcatcatgctttattgtaaaatacttgtttacttgtctgcatccctcatcctccaaaatggaacattcttaaggataagactttatttttctttgtaccctggcattcagtaggctccagttgtaatgattgctaaataaatgaataaatgtatgaatgcgtaagtgaatccatgaataaataaattaattgaatgtagaactattattcattccagcatccatgtctttgttctcatcacttaagtctccctggatttctcccttccacctacccaaatcctattcattcagtttctgttagagttctaccttgtacatactacagtgtaagcattgaggatataacaaaaaatgctatgtacccccactctccaggacctcacagtaggttatggaagaggtagatgtaaatagttgtttacaatgcagtgttaccagaacatggcagagtgacaaagtggagcctctgggatcatagaggaaaggaccaatgccagcctggtagatcagggatgttttcctaaagaaggctctctctgacttaagactttgaggaaaagtaagatttccaggtaaagtttggggatttgggataatataaaacatttcagacagaaaaactgtgaatataggtagagatgtgaaacaacatagtgtagtggaggaacctagagtcaaactaggaagtcagaagtaagactaaacaacctgtctaggatcagaatctattcagtgaaaaagatggcactagagcccagacttcctaatttcaagtgcagtattgcttctattaccccagaaaacactaccattagattacatttaaggagcttctgtgactctccaatggaaaatgcccaagtgtagcactttgtctctttagtgggtaggcctcactccccaggactctatttatatcaaatctcaggagattttagcagttcacctaactgttcaaagactctaacacagcaagacatctatagtttactgcaattctaactctgaagtgttcaagcctccatagcaacttggagtcatagtagtgactctaaagcaaactaaagaaagcccaaacatcacccactgatgactttctgtgacaacgtatctttgtctagagaatggcaactacaagttgctgaaatgtaccagagtaattgcgtattattgagataaatggtttgtcaactaagacccttaaaaatgtttcaattatcccaattttgttaaagtatctttaataaaaaaatgccacttactgcaatacatgatagctaatgcctactgttaggcattctgggtttatcagcattattcctaacaacaatgctgcaatgtgaacatcaatatctctattatacagttgagaaaatagaggttcagagaaatcaagttacattcctgaggtcacaaagcttgtagaggtggaactaggattcaaccttgagtatgtctgacttgaaagccagtgatagttctgataactcaaattgtgcagttgagctcatcctccttgtccctctaccccaaactctcaaatttaatgactattggactatggttaaggtatcatagaaaaagttccaaataaaagagtcaggagaccctagttaattaaccattactttctctgtgacttcattcccattgttaggagtatgtctaaatgatttttaaggtctctaatagttctgacagtctgtgactctgagattttaaaatatttttatgtaacaacttccccatggaaaggtcatagccctgaaaaggtcatagccctgtgagttgcctgtagtgggaagataggaggataaaactctcagagaaattgaattgagttctttgggtttatcaacatgaaaaataggtacctagctgccagaatgtaaaggaataagtccttgggagataaacttagttaaggcagagcctcttctgtgtcaacactgtcagcagcaacctcagtcaatgtcataaatgcagtgaagattctagaaaaatatgttgttgcttttgcagaagataataggaccttttaaccaagtggcacaatagactccacatttgatctgaacctaaagtcaaaaaagacccaatatcttactgtaagtatcttggctggtcagcatttttaatggttccttctctgcctatgctcaaggccaaaagcattccaaaaaatccaaggcagctcattccttcagcttaatttctccaaaatacaactttcatcttctggcttttctcatttttgtcaatccctagtttctattccattgtctcacatctggccaagagaatcttgcttcattcacttatttttaaaacatttattgagtccatactatgtgccagatacaagctctctgaagttagtaatagctgtgctgagatctgaaggatgagtaggatttattcaaaaacagattgagagcaggaagctaggagtggtgagaggccaggagggaggagaaagttacagacagatagaaaagtctgtgtaaaaaacacaggttaaagaaagagtgctcaagaaattaagagcagttcaatacagctagaatgtagaatacgccagggaaattgcaagggatgaagctggagaggtaagctgtggaacagagaatactgattctgccacttactagctatgtgaccaatctcagtttcttatctagaagatgaagacaatgactcttgcttcctgtagcacttggtttctcgcatttagtaggtgcttaaacattcactgaatttgattcttggaatggaaaggaaggacagaaactgaaaaagcataaaacagtggcatcggacagtttttccttatgtgacaagaaaaagtagactttttttgagtggtctagagtttcctaatctggcatccaattagatgacaggcccaggttcagtccaagtacctaagcctattatgatttcctaaaattcaaggcacagaatcaccctagcagcttcctcactcctcatgctgtgagttctgcacagagccctaagaaagttgtcagccatgagattcctttcacctccaatgcaaacacacatggcacaggcatatgattcccatctggatccgcccccaacttccggccaggaggctgctgtgtaggcaggaacgtctgcctttgaatttgctagcctaacctggcatcctgagccagcctctccaagcagtaacacacagacctggcaaaactcacacttctgtaaattcctttcagggtcctgtccatctctactacttccttgccctgtcagaagaagtcgacccaggccagggacaactttgctcataccaaacaagtgggtttttatttctgtagagaatggcagccttttctttaatccaaggaacagatgctggcccaggaggagaatgggctgaaagtcccacctatcaccctaaggccattagggccaagaattgttattcaaagcaacagatctcccctctccccccaggttccctgatggtttcagtgcccagctactgcagagttattaccgtcatcatctctgctggattctacgccccagtcaaattggcaacattccttctatttgcaaacagattgcaaaataagaaccccaggaaggatacaagctggccaggctccaaggactttcagcagcaatcatgctaaatcagggctgcatcttactccctgaacaacagcaggtgctggcactgcctcccagtggccctggatcattgaggggtgcctggcctctccttcctccctccctccctccctcctccttcttgaaaataagctgtctgggaaaaaggagagggcaaaacttgatgggaaattataagcaagaatacatcattggaattctaaactgttcacaaattttctgacatgggaattttatctccatgaagactgggttggcatatagcagcaagagaaactttctttgaatcattttcctccaaggttctaaaccttctatctcttctctgccttagtctgacattcatgatcctctgcaatctagccactcgtatgtgtgtcctgacttctctactgaactgatccttcttcttttgcccacacccttccctcagttacttgctttatcatcaaagacaaacaatggatacaacaacagtaacaatgaccattgccgtttactaagtccttattgtgtaacacgccataataagtgctttacatacattttctagtttaatcctaaaaaaaaatccaaaagtaggctgtatcaatattcccatatcacagttgaaaaaaaaggctagaattgtaagtaacttggcataggttataaagctagtatatgagatgtctggattgaaatatcatttgttacttgaaacaatttttctgaaatggatcttactttcccccctgtacagatgaggaaagatgtctataggtttaataacatgcctaaggtaacacagcttgtggtagaatggaactcaaaataagatctgattacgtagcctttactcttaaacattactactgtagatgggtattaaattagctacctctcttctttagggaagagaaataaatatctgtctcatctaactcaatggctcaaataagatagtgtcaatgaaaacatgttgtaaatagtatggcaatatgtgaaattagttacaattgatattactttagttcacatagtaaaaacattttgttcatttttagtagacaacttgctttttcttcctttccaaactgtataccttgtatttccttttctggtcctgtcacaatagctaggacttcccatacttacaatgttacatgggagttttcaggggagacatctttccttgttcctgatcttgaggaataaacattccatttctcaccattaagtaccaatgtaatctagaggttttctgtagatgttctccatcaagttgaggaactttctttctattcctagttttctgagtttttttttcttttaaatcatgaatgggtgttgaattctgtcaattttttttccatagcctgtctatgtggtactctcattaattttttaatgttgagccagttttgcatacctggaataaatcccaatgtataattcttttcacacatcattgtacttgatttgctaatattttgttgatgttaatttgttaatagtttgtttctatattattgaaagatattggcatgcaactttccttcctgtctttaccttcttttgctgacaatttgctttttatcatgtaatgaaggcaaatgttattctaccaaccatcctttggcaattttgttcttccccagaaataaaatttcggagtaacatttttgatctagtccataattgcagatgtagtaaaagtacaagagcagagactttgtagtcacacagacctgggtgtgcatcccagttctgtcattactctgtgacctgtgttagttattaaatctcagcagacctctgttcattaattggtaaaatgggaaatgataatttctttctgcaatgttatatcaaggatataaaacaaaacaaaaacagcctagatatgtggcattaaaacccaatgagataagggtaactttgtgtcattattttaaaaatccaatttagtaacaaaaccaaaggggtgtttttctgcttttatagcggttccctgaacaggagacccacaggtctccattaacagcctcagtatgcttatacaggggcaaagatgatttctcaagaacacaaatctcaccatgtctcaccccttctgaacccccttgaatggcttcctattgtctttaagacaaattccgatctctttaacatggcagtttgtgccctagatgatctttcctgcatacctctccagattaatctcttccatgcctgtgctctaatttggccatggaaaaaatagctagttcgttgtgctattctgcataaaatgccttctttgaactctgtgcctggctaattatattgtaatcctcataacttcactttggtatgaccctcctgtaggaagcctttcctgatcgtaagccatggttagaaattcttcctttgtgcttccactgcctatacttgcctctctcatagtttgaatgactgtgatttaactgtctggttataatccatttctctcactggattaagagctccttgaggacaaggagcatgtcttgtttgtggcatataatatgtgctaacataatgtttgaaaacttaataagaaaggtccataaatgacctttgattggtatgcattgtgaagcaggcattcactgatcagtatctctcaatttacagcatcatttcagctaggagctatcaaatgattctgggctgtgggacaattagaccctctactgattcctctccagaggaaaaaaggcagttagttcttcaatgcaaggtgaacctgaaacaacctttgcaaaaattataacagtgagagaaatttaacagaactgactccatcttgcttctaacatcacaagctaactgtctttgctaatcactatgtgtgggcttaactaactatgggaagaatttagtctatagtttaaggaatttagtttaatagtttaattttaaagcaagtatgctaatagtcccttcccaaagctaactccctccctgtttggggactgaaactgcctttgtaaaactaatgaaaggacacaaggttaaaattatggtaggggcttgaattctgctaaggtataggaataattaaacaatacctagtcatcgtttcctagtttgcttcctgctcaggagccaagtggctggtgggaacaagatttgtaaacttcactaattgcctctatagataacatcactattatgaaacctaagactgttgtttgagatattttttagaccttccattctggcagaccaattgacgctacccagaccgatgacccccacccaggaatggactcagcatgtgaagacattttcagcactgttgtgaattcatccccaacccaaccaatcaacagtatccattccctatccccctgcccatgaaactactgctaaaaactctagcctccaaattctctggaggatggatttgaggaaatatctcccatcctccttgctcagctgccttgttaaactttcttggatgcaacatctgctgtcttagtgattggttttttctgtgcagcaggcaagatgaacctgttgggctataataaaccttcctccttctcttctcctctcccccaacccttttttggattgcaagccatctgaggagtagtaattatgagaaaatctacactacaattattgtcacatttagctttatattgtcattaaaaaaaaaactcttgaaattaatgaacaattatgtttttcctacccttctttcacatgcactttttttttttctgaggcgtagtctcactctgtagtgcaagctagagtgcaatggcgcaatcttggctcaatgcaacctctgcctcccaggttgaagtgattctcctgcctcagcctcccgagtagctgggactacaggcatacaccaccacacccagctaatttttttgtatttttagtagaaacggggtttcaccatgttagccaggctagtctcaaactcctgacctcaggcaatccacccgccttggcctcccaaagtgctgggattacaggcataagccactgtgcccagcccacattttattttattttatttttatttattttattttatattttattttatttttttattttattttattttattttattttattttattttattttattttattttattttattttattttatattcctagagatatgtgcaggacatgcaggttgttacatagggaaacttgtgacatggtggtttgttgcatgtaacaacctgtcacctaggtattaagccccacatgcattagctatttatcctgatgttctccctccccctgccccctgacaggcctcagtgtgtgttgtttacctccctgtgtctatgtgttctcattgttcagctctcacttataagtgagaacatgtagtgtttggttttccgttcctgtgttagtttgctgaggataatggtttccagttccatccatgtcccttcaaaggacatgatctcatctcttttcatggctgcatagtatttcatgtatatatgtaccacattttctttatcctataattgatgggcatttgggttgattctacatctttgctattgtgaatggtactgcaatgaacacacttgtgcatgtatctttgtaatagaatgatttatatttctttgagtataataccttgtaatgagatttctgggtcaaatggtatttctggttctaggtctttgaggaatcgccaaactgtcttccacaatggttgaactaatttacattcccaccaacagtgtaaaagcatttatagttctccacagccttgccagcatctgttttttcttgactaataatcaccattctgactggtgtgagatggaatctcactgtggctttgatttgcatttctctaatgatcagtgatgttgagctctttttcatgtttgctggctgcataaatgtcttttatttatttatttatttgagacagagtcttgctctgtcacccaggctggagtgcagtggtgttatctgtgctcactgcaaactctgcctcccaggttcaagcaattctcctgcctcagcctcccgagtagctgggattaaaggtgtgaatcaccatgtcaggctaatttttctttttcttcttctttttttttctttttttcagtagagacagagtttcaccacgttggcaaagctgatctcaaactcctggcctcaagtgatccacccgcctcggcctcccaaagtggtgggattagaggcatgagccactgcacccaacctaaatgtcttcttttgagaagtgtctgttcatgtcctttgcctgctttttaatggggttggttttttctcgtaaatttaagttccttctagattctgggaattaggcctttgtcagattgatagattgcaaaaattttctctgattctgtaggttgcctgttcactctggtgatagtttcttttgctgtgcagaagctctttagtttaattaaaccccacttgtcaatttttgcttttgttgccattgcttttgacatttttgtcatgaaatctgtgtgtgtctatgtcctgcatggtattgcctagattttcttctagggtttttatagttttgggttttacatttaagtctttaatccatcttgagttaatttttgtataaggtgtaaggaaggagtccagtttcaattttctgcatatggctagtcagttttcccagcaccatttattaaatagggaatcctttccccattgcttgttttgtcgaagatcagatggttgcagatgtgcagtcttatttctgagatctctattctgttccattggtctatgacacatgcacttttttaactttaaaaatatcacttttaacacatgtcctaacagtcttgaatatctagattttatattttgtcttatgacacataagaggtattagactggactacaatatgagctatttagccagaaaacctgtgggagtttatcacttcaggaatccttgacatggtgtttgaagaaggtaggcaggtacaggggagagatctagaggtcacccagttgcagatggttatcaatgcccaactatgcctaaaacatgggtaggtggatgggacttgtaaacaggcaaaggctacagagaaaattcgtatttaatttgcattgtgaaatgcaaatttaaaaagtgtgtgtaatggcaatatcatattataaataaacttagaaatgatagacataattattactaaaaatatttacaagaattgcttttcaacaatggacttcactcagatgccagtatatgagaatattaagacatagtataaactgttatatttaatgtacccatatttggccacatattaattattgacaaatatgtatgttatctttgttgcacttacacatttttagtatgtaatttgaactaaataaactatttatgctatctgctgaacattttctatgtgccaaaactgttctacgtactttatagatattagttaatttaatcctcacaatgctgtaaaataagaattactgtctttacagaatagaaaactgaggccagagaggttaaataactaaaagttattaagtagcagagctgatacatgaacccaagcaatctggctccagtgtcaacatttataataagctacacttaatgaaattattttgttttgatttctggtattacactggcatctgttttaggcttctctttaattcagtcaactgacatatgtaatgagttatgtacatattatggaaaaggtgactgttttttaaaaagaaaccaattacagtcatcccttggtattagtggttgattggttccagcactgcctgcagataccaaaatccacatgcaaactcaaagcctcacagctggccctgtggaccctccagataccaaaagtcagctctccaaaaacacgagtttcacatgcctcaaatactgtattttctatccatgtttggttgctgatgtgaacctgcctatgaagggacaactgtatttgttgaaaaaaatccatatataagtgtacatatgcagtgtgaacctatgttgttcaaggtcaactgtattgtgatgtcattaaagcggatcagaataatatgatcaacagttacctgattgtgtagttgatattttttattactggtctcggaaagtaatatgaattaatcattcctttttttttttttagatggagttttgctcttgttgcccaggctagagtgcaatggcacgattttggctcaccacaacctccacctcctgggttcaagcaattctcctgtctcagcctcccgagtagctgggattacaggcaagtgccaccacgcccggctaattttgtatttctagtagagacagggcttctccatgttggtcagactggtctcaaactcccaacctcaggtgatccgcccaccttggcctcccaaagtgctgggattatagtcgtaagccaccgtgcctggccggaattaattattcttatggcacaacattgagctactttcagaattcacctttcttgtctcccttattcaagtcattaaaaaaccttttcatctttttcatctgaatggttttatacataggaggcttttacaatgcaagaaaaggatctgttcaattgctgagcatagacaatcctttacctgcatatttcctggttccaagaaatctaggaaaacacttttgcaatcccaaagggcctgttgtttccaagatatatacatgatatcctttatgataaaagcttagggattattggtttgcaaagaaaataaatctacttaagcttccttcagaaaagtgggatttattataagaatgttaaagatatcagtcctaaaatttgggcttcatgcttattgaaaaacaggtatatgtctgtctctttcctctcagcctctagtctctgctgtatgtttatttcattattctttctcttcaataaggttttctactcaactagttacttgcatgtgaacatcatagcctttacaaaatgtggtcataggtcccattcaactatactttctagttgcttctcccaatcaatcaatgaactctttaatacctagggactgaaaatttgattggctcagcttgggtcaggttaacaactctatttgtggattgacatcacgtgacacatagggtagtctcttctagcctgtgatgggttttcctagaagcatgtgtggggatagagaagaaattatggtaatttcaatgacagtgttattcatctggaaacttcaagtcatgggactatttatttcctgtttcagtttgaattgctttgagaacatgttgtctctggtgtcatgaagactgacaatcatgaatcactatggcaatttttatcatcataatcttgtactgtttgcccatttcagatgagaaagtggaggctaagaaagtttagatcacttgcactagggcaggatgaactcagctctgctgttctgtacactatacatgttgccttaaatgtaggcagattctctttatcctccaaatccacaatttggagtgtacaaattgcaataccaggtaaagttggaaagaaaaatttatctggaaagtgaatttcctatactcttgaacactgcaatcttataatgtatccttttttgtaaaatggaaagttccacatttggaaagtctggcccttttccaaaggctcacatagaaaccactgtctccaccactgaccactcctattcaataccctggccctcaacacgaagatccagttcagtctatttgacaaactccaaattctggctcatgagatgaaaacaaaaacaaaaacaaaaacaaaaaacaaacaaacaagcaaacaaaaaatagtctttggagaggaagagatctgggccagaattctggctttaccattcagaggttgtttagccttggtttctttatttgtaaaatggggccaaagcttgattccaatctaataggtttgatgtgaagactagagatactgtgagtaaaatgcctataacaataaatcatactgttttattgttttatgttgagaacatagaacatatttatgtactgaatatttactctgcaaatgcctactagtgctagtcaactagcctaacaatgccctaggctttctatgtgcattgctatcatgcttcagagatgcacacttgcctttgtaaccagccattctgtttgcaggagacacaatgttaattttatccctcctgggcctcccaagtaggtcaagaaaatgaacttaagatctctccaatctgatgagacacatcatatatgttcacacacttctgtgagaacacacacacaactaaaattactttatgtttaattcaatttaaacagacctgatacagtttggatttgtgtccccaccaaatcacatgcggaactgtaatccccagtgttggaggtggggcccggtgggaggtgattgaatcatgggggtggatttcccccttggtgctgttctcatgatagtgagttctcatgagatcagtttaagtgtatagcacctctctgctctctcttgcccctgctcctgaggcatgctcctgctttgccttctgccacaagtaaaagctccctgaggcctccccagaagcagatgctgccattcttcctgtatagcctgcataattgtgaaccaattaaatctttttcctttataaattacccagtctcaggtatttctttacagcagtccaagaacagactaatgcagggcccaaacagagtagtttaaatgttctattgattgtactatatacaaatctgcatgtcaaacattgttacatgtatttgggtaattaaaatgtagatatataagatagtctttaatgtctatgtaataattgatacatttcactgtaagtcaccagagagttctgggaagaggcaaaatgcaaggaaaagtatgctgtcagggtgaccttagaagattattcagttctctaatgttaacagctggtaaattgaggtccagaaaaaaaaaagaaatatactctaagtcacatggcaaatatagaatgaggaccatatcccatgtctcctatttctttgagcagcattctttataccagacaaaggactgataataggacactatttttcttcttctaacatttatatttaaagcctaatcagatagaacacttagggattagggacaatttaaatgatggaacagaatgagaaaaggcagggtggaaggaattataggatgtagtctggaaacagcaagtgatgcaagaggctgacgtttagactagcacaggtgggaggctaggagaataaaaagggtcattaactctattgagcactgtgtaataggccatgttttaaaaaactttacacaattaatctcactgaatcagacagattgcatccaggttatacctctcagactatgtgttccttgaccatagagaccattttatatgctgggtacatgagagcttttgagcacataccttattgacagtttgatattgaccaactcaatctaatcaccaatataaactcactgagaaggtagactatagtgattatagcataggtatagcagaaacaataaaaggctggaaggtaggaaatgagttgtggtctaggctcaacattctgtgtgacctttggcaagttatttcacttgcaaaaattaatttcattgctatatttaacactgttctactgttgatggcaatgattattgtattttttaagattatttgtgtacatgtacctcttaaggtagtgggttgaaaactttaatatgtttaagaatcacccaggaagcctataaaaatgcatacttgcagatgtaccctcaagaccaaaatatgctgattcactgtgtcaagagtggcgctagaatctgaattaaataagtgccataatataattatgatatttttgatactggtgatctgtagaccatgttttaacaagaactacctaattcaaagtataaccatccttgccttggctatcaggaagtttagtacagttttaagcttattctttattgcttacctctggttacttaatccatgttttaatggtcctattataacatcgtgtgtgtgtgtgtgtgtgcatgtgtatgtactgtaagtagcttatattctttccacaagtggtagacgcaaataataatgaaataaaattacatagtcactgatttttctggaagatgaaagggttgtattagataacccctaagtgactatcaaatctaataatttcactattatttagtttaaacaaatgcattaccaaagtcaatattaaatactaagtacctgcatatatcatgtactatgtcaatgaacaaaatagcaaaatagacttatcaacttaaatgttattttttaaaatgtagaggacacagggaataagtgtggtgagtaaagtgcatgtaggacaggtttctttattgaactcagaggtcaaagagatcctcacctggaggtcagttttaagcagagatttaaatggaggaattgggttagcaaaatagatatctaaggaaagactattccagataaagacagttaggaggatgactggaatgtgcaagaaagagcaagtgatgagtgtggcaggatcggggtgaatgagggacaatatagtaagagattgagtcagagaggatacaatgtgccagattaagtagtgtcttgtaagttattttaagatcttttgattctgagggaagtaggaagtcactggagagttttgaacagacaaatgatatgatctgacttatgttttaaaagaatagccctgattactgttttagcaatagattatcaggaagtaagggcagaaacagaaagatcacttgtgtggtggttccggtaatccagtgatggtggtttggactagggaagcatcggtggaaaagctaactggattttctaaaaaattaaatgaaacaagtaagaacttaaaatataaaagatcactgttaataccttgctctaactgatcagaaaatactgtctaaattgtggccacaatcaatggactcatataagcctctctttaatctgtttaaataaaataagctttgaagatacatggaatttgattaaggaagaaagattctggtcctgtggcattcctttaaggcactagggtgattctgcaacatacattactctaagactgtcacagcatttctgtgttcaaaggaggcagcagaaaactggctgtgaagttagattatatttactgaacactttctatgtgtcaggcattattctaagtaaaaaaaaactcaaaaaagtacgtctgtagtacacaatattaatattattccccaaactaggaataaggaaactgatgctcagagaggttaagtaatatgtacaaagccatatagtgcataagttggggagttgggatttaaaccaggcagccaggctccaaaatcttcatcatcaactattacactatattgcctccaaggcttctctaagcctctgttttctcatatgtatagttggcatactaatagtacctactaattgttgagagaataacaaaaattattatttagtccaagacttagtgatagatagtgatcggtattatcacatggtactacagttgatataaacaaattgcaatccttatttttgtctgttcctcaaatggttgtttcatttatcttatcagtaaattgagtctcaatgatccttaaatgttttaccatgccacagaggtagagaaagtggtaggatttgatgtcagatcttatgacttcaagatctttttcaattcttctcattgtcccttacaaacgaagaatacagagatatgcagggacacttaatgccatgtacagttcccagaaacactatttaaatgcctacaaaaaacatttgactaaatggaacctacatataagaataaatagcttccccaaatatgttctatacccagctccaaaacatgataaaaatactttatgcctaatagcaacaaaaataaaaactatatccaaatccacataacaaaaatgaagcatttacataaataaagttatccaaactatactttggaccaaaaaaagatgaggcactccatgttcctggatgcaaagaattaatattgtaatatgtaaagctgttcaagttatcctatagatttaacacaacttcaataaaaatttcaaagatatttttagaatataaaagaataattccaggtatcatctttcaaaacccaagaggacagtaaaatatccttttttaaaaaaagagtaataaagggagacttatgttcaaataataaaatatattacaaatctataggtgttaaaacaatattctaatactgttagactattggtacaaaaatagctataaaatggaacagtatagaaagtcctaaaaaactcattcacttactaaccaatagaaatgtattgaaataagtcccatatacaagattatggatttgaaaatttaaaaataaaacttttgaacatcaacaatactatggcaaaaggaaagagaaataataaaatgagacaatttctgctatggtttgaatgcttgtgccccctccaaaattcttacagaaacttaatccccaataccacagtattaagaggtggcacctttaggaagcaactaggccatggtggctctactccatgaataggattagtgccttataaaagggattgagggagtgcatttactccttccttcccttctgccatgtgaggacacaacatttgtcccctctggaggatgcagcaacaaggtgtcactttggaagcaaagacagagtccttatcagacactgaacctcccagcaccttcaactatcagcccctaaaactacaagaaataaatttctgttttttataaattacccagtctcacgtattttgttatgggagtaggaatggactaagacaatatccaattctataaaactgaaaaggaactcatttacttaatataaaaagcttttacttaagaaaaggaagtcacagactgggaaaaaatatttgcaaaaacaatatatcagataaagggactggtaaccaaaatatacaacatttcttaaaaccaaacaaaagaaaaacaacccaattaaacaatgggctacagatctgaatagacacctgaccaaagaagatatagatgacaaaaaaacacacaaaaagatactcaacatcatacgtcaattagagaattgccaattaaaacaaaaatgaaatacaactacacatatattagaatggtcaaaatctaaaacactgacaacaccaaacaccagtgaagatgcggagcaataggaattttaattcatttcttttttctttttttacatactttttttatgttctgggatacatgtgcagaacatgcaggattgttacataggtatacacatgccaaggtggtttactgcacctgttaactcatcatctacattaggtatttctcctaatgctatccctcctctagccccccaacccccaacaggccccagtgtgtgatgttcccctccctgtatccatgtgttctcattgttcaactcccatttatgagtgagaacatgcggtgtttggttttctcttcttgttttagcttgctgagaatgatggtttccagcttcatccatgtccctgcaaaggacaaaaactcatccctttttatggctgcatagtattccatggtgtatatgtgccacattttctttaaccagtctatcattgatgaacatttaggttgattccaggtctttgctactgtgaacagtgctgcagtaaacatacgtgtgcatgtgtctttagagtagaatgatttataatcctttgggtatatacccagtaatgggattgctgggtcaaatggtatttctggttctagatccttgaggaatcaccatgctgtctttcacaatggttgaactaatttacactcccaccaacattgtaaaagcgttcctatttctccacatgctctccagcatctattgtttcctgaatttttaatgattgccattctaactggcatgagatagtacctcattgtggttttgatttgcatttctctaacgacctgtgatgatgagctttttttcatatgtttgttggccacataaatgtcttcttttgagaaatgtctgttcatatcctttgcccactttttgatggggttatttttttcttgtaaatttaagttctttgtagattctagatattagccctttgtcagatggatagattgcaaaaattttctcccattctgtagcttgcctgttcattctgatgatagtttgttttgctgggcagaagctctttagtttaattagatcccatttgtcaattttggcttctgttgccattgcttttggtgttttattcatgaagtctttgcccatgcctatgtcctgaatggtgttgcctaggttttcttctagggttttcatggttttaggtcttacgtttaactccttaatccatcttgagttaatttttgtataagttgtaaggaaggggtccagcttcagtgttctgcatatggctagccagttttcccaacaccatcgattaaatagggaatgctttccccactgcttgtttttgtcaggtttgtcaaagatcagatggttgtagatgtgtggcgttatttctgaggcatctattctgttccattggtctatgtatctgttacttttttgtattatactgtaggtgctgggattcatgtgcagaacttgcaggtttgttacataggtatacacgtgccatggtggtttgctgcacctattaactcgtcatctacattaggtatttctcctaatgctatcacccctccagcccccatcccccaagaggccatggtgtgtgatgttcccctccctgtgtccatgtgttcttattgttaaactcccactcatgagtgagaacatgtggtgtttgattttctcttcttgtgttagtttgctgagaatgatggtttccagctccatccatgtccctgcaaaggacatgaactcatcttttttatggctgcatagtattccatggtgtatatgtgccacactttctttatccagtctatcattgatgagcattttggttgtttccaagtctttgctattgtgaacagtgctgcaataaacatacgtgtgcatgtgtctttatagtataatgatttataatcctttgggtacatacccagcaatgagattgctgggtcaaatggtatttctggttctagatccttaaggaatcaccacactgtcttccacaatgactgaattaatttacactcccaccaacagtgtaaaagcattcctatttctccagatcttctccagcatctgttgtttcctgactttttaatgatcaccattctaactgctgtgagatggtatctcattgtggttttgattggcatttttctaatgaccagtaatcacactacctgacttcagactacactacaagactacagtaaccaaaccagcatggtactggtaccaaaacagatatatagaccaatggaacagaacagaggcctcagaaatacaaccatctgatctttgacaaacctgacaaaaacaagcaatggggaaagctttgcctatttaataaatggtgttgggaaaactggctagccatatgtagaaaactgaaactggaccccttccttacaccttatacaaaaattaactcaagatggattaaagagttaaatgtaagatctaaaaccataaaaaccctagaagaaaacctaggcaacaccattcaggacataggcatgggcaaagacttcatgaataaaacaccaaaagcaatggcaacagaagccaaaattgacaaatgggatctagttaaactaaagagcttctgcacagcaaaacaaactatcatcagagtgaacaggcaacctacagaatgggagaaaatttttgcaatctatccatctgacaaagggctaatatctagaatctacaaagaacttaaacaaatttacaagaaaaaaacaaccccatcaaaaagtgcgcaaagtatatgaacagacatttctcaaaagaagacatttatgcggccaacaaacatatggaaaaaagctttaattcatttctgatgagagtgccaaatagtacatctactttgggagataatttggcagtttctcacaaaattaaatgtactcctacctatgatctagcagccatgatccttggtatttacccaaatgatttgaaagctgatgtccacacaaaaatctgtgcatgaatgtttatagcagctttatccataattggcaaaacttggaagcaaccaagatgtccttcaatagagtaatagataaactgtggtgcatctatttatacaatgaaatgtaattcagtgctacaaagaagagcgctatcaagccatttaaacacataaaagaaatttaaatgcatattgctaagtgaaagagacaatctgaaaagggtacatactacatgattccaactatatggtattctgggaaaggcaaaactatgacagtaagatcagtggtttccaggggttttggagaagggagggagaaagggacgaataggtggagcatagggaatttttagggcactgaaacgattattctgaatgaaactgtaatgatagatatatgttatcatacatttgttaaaatccataaaatgtacaacgcagagtgaatcctaatgtaacaatggattttatttaataacaatgtatgaatattgactcatcagttttaacaaatgcctcacactaatgcaagatgttaataacagaggaaattgaaggagtggtgagggggtaaacaaaacatctgtaaatttcattcaattttttccgtaaatcaaaaactgcttgatgaaaagtctattagaaaaaaaagctctcacaaccaaaaataaaatcatcacaattactcaattactgagagagagagagagcatgaacgagagttgcaaagcagaaaaataattaaagcaacaaaaaactataaattgtcattactcttactaaaaagtttagcaaagccagtaaagaaagttaagtaattaagcaaagagtattatttaatgttgataccaatcagagagattggcatatttatacacttctggaggaggtataaaatggaagaacttggagggcattttatttacatgtctcaaaggtgttttaaatatacataatctcaattttgtatctggaaatttgtcctactaaaataatcatgataaatacaaaaatgcttatatcactgtttattatggaacttaattatcccaaactaaaggataggtaaaataaattgtgatgcattcaaacaatgaattcctttagaagcaccttagaaaaaaacatttaatgtataaaaaaaatttaaggatatattgccaagtggaaaatagagcaggtttataaaattgtatccttttatctaattattaagaaaaaaacatatatagcattttacatttttgtctctatatatctctatcatccatctatctgtttatatctatgtatggagagaaacaaaaaagtaaaattacaccaacatgttaactttgtttatgtatttttaaattgggttatgagccggattttttgttttcgtctttttggttatctatattttcaatgatttctacaaataataggtgttgttttgtggtaagaaaaagtataatgtagtgtttcagataaaagtttctggagtaatcctaaatatacctcgagctatttactttgcctttctaagcctcagtttgtacatctgtcgaatgcgaatattttgtggaataagtgagacaatgaatgtcaagcatttaagcatttaatacatgcctgctccagaataagtgatcaataaacatttaatattattaatatatcatcatcatcattataaagggaactgagaattaaggaagaatcccaaagtgcattcaattctactgagacattatattcaggactaagaggaggtaggaaataggcttagagatccccataattatacaatgaaacaatcactagagcctttctggacttctgttcctgtaaatatagaagactcaatgcaaattaaaaaatcactctccaaacaaatccaagcagacatgaaagagcaggcaggaagtctgtgtgttgcttcagttacacagtgataagtaagaggagacatttgaaacacccctttcaaaaatctaacatctttaatacaggatagcataacactgaactttgtaaagatgtcagcttcaactaatattataattactgtatatgtcttgctcttatgagggttttgtgtagaaataattttatttcactttgtagttctttatttgaaaaaagcgttaaaaccacattaccaaaaatagtcaattatttattgttttaaattataaaatcatattctcttgaatttccatagctcctcagtgccattgggcaaatatgagaaaacagattagccaacaaaatttttaaaagatagagcttcttaatcagctttgcagaatgacagaaaagtatatttaaaagtcatgaagccctaggaccaaatcttgactttttatttaatagtatttattatgtttaaggccctcatatacccttacatagctatgtaatcttgggtaagttacttagttttcctgaactttagtttcctaaactataaaatataataaaatatttttattcttattttgaggattagaaataagcttctattaatcccaatattaatatttggacaaaacacaaatgcattagtttatggcaggaatacaacatacgggaatatttaaatgcagatgatgatgatgatgatgatgatgatgatgatgatgatgacggcaatgatgatagcaaacacatggggcttattgtatgccaaacactattctaaacactttatacatataaactaacttaattcccatagcaacattaagggtaggaaactgaggcagatagaatttagagaattcctttaaaagaatctagtaaaaaacatttaatgtatacaaatatttagaatgtattgccaagtagaaaataaagcaggcttataagatagtgtaaggtaaggtaaaatagtgtaagtatctaggtaagagctagaaagttatgaagccagattgaaaggcaggcaatctggctgtagggttgttgttcttaagcactagactatagggccactctcttatgcttagtctcatcctatatatggagctgtgtttatgagccatttagaaatgcattatcttacaagtatcttgcttacagaaaatgaatttttccttgtgatatgtgagtctacctactttttccattttgcccagggttaatgaactgcatcaagatccagaaagagaataataaaaggagagttgagttccaattgcctaggaaggctatgacaacacttcacctgctggacttgattttggggaaaagacagggttagattggctctaattataatagataatactaaagtttttatttatgaaatatgtatgtacaatgctgaacactttatatgcatgatctcatttcattctaatgacaatccaataataccagcatttctatttcatgttacagatgggtaagttgaaaccacgactaacttgttcaaatctgtatagccaataaatggcaaaatgaaggtatgagttaaactctatttgacccagaagactttaaacctgtttcactatcacaccaggtcatgagacttatgttcatataaaaattaaaataggtatggttgtgagaaactaaaaaaattacaatgtcattaacacaataaaagtttatttttctcacacatacaaaaagtctggaattaggcactctaggcttggtgtggtgactccaccattgccagaactcagcctttttctatttttctacccattatccttactatgctacctcctagttcaagatggctgatcaaactccagctattatgtccatatcccagcctacaggaaagagaatggcacaaagtaggatgtgactcctcccttaagaataccagtttctcaaaaaactcatagatacagtcttagtctgttttatactgctataaatatacctgagactgagtaatttataatgaacagatatttattggctcacagttcaaatcaaggttccagccagggccttcctgctgagtcatcaaatggcagaaggcaagaggaagaagacagagaaagaggaggctaaattcatccttccataagggcaccaatctcatttcttaggctgaagccctcaaggcctaatcagcttttaaaagtcccacctcttaatactgttactgtggtaattaaatttctttctttctattttttttaaggtagggtctcactctgctgtccaggctagagtacagtggtaccattacagacggttcactacagcctcaacctctgggctcaagacatccttccacctccatctcccgagtagctgggcccacagacgtataccactacacctggttgatttttgtattttttgtagagacagggttttaccatgttgcccagctggtcttgaactcctgggcacaagcaattcacccacctcggcctcccaaagtgttgggattagaggtgtgagccaccatgcccagctggtaattaaatttcaaaacaagttttgaagggaaaaaaaaaatttaaaccatagcacatatgctgacatttctctagctatgagagtatggagactgcagtctttgttcagagagtgatctacacagctaaaataaagggttttactattaaggaagcagaggagaatggacagtaaagtagacaagtagcaatatctgctacagtgtatacagagaagaagaaaatgacttttacatctaattcaatgtagtgtgaaacagaggcagtacacacaaggaagaatccagagccagaggtaactatgaaaatgcgagatctcctccaaggaaacttcacagaaatcttggaggagcttagacttccataggatgtgaaataggaatctaaattagttttagctaggtttcaataaactgagagacacccctcaccactatcaccccaaacaggaggtgagtggctttgaggagcgtgactcaaagtaaacaacttctgccttaagatgtgtattagtccattttcacactgctataaagatactacctgagactgagtaatttataaaagaaagaggtttaattgactcacagttcttcatggctggggaggcctcaggaaatttacaatcatagcagaaggggaaggggaagcaaggcatgtcttcacaaggtggcaggagagagaaagagtgaaagtagaagtgctacttttaaaccatcagatctagtgaaaactcactcactagcaggataacagcatgggggaaacagccctcatgttccagtcactcccacaaggtcactccctcaacatgtggggattcaattgaagatgaaaattgggtggggacacagctaaaccataccaggataaataatcttactcactagtgcagtctctgaggttacctccactttgaatctgttaggacctacagaacctacttggtcctccctgcctttgaccccatcccaggcccagatttactgcctgaacttggggattaatgctatatccttacaccctagaaaagtttctgttatacagtaagcactcaaaaaatattttctaagttaaatttaaaaatatatataaatcaagatgtcaaacctcataatcagacaaccataaattaaaacaatgagatgcccttttctactcatcaaactgataacaattaaaaagcatgataatgttaagtgctggtcaaaaagtatggaaaacagtattctcatacactgccagtaagactgtaaactaataatccagtttggaaactatatggcagcctctaatgaaatagaaaatttatatatcctgtgacccaacaatcccacttctaggtatatgtcttagagaaatgctcacatatgagtaaaaactaccacatgcatatgcttaatgcagcatgattttcaatgtcagaaaaactggaaacttgttcaatgtccatccataggagaaagggtttataatgtgttatgttcatacgatggaataatagctaagtgcttgagacttctattactcactataccgagttctcctttccttctgaacatacttctatatatcctttgcattcaggtggggtaatgtgattatcgttggccaataacttatgaatggaaatgacacttctgcactgaagcgtttaattgcttatgtgagaccctacagctttcttttctcccactgttgtgattgaggaggttttatttttcagatggtgtactacaaaaatggtgaaaacttattcagcctgggccctgagtaaatttttagagcagagcatgccaccaacccaggttaatcctggttatttagcaggaataagaaatgagcattgctctgttaaataactgagatttggggaaccaaacctttcctgattaatgaaaaataattaaggggaacagactagagcatagctagttttagtttttgaaactacacagttctcagaagcatatgtagaaataaataggcaaattccaaaatagtttttatagcatgatgttatttttgtaaacacaaaaccatacacacattaaaaaaatgccaggtgattgtatgtggatgaaaatcaatgatacatgaaaatggacaggaaggtaacataatcttcagtgaatgaggataagaaatgagactctttttaaataaaagccattttagctatgtagtaggttgaatgacagtcgtccaaaatttatgttcacatccaaatcactggaacttgtggatattaccttatttgaaaaaagggtctttatagttgtaattaaggattctgagatgaaatcatcttagattatccagtgggctctaaatccaatgtgtcattataaaaaacaaaaaaggaaaaggtgatgtgaaaatgaaggcagaaattggagtgctgtgaccaaaaagctaaagaagttaaggaatgcttggagccaccagaggctgggagaggcaaggaaggaatctctcttacagcttccagaacaagtgtggccttgtgaacaccttgacttcagacttctggcctccagaactatgagagaataaatttttgttattttaagtcacctggtttgtagtaatttgttgcattatcctgagaaaactaaatcaatcagtaatgcctcctttctcaaaacaaaataatgggaagcaaatataacagaatattagtggctgttaattctgagtgggaaacaagtatttttgtaatatttcttatattgtcctacattttttaatttctcaaaataaaatttaaaatgaatttttaacttggattatattgtaaaattaattacagtttgttgcataattttatgcagttaactgctttgtaaatgcttaaaaccctgacaagagaaacagttttgattgtaaacacactcattgtaaatggtccaccattacaatgactttcaaggcctttcacatttgacttccatctcattttatagttttaatgcttataccctacaaactcctgacacacaccctatgttctagagtacctacactttgccacacaggagatttttgtttttgtttttttattttgagatggagtctcttgctctgccgccaggctggagtgcagtggcaccatctcagctcactgcaacccccgcctcctggattcaaacacttctcctgcttcagcctctctagtagctgggactacaggcgcacgccgccatgcctggctaattttttttttttttttttttttgtattttgtagagacgaggtttcaccatgttgcccaggctggtctcaaactcctgggctcaggcaatccgcccgtctcagcctccctaagtgctaggattagccacacaggacatttttaagtcttcatgacttttctcctgctgtttccatcacttaaaatggccagcccctaaggtggtggcgggtgccggtagactgaggcaggagaatggcgtgaatccaggaggcagagcttgcagtgagccaagattgcaccactgcactccagcctgggtggcagagcgaggccccgtttcagaaaaaaaaaaaaagcccctaaggcctggcaaactcccactacttctagatccagttcaaaagatacctatagaggaagccatctctgattcctcagctagaattagtttctcctttgtactctcttagcatttagtttataatgaattctaatattttagttgctttttccctgacagtctttgcctctgaaatagaattagtcaaaactgtaattaattacatctatatccccaataactaacacagtgcctgacacagaccaggattccagtgaatgctagctaaacaaattaacgaataaatgactttcataattcagtgcttcttatcctgaatttctatatggtccaaacatcacaacctattgtcaatttaagaaagatatctatctgccgcaaaacaaattaacccaaaactaatttctatctaacagcattaatcaccagagaatgtcttctgaagaaaaaagagaaactacctcagagctgctttaacaacagaaaattcatctcaacccctggctatgagcccatgctcactgcattgggttcagcacagagaccagcactctcatggcattctgaataattatccaacagagcttggcactctctccagcagcctgacctacaacttgtattctgaagaaaaaaaaacacacaaaatcaaaactgagccacttttgtttgctttattagaatatcagagggagaaagatgttttaaaaaatcaaccattactttcctcctggcaccaagactgccttcccaaatgtctgtgtttacagggcattagaaagtactgaatttgtttccttaaaataaagtgagtcctagaaaagcaggtatctaggagtgaccttcagcagcatagaaccaggggaaaatcacagcatctgacattattcctccatctttacattcaacaatgtgtttgttgcagaaatctctaaatatcagctccaattggcttctctcacactcagaagccttcactgcccactataatctatacatttctgaacacttctaacatatttgccttagtatctatatatatatccagtgtttatcacagtgagtgacacatagtggtctgagtatgttgaatgaatgagtaaatcaatgatcacacagtccttatattaggaacatggagagaaaaaaggaggaatattgtcatgttgacttatacaaataatctcaaggaatttatccataacttttatcttaatatatcagcactctttcactttcttctttttttttgagacggagtctcgctctgtcacccaggctggagtgcagtggcacaatcttggctcactgcaagctccacctcctgggttcacaccattctcctgcctcagcctcccaagtagctgggactactggtgcctgccaccacgcccagctaatttctttttgtatttttggtagagacgggttttcaccatgttagtcaggatgatctcgatctcctgacctcgtgatccaccttccttggcctatgtttttcttttttaatgaagataacttacaaacaggaaagtacaaaaatctttagtggcagcccattacatttttgcatgtctgcttcttaaggaaaagtgttagcatctcatgatcatttaatcccattaactcccctctaccttttccgctaccactgtcaaatatataacttctacccatgttataatacccagaagccattattaccactgttgttttaaaacagtcaatatcccttttcttcatatatttaccatttccattgcttctcattccttcctgtggctctgagaatttttgagaatttatgaaggacatttaataaccgattcaagaaaccatatgttgaaagcaaaataaatacaaaggaaattatacttaggaacttgatatagtttggatctgtgtctccaccaaatctcatattcaattgtaatccccaatgttgcagatgcctggtgggaagagattggatcatggggatggatttctcatgaatggtttagcaccatcgtcttggtgctatctattctcatgatagtgagttctcattagatccgatcatttaaaagcatgtaggacgtcccttctctctctcttgctcctgttccctccatgggagacttttcagtctgcctttgccttccaccatgaatgaaagctttctgaggccccctgagaagcaggagctgctatgcttcctgtacaacatgcagaaccgtgagccaattaaacttattttctttataatttacccagtctcaggtatttctttatagtagtttgataacggactaatatagaacttcatagtcaaactgctaaaactcaccttggatcatttgtctttaccctgaagaacttcctttagtctttcttgtggtccaggtctgcaaggaataaattttctgagattttgtttactttcatttttgaaggatattttcactagaaatagaatttctaggtttttaaaaaaattcccctttgagcactttaaagatgccaatctattgtcttctgacttctaccatttctattgaaaggtcatacctattttactcttgaagattattggtcttttatccagggctatgtttaagattttccctgtcatgaggttaattcttcaagggaatatttgaatagatagcctaaagcttagaggagagacattttggggaatcagccatgagggtgaatgagattatccagggatagtataaagagaagggaaggaaaataattaaagaaaaggagaagatagggaaatatttaggatgcaataaaatggggaggaacccataactgacacaaagaaagaatgagagaaggaagagattaaggattatatggtatcttgaaaagaagggaatagagtcatgaagaaggaaatcatcaacagtgtcaagttatgaggcagggttcagttagatgagcataaggaggcattctttacattaggaaaaatagaaattactggaaaaaataccactgtatgacattttgtatggtttcttattgctcctataacaagttatcacaaatgtaatggcttaaaacaacccaaatctattaaacagttttgaaggtaagaagttctaaaatcaaggcattgacattattacattgcttctggggctctaggggagaatctgtttatctgccttctctagcttctagagtctacctgcgtttctggcttgtggctccttctatctttaaggtcatcagcagagcatcttaaaatttctctctctctctggcctttctgcttctctcatgtctcctctgactttaaccttccagtctccctcttacaaggacccttgtgattatattaggcccacttggataatccagcataatcgtctcatctcagaatccttaattgcatattcaaagtccctttgccatgtaaggtaacatatttaaaggctttggggagtaggacatggacattttgtgggggggccttgcctaccataatcatgtcacatcacctcttatctgcatctcagttctcttatttgcaagatgagcataatttactaaacaaactaggctgctgaaagtattcatttaaagtaagttgaatcctggggttcaaggcagactattatcttagtccattcatgctgtcataccaaaatcagagactgggtaatttataaacaatagaattttatttctcataattttgaaggctgggaaataaaaaatcaaggccccaacaagaatggggttggtgagggctgctctctgcttccaagatggcgccttgctgcagcatcccccagaggggagtaaggctatgtcttcacatagtggaacagacagaaaagcaaggtagtgctcccttcaacctcaagctgtcttatagaggtgctaattccattcataagggcggagtcctcatgacttaatcacctcctaaaggccacatctcttaatacagttgcattagagattaaatttcaacatgaattttggaaggaaaaccatcattcaaaccatagcaagtcattaataaacagtggttaaaactgaatcttaatttctctgccactgatgggagatgatatgggaagagggagttatagattaggcagcatgtcaaggtaatatcctggcaaataagctacaggtgttttaaggacagggttccctaacaggtgagaaaaaaagagacatttccgttttgaaaaaggagacaaatattccctagcaataagctcaaatgtctctcagcaaactgtcctgcaagaaaggaaattaacaacaacaaaccaaaggtgaaaggaactggagagagaaataagcccacgtgtaatcacctgggaatctgcagtcccctgatctcctgaggccatgccttccaagatgaacttaagaattgctagacagaaaatgattaaaaataaaaaaaggcaatattatcttcctgttcatgattttggtttccatttcaagtttcaatttcacttgaacagctatagtcctctactgaacaataccaatattggttataataagtattagtggaagagaagagggctctggaatgaagaaacatggaatctagttccaagtctgcaactaatttactgggtaattttaagcaaatttattcttcttgtcttggttttctcacgtataaaccaagaactgcactgagctaacatgccatacacttttattaatggggtctagtcctctctttttctcagagatctcatttattttcatgactgtgatgtcacttctatattaataactcccaaataatgctatcctttcactagcaatcagagttgtagcttcaactatccattaacaatttctacctggtcattctgctaccacctcacactcaacatgacagaaacttcattcaagtgccttaagtccatgtgcttacctatctcattttagttccaactattccccaataccttccacttcatgtaaagtgaatagccattcaccctccccaacaaaccaactcctgttatcccatctcaatattccagggatctttatttgtttatgttatctctgcatggcatgcagtgccctctatccttgggccatcttagtgtaggatcttaatttcctataataatcatattaaaaattatgatatatgtgcatttagtagaagtttctgtactactaatctgaataatgaattgacttattgtgtcactctggaccagctataatacctctctaagtggccaggctcagtggctcacgcctgtaatctcagcgctttgggaggctgaggtgggaggatcacttgaggtgaggagttcaagaccagcctggccaacatggtgaaaccctgtctctactaaatatacaaaaattagccaggcatggtggcacacatctgtaatcccagctacccaggaggttgaggcatgagaatcgcttaaacctgggaggtggtgggtgcagtgagccaagatcgcaccattgcaatccagcctgggtgacagagggagattccgtctcaaaacaaaacaaaacaaaaacctctctaagctgtctaagctacagctctcccaacttaaaaaaataaaataaaaatgtgccgggcgcggtggttcatgcccgtaatcccagcactttgggaggctgaggcgggtggattgcttgagatcaggagttcgagatcagcctagccaacatggcaaaaccccatctcttctgaaaatacaaaaattagccggacggggtggtacacacctgtggtcccagctactcaggaggctgaggcatgagaattgcttgaacccaggaggtgaagtttgcagtgagtcgagattgcaccactgcactccagcctaggtaacatagtgagaccccccgccccccgccaaaaaaaagcacatgtgaacacatgtgaacattcctcatgctattttctttgtctatcaaaattctattaatctttcaagtgtggcccattaatgctagttatgtgaaatctttctgagtttgtcattaaccgtggaaatatactgacagttggaatgtgataattctctacattcacactctgcatctacataatatcacaaggtctgtcttatatatatttacttgagaacatatgtatctttctctcccatcagtcagagactatgactgcatctgcagtgctctgctccatgcttgtcaacaaagaggcaatcagaaaatgcttgttgaatgaatctatgaaaaacacggaatgaaaagaaaggtgaggaaattagacatccatgttttatactcattgtgatatttcctatttggaaccaaaaatgtagctacataacctcctttaaaattcttttggccagacatggtggcttcgcacctgtaatcccagcactttgggaggccgaggtgggcagatcacctgaggtcaggagttcaagaccagcctggccaaaatggtgaaaccctgtccctactaaaaatacaaaaattagctgggcatagtggtgcacacctgtaattccagctacttgggaggctgaggcaggagaactgcttgaacctgggaggcagagatggcagtgggccaagatggcgctccactctgcacaagtctgggtgacagagcgagactgtgtctcaaaataaaataaaataaaattcttctgagagaaaaaaagaaaatcccatgacataaaagcatttaaatgaagtttggagtttcatttgtcttttaggctccaagtctaataatgctatttagcatttctatagtatttaacatttgcaaagcacagtgttaattaattaatcctaatgttcataaggcaggtcaatattatgatccttcctgaaaagttaagaatatgaaaattcaaaggtatcttgccttttccttttagaacatgagacactgctgaatattattacaaatataaaatagtgttttggaatagaaattaataaagttcagaaatgaagcaaaggggtgaaggggccaagatggccaattagaagcagctgctatgggtggcgctcatggagaggaattaaaggggcgagtaaattcagcacctttaattgaaatatcctggtactcgaattaggcctgatcagggaaacaacttgacccatggagaacagaggaaagcagggcagtgcgacggcccacctgggagcaacacagagacaagggaacccccactcccagccaagggaagcagtgagtgaatgtgtgaccccaggaaactatgcttctcccacagatctttgcaacccttggttcaggagattccctcgtgaacccactccactagggtcttgggtctgacacacagagctgtgtggagtctcggcagagctgctgctcaggcatgcacagagacccaggaggtttacttactcctaccccaggaccccagagaaaggtaactgcaactcaggcaaggcgggaggtctgcacataccctctaggaagggagctgaatccagcgggtcgggtcgagcagcacccttctgcgggccccacttccacggcacctcacaagataagaccaactggcttggaattctagccagccaccggacacagggtagtgcctgcctcagaagggactaaacccttcaggaggagggacaagccgccatcttttctgtttggacgactcagccattccagcctgcagactttggagagtccaaatagtacagaagaaaaagggatcccccaatacagtacagctgctttaccaaaacgtctgttttaccagactgcttctttaagcaagaccctggtccattcctctttactgggtggggcctcccagcctggcctccagccacccggcctgtattctagcgacagaactctgatctctccctgggacggagagcccggcgggagaggcaggctgccacctttgttgtttggatgactcaaccagactatcctgcagacttcagagagcctaaatggtctgggtgtggaaggtaacacagcacaacacagcactgaaccttttacaaaacatggccagactgcttctttaagtaggacccaattcattccttctcaggacctcccagccaaggcctccagccacccttacccatattctagacatagctctgatctctccctgggaaggagttccggcggggaggaggaggccaccacctttgctgtttgggcgactcagccattccagcctgagggctttggagagtccaagctgaccagggcagaggtggttcccaagcacagaggggctgctttgtctaggagagagaggcaaggaaagagggaggctagtttgttagttgtttgcttttctcccttcctgacctctgaccacatttgaatgcccttttgaaaatgtctacttattcaggatgaaggcaagtcttataggtgaaaattcttcagtatagaatgataacatttctgaggtgacaatgttgatggaagaaatggacaaattccttggaaaatacaacttaccaaaacagatttaaaaagaaataggaaacctgaataaacaaataactagtaaagacaattaataaggaatttaaaacttcccatcaaataaaacaccaggccagattatttcataggtgagttataaccaattttcaaggagcagaaacccacaaagaatggaaatggtggaaaacttcattgttccataaagtctgtataagtctaatgccaaaaccaagaaaggacagtaggagaaagaaaaattatccatctatcccactcctgtatattgttgccaaggattttaaacaaaacactagtataggatattctcattgtggaataatatttcacagggaaaataaattaactttagtaaaacccaatgttataagtgaatcttagtaacatcaagtttaacaagccagtttcagaagagtaattattacattatactgatgttacaatgctccaagacaatgaaaattaatatattatttaactatacatacgtacctgaaaaaactattttaaaaacataaaattctatttctggttctagatccttgaggaatcgccacactgtcttccacaatggttgaactaatttacactcccaccaacagtgtaaaagcgttcctatttctccatatcctctccagcatctgttgtttcctgacgttttaatgatcgccatactaactggcatgagatggtatctcattgtagttttgatttgcatttctctaaccacaagtaatgatgagctttttttcatatgttttttggctgcataaatgtcttcttttgagaagtgtctgttcatatcctttgccaactttttgatgggcttgttttgttcttgtaaatttgtttaacctgcatgttctgcacatgtgtcccagaacttaaagtataataataataataataataaaggctgggcgcagtggctcacacctgtaatcccagtactttgggaggccaaggcgggtggatcatgaggtcaggagatcaataccatcctggcaaacatggtgaaaccctgtctctattaaaaatacaaaaattacctgggcgtggtggcgcatgcctgtaatcccagccacttgggaggctgaggcaggagaatcacttgaacaagggagtcggaggttgtagtgagccgagatcgtgccactgcactccagcctggcaacagagcgagactctgtctcaaacaccccccaaaaacaaacaaacaaacaaaaaaaccataaaattcaggataattattctgaggagcaaaagaacgattcaagttattgatattgttcttttccttagattcgatggtgggttgagtagtcttatgttatttaaaaaataaataaaagggccataaatagatcaataatgacagtatatatgaaacaagaattatgatttatctaattcagcacatctaaagtccttataataaatttaaaattaaagactgggtttttcaaggccaggaacatgatggtcgagatgacagaaaggactcaggctaaccctccttgttcagtttggccatggtaaactcaatccaactggaaaaataccactatttaaatttgtgggacttccatttataaaaccctatcataaaatctgcccccagagaactttggttaagcctggataaccacaggcttcccaaactaagagcagatgcaggctcctacaattgaccaggtttcagattgtaatgaaataggcaagttaagaagcctaggtttaattctgtctagacactatcatctgttgcttgtgtagccatgagtaataattataattataagcatccctgaagtcatgtgcaagctgttaaagtacgttcatacacattgtttccattccatactgacaagcctgtacagtaagcatggaaactggcatggcaagtgctgttatttaagtacgtagataaggaaactgaagcataacaaagtgaaagggaacacagtaaaaccagaacccaaatccagttccttctgattccaggtctagtcctttttctactatatcaaatgacctcatacttctcttttctgaaactaaaaatttggaaggtgatttgacaatttacatccttgaaaatattcatacgcattgactcatgacacttcaagaaatcatactcaaagatttaacatgaaaggtgccaaaaatattactacctaatcattattattaatgatagttatccataatggcaggtactaagaactacatagactgtcccagctaatccgagtgttagcattcacactttataaactaggaaataggtgcagagacttttgagttaagatttaatgaagatcgtatggtcagaaattaaacccataggctgaatctgaagcccatggtcttcaatattgtattaagtggaatcattatggtcacaagtgattctccctaggaattaggctcatagatcccctaccaactatttggcactgtagcaagactgtcagccagagaaagcattttaaaactccatttatagccatgtgtggagggacaaagaggggtccaggggaagacagtgaagtgtggcaaaagaaattcctaccacaagcagattttattgctgagcctggttttatgtccaactgatagtcaattccagtttgaagctagggaaggcttggagttcttgtcaaataaaccagctccaccaatttttctgtgttacatttggtaagccatttaatctctgaatacacacagacactggtttccagacatatattcaactgcctgctggacatatacactttattgtctaataggcatcttagacttcatatggccaaaacagaatttttgatatatcattctcaaaatctgcttctcccacagccttctccatttcagtaactgacacgacacaaccattcactccgttgctcaggtcaaaagcctatgagtcattttttatttcttctttctctcaaactccacctaagcaagtcatgttgacgcaaccataaaatatattcaaaacctgttcacttctattattatcactcttatccaagctaccatttctcatctggaccactgcaactgtttcctaactggtcttttaatcttttctgtatataattcattctctacacactaatcagggtggtttttctgtaaacataagtcaaattgtgttatttcactgcttaagacactctaatgatttcctaacacacgtagaataaaatctgaacttttttttttctttttttttgagatggagtctcgctctgttgcccagcctggagtgcagtggtgcaatcttggctcactgcaagctccgcctcccaggttcatgccattctcctgcctcagcttcccgagtagctgggactacaggcacccgccaccacacccggctaattttttgtgtttttagtagagacggggtttcaccatgttagtcaggatggtctcaatctcctgaccttgtgatccgcccaccttggccccccaaaatgctgggattataggcgtgagccaccgtgcctggcctaaaatctgaactttttactttgtactacaaaggcatatgatatctggccttgtgtaacttttcaatctcattttagacttatcttcccatcagacactactctctcactacatttgtgtgttcttttttcctaaatggcatatgttagtctgggttctccagagagaaagaaccaatatgagattttatatatatgatatatacaatatttatttattataaggaattggctcacacatttatggagacttaaaatcccaggatctgcagtcagcaagctggagacctaggagacccaatggtttatttccagtccaagtctgaaaacctgagaatcaggaaagcctatggtgtaagttccagtctgactttgatctcaggcaagagaagaccaaagccccccctgagaatcaggaaagcctatagtgtaagttccagtctgactttgatccaaggcaagagaagaccaaagtcccagcttaaaggcagagagagtgaattccatctatttagacttttgttctatttaggcatcaatgaattggatgagatctacccacactgggtagagcaatctgctttactaagtctacgattcaaatgttaatcttatccagaaacactctcacggacacagtgagcatgatgtttaaccaaatatctgggcccctggtggcccagttaagttgacacataaaatgaatcatcacaaggcagcacaaagcttattttccccttaagatgtatttatttactgttctctgcttacaattataatcccttagatctttctaaaactgagtctttcttaagatttgacatttcttaatttaaatctttcatcagtcctcccatgatcacccaatctaaagaagggcctcagtctctatactttgtacatcttaagcatttatacttacttatcatcttcttctattagaaagtaagattcataagagaagtaatcatgcttgtcttatttgaaagtgtttatccagtgcctagaacagtttctaaactatagcaggtgcccaataaatgcttgcaaaatgaaaaaaatctgtaaaatgaggatgatagtatctacctcataagatggtttagagattcaataacatgtagaatcatttacaattaagtaggtgctcagaggatatgactctcaatcttgagattaaaaatacacttgaaaccaggattaatatctatcccattagctttttctaatcatctcaagaaaaagttcagcaagtactttgcttctcagtgtcttggatcttcatctgcaaaatgggaacttaaaaattctaccttgtaaggcttcagagataactgagatggcatgtaaagcacctaaacatggttatcttcttcctttagttgtcataaggaccaaatgagatagctgataggaaaagtgttttataaactgtgaggagctcttttactgcaggtttgatattctcaagcagagatctgcagacagacagatgaaatcagattcattagattctggctgtcaaataaaatatgttttaaaatataaattttgggctttttagaatcaaacaggattctccctgccagcaagcagcacaaggctttactcaaagccattaacaccatacaattcctgcttggcaaagttagccctcatattggcagtcaggattgtcagttaacagatgggaatcttgctcttggagcactttggggcaggacacagaatgctctgggtaaaacacttgtgtgcacagtaatccactggtcatcacatccttatttcttatacctgctcatttaggtggcctgcggctcttcaaacaggaggaaaagtgaatcccccagggcagcaactatgatatttagcaccttctacatggcataggctttcatctagctagaaactggattattcattagactttttcctataaatgtatggatttcaatgatagtctgtgccttctctgaaatgtaaaacctgatcatcagcaaaggcatactttgtgagcttctatttctattgcaaagtgccaatctccactgggtcctatttcaaccattatttaacatttattgagcaccaataatgcaccaagatcaccctctgtctctaatcttgtcattaatgatccatcaggctcctgtgggtgatgggaaggaggagaaaacaagtaattattagtgcgatattcaatctgaatcagttaaattgcccaaattattgaagtttagttacttaaataaaaggttgatcaaacttctgcaatgaaaacctaaagcatctatcttactgtctttaaaaagcttagaggagtaatggagagataggaggaggaaaacaaaacagtctgttctgtcagcttaaaaggaagtcagaggtgcttgcaataggaaatggccagacattcctcaagagaatatggaatacataacttctaaacactttctcatgctgttcatttaacccggaacacatttctatgccacctctgcatattaaaaatttacttattaagatagagcttaaatgtcaactcctccatgtaacctgaagtaaccttggtatcttcctaagtatttctttccttcatcgtcataagatctattaggtttccaagtcctgtcaattctacttcttacacacctttcacttacttgtattttaagagtagagatgggttttattcatctctacatatttgtcgcacatcttttccaaaacaagttggggtccagatctttggctcaggctagggtctgcagagcctgcccaggcaggagagtagagaggctggtccatatctgtgaacttgggtctaagaaccattgtctaagacaaggataaaatagtaccaggaagcaaggaactaagtaaaatgccaaggccaaaattcaaggggaaatatctgctccgatgatcagaagctggtcaggtaagtgtgttcaggagggagtgcttgaagaagtgctctgagggtggtggaggaagcctttattggggtatgagttatgggaccaaagggcaggagttaagggctctgggccagtctgtttggcatctatcacagtgtctggcacatatttggtcctaagtatgtgttttttgaatgaatggagcattacagaatttgccagcccccaaggttaggaagtttctggtaaagtataaccatcaaaacccaggtccagagaattaagcattttacttaagggactaatgacgaaattaggaaatcactcttgtgtgattttctccttatatttagagttggtaatggccaagagacacccctccaatccacttaaggaagagtgcattgttactgctggcctttatctggataatcaaataataaagtcaaactggcaagcaaaggcgagctcccaggctaactctaaaatactttcaatgttatttgttcagtaaactgcagaacattaaatttctatattaagtaaattaaaaggaagagtgcactttacaaaattaaaaagttctcagttactttacgttattccaatgggaaagttttcagagtgtgccctatacaatgagataatgtttttcgtggatggtggacagtggggaaaagattcctcaggctcagcacaagtgtcaccaggattttggctaaaattgcacagcttatatctgggccctgtggcagaaaatgttgatcacaagcacccagttctgaaatgcattcatgactgtaatcttctgtctcttatcaagaatacaaggatatcaagacatgaaacacgtgagacagaactggattggctcatcaagatcatttagtgctgatgtttctaaactaggccgtagagaaatttaattcactatgctttactcctgttgatatattttacatgctgggcttctctataacatttttattatagaaatggttctccagcaaagataatcatggatatcaatgatctatacaggtatagagctaagggcattattattggaacaaatttggcattattccatggtcatgtatcctcactccctcacttactgtggaatttcaagctagtcatcaaagagaagtttcctcatctgtaaagtggtgccatgactgtggtaggtattggttggatattcatcaataccatattctctttttgtgaaaaactacatatcccagtataccttgcaattagattgttccaagtgaccaggtactagccaaaggaatatgtgtggaaataatgcatatcacttccaagcttggacataaaattccatatgcaaaaatccatgttcttttttttcccttccacagcgatctgccctctgctcccatatctaattagtgcggtttttattttgtgaccattctaagcctggctagaattagtacgtttgtaaattctctatggaaaaaaaaaaaaaaaaaagagtggaagagaactagaccaatccccaccttgcctggcctaaatctcagatgtctatatttgtactatctaagaatgtaggtctttgagagcctctaaccagtagaattccacaagctgttcatagcccttttccttcactatttagcctctagtgttaataaattgacactgttttttaataaagccaaatcctatcaagacaaatgaaaacaaggattaactctatttcatctaaaaactccattgtactatttattttcactatttacacaaaaaatactttcatgaaaatgacttactcaggtccttactccaagaatcagagcatgaaacctcaacttaaatttctctccttttcatacataccgccatcaaaaatgtaagggcactagagtaatcttaaaaatggatgcccaaagatatttaagtcctaatgtcagagactttcaaaccagagcaactccatattgaaacggggctgggtaaaatgaggctgagacctgctgggctgcatttccagaatgttaggcattctcagtcacaggatgtttacattaataccaagtatttaatgtttactgaccagggccaggacttaacagacccaggaaatctcctgatgtcccaatatcttaagaacaaaagcattcttagtttaacaataagttttgctttaaagatagtaatatagattcctgtggaagacagtagttacacaaagattaacaatcctttgtcacaagcccttgtagtagagcacatcttccctatgatttttctgctttgctatcttatgtataagcaagcattgtagcttaggtggacacattcctccttttgctttcaggaatgccctaatctatgtattgagtagccattcttttattcctttatgttcttgataaatttgctttcactttactctgtggactccccttgaattctttcttgaacaagatccaaaaaaccctctcttggggtctggatcaggacctctttccagtaacatattccatgacaaaccacaaagggaccatattggagaaacctccaaaccaaaggaaaattgtatgtgcagtaccagttggctgactttggttaagtggtagagtgtattttatcgcaggtgaaaagataaaataaggttagaggcccaatataagagagttaaagtccctcctaagacataggaggttaaaggcctttcttagcaaaggacaagatgcttgttgaacttgggttacagttaggaagttaggacttccgaacttaggaagtttagattctctcttaagacacagggggttagaggcccacctcagtaaggcccctcttgattaaaaatagatttggcactataggatgttaacggctattctctttggattaatctgccttgcattctttgctgatggctgtgagtgacaggattaggcgtgtgcaggatcataggacgtgagaaactttttctctcccaaagggggaaatttaagagctgatgagacatctggaaaagatcccttcatgactgacaagaagccacctgaacttcggattcagcgttcagatgggtctttctctagccaccctgagcacctcgcctccctgaccctgcgacaggcaatgcttttctccctcccctttctcctcctctctctcctttcctttttctaacctttctgctctcctaatccttacttgtttgggtcacctgaatagacatccatgggggacagattgaaatggcttccctggtttactggtctgtgttacctgaatagttatctgtgcaggacagattgaaaccgttgatcatctgggtctgatcagcaatgggacaggtcataccccttccctggcctaagttggtttgtgttcaagtcccaagaagatcattctctttttcgctttttttccactctccctctctgatgcctcagcctctctctgtgcgcaagctggttgagtgaatgctaaacgtcactgcttgtctcttctgcaaggttttaattgatgagaaaaaggatttgtgagatgagtcttaggctgtagcaaatctggtgtactttgtgtccatctgtcacagagaggtggacaccacaggagaaaatgcaggccgaaaacaattataaaaagcccattgttcaagccactctgacaaactggtcagttaaaagctttgctgcaggttcctgaaacaaaaactgatgaagtttccctctcattttgttttatgtctttgggagcttcactttgtgaccatgtgggggtaatttctcttggtccccaccatccagagggcaggaattttgcagttcatgtcacagttaaggcctaaaagttatcttgagcagttaaaaagcttttgaaaggcttctgggaagagcaccagagactgcccaatgctgtatttctgtggctaaggctttgtcttttcgtggtagcagtgaaggttcaatttccagcttagggaatgagtcctttctggtttgacatttgtgtgacctttgccatttattgattcttttctccttcatgaacaacttctgatttcctatcttgaatttcctttacctttggaaattctagatcttataaaaactgcttaccacctctttgaaaatatcttgtacacccgtggttaagtcacaaccttagttaaggcttattggtttcacctggaaggttacctttggtaaaggttaaaagccagaaatattggccctttgtcctgactggagtctggtaataagagatttggttaaaagtcagattaactaaaagtggacaaccaagctatacatatatttaaaagacctttatgcttttttttttctttttgggtcttatttttttgaaaacaaggatttttgtttttcttctcagtcggcctgaattatttcccccgtctatcttcttgtcaccctcaatgcccacatgagaggacctaaggtgaattctgacagcataggactccttgggagaaatagagaaggtgccacagaccccgttttgggaggaacctctgttttcctcatggaatcccaagaattgaaagcagatagatccctctcaaaatctaaggctctgttctgttttgcattgcatttggggggtatcagaaattactctgcattatgagagagcaaaaagccttgctgtgtaataactaggtgggaaatatacattcagaaatggctaatggaagttatggaggggatactcagttctttgcatgtttggatcaaagaagcatacttttagccacctggaaagtataaactcccccaccaccagaggtaagacttccaaccaggataaactaattggctttgggttgtccaccagctttggggaatgtcattgtagtaaaacgcatgataaaagcattgcactttctggtccccatagcattcccctctttttggggatccaaaatttgacataaaaataggaaagaaaaacttaaaaactggaccaaatctacttctgtctgtccatctgtgtatttatgtgtcatgtgtgaagttttgctttcaaaatatgtgaatgagctctgattaactggcttaaaaataataagtgtttaaatcaactattttgtgggaaaaatataaaccttaacactgtttagttcatgtgactttagtaatctttgagaaataaagttgtaaagattattgattaaaatgccttcaaaatttagacatttgttctaaattaggcaggtcagatactgtctttactacataaactgcttctttgacttttgataactgttcaatttacctaatttagagccattagattccaggtaaatcttgaggacatgtagagttagccatgcttcctggctatgctggaaagagtcagacctatctgcgctctgtctagtgtcctaggcttcacacctgatacacgattaaaatcacttaccaggttttccaccaaaagtaagtttctaagagttaacattgtaacatatgtaattaagactactggagtgtggcacatgtatacatatgtaactaacctgcacaatgtgcacatgtaccctaaaacttaaagtataataataaaagaaaaaaaaaagactactggagaaacagttttacatgtaaggtgtataaggaaagtagaatatgtttttggtaagattataagaaggcatgaaaaatgtggtttttgcctagtgcacaggcttaaaggattgttttaagtgagataggataaagctaaagatttgagcaagctgtggaaggtttgtgaaagattaatcttgtaaaaaattctgtgtgtgaacatactggctaaagttaaaggggtgttattcagtttttccataaattgaacattggaataaaaccacaacaggggtttccttggagtagtgatctgctctttaaccccaataaactaaaaaattttaagtttatgtaatcttaccttatgatcaaactgattaagactagatagatttgtctgtaaggttttattaagaattggatttgacattaatagcagtatattaatgtaaatctggccttctctcttgaacaagattttcatgtaacaataaaagatgatgaaagatttttgtttgccttttgaataaactacaggtaaagaaagaagagaaaagagacaacatgagtaaagcgtttcaccttttcagaatctttgagttatcattttggctaaataaatgacttatggtgatctgggattctcttttataatatcaagtgtttgaagcctttgatatttgacaaactttccaaaatcaaattcaaattaagtctttttctgacctgattaatcctttttgatattaggccccctaattccaaaaatgacatatttggcttatttggtatattgaaataataaggaagcattgtcaaatataaaacactgtttgactttctttgggctgtatttgtataaatgtgttattggtatgtgttccaaaattatgcaaaactcctgtaattctaatatggatttagtgtacattatcagcaacaattataattgttacgttaaattatcatgtgcaacagagataataaaatttccttgtcaattgtgtctttgactgtggctgtcctaagactttttgtcatccacaggcaactgttgtcttgttttgatcatctttaaagggcagtttataatcagctagaggactttgatgaatactctttaatgtaggtctccaataactttggaaagggtgagaagggtgccattaaaatagagaggaaaaaaaaattccagatctcccttggacaactcatctgttcataaatattaagcaaaagagaaattgcctaggctaataaaagactgaaataatcttttgatgactttttgcctaaattgttggtgatactttctgttttgtttttcagtcaagaaaacttttcttttgagctattatagcttttaacaattgagtaaagtatactcctataaacaaaatttggggcatatttctttctctctgcctgatttctctaaaatttaaaaactatttgtgagtattcttaacttatgaaaatatagttatttggacaagtgcaataagaatctatattcttttgtaacaggacaaaattggaggagacactggttattttaccaaggctttgactggaattgcttgatttcaaatataagcagactgctttaaggaatcaaagttgacttacagaaccaataaaagacccttgggctgagctcaaagcttaaaaagtttaatctaagattcttgatggaacttcgttccatcaaagccaattttaaaaagcgcctatatggcaaataattattcttgctgcactttataatcagtccaagtttaataagaccaaaacttattttgcaaactaactggtcatatcatgatttgtctgtggtaaaaatgagagactagagagaggaaaattatgtttcaaaaactatgttatacctagtattagattctactctcgtctgttgtttttgagggtttttgttttgtttttgttttctgtcaatttagactgcttattcctgtgaaccaaccagtgatctctggctgctgctcagaggaaacaagagggataagtagcataaaatatttagatcagtattgtaattctggatacatactggaattgcctggtgatcccacgtcagcttggttccaacaatttcccagttcatgaaaagccttcttattcagtttacttgggaagattttacttattttgcttcactgttgtggactatattgctgtcgtactctttgtacaggaatgcaggataagcttattcagtgttttcttaaattgaacacttatttgtcttccagatttcaccttttgttgggattcaaagttatgaatggtcctcaccatactgatactttctgactgagctactctctatcctgaatacaagagaccctaacattaggtaggaatatcactgctcctacttcgcctgaagaacttacagaagatagatcttcatccttctacaactcttaggattaaggatccccttgtaaaagaaaagggggaaatatgtcagaggcttttgaaccagagcaactctatcttgaatagaagctgggtaaaatgagactgagacctgctggactgcatttccaggagcttaggcattcttaatcataggatatttatggttaagggagcaggttaataatgtttactgagcaaacctaggatttaagagacccaggaaatatcctgatgttcttccaatgttgtaagaacaaaagcattcttagtttaagtttcactttaaagctaatatagattcttgtggaagccagtagttacacaaagattaacaatcctttgtcacaagcccttgtagatttttttatctttgttatcttctatataaacaagcattgtacctaaggttgatgcaatcctcctcttgctttggagaatggcctactatgtctatgaagtagccatttcctttctttctttctttctttttttttttttttttgagatggagtcttgctctgtcacccaggctggagtgcagtggcacgatctcagctcactgcaagctctgccacccgggttcatgccattctcctgcctcagcctccccagtagctgggactacaggtgcacaacaccacgcccagctaattttttgtatctttagtagagacggggtttcaccgtgttggccaggatggtttcgatctcctgacctcatgatccgcccgcctcagcttcccaaagggctgggattacaggcgcccacatgccattttatttctttactttcttaataaacttgctttcagctgggcgtggaggctcacgcctgtaatcccagcacgttgggaggctcaggcagccagatcacaaggtcaggagattgagaccatcccggccaacatggtgaagccctgtctctactaaaaatacaaaaaaattagccgggcgtggtggcaggcgcctgtagtcccagctactcgggaggctgcagcaggagaatcgcttgaacccgggaggcagacgttgcagtgagccaagatcttgccactctactccagcctggcgacagagtgagactctgtcttaaaaaacaaaaacagcaacaacaaaaaaacttgttttctctttactcagttgatttgccccaaattctttcttccacatgatccgggaaccctctcttggggtctggatcagggtccctttccagtaacactaattcttggaatctgtaaatattactttttatggcaaaggctttgcagatacgatttagttagagatcttgaggttgggacattattctggactatttgagtgggccctaaacgcagtcacaagtatacttataagaggaagacaaagccaggcgcgttggctcacgcctgtaatcccagcactttgggaggctgaggcaggcggatcacgaggtgaggagattgagaccatcctggttaacacggtgaacccctgtctctactaaaaatacaaaaaactagccgggtatggtggcaggtgcctgtagtcccagctactgggtaggctgaggcaggagaatggcatgaacccgggaggcggagctttcagcagtgagctgaaatcgcgccaccgcattccagcctgggtgacagagcgacactccgtctcaaaaaaaaaaataaaaataaaaaaaaggaagacagacggaaattagaaagccagaagaggagaaaacacatgcacagataagaaggtgctgtaaagatgaaggcagagattgaagcgacccgcagtcacaagccaaggaattctagctgctaccagaagctggaagaggcaaggaatgttttctgtcccagagcctccagagggaggaggaccgtgcttttggcccaattatatggatttcagatttctggccttcagaactttgaaagaatagatttccatagttttaatccgtctaatttgtggtaagttcttagagcagccacagaaaacgaatagaagctttcattttccatgctaactctgaccaatcactactggttgcctgtatcaaaaaggaattttaaatagtgtccaggtctgccacaggacaaggcattaggagtaggaacacacacgtcatatgtttattaatctcttccagggtaaatagtgaaaataagttaatgatagcaaacctatctttatacatatatttggttctactagctaaaaaataatatttaaaatgctttttggtctcatctctattaattccctgccatgcaccagccatacagattttctatatattactctaaaaataattttcacatggcatcctctgagtccttgctcatgcttcctgtctagaatatcctcttttgtatctaaagaaaactattgtgaaactgttttgacctcctgccctgactccatgatcaatagagttggtaccttccttatatttcccatatatttagaactatggggcatagaagtattagcctctgtaataactctgatcatattctgttgaaattatctgatttgcatctgttttccaccagaacatgagttccattgctgtattcagaacctacttcactactcagtacacagaaagaactaaattatgggacttttgacaagcaattaccctctaccaggttctttcctcccttgttctcctccttctctcatctccttttccaaattagttcctcctacccatgcttgagatctcagttcaaatattcaccttctcaagtgccccctccctgaagcagcttcctccttccaagagggaacatgctccttatatatatttgttgacactatgtacctcttctttgtagcacttaacagaattcgaaatcctaaatttatttgtgtactttttggataaatttctttgccccctctagactggtaactcattaagggcagtgttatgggctgaattatatcccccaaaattcatataataaagtcctaatccccagtatctcagaacgtggctatatttagaaatagggccttaaagaggtaattaaaataaaataaggtcatatagatgggccttagtccaatatgactggtgttcttataagaaaatattaggacacagatacgcatgtgcacagagaaaagaccacatgaagactgggagaagacagctatctacaagccagggaggaggcctcagaaaatatcaaccctgctgacacattggtctcaagatttctagcctccagaatggtgagaaaataaacttccatcatttatgccaccctgtctgtaatattttgttatagcagctctagcaaagtaatacagacaggaaacatatttgttttgtttactgatatatgtccactctgtgtcacagtgtttggcaatacttagatggaagtatttcaattaaaatacttcaatgaatatttgtttttttttttgttttgttttgttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccctgaatatttgttgaataaatgaatgaaatgtttgctgagttaaatttattgaaagaggtgaggtggttgtttttgttttaattgtggacaattgaaggtatcacaaacaactgaacttttattagttttgggggaacaagaggtgtttggttacatgaatgttctttaatggtgatttctgagattttgatgcacccatcacccgagcagtgtacactgcacccaatgtgtagtcttttatcattcatccccctcctaaccttccccccaactccccagagtccattatatcattcttatacctttgtgttctcaataggaccaggacaggactcttcctgctgcttcttctacttttatatttcactcaactctctaaatttatttcagctttaggtaagggtaaatccttctcccattatctggattttcaggttccccagtaaggatgtctgttcaaaggtagactttccccctctcacactttgggcactcacagttttttggctgtctcatggagtttgtaacagcaagccgcttctttcaaagggtctgtgaattctttcagttttcctagtatgttcctgcagtggttcttggagcaaaagttcacaatgtgagtcttcacatgctgttctgtccatctaagtgggtgctgcaagttcatcctgcctgctatccaccatttttcccccgaattttacaatgaacaactgagtggggtaaacagtggcttaggacaatgactttagtaacttagaacccaggttttggcaagttctgcttctaccagtggtctgaatgtggtcttttcaggttccagatgatacactccatggcagaattacttattaacttattacctcttttagaaattctaggttttccactcatagtggaaaatgatcaaatatagggagtatactctctgtatatgtatagtacacatatgtatatatatatatatatgaataaaccatggatacaattttatgaaataataattaagctgactattctaaagcttattcatagaaaattacatctcaaatatataaggtgggaatgagatgagattggtaaggtcccattccctatctttatttaaatcatccaactctcagttgagtgctagtgatgaaagatctcagattttatacagattttttgttactctctataattattccctcttatccacagaagtcatgagttatgggtagaaaagacattggcctaagaatcagtaaattttcatgtcagtttttgctactaacttgtgactatgtgattctggccaagttatttcttctgcctgagcctcagtcttctcaactgtaaaatgagatatttataccagatggccactatggtacatttcatatctgatattctaagccatgatgaatcagcctaagccatcgtgagtcatgcccaaattcctgcaaagagtatttgtgttttttcattaaaaggattcctctgtactctttttcaattaacttcctcttgcctaattcttccctgcacttgctgcctgcatacctctgcatcaaatgtagttcccctaattatccatccactgacaaacctttaatcctttaagatccggcttaaaccacacccattccaggaggtcttcattcaacatactcacagaacaccgcttgcatctctgctgaaccatcagttagcctaattggaaaatagttatttatttacatgcctatctcctcttctaaatcagactctcagagtgtggggactaacacattacctggcatgctgaagatgtttcatcattttgccagtttgaataaagtattctctttcttaaaattatttgcccacatgaattgaagctttttttttttttttttttttttgtggaaaggaactactactaggatcagcctcagagaagaggagaaaaacctcggcagtggcccttcatgtgatggctgcttaatctgcactggggtcctggggcagagaatatcagctcccagcagttttaaaggccccccctccttctggccttccagggggaatagcaactagagttctggaagccataggtctgataatagtggccagagacagaagcctccagcctctggagacagtggcttgatctagggctgtttgatacccatagcaccaggagcagaggaaaatgaagaaaaatgaggacagatagaggaataataaaaagctagcatgtattgactgccaaccacacatcaagaaaagctgagcactttagacatgttactgctaatcctcataacttatcaataggacccataataattgtccttattttacagatgaggctaagaaaagttaacaaaatgtcacatagtagtagcagcagatggagttgggattcaaacctaggttggactggtcttttctctgtaacactgcctctatctttagcaccctatgactttcctttcccaaatacatcatcccttcatctaggtgactgtgtctcatttctgaagaatctgcattcaaactagtttaagtattatccctttataggatgtttacattaaagatagaaaaattttcaagacacaaaataatcttatataaagtcatagaggtatgtcaaaaccacctttgacctgtaaggtctgggttttagtcccagctctgctctagtccgtctctgctgttaaaacactgtatgtccttgggcaattaaagtttcagtttattcatcagtaaaataaggggtagcactatgtgatatctaaaagcccttatatctctggcatctaaggcatttaatcagacttttgcgggttcctcaatactatgtataacataatttctataaacttattaaagatgacccattcctatattgggggtggcctccactagagagtccagaaggcaatgaatggataattacaattattgtgattaataaacataattataattcactctgtacttatacatgatccacagtgcagaaaagactgcaccctggaaaaggattaatgggaaagtgatcctgttgatatgaacaggaggcagggaaatactgggtagaagagggcagttccctggtaaaggccccaccttcaagcctggaaacccatggacctaaatgagaaaaggcattcctgtttcatgcccaatgttgccttttggcccaccacaccccctgtcctgtacccatacaaacctcaaaccccaggctccacgagcagaagagtggcaggcggcagagcggcacagcagagaaggagagaagagaaggagcatctaaacatcaagaggagttcagctgaggacagtcagagagaagactggccatgggacagctgaactccagggaaagatcatcttcccactccatcctctttccagctccccaatcatcctgctgagagccacctccatcactcaataaaatccccacattcataattcttcaagtctgactgacctgattcttcctggatacaaaaaaaagacccaggtactaagagggcagggtgtaaaaggctgtcaccctgactgtccactgagctggtttaacacttagctatctgtggatggcaactgctaaaagaacattaattgtaacacacccctagatgctaccatggagctggagcctaaaagtgctcactccggcttttgtacctgcccatctgtgggctccccatccagtaaggggtttgagcaagcagtgtctgaataaatgagccacaacattgtcgcacatcccatgagggagttagggaactctcctgttccacagtgatgaataattagttttcatcttaatatttaatcaacatttaaccgttgatcactgttgcctttattgaaaggttttctcatttggcttcatgtcattatactctccagcttccctcttaactcattgctcactctttgtcagtgatatttgttgggtcctccttctctttcagacttttaaatgctagagaacccctcaggctcttgcctcatctctttcttcttcttctctatctacacttgctttctaagagatcttatccattctcttgaatttaaatatcatctccatgctaatgactcccaaaaatacagtaaaacctcatgtaacatctctgataggttcttcgaaactgtgactttaagcaaaatgattatgatgtataattaagtcaattttaccataggctagttgatataaataagagttaaattctagatgtttctggtcacaaaaacataagcttctaaataacgactcaaaatacttctaatattaaacattgaaacaaatatgaactatacaagcatttaagaaacattaattttaaaaagacaattacttaccagcttattccagttcagggtagtatgtagctggagcctatcccagcatttcagggtataaggtggaaaccaaccctgggcaggacaccattccactgcagggcacacatacagccacactcacacagggataatttagacatgacaattaaccttatgtgcacatctttgggatgaggaagggatcagaatacccagagaaaaaccatgcagacacggggagaaaatgcaaactccacacagacagtggccctagccaggaatcaacttttcgaagtcgactttttaataaaaacaacacatatttcaagcactcgatccaactacttaattgaaatttcatcttagatgtttaacaggtatgtcaaattcatcacatacaaaattcacctcataatctccatctcccaattctagtattataaatattagcaaatggaaacatcatttaccaagacgtttaccaaggccaaaaccagggcgtcatccttaattactctctttccctcactcattaaattcaatccatcacaagttcttctgactctgcctaacatttctccatctccactaatacaattctggtcaaagccaccatcatttctcacatgaactattatacaaacctaactgctctccttgattccatatgtgtccccaatccccccaacatgaaagtgtgtatcaaaacatgtcactcccttgcccattagcttcccatcaaacacagactaaaatccaaactccttagtagagcctacaaggctctatggtatctgacctatctctctgacttcatcttctgttctctgacccattcaattcattccagcataatacttttttgctattcttcaaagacattaaattttttcagccttaggacctttgtagttgctattcccttcacttagaacacactttccacagatctttgcatgctattctaattttcatgtcacttcctcataaagcaaagagcaatgagtatgtagcatgtcattctcaaaatgaagcaggtaccaattagtgatgaattcgccttcccagtactgcccagaaagttcaaccggagagacaatcgtagtgtgcactccctcctcaaaaagccaattctttcttaggggagagtctttactacaatgaagaaatagggtcctggtctccctgggtatgcttcctacatctttggaaatataaaaaaattttgtctcatattttgattctataaaagagaacataaaaacagacattgtgagtcaactatgaagatccttccaaagtactcccccaaaattaggatcctggggggatcagaagaaacctatcttatatcactatgtttcagaaaaccaagatttttctatggattaatttgaatttcttccccattcatcatgacttctttttgtaaaaaggaagagaacttgctttctaactcctgccttgttggatgttctgataaacgacagacacagacaccttcacatgccttcaaatgttccaagagactattaatccaataaactagatgccctgaaaacaagtgactgattagctatgctgatttgtagatgtgtttcctaaagcagattaatgttattttcaggcaagcaactgtctcttctatcaccttacatttttcaaatacccccacctcaccatctcaaaatgttgaaaaataagacactatcagcacagcaaacagtgccaagaatttcttttacggctttatttccatttacatggcaaatgtaaactcagagcaaagtgaccttggttatcaaaaataagaaggcaacatcaggattgatgggccccactattagtatttcattctgacaggcaggaaagaagtgtgttagtgctgaaggtttgttgagctgtggttctcaatgtaggcaaagtgggaaatgccttcctgtggagagtcatttccatttaaacaaaaggagctttgttgatacctggcagttacctaaatagaataaccacttcctaaccaagagctttaaactcaaatcttaaaaacaaacttcacctgattgacctcaaagccacatgtccagtaggttttcagccaccccaaattggtgtctctgacatggaatgatgaacagcaactccaacaagaaatgttgtagagactttccctgagtagatgtcctgatcaggataactgagcacaagaaccaacttacaaaatgcagggaatgacactttgtcctaatgggcaaaggtggcatataaagtgactgggggcaaaagagttacggctgggccaacaaagaagactggttgcctttctttatctgtcaggctgtttccctccctcctgcttctctgtgtcctcctgcagatgctcatcctgtgtactcatcttgctattagttgatagccaacatcttcacattgagactattccttgattgtaagctattgagggtagcttatcataaccctacttcctcagtctctgtacatacggagatgaattatctgcaacttacatccagacccaggctctatacctaggagaaccagagcaagcaatatttatcaggagatccactgtaaggatggaagtagagaggggcctgcaatgggctctgctgtcctaatccaattttgtaataagtagcatatatatctgaaaaacacaggtactagagtaagaatattcaacctctattaaatggttcctatattccaggctctgtgaatttttcttctcaactatcctaggaggcaggcattataatccctgttttactgaaggaaaaactgaggattactaagggcaaggaatttgcactgaggtcacataaccaataaatggatgaccactccaagcctcagtctattcgtctgtaaacaggaaataacttctttagagtattcgtgaaaaataaggagaaacagtacttggcactcagtagaagtcctgcttacctgtgcaaacgcctatctttctacttcctccatctcattcatacagcattacactcaagtgtgttatatcttactgggacacatgcttcacttcgttccttgtctgaattctaaacatcctctaggtcccatgtccatgtctttaggctcatctctctcacccatcctccctactcttcattgtccactccaccacaattagtactccaattatggcaggccaggtttccattagcaaccagagtagccagtttccactaaccctttactataattctgatgaatgtattaattaaacattaaagaattagagaaactggtgcctgagtatgagggctggaatgcaaaaaccaacccattaaggccccacctgggttttatcagaccctaaaatctaatcaaataataaaagcattcttacacatacacctcataccagaccccaattaagattaggaaactttccaagactctagataaagctttccagaccccagaccctagttaaagattagatatagattgaatgaaacactcctgcttatgggtacactctcgtgtaggcatggagcttaaaatgtatataagcaccagaaaaaaaaaaaatgtaactttgagttggtctggtgagtaactccaaccttctccctgtaaccttctttcctagtctgtctgcatcttattattggacagtgagaacaagcagccagactttatttgtctgggaacaccactattccaaaagagataaccatcctttgcttgaacacttttactaacaagaaatcattttcctgtgaaacagttcgtttgattattggttagcgctgaacatttagaaaaaaaaatgtttattatacataagcaagaactggtgcaaagatttaattacaaggataatcactgctcctaattggaaacttcagtgtctgacataggaagcttattgcataaattgtgaaacaacttttcaatggaaaataatagagctcttaaaaatgaagatgaagaaccacatttattgacatggaaagatattcattgatctattgataattgaaaaaatcaagtttcaaagcctactacagtttatatgggtcttacatttataataatagtccccatattatagttttgcatatgtctgtcttcatctcaagaggaaatgtactttgagaacaaggtcttgttttattacttatgtattaatttcagcaggcctgcagtgagcaccatgtgtgcgtacatacattaaaagctggaggctcagacaaattggaccctttggtctatcagtgtctactgcagttttaggcacaaaatagctttagcatgtatgagttaaattatattgaattacactggaatgggttgaattagattacaaggatttctgtaattttggctactgaataggatttagtagaaagcaaagaaaactgcattggaataaaaagattaagccataaatagcagctcagacacttatcagctgtttactttcaaaccttaggtgcttcatttatgaaatgaaaataatactgtttacctcacaagtctgaggtaatagtttaatataattaagtgtgtaaaagttactcacacaatctctgacatatagcatatgttcaataaatggtttccaaaaaaacaaaaatgcaaaaagcaaagtaaataaaacaaacaacaaaaacactgaaactgaagtcctagcttgtgtcaggggctatgcttgatgttagaagtacagagattgaattatcttcccagccaatcaaaagttgacctcatgctcttccagacatcagtatgtctccactgcgtgcatggagaacactgtaggcaaaagctggcagcaaagttgacaaatatcacattgtgatcacaggactgatccagtccttactttacccagtccagctcagaaagtgaaataaagcttttttaccccgagaaagggccatgtacccacaggctctgacttccgtgccctcattttactcacagtcacatattactggtatgctgaaggtaaccaactatcctggttcgcccagaaccggtatcctgggacatagtacttcacaattaaaatcaggacagtcccaggcagatgaagaggtggttggtgacccttgatatgatgatggctcccaagagagcctgatgagtgtcgacgtgcaccatgtctttgaggtgcagatgacagtagaggttgtctacaggactggccgatatcagtcacttggattaagttatggatcatctttccaccaagaagatttttctccaaagcccatagctttttctgatgctttggtctgaaataatcatcagtttttaaatcattccataaagatcctagcagagtggaaaaccacataggctctgaagtcagagagccctattttagaatatactttctgctattaactagcttatgacttataactggaaaagatacaatttcttcaagcctcagtttccttatctgtaaaacaaactcatatgccagtcataagaattaaatgagctaataaacataaaacatatagtagaataataaattcaaatgaattctgtgtatctaataattcattcccactgaagttcataattttctatagtcattataatttttagtaacaatgattatgaaaaaagctggtgaatttaattaaaagtcctaagcacatgatatttctgagaaaagcaaactgttgctgttttattgcaacagttttctaaaaggcagcatgtaagtgtccatatatacacaaatgaacaagacgacaactaccaactaatttctaaatgtactcaggacagcttagtaggtacctttcaattcagaggaaagcccacttctctattatatttcaataattattatagctgtatgcaatatgaacataggtattatttttaaaaaggaagaaatacatatagaacaaatactgggagaaaacgaatccgcatgttattgtggttgtattttttttaatttttattttttttgagatggagtcactctgttgcccaggctggagtacagtggcacaacctctgccttccaggttcaagcaattctcctgtttctgcttcccaaatagctgggattacaggcacctgccaccacacctggctaattttttgtatttttaataaagaaagagtttcaccgtgttggccaggctgctctcgaactcctgatctcaggtgatctgcccacctcagcctctcaaagggctgggattacaggctttagccaccatgcctgtgtattcaaatacactgtgtatttgaatagtgggtgtttcaccttctcagtggattttcttaatattctaaaataagcatgaatatttcttaatattctaaaataaacatttattgcaatgatatttaaaaagcttttaattttcaaagtccctctgacagccatcatcattcctaactgatttctatttagccctctatcctcatctctcattcctctatcacagaaccagacacagaattaagaagtactttatttatttatttatgtagcccaggctggagtgcagtggcacgatctggctcactgcaacctccgcctcctggttcaagcaattcttgtgcctcatcctctggagtagctgggactacaggtgcccaccatcatgcccatctaatttttttgcattttagtatggacagagtttcaccatgttgtccagggtggcctcaaactcctgagctcaggcaatccacctgcctcggcctcccaaagtgctggcattacaggcatgagccaccgtacctggccaataagtacttaaaaatactttttagattataaagcactttcaaatgtgctaaatcatttaaagtttaaaaaccctttaacaaagatatagtcttcctattcattcgccatttttcactgtctccctacacacacacacacatacacacacacgcacgcattacttaatctcttctgtgttcctttagctgattgtacccagtctcatggaccatgataacttttaaagtttacctccaaccctggcctctcccattgagcccgattcccatattcaactgtttaatcaatatctgtaattgaatgtataataggtatctcaaatctatatcaaaacagatctctttgatttcctctatgaaacttgtttcttctccatttcctcacattaattagtagatgccaccttccttccacttggatgctaaggacaaaaaaaaatagtcaaccttgatttttcccatttgacatctcctgcatccagtctatcacaagtactatgatctcatatgaatgttgttgtaatctgaatttcagtgatttctatgtaggaagtgctcatatagcaaccctcttatgtgacccagatgtgggtttcatctggaaaacactacagagaaccccacacaactagtagaaattgcagatgattttccctaccttcaggaatgactacaaccagcctctcaaatttataatgcagaagcaagaagtaagcatcagtatctatgttcccatatatttccaagctcttgtatgtgtcaaacttttcaaaaaatccaactatacactccagcatgggcaacagagcaagaccctgtctcaaaaaaaaaaaaaaaaaaaaaaaagagagaatctaactactctctgactgatgagagtctgagaaggactgaaaactttctagaactcagcaaacttcagccgagggagtaagaaaccagtcttttctttgcgcaaacacccacactctccctctcagagctcgtttaggacccacctcacttgactaggatccttttctacaccaacaatttcaatgactctgctttgaatttctagtcttctctttacatagtatgaaattatatgattgggtaaagatctcagcaccaggtcaatctccatttgcaggtcccaaaggaatgtatccagtaatgatctttagaatgtgggtgtctcaattgcatatgggctcacctttggaatcttaagtgaaattctgagacaagagaaaatgtcttttcaacattaattgtaggataatcaagtctgaagatagaggcagataatgaaacaaattttggacatactgaatttgaggtgtctgggactctttccagtttatttgtctagacatccagcagctgcatataagggtcagcaactgcatataacagtcaaggtctcctggatggagacagagatggagatgaaagccatagcatatagatggtatatatgacccatgagagtgggaaaagaatatgaagcgagaagactaaagacaagctttagaaaacaccataatttaaagacttgttagcaccaaaaatgtgacaaagataggtttgaggaaaagaaaaattaaatatggcactcatatcttcatttctgaagaggtatatattactgtctgttctcttcataaagcagattcttactgatgtcacatgggccttgtctaatgaggaccccaaaagtacacacggttggctggcctagagagcccagctgatattatttaaaattctactgtgttcttcattcagcagagacagtgtgtcatttccatatttgtaacaagcattaatgatacttgcacagatgacaaatgtcttctctggtgaaaaattaatgcaccacaatattttccctacctggggttaatgaacatgtcagatgctgaaaatgagttgtttgaaactaaattactataatctatatttagaagattgccactaggggggagttacgggtatatgtgagtggatatatttgaagttctctttaccttgagtcttaattttcacaaggccttaaaaatactaacttgctcaatagtctcacataaagaagaaacagtccatcacattctctacaatgttggatagaactctcctgaacaattattctcatttattcattcattcagtgagtaaacaaatatatagagtactcattatgtaccaggcactctgctatgtactagggataaagagatgagtaagacatgatccttgccctcaaagagctcatagctgtacataaaaaatataacattgcaattaactgtagcgatggttgggaaaaacacaggggggctgtggatataaagagatagactccctaatccacctggaatcttttctggaggctgtgatgcctcagattgaattctcaatgacaagtcaatctgtgtcaggttcagtaagcgggaagaaattactgtaggcagagaacagagttgtgcaaaggcagagaggtaggagatgataaggccgtttgggaaactgagtgcctataatattgtataacaaattaattaatgggagaccattcatatttaaaaaggactctatttaaaaatacatttagtgtatatgcttaatgcttgtccatatagtgtagtatagggctaagggacatattatgactcaggcagacctgcactccaattccagctaaacctctagactacattggaaatattggatgaggtcccataatctctctaatcctcaattatttaatctataacacagaaatatttactgtattatttatagagtactatgtaccaacaagtactttaattatctaatttaatcttcaaaaccaccatgagagtagtttttttttttcttttttgagacattgtctctcattgttgcccaggctggagtcagtggcaagatctcagcttgctgcaacctctgcctcccaggttcaagcgattctcatgcctcagcctcccaagtagctgggcctacagacgtgcaccaccacacctggctaatttttttatttttggtagagacggggttttgccatgttggccaggctggtcttgaactcctggcctcaagtgatctgcccacctcggcctcccaaagtgctgggattaaaggcgtgagccaccgtgccgggcccatgtgcgtacttttacttaacttgctttacaatgaagagctaaggcagataaattaagtaattgccaagctcaaacagatggtgagtaatgaaggaggaatccaacccagtaacgtgacaccatcccctgcattttcaaccactatactgaacctattgtatgagatggttgtaagttcatgcatgtgaaatggttagcacctgttcctggcacctagtatatataaacgataagtataaatagtcctactccattattactattttaatatgagagataacaattattgttagtaattgttattatcctgtggttgttatatagatcaaatgagagaggagacttgaagcacatataaaactgtaaaccaataagcaaacacaaagatttatttttctaacattatctttgagatagcaggccatggcttagagacattaaagaaatggcatgagttttggaatcagacaatactgagtttgaaataaatctctaccatttaatagtatgtggatttccacaaatcagttcgaacttctaggcctcatctgaaccatggaaacaatagtaataatgataagaacaacaataacaacatataccacttagtgttattttatggagtcaatgagaaaacgtctataaagaacccattataatacctggcatagataggatagctgttcaaacaatagaagctatgtatttattattataaataataatttataataattctgtttcacagaagggctaaattataatgataataatgataatattataatgataatgacttattattatcattataatttagcccttctgtgaaacagaagtattaactctttgaatacaaatacttgtttgtttttcctagatattcctgtgggtgataattatgatttttcaataccttgtgccactaccctctatttcaattccttgatgcaactttttcacctctgcttgtctttgttttccgtttcttcaccagcacagagagggtgcaagaaagaagaaaagttggcctcagaaagatctggagttgaatcctagctctgttacttactaggtagtagacaattagaaagttactgaacctctttgaatgcctgtctgtgaaatgaacatgttaaaaacctacaagactgtaaaagagcactgaatgagataacaaaaaaagtaccaagaaaaggcatacttttagcagctggaaggaaagacacagattttaaggattcaaggtcccctttgtttcccatgcttaagactctcctacatccctacttccttctccagcagcaatgataattcaactcaactttcaatgcttaagaaaaatatcattgcttctaggcgatttcccctcattcttcaaaaaaaaagatggatgcctgtctcctctgggaccttaaatccagggattatgtctgtcttgatcattgctatatccttaggtccaatagcaatgctacaagctcaaaaatatttcattgatgaatggatgacagaatggtgaatgaatgaatgaataattgtttttcctcttcctatccgctattgtacctggcacaatgccttcaaaaaggtggctatttaaaatgagatgtctataagaaggagaaaaaaaatcatccctccattttggcagatcaagtaataattttttccaccatgagagagtctaaacagcacaattacaaaaatcttaggggtgtaggagttataaccatcataaattatactttttattccctttgagaaatcctcctgatttattacatttacttagaaattgtcatagctttttctgagacacttatctgtaccctccaatattcactccatcaaatgagtgaggtggtggtgtggtgagagcagacatttcggagtactaacatcccaaatgagttcccatgcttaggagtcttgaaacattagacacctatatcatccatatctaggctcaacttgacctcaaaagaaagcttcttgctgcttttcaaatttgctagataatagagtcttgccaaagttttctagacttagaaaggtcttcctttggctacagctgatgcagaatttttgctggaacaggaagactcagctataacaaaaagcaggctagaggcaggaggctctgagagaaaactgacattctacttggaatggcagaggcaagacaagctaggtgaggcacagacatagacatttatacctttctgaatgctaggctttggcatgcatgataacttgcaattttcccatctgacatctggaagctgcctaggtccagcacaaaacaggatggataatgactaatgaaacaaacaaacaaagaaacaaacaaaaagcagtgcatgtcactggctgatatagtgatacagcttggatttatcccctccaaatctcatgttgaaatgtgatctctaatgttggaagaaactggtgggaggtatttgggtcatgggggtagaccctttatgaatggcttggcatccttcccatggtaataagtgatttatcatgctattacttcatgtgagatctaaatgttaaaaagatcctggcacttcctcccctctctcttgctccctctctcttcatgtgatccactggcttctcttgccatctgccataagtgtaagcttcctgaggtcctgaccagaagtacatgtttgtgctatgcttcatgtatagcttgcaaaactgtgagtcaagtaaaccttttttctttagaaattactcagcctcaggtatccctttatagtaacacaaagtagactgatacactggctgaaagaaccaggcttggacaggggcagaacttgttccaaagatcccaccatcgtgtgcaagccaaagtcttccctggtcaatgaattgtactgacatgatcctagatgtttgggttcttacgacggaggaagaaaaaaatgtttttcttaattaatcactttttatgtttttattgtggtagaattcacacaaaataaatttaccattttaaattatttaccaattcagtggcacctaagacattcacaatgtcgtgcaaccatcatctctatctagttccagaacatattaatcatcccaaaagtagaacccatctacattaagtattcattcctcatcgcccccactcctctccacccattggcaaccactaatctgctttctgtctctatggatttgcctattatgaatattttataaaaacgagatcataaatatgtagtcttttgtgtctggattccctcactttgcatatttttcagggttcattcatgttgtagcatgtatcagtctgtcattcttttatggccgaataatattctactatatggatatgctgcattttgtttactcatccattgatagacactggggttgtttccaccctttgtctattgtgaatacagctgctttgaacatctgtgtacaagattttgtttgaaaaccagctttcaattcttgggggtatatacctgggagtgaaatcactgggaaatatggaattttatgtttaacttattttaaacaactaaactgttttctatagaaaacacttttttacgttcccaccagcagtttatgaggttaatcttttaaaagtatttatttatatgtacaaagcactttatacaccttttctcatgttatccttgtattaatttctatgaggaagttaccattatcattttttttacagattaaagtaaggctctgagagattcagtaacttgtcaaaacccacgtctctgtggttataaatcctggacttttggccacaaacctaagcctcctttcaagcccaggcactgtggcttctctgacagctccaggagaagccctggaatacattcctggctctttctgtcccacctatcaaagcaatctgtgggttcttttagtcagtctaatatttttatgttgctatgcattggatattttcacaggtagtattatatttaattaccattctatacttagaagaaattgaggctggccgggtgtggtggctcatgcctgtaatcccagcactttaggagactgaggcaggtggatcacttgaacgcaggagtttgagaccagcctgggcaacatggcaaaacccatctctaataaaaatacaaaaaattatccaggcatggtggcacacgcctgtattcccagctactcaggaggccgaggcaggagaatcgcttgaacctggtgggggcggaggttatggtgagccaaggtagcacctagcaccactgtactccagcctgggcaacagagcaagactctgcctcagaaaaagagaaaaaagaaaatgtgaggttaagagatgataagtaatttattcaaagtctcacaaaattagcagcacacaaaggtttgctgaagtcaagactactgctccttcactagatagatctgtaaggtagtaaacaaatttaataaatatcccagcataacctttagatatctttagaaatcatcaagaggtcagcttttaaaaaactattcataacagcataatcctttttacaaagcaaatcttacgaagaggaaattctgcttctggccaaacagtgtaacagggaatagatttaacttcttgtcttaatcaaccataaaattaaagcaaatgtatgaaacaatcattttcagatactagaaaaaaggcagcaaagaacagtgacccctgaaagacagcaaacaaacaaggtgaccctatgattacccagtttattatctaaagggaatgtttccaggccttggcacagagaggtgaatcaagtggatttgggggatccttctgagttgagaagataaatttgggagtttaggtaggacaaagttgctaaaattcacagggtcctctcaaatcttcacctgaatactgctcagtgtatgggtatatggaaactaaccaaagatgaggaaaaaaacactggaaaggagtaagcagaaaaatcctcagagttcacggctgggaatagttcatattactaattgtgatgatttattttatatgtcaacttagagagtgcttatgatgaaattaacatttacattggtgaactttagataaagctcacgaaaatgaagactttaaaaattctccataatgaaggtgggacatacccaatcagtcaaaggcttaaatagaatgaaaataccaccctccttgagcaagaagagtgccttcagattagaactgcacatcggctttcctgggtctcctacctgcctgcccacactgccagcctccatcatcacataaacacacacacacacatatataattagatattatatatataattacaatatataatatattattttatattataaattataataattatatatatattatatataatatataattgtatgagccaataaactgtgtggataaaatatatatcacataatatatatatgcagagagagagtgagattgattttaaggaactggctcacgttatagtggaggctggcaaacttaaaatatacagggcaggccagtggactacaaactcaggcaggaattgaaatcacagtcttgagtctgaaatacatcaggcagaccagcaggctaaaaattctggcaggatttctatgttatggtcttgagctgaattccttcatctccagaaactcacttttttgttcttaaggtcttcagtggattaaaaggggaccacccaaattattgtgggcaacctcctttacttaaagttaattgatgttaaatcccaatcacatctagaaaataccttcacagcaacatctggactagtgtttgaccaaacaatttgcaccacagcctagccaactgacacataaatttatctatcacacttaaataagttacttaatatccttgtgtgcttccagttcttcatttgtcaaatggggttaatacaagattttacctaacagtatcattatgagataaaatatataaaatgcttagaatacaacactgagatctgatcttcctgcttctattttcaataccttcaaactgcctgttgtgatagttaattcgaactgtcaacttggagggtttgagatgagttagatgaggttaacatttaagtcagtgaactttgcgtagattaccttccataatgtgggtgggcctcatccaatcagttgaaagcccacagagaacaaaaacaccaaatgctcctacaccaagagggaattctttaaaagactagtttcagatttcacctgtaccatcagctcttgtgcatcaccatcagccagtttttggaccagaattgcaccacaggctcccctgggcacccaggctactggccttcaaaatggaattacaccattggctctccagactgccagcctctaattgtatgagccaattctatataatgaatctctttagatagatagatagaagatagatagatagatatatagatagatagatagatagatacatacatacatacatacatacatacatacatacatacacacacacacatccttttggctgtttctctggagaatcctggctagtatatatgtttacttgctatctcctctgctagaaaataagctttggaggggaggtagtatgcttgttgttttacaactgtacatacgtcacacatagtttgtactcaagaaatattttataaatgattaaagctgcacttgtcccactatttttagtcttttttagtgggagtgcagtaaactcatttaatcctcttactccatcattaaacagcagaattacatatacctccctaacactttgcttctctaagaaaacacttctaggttgtttggctgttcctcacatgacaaaatctttgcaattttagtcaccctttcctggccctctagagtgtatctctatccccgtatatgttataaaattctaggtagaatgggataatgcagaagactgcagaacttcgatttcaaagcatctggataccattttcttggaaattatcattgtgtgtcagtcagagccagtgacttttcaaactctgtgtgtgtgtgtgtgtgtgtgtgtgtgtgtgtgtgtgtgtgtgtgtgtgtttaaatagacacctctattgtaaccctgatggtgtctcagacctccaaaaggaaaagcaataccaaatgttccttacatatttctttctactggaacaaacttcgatgaaaaatatactggaggataatgaaattgattacatctagtaaattcatggtatcataggaggtaaaaaaaatcctatttcagaatctagatttttgataaatgggtggcatatcctgcttagaagacattacagaaaggctgatgttttgagtggtgggttttaataattaataaatgagcaatgttttccattttgagcatgcagtatgcatcccagaacgctcaaggctcatgttaaaaacaaaaactagttttttatctcggttaaaacatagttgagcataaaagagtctatatagtaagtaacaatctcttctgtgaagtccttgctcgaatcctattctggggcttatttttcatccatgtcagttcagtcactcttgtgacttacagtataatacacaagctccttagcaagccatttaaagttcttattccacattatcttttcaaattcctttcccataaagcctcctaccaatccctccaatcttgggaactttgttcatgctgctctacccatgacccgaacttaccttctattttccctgctactgatcactgtttattgaaattcagttcatcctttaaagcccagttcaatctttctttctttcttttctttttctttttctttctttctttctttctttctttctttctttctttctttctttctttctttctttctttctttctttctctttctttctctttctttctttttctttctctctctctctttctttctttccctctctctcttctctctctctctctttcttttcttttattttttgagacatggtttccctctatttcctaggctggagtgcagtggcataatcttggctcactgaagcctcaacctcctgggctcaagcaatcttcctgcctcagcttcctgagtagctgggactataggctctcaccaccatgtccagctaattcctgtatttttagtagagatgggatctcactatgttgcctaggctggttttgaactccggggctcaagtgatcctcctgggtcaccttcccaaaatgctgggattataggcgtgagccactgtgcccagccccagttcagtatttcattgccttcacaaagttcttccagttcatacactaagaattaactactaccttctacactctgtatctctctgaatacaactctcccactttgtcctgtataacagttatttagatatttaaatattttgttcacccattaaactgagaactctttgtgagcaaaaaccgtactttattcatttctattctcctatcacttaactcatggcctggtatgtggtatatgaccaatagatgcttaataaattaagtagaactgatatctccatgaggagtaaccccaaaacatgcctgcgataattcaggcagggatttgcccctataatttaaaacaatgggttttctgcccaagctaagtcctaagaaagagcagaggactcactaataaaatgctagaaaataggccataatattggaactgagaaaaacaggaacatttttaaagaaacaattctggaagaagaaggtaaataggttaacatagagggcaaaacaaagggcaatagtacaaaacagttcaaaataaatttgttatggcttttatatgtacatattactatcctcattttatggagaaaaaaattgagatttggaaaagttatataattattcaaagttctcaggaagagaaacaggtagatctgggatttatacccaattctgtctgactccaaagtccaggataagacactattaaaaaaatatctccaggaatctttttagaggaggagaaaatactccagaaccatttttcttttacaggtttataccacatttttaagggtagcctatcatgatgacaagtggcccggtatatggtattgggtcaaagcttctccaaaccttgcctcagttcagattgtgttttgaattgaaggcatgctttttaattttatttatactatacataaaattatattatgtttctcaatcaaaatcataaaataacatcaacaactatctgatattgagtactaccatgaatcaggcactgtgcaactccctttagatgtattaactaatttaaaaaataatcttgacatgttccagtattttccagggtagtagtgggcctgagtcaaatgagtagtttccctgttaatactctatcacttcaaaagttttaggtttcacacatgtatttattcatgcttttttctttgaaaaaaaattactgagctcagataatgcttctatatccgaagccagttgtcctactttttcagattctacttctactcttcagcttcattcctactcttcagaatcctaaaaaaaaaaaacaaaaaaccttggttgtaatcaggggcatttgatgctttctccaccaacttggctccaagatatattcacctgtaccatctccgtccataatttcctgcctcagaaatgctcctagacttgcttctcactggtccctttccaaagcccctcatttaacactcaggaaacattccttgagtgaccactctgtcaatgcacaggagaggatacacctataatttggaatgtaagactgagtcaaatgtagtgctctcaaagaatttagtcgagtaggaatcatccttgacccttcttttcttttttaccttcatcatttacatcttaatatccccaccagccactagatttcctatatattgcttatacccaaacacctagttctatactcactgccactagcacaaaacaggctatgtcactaacctccttcctaaaccttcagtaatcactttcattctttacactaaagtcagaatggtctttctaaatcttttagttgaccatgtcatacctacagttaaacctatccagtagcttcccagtaactataagatcaagtttacacttctcgataaaatgttatggcaaaggcaattctatttccatctatttctattgctttacctttgaccaacctctctctttccctccaaaacactcttttcttcagtgttatcaaattacttgcattttcttacatgaactatgctctttcatgcctctggacctttgcataggctatttccatggcctggaaaactacattcgtttgtaaaacaattctgaacaactgcttttgcttggggcctgtgagaataatgatatgattcagacatgatacctgcccttaagaaggttgtcagtgggtagaagcatatgggggaaagtcccaagtgtcctctaccctgattcctatacatggctcattgtgtcttgcatatccagttatagaaagtgccatttatcctttcccatgacactactgcctgtcaactggataaatgaataaaactgctcatgggatgtgatttctgagaagtgatgatttttttttctaaaggccacctttaccaaccttgaaagattgctttaaaagtcacggtgccctttgatgccttcctgtaggacaaaggaacccagagcttatctgcatgtagacattctattaatacataatgactcttaggacaagaaggaaatgtaaatgcatttcctttttggacatttccagcaaaaccaaagaagcaaaatggcctcatcttaatgaaagagactgctcttgggaatgtgtttaagggaaggttacagaagcaatatttgaagaaatatggacaaagcacaattcatcatttcttcacaggaaagtgattatcagaagaaaggtagcttcaaggccagttctatcctgcttcacaaaagattccatatacagttcaagaaaggataaaaaagaatgccactcaatgaggctatttcacgcaaggccttctctgcctttctcgacagagtctgacctttcttacttctgatgacattgcctctctccttagcccatgcccttacactgtccaggaaaagaaatgtctcccaagatcccactctcactccccagaagagctagctttctaaaacaaaaaatctgtgttatttctttgattccttcagcaatgtctgcctgtatattgtatgaaaagattaagagtctcagcatggcattttaaatccctctacatcttaactccacctacctctgcagctccattcttgctgcaaactctagtaaaccactatttggtgctcctgtacccaccatttcatacctttatgccttggtgctattgcctcagtctggaacacctttattcccttttcatgttagttgttcactgcccttccagatctattttgtactcctctcagcctgcttgtatcctgggaggctgggaggttaacctctacagatgacatcatgtaggaccccctatcctttcttctcttcctatctagatttggccaatgaaaagcactggtgggagattggagagcaggaaaagaaagaggtaggatacttattctgtcctaccttcacaaggccacataaaagagttgttacagttcttccaagactctagtaagagcttcctccccttatcccttcagtatttggggtggaaacagcttttactattgccagtccctggatgctccttcatccctgatgattctcttaaacctgaactaatatttgtaaacagtctctttattaaactctattcagttacttttttggtatgatatatgtcttctgttgactctgatgacaaaccttcctcacccaactaatctctcaatctttaagatcattttagaggggatcttcccagaaatccccatggctagcctacagagttaattgttgtcccagatccctacttgtattgttatcacatacttaccacattggattttaattgtcatgataaaacataaattctcttagagaaaggacctcgcccatattgtttatgctgcttacccagcaattagaatggtgcccagaatattttaagtgttcaataaatgtttgatgaatgtttacttgaaagtaataagtaagtctatattatctctacatcctctgcttctggtgaagagaagataactcatatatactacttgaattcaacttttcttaaaagaaaatgaagtaaaaatttccggagtaggtatgagagaggaaaagtaaaagaaaacttttgttggtaagtgaatataaaacagttaaatatcatatgaacacctactttcccccatcttgaaggagatgggggctaaaataaaggaagcatttagaaatgagagtgacacaaaactatgagactagaaaaatcaggacagtaattatgtactatgtgccttctatgttccaagctctgcattagtggcattgaaataattcttatctcttttaattcttccatcaacctactgaagctgatattattatattaccaaagagaaaattacttccaaaaatgttaagtaacttattcatggacacccagctagtaagtggcaaagcaaagattcaaatctatgactgtctggctttaagtatagtgctcttttgcttttaacacagggaagaatcttcacatgtcattccctactaccttcaaactgttaagaaccatgaagagtctgatattttatcctacatgcaagctagcaaaataacctcctatagtttcatggatactaggagaagatacaagactcctgggtcacaaaagacttatagcaatagcagtaggtagaatatcagcttttatattcgttttcctgagccccaaatactaagaagcaatgcaaagagggccaggcgcatacagcatgaatttcgttactggtgagaatcctgagctaagataattcaaatgttttaaactggatgtaagcacacctgtacctggctccagagggatatagtattctctctaccaggaatgatcactctacaaacaccctgaaaagacagtctgaaacaaaggcaatcagttccatgcttgtgagacacataaaaatgtaagatatgtacatcttacatgccttgtctcccaacacaaacttcatgccttgtctcccaacacaaacttcatgccttgtctcccaacacaaacttcatgccatgtctcccaacacaaacttcatgccttgtctcccaacacaaacttcctgtctggccctgatggagaatttcacgacaacattgaaacaaatgtaaggcccttctgagtgtgaggatttttgaattgtacaagtaacatatatgaagatactccatccatgaataagaccttaaaaagaaaaaatgttgcaggatgggggttggggagtacaggattttatgtttcacaaaaagagttcaactaccagcctggccacatattttctttgtgatctggggacgtaatctatatcccacctcttaatctatctcatcttaaatgtcttcatctaaaaagtataaataatagtgtctacctctaagtaccactgtgaaaacctaacactgttgaggagattacactaggaatagtatccgaggagagagaccactgatttgaggtaaggaatgagagagagaaccctggtgagagggagcagtgggtttccatgtttatcagtttgggtcatttggcaagaaaaaaaaagatagcattagatgtgctagagagttttaggaataactgcacattaagaataagaaggaaggagcaagagtaggcaaggtgagctttcagacagcgttacaagtctgtcacctgcgaaaggagagaagaaaggaaggcttctgtaggaaaagccccagactgtgatgtagttcagagaaagtttcagccaggccaatgggaaatctgagcacaagttgcctgttagaagtttccctcactgagtagtaatggtccagctctattacccttaccatactcagtcattggctgggagtagcccgaagtatgtgtggtctggtgtgttacccagaagttcactgttaatgattctctccagagaaggttttttttaaaaggaaggtatgagcagcacatcattgtggccaccaccactctatacccatatatcaaactggaagaggactgaggcctctggataaggaaaatgtggtaggcctatgaagactagacaaatgcgaaatttgtatgccctagtatagtgtggaagcatcagggggtctaaactcaagagcatttgcaggctgaggcttcttcacaatcagaattctcatcctgaaaagctcagtgaaaatataccactgccttgatgatgtcatccctgatcttctatcattccccactttgtaattttctttctcttgggaaactaccacacattgcctagaatggtttgtatgaattgttatatgtgcattcttacctcaccaattagatagatgctttcttaatagcagagtttatgtcttatttaatgcagcatagaactgcctggcacagaatgggaatccatgcccgttttggctacatgtcttgggataacactgctgcatctttcttcgacatcagcacatacccattttaaaatacagctccccttcagtatgatattggctgtgggtttgtcatagatagctcttattattttgagatatgtcccatcaatacctaatttattgagagtttttagcatgaagcgttgttgaattttgtcaaaggccttttctgcatctattgagataatcatgtggtttttgtctttggttctttttatatgctggattacatttattgatttgtgtatattgaaccagccttgcatcccagggatgaagcccacttgatcatggtggataagctttttgatgtgctgctggattcagtttgccagtattttattgaggatttttgcatcaatgttcatcaaggatattggtctaaaattctcttttttggttgtgtctctgcccggctttggtatcaggatgatgctggcctcataaaatgagtcagggaggattggaagcattccctttgaaaactggcctaagacagggatgccctctctcaccactcctattcaacatagtgttggaagttctggccagggaaattaggcaggagaaggaaataaagggtattcaattaggaaaagaggaagtcaagttgtccctgtttgcagacgacatgattgtatatctagaaaaccccattggctcagcccaaaatctccttaagctgataagcaacttcagcaaagtctcaggatacaaaatcaatgtacaaaaatcacaagcattcttatacaccaataacagccaaacagagagccaaatcatgagtgaactcccattcacagttgcttcaaagagaataaaatacctaggaatccaacttacaagggacgtgaagacatggagaactacaaaccactgcttaatgaaataaaagaggatacaaagaaatggaagaacattccatgctcatgggtaggaagaatcaatatcatgaaaagggccatactgcccaagataatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctatagtaaccaaaacagcatggtactggtaccaaaacagagatatagatcaatggaacagaacagagccctcagaaataatgccacatatctgcaactatgtgatctttgacaaacctgagaaaaacaagcaatggggaaaggattccctatttaataaatggtgctgggaaaactggctagccatatgtagacagctgaaactggatcccttccttacaccttatacaaaaattaattcaagatggattaaagacttaaatgttagacctaaaaccataaaaacccaagaagaaaacctaggcattaccattcaggacatacgcatgggcaaggacttcatgtctaaaacaccaaaagcaatggcaacaaaagacaaaatcgacaaatgggatctaattaaactcaagagcttttgtgcagcaaaagaaactaccatcagagtgaacaggcaacctacaacatgggagaaaattttcgcaacctactcatctgacaaagggctaatatccagaatctacaaagaactcaaacaaatttacaagaaaaaaacaaacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagatatcatctcacaccagttagaatggcgatcactaaaaagtcaggaaacaacaggtgctggagaggatgtggagaaataggaacactttgacactgttggtgggactgtaaactagttcaatcattgtggaagtcagtgtggtgattcctcagggatctagaactagaaataccatttgacccagccatcccattactgggtatatacccaaaggattataaatcatgctgctataaagacacatgcacacatatgtttattacggcgttattcacaatagcaaagacttggaaccaacccaaatgtctaacagtattagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacacggtatattctcactcataggtgggaattgaacaatgagaacacatggacactggaaggggaacatcacactctggggactgtggtggggtgggggaaggggggagggatagctttaggatatatacctaatgctaaatgacgagttaatcggtgcagcacaccagcatggcacatgtatacatatgtaactaacctgcacattgtgcacatgtaccctaaaacttaaagtataataataataaaataaaaataaaaaaaaatacagttcctgtagccactgaaacactcaggactttcacacaacagtattcaggctgatccacatgaacatttctagtatggataaaaaagacttccactaggcactgagaagtaaatttccatttacttttatttatctcctgacatacttggcattgtaactgatgcaaaatagtaataataacaggaacaagaacgagaacaagataagaaatagaaaggcttttgtttatttttacttcatcaagatttgagcccaagcatttcattgtttaccaaatgcacattataagttaggcaatgcatcatagaatacaaggatagttcaacatataaaaagcaatcagtataatacaccatattgaaaaaatgaaggggggaaactacacgatcaattcagttgatagagaaaaaaaattttttgacaaaattcaataccctttcatgatgaaaaaaaaagtcaacaaactgggaatagaaggaagttacctcaacataaaggtcatatatgaaaaacccacatctaacattattctcaatagtgaaagcctgaaagctttccctctaaaattaggaacaaggcaagaatgcctactcttgccacttctattcaatacagtactggaagtcctagtcagagtaattagccaagaaaaagtaaaataaaaggcatccaacttgtaaaggaaaaaagaaaagtatctctgttcacagagagcatgatcttacatgtaaagaccttaagagtttccaattaaaaaccttttagaggtaataaaaaaatttagcaaagttgcagatacaaaatcaacacacaaacaaaaatcagttgtgagtgcagcatggtgttacatgcttatagtcccagctacttggaaggctgatgtggaaagatcaccttagcccatgagttcaaatccagcctggacaacatagcaagacccttttcaaaaaagcagttgcatttctatacattatcaatgaacaatccaaaatggaatttaagataataatcctctttacagtagcaacataaataataaaactcttatgaatgaatttaaccaaagaggcaaaagatgtgtatactaaaaactacaaagcattgctgaaagaaattaaagatgaaaaatgtcccatgttcatggattggaaaacttaatattactaaaatgtctgtactactcaaagtgacctacagatttatctacagattcaatgcaatcattgtgatcacaatgacatttttcattattttgcagaaatacaaagaaaacctaaaattcatataatatctcataagactgaatggccaaaataatcttgaggaaaaaaaacatagttaaaagcctgacactttctgaattcaaacatattacaaaactacagtgatgaacacagtatgatactagcataaagacagacatttagaaaaatgggacaggatagagagccccaaaataaaccctcacatatatggtcaactggctttgacatgagtgtcaaggctgcacaatggggaaagtacagtttcttcaattactggtgttgagaaaactgtatatccacatgtaaaaaaatgagattggacacttatgtcacactatatccaaaaattaactcaaaatgaattaaagatctaaatgtaagatctgaaactataaaactcctagaaaacatacaggaaaagtttaataatattgtattcagcagcgatttctggcacagataacaaaagcaaaaaagaaaaaataaacaaatgagactgtatatatatatattttttttttttgagatggtgtcttgctctgttgccaggctggagtacagtggcgtgatcttggctcattgcgaccgccgcctcccagattcaggcgattcccctgcctcagcctcctgaatagctgggactacagctgtgtaccactacgcccagctaattttttgtattttagtagagacggggtttcactgcgttggccaggatggtcttgatttcctgaccttgtgatccgcccacctcggcctcccaaagtgctgggactataggcatgagccaccatgcccggccaactatatcaaattttaaaacttctgcacagcaaaggaaacaatcaatggagtaaaaaaggcaaccaatggaatggcagaaaatgtttgcaaaccatatatctaatatggaattaatatacagagcatatttttaaaaatcttaaaactcaatgataaaaaattcggattcaaaaattcggaagagacaattgtgaaaagaagatataaaaatgggcggctgggctcggtggctcatgcctgtaatcccagcattttgggaggtcgaggcgggcggatcatgaggtcaggagctcgagaccaccctgaccaatatggtgaaaccctgtctctactaaaaaatacaaaaattagctgggtgtggtggtgtgcacctgtaggcccagctacttgggaggctgaggcaggaaaattgctggaacctgggaggcggaggttgcagtgagtcaagattataccactgcactccagcctgggtgacagagtgagactccatctaaaaacaaacaaacaaacaaaaacaaagcaaacaaaagccaacaggcatatgaaaagatgtttactctcattatcaccagagaaatgcaagtcaaaaccacaatacctatcatttcataatccttaagatggccactatccaaaaatcagaagaaaataagtgttgacaagaatgtggagaaattggaaactttgtgcactgttggtaggaatataaaatgatacagcctctctagaaaaatagcagcaatcacacttctgggcatatatccaaaaataattgaaagaaggatctcaaagaattatttgcacactcatgttcattggagcattattcataataggcaacatgcacaagcaaactaaatgtctattggcaggtgactgagtgtaagaaatcttgtcatatgcttcagcctgaatgaacctggaggacattccgttaagtgaaataagccagtcacaaaaagacaagtactgcctgatttctcttatatgaggtctctaaagtaatcaaactctagaaatagaaaatatattgccaggaactggtggtgggaggaaaaaaggggttgttcaatgagtatagagctgcgtttttcaagatagaaaagttttagagatctaatgcacaacaatgatcatacagttaacactactgtatagtatacctacaaatggttaggacggtaaattttatgttctgtgtgtttttttactaccataataaaatgacaaaagtgcagatttactgaataaaagactacattcttgtgttctttttcaaactaaagaagtttcaaactctctaagatgtatctaggatggtgagatcttggacctattatttatttcaagatatgtgcctttataaaatatccctaaatgaaataaaatgaaatacattaaaattccatttaatgagaattttcatggttagcttctttattgttttttgatgtagatttattttaattattggttacaatattaaagaaggttgtatattaaaaagatctatcaacatttgaaggagtctttaatcaaacttctttatatcttttgtacaattttctaagtgaaattattctttagccttaatacaaaagaaactaaaagaagagaagacataaatattatagaagattttgggtttgaaattgctttctttttgtcatcatcactcacagcagggcatccaaaagtattggtattctgtggcctaaactttatagataatgccctaatacaaaaggggatgataactctacttaggcaaaaatgagagtcaaatctttgtattccagttataaaatatcacctttgctatgtatatatcaagtatctaaagcatctagtcacttagtacattagtaaaaatctgtcaaaactatagtagcacccaatgtagttaatgctgtggtaaactaattctgtttctcctcttgtagacactataaagaaattcttacaatcctactgacattaatatggaaatgtgtaaaggcaataatgacattcgtattctttgaccccatgatcttacactatttcccacatcatttcttaaacatataatacaacagaagaaaaaatactaaatgttagaatatgttcattaaccatatcagtttaaaaaaatgaatacatatattttttggatggatggatggatgtgtgtgtgtgtgtgtgtgtgtgtgtgtatctccaacaaagagaatgaggtaaatcatggtgtaaccatgcaattgtgtagtctttgaccattaaaattgtaattgcaaagactatgcatggaataaaatgtggattgacactgaaagattatatgatgttctgatgttaaccaatataaagcaaaatataatctcacatttcttgctgcagccatttaaaatgtgtatacgtaaggagaatactagaaagaaataggcaaaatggaattaattgtgttttgggggaagattagtgttaatttttaaaaactgattttctttttattatttttggaaacacaatgtacagtaaaataaaacacatatatccctgttcacttgatgattcagaatatcatctcttcaggctctggtcagcaacttcaaaatgaagtatttatcagctcagatggaatgtctgattaagacaattatcattttagagttggaacaaaatttagctctatcatgcctgactttaaaactgtataaggaacttcaaattggctctatattctctctagctagttaattcatgataaagctgtgagaccttgggcaaggtttattaacctttttaaatctcagttatcttaactacaaaatgaaggtaataatatctatctcatgagaattaaataaaataacacatatgtgatagcatttaatacagtagatactatatagaggcttcaataaatgttagattattaaattaaactttttaattaagaaatgaattaattaataaactaatacacatgaataagcaaagagtcaattttcaagttctagttctgctatatattagctgtgtgaccttaggcaaataacttgactttttcaagtttcagttttcttgtgtataaattgagagggttaagtagaagaatcttcagggttcctttcacctctaaattctacaaattacacatagatgacaagtgtgataatagctttacatgcaaaaatgaggtatacattacaccactccccttttttgttgctaataataaaataacccttatgctctttctaaaagaagctcttgataatcatttatgcctcacttttaattaagcagctcaacctactttattaaagttttgactattttacagttaacattagatgatttaaaaaaaaaacagaccgggaaatgaatcagcctgtcagcttatagactcctttcatcctatcttttcaccatgtatgattccattgagattttaagtaatgaactaatagatacccaaactgaaaaaggttggtatgtgctgacaaaaatgtggtgttaatgtcaaaacattcaaaaattcagtaattcttactattcaatctttaccagtctcttagtttttgctattatgtttctatgttttcaaaacaccaatcctagttatatatttaaactcctttctgatattgatgcatttataatgcatgctagacttttgtacccattattaacgtgatcatatgcaactcttcagatcgttaatgcttttcataaaggctctaacaggtaagagttacaatatttgaagccataactacaagaggtaaggcagcttcataaaaggaacatgaattttggaatcagatatctaaatttgaatcctagttctgccactgtagtcttggtcaagttataagagtcagttcatttgtaacatggatataagatgcccaatacacaatgttgttgtaaagactgaacaaaataatacacaaaaaacacataggacagtggttgacattgtcaggtactcaatttatgtcccccagtcagttaactagatttatttctattaccatacttcaataccatcatcctatgcctcttcctaaaataatcatttttaaattctaataagaacacatatttgtatagtgcaggagtggataaactttttcataaagggcctgatagtaaatagtttaggcttataggccatagagtgtctgttgcaactcttcaactctgacaaagttgtaatatgaaagcagccaaatacacataaataaatgggcattgttgtgttaaaatataacttaatgtacaaaaaaaaatagctggccaggggcaatggtttgctgatccctgctgtagtactttctaaagcatattacttataatagttcatcttctcagcaacctagaggaaggcatgctatttgtacatccatcttacaaatgaagagaagcagagacatggttagacctgttcaagatcatacagtagtaaatgtcagatccagcactcaatacttcaatcattatcctatgattcttgattaaatatgctacaacatcacagaaatatgactcaggataagcaaaggtcaaagcattgccacaaatggccaggtttttggttcatatgctaatacgtaatatccggaagagtaatgtccccttagtgtaaattgtagaaccaaactgcaaagctctgtaaaacaatctgggttccctactagtgagtgcctcatcaccagatgcattcgcacagaagtttaatgcctctgtcaggaaaactgcagaagaaatcatggataaggaggtaacagaatggctgaggttcctctaagatttgaagcctaggttcctgggatacaaatatgaatacatcagaggttttcgaaaggcaatttgagaataaatcatgtctcatttagataaaaaatgtttagcgcaagaaaaccatgagatcacagtttgagtggagacaatatgttaagaatgaagaagtgacttggaaggagataaaacaaggtaactagaattggcttgcttgaaggtccaactctgtggcaccaaaaacctctttgaggggtagattgtagtgctgttacctccttccttcagctaagaatggggaatgagttggatatcatagacttgctagcctgaagggagatcatctgccatcaattttttttttatgtgtaaaaagagactcagaaaagagaaataatttgactgagggcaaacagcaagtcaacagaggaaacagaccttaaatccatcctacatgtctccaaagccctttgctcttctatttgcctagctggttaattacttcatttcaaacctaccatagtcctgaaaactaagtactattactctcattttacagaagaggaaattgaggcttgacttgagaagtcaagtaattcagctgataaacagtagagctagtattaaaacgtggcttcttgttttctagtcaaacactgcctgtcctctcaagccccttctcatgcctgaactaagctggtttcctgacactacttgttataaatattcctgagagctcagcaaaacatttaaacatggattcatttataaatgccaccacagacttcttgaattgagaggaaatctgagctcctgtttatagagctgacagtgaggaagaaggggaaactctgtggtcctgtgctcttggaagacccttttaaggtttcatatgacaaggaaatcagattagctactaaaatagaagccatggctcacatttcttgggaaaagtgaattatgtcatttttaatacttcactagcttgacttacataaaggtataatccaattgaggattctgataattgtagaattctcaagcacaggcagtagactaaccaaggagaaagattgtcattctctgaataaccagcaaaatttcatgctaggctagtcccttggactctgtttctatggacccagttaaatacatttgaatctttctctctggtaaattcaattcacttctgaatggtttgtgagaagaaaaaaaaataatgattacacagatggaagtggtcaaagtcacagagccgtgactatcaccatagatggttatgttcatgcaacaaaaataactggattaccattttaccactgtaattctcataaaggctcagaagtctcagaggatctgtccactatgctgttaaaacttgaaaatcgttaaaaatcatctttaggtttatcttctcttacaggaggaaattggggcctcaaatggccctgtgttcttggcaccagaggatgatcaatgataggaaaaactgcatttcatttgcaatatatcctaagaacaatggattacagggctgctggaaaacttcactaataatgaaggagacatactcaaaaatctctaaggaagaaactgtgtgtattacagattatttgtgccaaggccctgtgctaggtgctttacatacttgcattgcttttcacaagcataaaataggtatagctttctctttcttacaaataaggaaactatcttacaaaagtttcttaacttgtctaagatacacagtacaggaagtagtagagctaccattggaacaccaaagtctatattctttctaccatagcttctatgctgcctgtcccaatcctaaaattctgttatcttataatggtcattatccatttggtgttttggcccactagcaactaccttgacagcttattgtctatgacagagactctgaccattcatttattctgcaggcatatgctagatcttttacttgatccttgagaatataacactttctagttttaaggagctcatagagaatggaagagagaggcatggggtacaatgcagtatcaaaaaggcccttacaccaggctgcggtgtgagggaagagttcaagaggagatatgctgagctgagtcttaaagaatgagtggaagaggaagatgaaattcttagaaaagagtgctgaaggaagaagggacggcattccttgaaaggaaatgtgcaaagttatggacatagagcagatcctagcactctgtgggaactggtaatagttgagcacagttgtagcatacaatcagcgtgagagattgatcagaaatgagaatgaagaaggaggcacaggcaacattgaagagggccttgtaagtcaggataagaatctagactttatcctgaggttagtgaaaagacatcacagggtttaaagtcttacatggttaaaggtctttttgatctttaaaaagatcttgtttactattgtgtggagtatggactgaaagggatcagacttgagctagagaaaccagtcagaatgttagcatagtgatccaaagagctaatgatggcctgaagtgaacaaagacagtggcagtgtggatagaaaggaggaacagatgtaagagatgcttatgattaaatgtaggaatgagagagcatgaaaaatccaggataaccatgagttttttttttttgtttttttttttttttggagacggagtctcgctctatcgcccaggctggagtacagtggcgcgatctctgctcactgcaagctccgcctcccgggttcacaccattctcctgcctcagcctcccaagtagctgggactacaggcaccggccaccacacccggctaattttttgtatttttagtggagatggggtttcactgtgttagccaggatggtcttgatctcctgacctcgtgatctgcccaccttggcctcccaaagtgctgggattacaggtgtgagccaaccatgaggttttgaacttggggaaatgggtggatactggtaccattaataaagagacaaaatattggaagacaagcagaatatgaaggaaagaagatgaatttaggagtcattcagcatttattgagcacatgatgtgtgtaacctctcttctgagcactggctgttctagatataacttgatctcaacatctggtactagtaaagtgtgcctaggtgataaagcaacagatgctatagatctgtctgtccaatacagtagtcactggcctaccaaatttaaacatgtggctgtttaaattttttaaaagtaaattaagtaaaattataatgatagtttcttagtcacaacagccacattatggctaattatagccacattatggttaacggctactatattaagcagcatagacagggaacatttccattactgtagaaagttctatttttgggggcattaagtagttggatatccttttctctggagtataacagctggcagagccctctaaatggcagctgtggaaaacacagttaagccaggaaccgtgtttctcagaatgacttttgctacatggttatgagttggtcaatgaattggtcaatgtgtaacttctgtttttggtaggagcagtctcttaatagtgaaccactaatgtacttgaggcacaggccaggcaatgacaaaagaagtaaaattttagttcgttagttccttaggcttagttccttagtcacattagccacattcgagaactcaatagccacacatggttagtgattactcacgagccttgtcacatgccaatttcacatgtcaactaatgtgcaattttcaactgtgtatacacacacacacacacacacacacacacacacacacatcatatacatgcatagagaaaacactagaaagaaatttaccagcatgttaatactggttctctttgagtggtacaattacaagtaatttactgatctttattttcttcagaagtttccatgtttttcatgagaatatatgattttgtaatcataaacaatatatatttctagtaaaatgtacattttgtgtgccttcaaagtaagtattataataagcaaaaatttcaatgttagtttaaaatctagctctgtgacattctatttgtgtgactttaggcaagatttttagcatgtgagcatcagttctcacctctgggaaacaaagaaaataatacctaacttgtggttgttttgaagattaaatgcagtaatgtaagttaagttattacagcaaagcttgacacatagtaggcactcagtgaatgatggtactggcacagttaattgagatagtaatggttattatagtattagtagtggtactagtagtaatagaaaaagtaaaataataaatataacaacagtaataatgacaacagtaacaataaagctaaagtaagaatgaattttagttatcagttaggccaattgagtcacattattaagaaatcaaggtctggagaggctggaagattgtacaatctggtgcaaaattcacttcttattcccaatactatattgttatgtcaccaatattttagattgcatagaattttgattttgttcagttgatatattccagcactctcaagcgagagaagcaaaagacaaggtcttgcctctaacagagctcacactttatcagagcccaaccatactatttagaaaatactgctaagggctattagagaggtatgaaaatatgcagttggagcacaaaggaagaaactactagccctggttggcttgaggtagggaaaaaagcaagttcacagaggtgatttctgagttaagtttcaaaggagcaagagtattttgatagggaattaagagggaaatgttcactaagtgcatagagctgtgtgtgagtgaagacctgaaagcttgagagtgcattgtgatgtagggagaaagttgatgtggatacatctatgacagagaattcatttacctgattactcacatttacttgattactcacaacaaaatttgttgaacacttcggtgtgccagacaatgtgctaagctgaataggtgatatgtgaaaggctctgaatatcaagccaaaaagttgaaactttattctacagacaatggaaatagaagcattttaagacaaagaggaatgaaatcaaatttcccttttgatctgattactctactgctgactggtctatttcccctggataggagctagatatttgggatcaaaagtgtcactgacattaaaaaaaaaaattctctgagaattgcagctgaaatggagcagaccttcctggagtatttcattttgtgtcttgtgctgtggcaacacgaaagtatcaacccttccccattgattttctagtggcagcaacaaaactgcactttgaggagaatgaccactgggttgattaagatttgaaaaatgttgaatttattctataaattctggcccaagctgaagaggtgctaatgtgattggaactcatgcagtaactgtcagaggcaagagatcgatctgaaattcatgttcaaaatcctgctttacccactgggcctaatccagtttttaaagctgagcagcttctgtaagaaacacagggtcagactgctcccaccccacatcactgttgcctcatatttcagacacatcatgaatggttaatattttaaaacttaaatgagatgcagatcccccctcttcctccagagaaagaaaaaagaaagaaaaacgtaaaccctgaaaacatattaaaagtttcttaaattgagaatttccatggcaaagatatatttggtgcaagcaattcactatatgtcagcctaaccttccctctgctcctgcattgcttaaaattcactaggtataccattttgtttcagagataagtccgcctcagcagggaggatgggctaagtcaatgagcagcttcatttatatctgcaaactctgcttttcaatccccagttgatcctggacccacagcacagaaaatcaggtgtttattttcattctggtctctctgcctaatgctttccttcaaaaagaataaaacttcctgaatcctagaagaaaaattaagccaaaccatcaatcttgcctgttttttcaaacaatgcccctgttctagaaggatatgaaaagaaaaaaaatgctagacacacctaactctataagctgagtcataatacagacacatttgctattacaaagtgctgattggcatgaccttaatccatctcctttgggggacaaaagtgtgttttcttatgtttgtgctgaaatatgcacacacattaaggggtcattaatatgatttgaacactgattatgtattaggctgtgagtaaaatgtggtctcatggtaccctaggctatcttgatcagggcacttacatactgtaatatgatcatttaggtacaagtatcaacttgaagaaaaagggctttttttaaaaaataattttaattggtttaatgcctggaacatggcaggtattaaataagtattgaatgaatgaaagactgcatgaatgagattgagagaagtacaagaaggtgaatataaaaataggaaaaaggaaaaaatgagcagataaaagaaagggtatgacacatatgttggaaataatgttaaaattttgccaaacactagtgtgtgtgtgtgtgtgtgtgtgtgtgtgtgatattatatatatacatgtgtgtgtgtctgtgtgtgtagtgaactgcacatgtgagggatctaagttgcatgttccttatgagaatgtatttgaatcatctgtcctcactcccactgtctgtggaaaaattgtcttccacaaaaccagtccctggtgccaaaatgtgtgtatatatatatatgtatatatatatatatacacatatatatacatgtgtatatatgtatatatatacatatatatatgtatacatatatatatatgtgtatatatatatatatatacacacataaatatatatatatatatagccagtggtccatatatcagtggtcctccccaagcataatctcataaaacagagcatccccttaccctctcaactggaagaaggtaggaagacactctgtctattctctcctcatcttaactgggtattgaagacccagtgtctacatcaaccaaattatccagtaaccagaaagttatatagctgtccttgtgctgcatcagagttactttttgagggattattgttctcccatgctaatcttcacctatcttcctctgtcttgcagagacttaactcccagatagcaatactgaaagaaggtaagagaggactattgatacacaaagcatcttggaatgtgtgtgccccacacttcctaaggtaaaggatagatactagatgcagggaaatacgcaaacatccctgtaacatacatacttctaagtaccaaaaaataaagacaggtaggcatttgtgtatgaatgtgtgtgtgtgcgtgtgtgtatgaatgtgtgtgtgtgtgcgtgtgcacatgcatctacatatgtgcatatgcatatatgtttggaaagtagtggaagaagtgaaataatctgatgtcaccatatataatcgagctaaaaaagattcttctaaacactaggaattagtgtgggaactgtacagcatgatttttaatagcaaaaatatgaaaaaataaatgacattcaacatgtaaaataaatagttctgtgtttatatgtttgagtattttgtactctgagaccatttaagtgtaaaaataagatataatactgtgtgaaaaaagcagaatataaaattatacagcaaaatttcaaaagctttcatgtaaatcacttcctgatcccactcctcttcactgttggcaaactatttgaattttgctctaaaagaaaaaagccccagacatttcctctttctgcacagctcccaacataagatagggcttcaataaatagttgctgaatgaatgagaaaacgagtaaatgcagacattctctaggccagtggtccccaacctttttggcataaggaccagtttcgtgggagacaatttttccgcagacagtggggtggggatggtttcagggtgattcaagtagattcttataagtagtgtgcaacctagatccctcgcatgcacagttcacaatggagttcacacttctatgaggatctaatgccactgctgatctgacaggagacagagctcagctttgctcacttgcccactgctcccctcctgctgtgtggctcagttcctaacaggccacaaaccagtactggtccatggcctgggagttgaggaggctctaggcctcttgaaaagagaagcacaatatagaatggcttctgttaaaggccccactccaccaaaaaaaaaaaatccttctcagggtcagctgccccatctgcccacaatgaagataccacaatgaaactagagaatagaaaccacaaaaataagcatgcatgcatctttaggtatgcatgtatctttaggtggtgtgggtgaagcaggtgctttcttcaattatttcccttctctgatcattagaagtcagggaatagcagaagtcagacccctataacttgcaagaccttactttactgtgccaaaactttctctaataacaactcacaataacacaatgatccagcatgaataatatacaggtaaaattagtaatccagaattgaatcagaagagtatttaggtaaaaaacaaaggggctaaaatgacaaattggtaaaaaagcaaacaaacaaacaatgacagtaacattcccctcatgtgtttttaccttatttcaccttctcccttatactagctccttctcatcagcatttaagtatgcttatgtctctccaattttctctagccagcacactagctctcccaacttccttacaaatttcgttcatccatttatctacacatacatctaataatttatttgtaagcttattatgtgtcaaaaacaagctaggtatatggataaagtgaatagattagaaagctttctactctactgtagcctactttctattgaaggaaacacaaaccaagacagacaaaacagacaatataaaaaggctacaagtactgtgcagaaaatctcattaaagtactttgtttgtcttggatacttttaatacaatatgctcaaaatgcccccagataccaaaacctgctcttcctcatttgtctcctgtgatggttaattatatgtgtcaattgactaggttaagaattgcccatatggctagtaaaacagtatttctgactgtctgtgaggattttttcagaagagattagcacttgaatgagtagactgagtaaagatgttctgccctcagcaatgtgggcaggcatcatctatttcattaaggacccaaacagaacaaaaaggcaaaggaagagtcagtcagtctctctctccctctctctctttctctctctctctctctctctctctctctctctcgctcctgattttcagacctgtgaactctaggacttacagcagcattcagcccacctccccacaggttctcagaccttcagccttggactgaattataccactggcttttgtggttctctagcttgtagacagcacatggtgggacttctggccctccatactcttgtcacccaattcccatactaaatctcctcttatatatttatacatatcctactggttgtgtttctcaggagaacactgaccaacacattccctttatcagtaaatagtgcaacttgccatccattagtcaaagccagaaatcttcaaaactatttgactgtttccactctttttttaatttttgtgtgtacataggtgcatatatttttgggttacatgagatattttgacacaggcatgtactgtagaacaatcacctcaggataaaaagggtgtccatcatctcaagcacttatcttttgtgttacaaacaatccaattgtactcttttagttatttttaaaatgtacagttatattatttctgactatagtcagcctgttgtactagcatatactaggtcttattcattctgatttttttttgttttcattaacaatccccatttccctgccaccaccctactacccttctgagcctctggtaaccatccttctactctctacatccatgagtttgattattgtaatttttagctcctactaataagtgaaaacatgtaaagtttgtctttctgtgcctggcttatttcacttaacaaaatgacctccggagctccattcatgttgttgcaaattacaagtttcattctttttatggctgaatagtactccattgtatatgtatcacattttctttatccattcctctgtttatgggcatgtgggttgcttccaaatcttagctattgtgaatagtgctgcaataaacatgggaggcagatacctcttcgatatactgatttcctttcttttgggtatattcctaggaatgaggttgctggatcgtatgataactatattttttgtttttggagaaacctccaaattgttctccatagtggttgtattaatttacattctcgccaaaagtgtatgagggttcccttttctctacatcctcaccagcatttgttattgcttgtcttgtggatataagtcattttatctgaggtgaggtgatatctcattgtagtttttatctgcatttctttgataatcagcagtgttgagcatcttttcatataacttttttccacttgtatgtcttcttttcagaaatgtctattcaggtcttctgtccatttttaatcacggtattagctttttctttcctacagagttgtttgagctccttttatattctggttattaatcccttgtcagatgggtagttgaaaaatatcttctctcattatctgggttgtctcttcactttgtttattgttttctttgttgtacagaaggattttaacttggtgtgatctcatttgtccatttttgctttggttgtctgtgcctgtggggaattactcaagaaactctccagtccaatgtcctggagagtttacccgattttttcttgtagtagtttcatgatttgaggtcttagatttaagtctttaatccattttgatttgatttttgtatatggtgaagcataggtcaccatatatgatgagactggtgagatatggtgagattctagtttcattcttctgcatatgaatatccactttcccccacaccacttattgaagagactgtgttttccccagtgtatgttcttggcaactttgtcaaaaatgaattaaccataggtatgtggatttgtttctgggttctctattatgttccactggtctattatgtttgtttttatgccagtaccatgctgttttggttactgtagctctgtagcataatctgaagtcaggtaatgtgattcctccagttttgttctttttgctgaggatggctttggctattctgggtcttttctgatccatatacattttaggaattttttttctatttcagtgaaaaatgtcattggtattttgatagggattgcattgaatctgtagattgctttggagagtataaacattttaaaaatagtgatctttccaattcataaacatggaatatctttccattttaggggtcttcttcaatttctttcatcagtgttttatagtattctcttccacttctttggttaactactaggtgtttaattttatttgtggctatcataaaaaagattactttttaatttctttttcagattcttcgctgctggcacatgaaaatgttactgatttttgtatgttgattttttatcctgcaactttattgaatttgctgatgagtcctaataggtttctggtggagtctttagattttttcccaaataaaattgtatcatttgcaaacaagaataatttgacttcttcctttccaaccctttatttctttcttttgtctgatttctctagctaggacaatgtgttccaaatgtagaggaaaagctttcagtctttttcccattcagtatactagctatgggtctgtcatatatgggttttactatgttgatgtatgttccttttatacccagttttttgagggttttcttcaagagaggatgttgagtgttatcaaatactttttcagcattgtattagtccatcctcgcattgctatgaagaaatacccaagactgggtaatttataaagaaaagaggtttaattcactcacgttccacatggctggggaggtctgaggaaacttaaactcatggcaggaggcacctcttcacagggcagcaggagagagaatgagtgccatgcgaagggggaagcaccttataaaactatcagatcttgtgagaactcactcagtatcatgagaacagtatgggagaaacaacctctgtgattcaattgtctccacctggtctcatccttaacacatggggattatcagaattcaagatgagatttgggtggggacatagccaaatcatatcacacatcaattgaaagaatcatatggattcttcatttcactggtatgatgtatcacattagtagatttgcacatgttgaaccatctttgtatacctgcgataattcctacttgttcatgacgaatgaacaagtattaattcaacaaatttttaaatgttttgtcgaatttggtttgctagtatttggttgaaaatttttgcatcaatcttcatcagtgatattggcctatagttttcctttttgatgtatccttgtctggttttagtatcagggtaatactggcctcatttaatgagtttggaattattccctcctctatttttcagaacagattgagtaggattggtattggttctgctttaaatgtttggtagaattcaacaatgaaactatcaggtcatgggcttttctttgctgggagagtttttattatggctttgatttcattacttattattgatctatacaggttttggatttcttcaagtttcaatacttataggttttgtgtctaggaatttattcatttcttctacattttctaatttattagcatatagttgcacatagtagccaccagtgatcctttgaatttgtgttatcagttgtaatgtctcttttatcatctctgattttatttatttgggttttctttcttctttttaagttagtctagctaaaggcttgtcaattttgtttttcttttcaaaaaaccaactttttgttttattgactttttgtgttgttttctttatttcaaattcatttatttctgctctgatgcttgttattccttttcttttaataatgttggctttggtttgttcttgattttctagttatttaagacacattgttaggttgcttgtttggaatatttcttctttttggtgtaggcatgtatagctaaaaactttccacttcacacagcttttgctgtatcccctaagttttggtatactgtgtttgcattatcaattcttgaaagaaatttttctattttattcttaatttattcattgtccagtgctcattcaggagcatattgtttaatttcaatgtgtttgtgtattttccaaaattcctcttgttattgatttgtagttgtattccattgtggtcagagaagatgcttgatattatttcaatattttgaatgcctttttttttttttttgagatggagttttgctcttgttgcccaggctggagtgcaatggcaccatctccactcactgtaatctctgcctcctgggttcaagtgattctcctgcctcagcctcctgagtagctgggattacagacatgcgccaccacatctggctaattttgtatttttagtagagacagagtttctccatgttggtcagactggtcgcgaactcctgacctcaggtgatctgcccgccttggcctcccaaagtgctgggatcacaggcatgagccactgcacccagccatcaaattttgaatgttttaagacttgttttgtgagctaacatatggtctatccttgagagtgatgcatgtgctgaggaaacgaatgtgtattctgccatcattaaatgaaatgcttcataaatatctattggttccatttggtctatagaggatattaagtatgcttttgttgattttctgtctgggtgatctgtccaatgctgaaagtggaatgttgaagtctccagctatattgtattggaaaaaatctttctttagctataatagtatttgctttatatatgtgagtgctacagtgttgggtgtatatatgtttataattgttacattctcttgctgagttgattcctttatcataatataatgaccttctttgttgcctcttatctttttctcttgaaatgtattttgtctgatacttgtataacaattcctcctcttttttggcatggaatatcttttccatcactttatttttagtctatgtgtgtctttataggcaaaatgtgtttcttgtaggcaatagatcattgggtcttttttcaactccagaatttttgcttgattctttttaattattttaatctctctgttaaatttatctgttagaattctaaattccttctctgttatcttggatttcttttagtttcctcaaaacagctatttgaattttctgtctgaaaggtcacatatctttctttctccaggatttgtccacagtgacttatttagttcatttggtaaggtcatgttttccaggattatctttatgcttatagatgttcttcagtgtctgggcattgaagagtttggtatttattgcagtgttctcagtctgggctttttgtatccaaaactgttcaatatcatataacccagattctttatcattgcttcaaggccctgcttgatttatttcttgcttatctttctattcctcctactttcaatttctcacctctactttctacccctactttaagggccaactccaacaaacttactttattctttcaaaagtgtcatgctttctctctgtcttctgatagatctttcagataatcaccctcttctatctgagtcactctcccctgtctccctcccatttatctgagtaacttcctttagttttcaggttaaaatgtaaaaatcatttcttgcagaaagctttgccttaccacctccattcctgagttagggctctcatatgtaatttaacagcatccttgttatgacctaaatgcttctggccaccccccattcatacattaaagccccaacccctagtgatgctgtatttagagatacagtctcagaggaaataattaagattaaatgaggtaataaaagtgggctcctgatctaaaaagattagtgtccttataggaaaatacaccagaaagctttctctctgagaacacacacacaggaaagaccacatgagaacataggaagaaggcagccatctgtaagtcagaaagagaaccctcactagaagccaaatttgccactatcttgatcatggactcctagcttctggaactgtgagaacataaatttctgttctttaagccatccagtcatccagtgtggtgttttgtgagagcagccagagcagacagatacatcattgtactttctctgtcatagcatttataataaggtgctgtgattatctatttattcctatgtaggcaccattacactatatgatccttgagggtagtggaacctacgtatcttttattatttttacttttccaaagtctaccacaattttgtttgtttaattaactgagtgtttacaaaattatgaattctttatgtcatggtttaatatggcagatttttaatatgattttaataatttttgtcaagttctagtaattttctcataacaaataaaacaaatctaattaacaagaattaggaaaaatattttagctgaattaaaatttggaaaaaattatatattcaactgcttatttttttgagcaagacttttcaattgaatcatgtagaaccagagagttactgaatttcacatgctgctaggatttcctatgtaatgcatcagtggctcctgccacaggagttttcttcaaaccactgtgtgactgaatgcactatttatctttagccttcagattccactgggtgcttgggaatgctcaacttcccttttgtgagtatttaatcaacttttgcctattctctcaatgtctacttcaaatcatcattagtattcccaagtcaccctcacctccatactcacccttctccaaattcagaacctcagtatcctacttcacagagaaaataacattcagagaggcccagtcacctcatatttcctcttttcatatttaactgcattagtacccgttctcaccggctctccattattcaagagaaacatttctctagttctgtctaaggccaattacagaagtggatgagatttaatttaccctgttctattagcatgacttcattctaactgtgtggctctttgcaagttattaccttttttacactctattctttcatctacaaaatggggatgataataatatacatgtattccatgggctcatgataagtattcaatatgataatgtatgcaaattattgaaccatggtgcctagtaaatagcgagagctcaaaaaaccatgctgccactgctgctgctccccatgccgttccctccagcttcctagagggctttgcctaaacagttatccttttaccaccatcttccttttcttccctttgatgaggtgtaccttagagacacaaggagattctctatctaaaacttgccaaaattcaaatgtgagtgacagattttggcctcagatctacgtttttatcagggcaacctctgaatatcatgggtgtgtggaagtaacagtaaaaaacaagatgtttgccaaatattccctatgtttctgtcagaatgcatcagtacatgatgccatttgtatgggagtagagaaaacactctccaactcaatgtcataatatctgcacatttggaagaatcctattggaagaagaaaggagactcagtttaggaaatgcttattgatatgttaagcaaagccattagctgtataattagcccttacaacaaccactatccttcaattctagtctctgctgcccaaacaatcttaacatagcagcaatgtattccctaaaacgggtcagtgcaactttccaagagggaactgtctcacagaaagcatccatggtaagcactctggaagaatgagtttaaatacctaaaacctattaaaatgctaacaaattgttgtgagcagactgccctagagatttgattattttgtagtgactcttaaaatatgtctttcctaataggattcaaattccactggtaatagaaaaagagccctcaataaaaatttaaatctgctactccaattatcccatttaaaaccaatgcaacatttggtatgatatttatttcatcaaaaccaataatcttacctacaaatgtgatataaaacaaaagtcaacatgcagatggagacttttattcatgaagatgttcgttgaagcattatttataacaaagaaaattggcagcaatttaaattaccaagcaaagggtacataaaatcctatataaatatatgataatgtagtttttatatattttagtagtgtgataaatgtttatacaataatatgtgataacccagtataaaaaaatggtacaggtaatataagctcaactatacaaatgtggttttaaagactggaataaagatgtcaaaatggtagtgaaaaactctctgtggtaaaagtatgtgattatttttcttaatctggcattttttttctgtattttattcaatatgatgtgtatatataaaataaatgcaggccaggagcggtggctcatgcctgtaatcccagcactttgggaggccgaggtgggcggatcacgaggtcaggaaatcgagaccatcctggctaacacggtgaaaccccgtctgtattaaaaatacaaaaaattagccaggcgtggtggcgggcgcctgtagtcccagctactcggtaggctgaggcaggagaatggcgtaaacccgggaggtggagcttgcagtgagccgagataacgccactgcattccagccagggcgacagagtgagactctgcctccaaaaaaaaaaaaaaaaaaaaaaaaaagaaaggacaaatttttttctttttacctattgtaacagttaattttatgtatcaaaatggagggtatttttggataagattgatatctaagtcaataaactttaagtaagcagattgtcctctataatgtgggttagcatcatccaatcaagttaaaggcctgcatagaaaaacaaaagaaagcaaaaacaaaaacatcaacctctcctgccaagagggcattgcttagcagactgcctgtggctttcatctacaccactggctcttctgggtctctaggccatgggccttcaaactggaactgagctattggctctcctgggtttctggactgccaagtcacagtgcagattttagacttagcagcctccatcatcacgtgagccaattcctcataataaatctctttctatatatttacacactcagttggctctgtttctttggataaccttgactaatagctatacagattttcacaggtggtaagaaagacaatattacttctgagatgatacacttccaaagcaaagttgaattctctcacaaaggaaacaaatgatcttaattgttctatgtcttgaaaaaaaaagaggaacactttttaatgaaatcagaaagaataggaactttggaaaaaatatgaatgctcaaataattttagtcaagatgaattcagttccaagaaaagatcctaactgccttgaaagtgatttatgaggcatatcggaaagaggaggttgatagtcagaacacatcaaaatgaaaatatctgtatgatgtgtgttcctaataacccaggtctgtatttaaatatagccaacaaatatccagttgcaaatgtccagcctttactgagaaattccctcagtctacagttggctaaccctgctcccaggttacagaattctgaggtcacattcccagctcagacaccccatttagacaactgacttatttttcgcttatcagactctggctctctactctgtgctccagttttgtgattctactcctttgcctgaattcagggttacagcagcctcaggtaagagattgcttcctgtaactcctgtcctagaccccagagactctagaactctcacacaagtaaggaatattgtggacaacagagtaacaattcatgaaccaaaatactgagaaataagcaagaaagaaaaaatgcatgtgataacactgttattttttaaataccaaataaatgcttttagtacaatctattgtaaagcacttcgcaatctataaaataaatttatatccatgtcttcactgatctcacactacccttgtgtgatggttaatactgagcatcaacttgattagatagaaggatgcaaagtattgttcctgggtgtgtctgtaagggtgttgccaaaggagattaacatttgagtcagtggactgggagaggctgactcactctcaatctgggtaggcatcatctaatcagctgccagtacagctaggataaaagcaggcagaggaacatggaaggacttgacttgctgagtcttagggccttcatctttcttccatgctggatgcttcttgccctcacacatcagactctgagttcttcagcttttggactcttgaaattacaccagtggtttgccagaggctctcgggccttaggccatagactgaaggctacactgtcagcttccctaattttaaggttttgggacacagattggcttccttgctcctcagctggcagacagcctattgtgggacttcactttgtgatcgtgtgagtcaatactccttaataaactccctttcatatatacatctgtcctattagtcctgtccctctagagaacactgactaatacaccttgtgaggaggtgagagcagagatgaaatctccttattgtcaatgaaggaattaaggcttacagaagttaaacaatataccctagtcacataatgccagaggcctaaaccaaatcttttcattctaaatcccttcctttctctgtctttttctgtctcccctctccttcctctccatcaaaccccactctctctggctctctctctctctctctctctcatttatcctccaagctggcaaactaatgaaattgataccaatactttttgttgcaacccacatatgtaacttcttaacactaccacacatcttgaagcaaagtgagctagtgcctattttttaacaattacacaattcacatctaatgaggatttgggggaagaaattaatcagaaagtgatacttttagtgagatcctgatcaataccatgcactcaatctaaaagcaagagtcagagaaatgagacacttttggggaggggaaggaaggcagaaacaaggagtgagggatggaagtatataatttgtattaagctaataggggtgcaaacacaacccagagaccttaaagaaggcacagctgaaaagtgaggaagaaaggtgacagagctacttagagatttcatggtaaagcagaagtcagatagggcttcatttaaaatcttactctggcgctgactatctttgtcatctttcttaagttagtaaaattgcgattattaatatttcaatttaattgttaaaagacattattatctatttcaaaggatttatttttaaaaaaacaagaaaatggtagaaaatcaatacgtgctactttacttcctcttaatgaacaaaagtttccattttctttgatataatttcagcttctctgcacaggaggataggaatattataaattccctaactgaagatcatcccagtctgatttattcaagctcatattgaaaaatatctggtctgagagagacagaagtatggacaggaagaagacatacagaatcttgaaggcactttcttcttgaaactaggtaagcagtcctacaaaattttctacagatggatgtgtgggtccctgaagtactacaatgtaggaaactggtccagaaatgcctagaacactctgcaggcctctctatacctcttgttgaacccaaatgtacttgaacctcttaaggatgtataatatgggccacaggcacagatgcacctgtgtccctcatagggagggcaaagctggcagagctccaggatatggccatgttgtgctcagtcggctgcattcccgagcacgactagaaacccgtatgcagaaatctattttgagtttctgctcacacctgaagacaatatgctcctaactttcttcccatgatatttcccttctacaagttttaaaaaccaactactgcttagcccggcatagttttaagttctggaatccctctaacctaggtgtttgaggggaaatgtgccaaatatgaggtcagcaggggttgtggaagggagcattttaacagctctatgagatgaataatattatcaactaaatacaacagccacaacttgagcatagctaagactagccatgctctttcctctgtatcagttgctgctatcaattagtcagaaggtgaaataatttgaaaaccacaagaggcctattagagcagtgaacaaagttaattcagctaggttctagctctcttgatttgctgtctttcttacaagctccaaaagtctgaaccaacctcttccttttcctggatccatttgtctatgtataaaatgcaaatttgacaaagtcatctgtaaaatctctgatacattggatatgctaggatccctcacaccttatgatgatgatgacaacaatgacagtaacgtcaatgatggcatgatactcactgcacttatcaaatgcttactatatgccagatgctgtactaagggctttatagtgagttacaagcaaagtaagaaagtgtattagtcagggttctccagagggccacaactaataggatatatgtatatatgcaagggagtttattaaggagaattagctcacaccatcgcaaggtgaagtcccaagaaaggctgtctgcaaggtgaggaagaaagaagccagcagtggttcggtccaagtccaaaagcctcagaagtagggaagtcaacagtgcagccttcagtctgtggctgaaagcctgagagaccccagcaaatcactggtgtaaatccaagagtccaaaggccaaataacctggagtctgatgtccaagggcaggagaaacagaaggaaacatccagcatgggagaaaagatgaaagccagaagactcaacaagccagttttatcccaccttctcctgcctactttgttctaggcacactgacagctgattggatggtgcctatccacactgagggtaggtcttcctctcccagtccactgactcaaatgttaatctcttctggcaacaccctcatagacacaccgggaaacaatactttgccagttatctaggcatccttcaatccaatcaagttgaaacttaatattaaacatcacagaaagttaaagcatttcagacagatgacacagtatgtataaaaagcagaagtaaaagaatagcaaggctctcaagtagttgaagttctataagaaatatatggaataaaaatagtgaatcaaggtcagatagtaattcaatgtgactaacacacagaaaggggcaacctcttgaaataaactaaagaattaatcctttaatgtatataaaattaaggtcattgaagagtttgagcaggacactgacacaaccaaatttgcttttagaaagatcatttgggggactatatggaaggcagactagaggggaacacattggaaatagagatgatggaagtctgaatgagggcagtggcagtaagaacctgtgaaagtaagtagatttaagaaatatcagaaatccaatatattattatcattaattgttacaatggtaaattatatttggaaaatactaagtacaaagtttttctagaccaatcaatttctctaatttgttcattcactcatgtattcattcaaaaatatttattaggttcctattttatgctagttttatttttcttttcataaaaaaaatctgtagaaagaaaataaaatgaatgcttcttagtcagtttgggcttctataacaaagtaccatagactgggtggcttataaacaccaaaaatctattctcacagttctggaggctggaagtttgagatcagagtgccagcaagagcatgttcaggttccagtgaaggttcttgtccaggctgcagacaaccaacttctccttggatcctcacatagcagaaagacagcaaactagctctttggactcttcttataagaacactaatcccattaatgggattagtgagtctccagcctcatgacttaatcacctcccaaaagccctccctcataatcccatcacattgagggttagattttaatatatgaattcggggaggagggaacaaacaaccagtccctgtataacagcctctaactattcacactcatacccaaatatgctagaagtttccccagcatcatgcttttatatcacattctccacaaaacaaacaaaaacaaacaaacaaaaaaccaaatgttcttcctgtactctccactggccagaaaatatttggaaaagtggagttgaacttcttaagagtatctaggaatgaaattacatatccagatggtattagtttgtagataatagttgaagtttatatgaattaaagagtataaatgagaagagtagggagattttctgaagagagtacaacacttaagggccctcaaaagaaaaggagactaagaggaagaatgggagagagtagatgtaggtataaaagggaaaccatgatggaatattaccaggcaagataagaagaagaggaggaggaggatttattgacaatgtcaaatcctggcagtcctgtgggataaggttttaaaagatgttcccagatttgtgaaagaagcaattctaatagaatggtggaacttgataccagaatgcagtagattgaagactgaatggaaatttcggaagtaaaagcaactctcaataattttggccatgaggtcacacaacctggtagtgtcctttactgtctcattgggtgattatgattcagtgaggtttaataggcaaaaaggtagcagcacccagaatagagtttagcactgagtaagtaatcaacacttcatatttgcatgcattcaacatttatttaacaaatatttattatttaccaaattccaggttctgggaatacagtaatgagtaaaagcaggtgtgaccttgacctcaaggcatttatggtctatagtgtgtatgtgcaggataagaaggcattaaacaaataatcatacaaacaaaagtaaaattgcatcagaaagcagtttgaaagaattgtatataaatatgaatgaggaagttccctcctggcaacaatgggtggaattgatttgaccaatgccttttcctagacctgagggtgaagcccaagttgcaaagaataaaaagttcaggtggagctctttgcggtcttgacctgagcctgtctgtatgtcttccatgcctgcaaaagaacctgacagtctttcactggatctggccaaatgcaggtcagattcagtaaccctgatcatcgctgggcttatctgcagccacaacaatcacaatttgcctgatctatacaaggcttgaataaaattatacatgaaaaatgcagaggtgacattatgatgtagtaaatagaatgctgactttgaaatcggggaaatcttacttcaagtcttggctctttccctttctagttatgtgatctgtaacaggtcattttatctctgagcttcagatttctcctctgtaaatgaagaggataactaatactcggcctagttcacagagttgttgagaacctgtaatcctcaaaatacaaataaaacaaaaaaaatcagaatctctttattaggcaggatcataaaggtcttatgatccagttacaatgtttgtgaaagcaccttaaaaggtagaataatgagaaaaggtgaagaaattatccttaaggttctatacattctcctctaaaaccatatgtttaaatacatgtgtatgtatacatacgtatatatttataaaattgtatatgtagacacatacacatatatataagcccatatagtgtagtgctatattgaactcacattaatagaaaggaatctatttcaattaccaattttatgggttggtgagtaaaagggaaatacatgagaaaaaatgaaagttgcaccattcactttatttattttgataagatctgtttagctgtattgttaatcatgcttccaaaataccaataaatggaccatactctagtttgtaatttaaaaagtcatcagcaacatgcagactagcttcttaaatatttttgaagtgaaattatccataatgaggaatgatggacaccggttttgagagaattactacatctgtcaatggttatatgcaatgaaaacgggcctactgcttaaaactgatcaaaggaatatggcaaagcgaggttaatgctctagtctccatggagctacaggcttaagcaccattgctataagagtggtgctcatctttaagaagccatgaagaatgtagggggaaagaactagttctggatacacaaaggctaggttcaaatcacagatctatcacttacttaacctctttctagctctgactcctaatctgcatagtgaggacaataataacaatacactcttcataggcttattgtgaggattagatgtatgtaaagtatttaaaacagttcctgggacatagcaagccctcagctaatgatagttgctatttttattttgggacagtatgcagtgttagctataaggatgacaataatatttacttgagtctgaggcatcatcaaatgctaatccaaccccatcattttttagatgaggaacctgaggcatagagaggagaaatgatttatctgaggtcatgtagaaagttaatagcagatctggaaacagcatccaggtctcttaattcccaattctgtactctttcctacttcttcgctagcccaaggactgtctctgtccctctgctccgatacatgttacattatgtcaaaagagaggaacagacactatgctgattagaattatttttgtctttatatctcctactacattttgagctccttaaatggaaggactgtattacttatatcagataatgcagcacctagcagagtggtgcaacaatgttaattgattgctttaaaatattcaatagaataaaagatgaaatagtaagtatgctctgagggtggtaaatgtaataagtttccataagaagttacttctagaggtttgttaattggagatggtgttagaatagaaaaagcattgaacttcatatcagggaatatggattctaagcttgaacctgctaataactaggtgaatttggactgaagtgacattaaaatgtagggaggatgagggaagttcaacagaaataaaactagaaaggtaggttctaaagaaccttgagagtcaggctaaagaatatgaactttatccttaaagcaaaggagagtgagagatggattttaaggaggttaatgacatgatctggatagtattttagaactatcactctgacaagtatgtgaaaaacaaattagtgggagaaaggctaaaggtcagaaaaattacttctttttagcaggttaaagtattgaggcttagagaaagaagttaagtgaaagtaatttgctgaaagtcagaagtagaatcaacattcaaaataagatcaagaaatgccaaaacctgtgtcttcccaccataccccaacacccctcagataaagagcttataggacatgcagaaaccagggagttgcatggaacgatattctacacaaccttgcctttgggagaggacattatctggttaaaatggattatccttggatttatccaggggtcaatgtcaaaaatatcagctttccaatgaggtaaattttgattatatgaatatagtctttgttaaggacacaaaaatggtttgctgttgtttttttctttcaaaagaaccggtacattttgttatgtttatatactagtcaaattaagagttaaaaattgatccagatgatatttatacatgtggtaatataaaaggcatatatgcatatgtatgtgtgaatagacgtatacattgtgtgcatacctgtagttaaaccagatgcaaaggtattaccaaatgtttgaatttagaacatcaattatgatttggtggaaaatttctaaatttaaaatcagtaaacttggttcatatctcagttccacatcttactagttatgtgatttgtggtatattcttcatatcttggagccactatttcctcatccataaaatggaaataattatggggttgccatggagatcagatgacatatgtgaatatgctttgtaaatggccttagataaatgttacaacataatgtttaagagtttaggctgtggagtagcattcaatgctagttcagctagttatttaatgtgatactttgggcaagtcatttagcttctctgagctcgaatttcttcatatgaaaaatgaggctcataatagcttttacttcataagtttattgtaaggattaaatcagtcaatatatataaagtgtatatattagttaatacagataaaagtatggcctggaattgagtaaaagctcaatgcatgttctgtatagtatttattatatgggcatgtaaggcagctgactcacacctacatgcaacaatggcaaaaaataaatacaagaaaaacatgaatacattaaggaaatggaatatgattgttgaaataataaaactaaaaagactaggtgagtcagagatctaaagctcactgctccatgactaagagatttaacctaatagtatcttcacgcactttcacccactgtattctgtgttctgggtccatgggccacaaatgatgcagacatgtgttacaattgacaataaattaaagtctcaggtctatcccttcagtgtgaaggagaaacaagtgtcataggctatgatcagagaaggcatctgaggaaacctgtcctgaaagaaaaatgaccttggaattcagtgctagaaacaagcaagctgtttttcaaagctaaaggaggttaatcaagcagttcattaaactaaaggaatacagaaaaaaagcgatcagaaaagagaaggagaaatggagaaacagaaggctcaatgaagaactagttttacaaacagttggcctgctgtggagtccttttgctgtgccagaaatttgttcttaatatgagtaaaacagaaaaacaaatcaaaattccctcaactgatccaaaaagggcattcatataagggagaaggagatcaatagtagttgattaggataaactggagttcttttgcaagggagggctaaagtggatgattgactagttcagttttaagagactagagagatataatatggcatggtctaaaatatacccatataggatctcttctaagaacttcctaaggattgaaacaagaaatggggtttttgaaacctcataatgtgtcccattcttccccttgtaactttgcaattcattggaatgatgtctttaggttaaaatacattgctttttatgagtcttcatatagctgagttttttatttgacatgcaatcaactacagaagcaatcttaccagagaaagcaattcagaacagtcagtagtttaaagctatgcaaaagtgaaggttttattgcagctttagaattatgcatttcattttaattttctaaatggatcctctgtataatatggtccacagtagaaaggagacttttcagctttagtttgttacacctagattcatgtgtacatgtttattgtttgttttatttttcatatgcacacattgaaggcaacacagaaaggccattccaagtcttcccttggattacctttttactgtaactttagctttctagtctagctaaattccagtctcataacctttgggtagctctgcagttttatgtctataattctgcattctccatacccctacttatctaagccaaatctgtcaatatcagggactaggctaaatccagctgttggaaaatttctaattgaaatgaaagtataagaaagaaagtaacatttaatggccacctgccacatctctttaagtggtaggagccttcacattgattatcaccttgactgctttcaacaactctgtgaaatagatactgtgacaagagctatggttataaaaatgaataaaacatattcaggtccctaccctcatggagttcgtagtctaatagaagagactgatattgagtgaataattcaaaaaccatttaattatacaaataaaatgtgctatgaatggactaagtagtaaaagaacatgtaacaacaacaacaaaaaaccaagactcagtggagtcagggacaattttcttgtaggcaattgaactaaaatataaggattttactggatgaaagtaggaaatagactgtgcatttcaggccaggagaacagcctgtgatcccccctgtgcttaaaagacatgtgctccagttaaaggactgaaagaaggctagtgccacagactgataggcaaagttcatgggggagaaagttatgaggtaagtctaaagatgtaggcaagtgctagttcattaacggcatggtaggccttgtaaggaatttctctttgtcccaagtataatgggaaggcattaaagctattaagcagggaggtgacattaacagatttaaaaaatgttaaaatatcattatggcttcctcatagataatggattttagaaggttaacagtggataaggaaatataagttagaagactattaaactagcccaggtgagagatgatcagactttaattaggaagggaaaggatggagataaatttgagatgtagtagaaggcaaaatcaatagatctttgtaactgaccagataagtaaatattcttctttacaataccaaagcaatatacaaaaatattagtattataatattttacatattaagtgttctcccagataaatagtgtattgggtcatctgttactggtggcatatcacacaacaagtattatatgcagtgctctagttggcaagtcaaatgtaaaacaagttctaccttcaagaagtttatgactttggagaggaaatataatattacagtagctgaaatcttgacaacaattctgtgatatcggtaacatagttcacattttacaactgcatatgttaaaacctagagtacttatcaaacaaatgtgatacatatggaatggcagagactcccagctccactctcttttcatgacttccttagcccttgtttctcagaatgaaaaaaaatattttctggatccctgctgatatcttctgggacccaccagtcatctcccacgtaggcatctattcaacaaatgaaatctcaagtagtcccattgggaggttttacatttcagttggagatcagcagcgtagtatgtattctatcccaatggacaaaataaacagattaaatccttatcctcagtgttcaaatttttgcccaagtgacataaatttaggtaataattccctgtgaactaaaatggttactcagaaaaatactattaggtataaatacaaaagctggagacaaggttggtgaaatgggtactatcaagactgagtcagcctgctccacaagtgctggcttaggaggggataggatccctgcataggtgatataaagtcttgctgttcaaagtgtgattcttgaaccaacagcatcagcattatttgaaaatttgttagaagtggagaatctcagcccctgtagcaggtttaaagaaccaggatctgtgttttaacaggatgcctactgatttataaacacaatgaagtttaagaagcactgatataaagtacacccaaaggaatcttcacctctaatagcacaaatgacctgaaattctcccaataatactttctatttatccaacttttggtcttcttttactcttccttctgtaaagacaaaaatctctcgggattgaaacaggctgataaagatgaaaaggcatgacatgtgaagtcagatatacaagggttggcattacagttctatatcaaggtatgaaattgggtgtattgctaagagtttctgggacttagtttgcctcactccagaataagagtaacaaactagtcttgacaaatctacaagagtgggataaacatctaagaagataatgaatgtaaaagtgctctgtattggccgggtgcagtggctcacgcctgtaatcccagcacgttgggaggccaagacgggcggatcacgaggtcaggagattgagaccatcctggcaaacacggtgaaaccccgactccactaaaaatacaaaaaaattagccaggcgtggtgttgggcacctgcagtcccagctactcgggaggctgaggcaggagaatggcatgaacccaggaagtagagcttgccgtgagccgagatcgcaccactgcactccagcctgggtgactgagcgagactccgtctcaaaaaaaaaaaaaaaagtgctctgtatttatttgtatgatatgcaattattattgctattgttactatcaagaataactgtatcattcactcattcagtcagtcgtcaaatagctatatagctagaacctaatctgtgccatatcctgtgctagatgctggggataatgaggtgcataagacagctattccttactttaaggagttctcaggcttgtggtaaagaacataagacatcatgtaattattaatgccctaaaagaggtacagagcaatgctagaacacaagtaagtctctcaatgcttagatcactcttatttctcactataacaaattctaaggaaacatcctgtgtttgggtggaaagcataggaagacagctgattggaatattgactataccacttaaaatcttgagtaaaaatcttaaacatctcaaagccttagtgtctctgtatataataatacctgcatcactgagctaaccagagcataaaatgaatgtaaaagggctaagtgaaccattcattgttggccattcattcatatgctcaagtacaagcacttgatttcaagccaagcacacagtagtctccctgaggatacaggaatgaaaaatgactctgttgtcttcaaagaactttcagtcaagtacacagttgtaacaaatgctacggggggcggggggaagctgtgggtactatgtcataaaataaaagaaacataaaacattgtctgaaagtgagatggaaggggtaggctcaggagagccagctttgagaaatgttttgcatcaatgtcgtgttttcaatgtttgttatcaagcaaaaataaaattgacaagagaaaaaacgaagaaataacctaagcaagaagagagttgagttagcagtgtccaatgagtcaaaataaacactaataataataatagttaatgtttattaagcatttattaagtgccaggcatggtgttaaatactttaaatgtattctctcttttaattctacctgtattagtttgcttttgtggacttgcctggaaacttatggtactttcccatctcttgactttctctgccatcttttctaccatgaaatcctagatttgtctgccaagtttcaagataaacactattggtcctattttaacttccttccctcctgcctttcccctaagcaccgtttgacgcccactccacctccagttctatcgatatagattccacatttagatgtactattcatttttctcatatttaaaaatggtccaagaaatgtgtctttcattgcagtaactcctgttttgaaatccctctctgagccaaaaactttatttcttcctaagagagattcttatgtagatagactttggtcttaatcaattcatagatagttacaaaatgcaagagttctagggcactctatagccatagacttttttagaccaatttcagcaatatagatgcaggcacaaaaaattatgagatttttaatccaatcatttttacattaactgttcttcaatgagcccaaagcaaaacaactctgagtattataacagaaaattttgctgttaatttcattggaggaataaaagtgcatcaaactgcttctctgcacatccttaaaatttgtggtttctatgtcttcacaaataaatggagatatgattttcagggaaattcatttccaaattctttttcattttctttctgaataaagttctcaactaggtcatgctggctgcttaactttcaactagtttcaaaaaatacttctttgattttgaaaattgggcaatatatttttgatcagaacaattgaattaatatgtatcaatgtgacccagaactgctgctaacctccttgtgtcactcatcaaatgcaaaatctagatgtaagtcctttgactcatatatttaagcatacaccttgctatttcatgctttcttacttttgctggtgtcatcctcctacttcaaatcctactttccccttcttcacccagctcactcttaaatatccttcaaaaatcagtttaagtgtcactttctttaggaagctattcttgattctcatccccacccccttaccacaaactaagctcccctcttcttctcccataattcctgtgttgatttttgtcacagcacaattaccctttattattagtgtaacaagggcaataccgtgtgctctctaaactcaaattccttttaatctcaggcacacagctagactacatttctcagtcttccctgcagttagataagactatgaaccaactctagcaaatgtagtgtgcacaagagatatgttcacctcttctaagcccaatcttccacattctttcttcccttacctccaataggatgcaaaggtctgggtccccaatgtactgtggagctgagttaccctacgaaccacatatatcctattaatagaagagaagtaaatttttatgttaagccacagaggtttgggggttgtttgttgtaacttacgccaactaatacaataatcaaatatttgtctgtgtctcctcctagactaaaagcttcttcaagacagggtttgtcttttttattcatctctgtttctacaatatttagcaggatgctggcagagagtaggtgctcagaaagtattttaaaaataaaaaataaacatcctgtaagttaactggaaatagctgcaattcagtgttcctaagacaggcatgagaggacaatggaacagaatacccatgaattatgtgaggacccagaatttcacaatagaaatcaagttggtagaaaagatatccagcaattaactagggcaactaggccaggcatggtggctcacacctgtaatcccagcactttgggaggccaaggtgggcagatcacctgaagtcaggagtttaagaccagcctcgccaacaggatgaaaccccctctttactaaaaagtacaaaaaattagccaggtgtggtggtacacacctgtagtcccagctactagggaagctgaggcaggagaatcacctgcacgtgggaggcggaggttgcagtgagctgagattgcaccactgcactccagcctgggtgacagagtaagactcggccaaaaaaaaaaaaaaaaaaaaaattagggcaactaacgtaaatggtttccaagacaattcagcattaagagacacagccgagctccccagctcattagtgaataaaataggcaaaatccctaatgtcaatgagaaatgaccttcaactctcttaaataagatactagtactggttagtgctaatttgaatctctgcttccttctctggcctgctctatgccctgggaggcacttgtaggaaacacatccccaacaccctctggtctgctaagaggctacccagactgagtaggcagtggtgccttgaacaatgccattttcgaagacactaagagaaccaagatctatgagatacatttccaacctatgtccaacactttagcagttcatgatatataaacaatattagatagagtctgtctatgcttatgacgaaacaaacaaagaaacaaacagttaaatagagccaaattctttctataaagaatgaaaaatcctggatttttcccctcctccgctcttggagattgccttcactagaaggtagccattattgaggcagttatattagtcctgccttaggcagacccagaatgctttgttttgtcctgttaaatgaaagagaaaccaaaaattaccagtaatttcactgggaaagtaagaaaatgtaattgtgagaaatatcctaggcagctcagtaaataattatgcacacaacagactaacatttgaaattaagggtacttattttaattgaacatctcaactgttgtatttatacaacgaaatgtgtgagggaaattaacccagttccagcaaggcctcatatctttgtggaaaatactcatcttcaagcctctgtattcttctgtacctggtgtagccagtgtttaaagcccacgaggtttacaatgcatgctcttatttatagatactccaggtattagaaggctcttgtggtctaattcagtcactgaggagagtgatggggactcgcagcactgttttgcagagttacagagtcaggggaatgaatgctctgtgcctggagttgaagtgaaatttacttcctaggtaagtatgaggcctggtgaggaaatgaagatctggccccagggagaggaaatgaggacataagagcctggaaggaaaaaggtaaccagctaatctgatgagtcaactttactctaaatctaatgaaactcaagtttcaggagccccctacttgcacaggtcccttttaagaacctgaaatgacccaggaaatgtggttaatgaatgtcaacaaaaagaatcgaagattagtcatggaacaagaaaacatgaaatgttctaaaatcttaaagtttatgtacgaagaaaacttgataaagtttcctaacttacataataattctaaaattttacattatgagtcacaatgctgaaataaactttaaaaactatcaataataaaaaacatttgctctaccatgttaaagaaaggaccaaattggctttttattctctttagaaaatgatgtgacagaatcatagtcatatgaaaaggtggtcaaagaatgtgcagccaaaagtgtaggaaaaattattatataagtgtttcaggaggttaattaataaaaatatgctattttaaatattttgtaatatttatagcatttaaaatactttaaagatttgtaagctttaaaaaatgtgtaatttattgtttcttttcttattctagctcaatactagctttcggacctaagtttttatttgtaatacatatatttttgtcttaaagcagcccatcaagttaaataagcttaagtccctgcaaacttggatgcacccctgctcatacatattaattactttcaatgtcagatccctctgccagtgcctggctcaacttagctatagcccctctcatctctgcctcatgaccaaagtagagaccaggggtgagggggtgagaggagaaactctggggttgaagccagtataggaagagcaatatggtacaatgtaaagtgcatggtacagtacatagtctttgtcacatggaactgggcttgaatccagcttttttcacaagtgattgctcatctgttccttgtcatctttgaggaaactgaggctctgtgacgcctggcaagttcattaacctcactgagcctcagttgccttccccaagatgataatgaacagatgagctaatagttgttaaagaagcatttggtaagctgcatatttttcatatgagagtgttaagagtaagtcaaaaaagatttacttagtattttattgttatttttcaagtccttacctttcataaacgcatattgaaatatttatggaataaataatacaatgcgtgggattctcttcaaaataatacagcgggagaggggttagaagaaatgagtagtgataaaatgaaaagtcattggccatgagttaacattattgcagctggattatgggtacatgaggtaaattatactatttctgtttacttatgcatgcggaataaaaagtgaaaaaacaaaacaaaataaaaccaatctattgaatatcaccctggatgcaattggagctttattctggccctttctccatttatctcctgaaatttactgtttgctccatttattttaaacttttctgttaactatataaaccaaaaatcataatggtgtggcaataatattaataataattaataagagcaatagcttctgcctatttaatacttgttctgtgcctgccccagtgcaaagtaatttactttcatatttcagttgagcaatagcttctacttatttaatacttgttctgtgcctgccccagtgcaaagtaatttactttcatatttcatttgaccttcacaagaattctatgaagtaggtactactacttattttacagatgaggaaactgagagtcaggaggattaagtagcctgaccagagtctacagaaagtattatgttcagatcttctacctttcctgtgtcctagactatgctttatactctgagaagacgtcatgctacagtaggctactatctagctggagaagaaggaagtgttgaaaaagccaaggaaatggccctaagttttctctgttatcatataccaaatctgaagaatagacattacatgtcctccttatacatgctgtattgtgcaaggccagaaggacacacaactttcctctcgtgagcttacatccaaacaagagaacacaaatgtcaacagatgtagtgaggcatttattttttgaagtaagaaggaaaaaggatgtaacaacaataaaacaagcagaaggaaagaaagaaaaaacattgattgagcaccaatagtacttggtacttgacatatgcaatatattgctattgacaaccacaagtccttcagagaaaggtggatcttgctaagtaaacagactttttgttctgctgagcacctcaaaggtgggccttgaagagaatgtgggctaggacccgagagagttgaatgttctacagaatatagggagaatttagaatttagaaagaaaggataatctgagaggagaaaaaaaggaaaccttcagaagggtaaagcttggaataccatgagggataatgtagagaatgaaaacaatttcctggtggtgtgtctggaattggttccttccggtgggttcttggtctcgctgacttcaagaatgaagccacggacccttgcagtgagtgttacagttcttaaagatggtgtgtccagagtttgttccttcagatgttcagatgtgtccggagtttcttccttccggtgggttcgtggtctcagttgacttcaggagtgaagtcacagaccttcgcagtgaatgttacagctcataaaggtggtgaggacccaaagagtgaggagcagcaaggtttattgtgaagaacaaaagaagaaagtttccacggcgcagaatgggacctgagcaggttgctgctgctggctgggtggccagcttttattcccttatttggccccgcccacatcctgctaattggtccattttacagagtgctgattggtccgtttttacagagtgctgattggtgcatttacaaacctttagctagacacagtgctgattggtgcatttttacagagtgctgactggtgagtttacaaacctttagctacacacagagtgctgattggtgcgtttttacagagtgctgattggtgcatttacaaacctttagctagacacagagcactgattggtgtgtttataatcctttagctagacagaaaagttctcgaagtccccaccccacccaggagcccagctggcttcacccctcagtggcacattggctaatgaactatttttagttactaactttttttccacataaaaaatatcaggaagcttgcttgtaaacaacttggggaccacactataagtgttcagttaatgttttgttttatttttctttctagttccacagattcatagtgggcaaaaggggaaaatattgaatttcacactagtcatgtgactacaaaactagatattccaaaaagattccagatggctaagcttgggttccattgtagcatttctaataaaactgagaatgccacagggacgtgaaggaagaggagaaagtgaccagagattcacagaaaatactgacctgatgttttggattggttgtgaataatagcagcagaggtctagccagctgactagaactgaagtggctcagtgactctcctgcctggagtttacttggcaaggaggtttctgaatcttccatccagatccttctcaattctaagatgcagattcagattattaagatgcaaaaatattattctgtttagggcaacactctaccatcaggtcagtagtaaaagtattttgagtttccccagaataagcaaaacctacggtgccccattcgttggactaggccattttgtgcatccaaagagactgaggcagagccaatctggttcactttaagcaggaagcagttgcattattcctcatccatggccttagcaatttgctctcagttggccactataagatcatttcctatcacctggatatttgtatttacagggagtttattttttcccaaatttgccagccattctggccaaagaaatttttataatacagcactgagtagttcttgatgagctaccacaggctgatgtatctgctgggataaataggagagttaaattacaaattatatgttccagactggaagaacttagaattcattccagtgaaaatctttccaatagtgttctatagcaattctgtggattctttatactctagctagaagagaccaaactgttcctttaaagagccagatgataaatattttttactttgtgggttatacagtgtccataacagctcagtctctgaaaaggcttttcaaatataaaaatttacatcaatagttaggctcccataagaatgaaaggtctgtctggcaatgatcctgagaacacgcttagtgaatttctggcctatgttcttggtactcaggaaggaggcagaggatgctataaataatatatgtgtagtattaataatgccagttaaagaatttttaagaagagataggtctaatattcaatttgaaattttctatgctataatataaatctacccttatttcttcaaatactaaaatcagctgcatattcaaatgtctgtgtgagtgaagtttgagggaaaattgacttagttcaggttctcatcttttcttctgttactaccttactcatctccctgccactacttctatctgtctccaatgtattctccctacatgattttttaaaaaataagaaccttatcttatcactcttctgctttaaatcctcactagctgcccttgggtttcaggaaaagtccaaactcttcagtatgatatttaaaatcccttattaactctacagccttatgctctgctacttctctctctcttcacaggctatactcctgacacagtaaagtatttgcagttctttgaatatattttttttttttttttgagacagagtctctgtcacccaggctggaatgaagcagcctaatcagggcttactacagccttaacctcctgggctcaagcgatcctcctacctcagtccccaaagtagctgggactacaggcaagcatcaccatgcctggctaatgtttttgtattttttgtaaagatgaggtttcaccatgctgcccaggctggtctcaaactcaaactcctgagctcaagcaatccacctgcctcggcctccaaaagtgctgggattacaggcgtgagacaccatgcccggccacatataccatttccttgttcacctcagatacttctcaaatggagctccatctgcttgaaatgcccttcctattagtctttgcctgtgtaattgctatctttcagacataggtcttatgtcacctgtcccaggctcccttctctgattcccaagtccacacaatctagcttgggtgttttgtttgactttagaaaaatacccggtacttatttctgcatgttgtactgtattatcattgattttttcttttccctagctcacccatgtgaattccttgagcatgagaaggaaattttctttgcttctgtatcagcagaccctagtatgggcctggtacagagtaagtgcacagtatataattttgaataaacaaattaaattaataatagttactttaggtaggaaacagacaccatctcaaactctgaaagagcagagttagaatatgtctaaaggtatagaagtaaacatactttaaattgcattaaattataacgtagatacagaaaagtacgtgtatcataagtataaacttaattaattattttcataatctgaacacatctgtgaaactagcactcagatccaaagccagaatataaccagtaccctacaaattctctacttatgctcccttcccattgctagccatagcaaggataaccaatgccctcacttctaatgcctggcttagttttgcatgcttttacacaacatgcaaatataatcatacagttgatactcttttatgttggctctttacactcaatattatgtttgtgaaatgtatctatattgttgcacataggtgtagatcactaattctcatggctgcatagcatgccaatgtgtaaatataacataatttatttatccgttgtattgctgatggacattgaggtagttttcagcatggacatataataaatagtgctgctatgggcatgtgttttggtaaacattaatatacatttctgttgagtatatactactaggagtgtaatttctgggtcagagggtatacatatattcagctttagaagacactgccaaatagttttctgaggtaattgcaccaatgcagaacttcttttaattcatgagatatgttaagttcataaaaaaactccatgtaaatataaagtactattattaactcaatgcctcatttgcagaagatcatcttgttccacagcaattaaaaataacatctttgattagatgaaatcaaatatctactgggaactgtatttataatctagatgtgtcacactcttttctctaatcaaaattaagtttagacatgtcttcaaatgtgtcagtggaaagacaaacgctggtgtcctgtttttttaaaagcatattaggtcatatatgtttggtatccagtcaagactttctttaacaatgtcccggtttatcaagtgattgagaaggacaccagcaaatccagcattttgtacatctccattgtacattttgctgtaatcatgtatttttttaaaaaaatatgacccactaattcctagaatttatttcaacataaacattccgtggagaaatgattcacttctttgcattaattattttaaactttacatctgctattaaacttataatagtacagaaaaaatgcttgaaaaaagagaaaatatgtaggataaagaataagataaaaatcactggtaatactgtggcaggccaggtctcactaatacaggcctccataacaactgtttcagtactgactgagtggttaagttaaatattaagacctaaaaaacagctattgcccttgtacaaagtctgggatgtaacaaaagcccaccaataatttttcctaggcctttcctgggccttaaagcatgacaaaataatgaaggaattttttatatgacccatttaggattaaacaagtttattgagggtctgaaggaactccataaccctccgtgatttagcaggagacaagataagggtaatcaccccagcacctggacctatttacattaagtaaatttactgaggctccagaggaaggtcttcaggactcagaccttaattatagattaaaagaagttaattactaatgtctttagatgaatgcacacttacacgtagacatatagcttagcaggtatataagctctggaaaactttgtaattttgagttggtctggcgataatttccaggccttcttcttggaatttccaattccaactggttgcaggaataaaaactctcttcctccccatctcttcctctgcatcttgttattgggccacaagaaataacagcccaaccctcagtttggtccagggacaatactactgcatatagaacttttaaactacaatacatattccttcatatttttcctatgtattcttgcatatatgtatgtgtttttataaaatagaatcatattatttttataaaatagaatcatactatacatctattttacatggttttactttttatattatataaatctctccatatcaatttacatcaaactttaaagctcaaacaaaatggcatattagcaagttgttacattgtgaaacatgaatttgttctttctccctgtttattgacatacagctactaaaatccttgtaatctcaaaagttgtaagtgtcttttgtatgttaatgattgatggtctagagcacttggatagctttaggattggggctggtcattgaacataccaaagaggcatgattaaagggttgggacattcagttgcagtccccaaccttcagggagaggagaggagcagaaagctaaactgataatctaatggccaatgatttaatcaatcatgcctacataatgaagcctccaaaaaacccaaagggacttggttctagggctgaccaagtggaggttcctggagggtggtacacctggagacgtcatggaagctctgtgccttttctcccacaccttgccctatgcatctcttttcatctgtatactttataatatcctttataacaaactggtaaaggaaagtgttttcccaagttttgtgagccactctaggaaattaaccaaacccaaagagagggtcatcatgggaatcccaatttgtagccaatcagaagcataggtaaaatgaccttggcttgtgactggcgtaggaagtgggggcagtcttgtgggactgaactctcaatctgtggtatctgacactatctctgatactgtagtgtcataattgaattgaattagaggacacccaactggtgtccactacagaactgattgcttgcttggtgtgtggggaaatacatatttggtcacagaagtgttctgtgatgattgttgagtgagagaataggaacacactttagttttttcctatgtttctcacaagtagttatcattttaagcaatagataaatacccatttttccacaaatattatgaaagcatataataaatacagcacaggttagattctatgggtattggtatatgtcactggaaggataattttaatgacaaaataagccggatttgaatcttgattctacctttttagtagttgtattgcttgcagccagttatttggtatattgaagcctaagtttacttgtcaaaaagtgataaaatagacttcacatatttgtcatgaggattgggttaaatatatagagaaatgcttgacatggtgcctgggacataaaagatgttcagtaaatttgcttgaatctgaatctgtgggaagcacaaaaaattacaagaaattgccactgtccttcagaaacttataatccaacatcagagttagggtggtcaataaaagtcagtaagaggaagaaataaattttcattgattaaatgcctattgtgtgaggatcgtgctatacactttcatttttaacatgagagacatctctgccctggaacaagatgctccaatccctgtagcatatacttgggagaaacttccttctgacaggacactgctgagaagattgctggattggtggagcaaaggtctttgaagccttaatggggagaggtagtagaaacagaaataagaagatctgtccttttatcaatctggattgataagaaatcaatccagcaataagaagattgctggattggtggagcaaaggtctttgaagccttaatggggagaggtagtagaaacagaaataagaaaatctgtcctttcaactgttacctattttgcagaaggtacagatatgaattctacttttagtaaatattatacttttgttctgggacaaaaaagccactcaaatgggccttttggttaggcaaaagtaaagcaaagaaccacctctgacttgaaaatgtttgagagattaaggctagattgagagaaactgctctgcataaaaacatgaaaggttattcatgtcgtaggtacagatatatctcagaaggctgtttatttggagaaatgacttgaaaggatttggggttgctattccagcaaattgctatctgttcttgtggtggtggtggtggtagtggtggtagtggtggtggtggtggtggtggtgctggtggtggtggtggtggtggtggtgtgtgtgtgactatatggtagcttacagaaaaagtgttttgggataggggttatagaaaatgagggacaaagagtgtcacttcagatgtcccaagaacaaaatgaggcacaaaggtgatgggaagttattctgtcctctgcaaaagggattcccatctcactctggcattcccaagtattggaggtctcgagggcccacagagacagcacccttgcaatgacattggcacaagttcttctttccacctggaagtctctctttctctcagattagctgtctccttctcatccttcagccttctttttatatgattaaccttagaaaatgcctttcctgagtacttcctattattacatcttaccgaaccttatattcttttgcttcagagcacatataacagtttgttgttacatatttatttgagcattcatttacttaatgtatgtcttttcaatatgctccatggtaccagaattacgtctgattgttcatcaaatcagtgcttagaattttaatttgcaattaagaatatttattgaataaatgcatgcatctaatccaatatggagcataaaaataatttccttgttattatgtttattgtccctctcctctaaccagtagataagagctgtaagagcagagatttatatttttttccatggatgtattcccagcatccagtatagtgtgtgatgcaataactatttgttaagtaaataaatgaatgaatgggtatcatggccacagtggtgatgattaggctccttcaagtactttgttggtcagagaacatgtgcttgtgggaattggataccaagaagagaaacatgtcagaagtcacataggatctgtagctgacagtctggtttgaaagcacatgtgagacacactcttaaggacttctgaaaatatcatagggtgctttctagggagaactcagagttctatacagggcaagaacaaaaactctgggttatctgtgttactttgaatagattcctatcaagtaactgggaaggtttggtagcttgggcttattcttaaaggtagatattattttcatttttaaatgaagaaaatagagcttagttagattaattaagttcccccaattcaccacacatctagtaagtagggagctgagatgtgaactctatcttgtctatctccaaagcccatgctttttctattatgctcttctacatttgtaagataaagctatatggactaaatatgtcaaaggtgctggatctataaaacatgctaatgatgtttgtgagagggtgagattcattctgaccgatatgattagagaggagtttctggtggatatgaaatttgagctgaacaataaggatcaaggattgcaacagataaaaacagagagaggggaagtgtagaagaggtagcagtggattagaggaagtacagtgaggtatcagaagatgagcaaggatacagtataggaaaaatgcatgagtttgaaagagagtggtcatctagaagtcggtaagtataacagtgagtgtttcctcagaactttaggacaaaagagaaatgaaatatcaagattaaataaaaatatcttaaatgcgaactcacagaaaaacatattgctcacatatgattataattaggtcaacagcagtactctcaaaagcaataatagattccagaaaacaatgctacaaaataagaagagaaaatttctgccagtttagaatactcacctaaagaattagaggcacataatatttttcagacacaaaataatcaagagaatttatcatccatatatcctcattgaaagtactaataaaggatttactttcacacaaataaaattcaagctagaaagaaagattgggaatgcaagaacaaagggaagagaaaaaaagtgtaacatatgttagcaaatctatcttttgccaataaaaataatacttgttctgtatttttaaaaatatttcacagaaattcttaggaaaggaagggggtgtagttccgacgacagcttatttagacaggctaagattcctaccttgttcccaggaagagaataaacgtattcaacaattttagactttgttataaaaaacaagtggttaagaatatatgttaaaaatcttaaattacaattacaagattataaatagaaactgtgaattccacaacaggagcagaaaaaaaattattaatccaacctaatgcagtaacaaaataaaaaagtgtggtaaacctcttactcttcttttcattctgaacaattcaggccaaaagccattaggtggagcagtacaaggtatagaattccacggtggtggggagcatcatgggcccagggttgggtatcagagtctgagaaagatgaggaagttcatgggagagttggagttgaggacagcccgggtcagagaagtatctaccctgcttttttccattatcttgatccactagaagaagctatcaaccttattactttggaataaaggattggctttctggtattacacagaaataatatgtatcttcaaggtaggtattattctcattttaaatcaagaaaatagagcttagttagattaattaagtctccccaaatcaccaaacatctagtaaatggggagctgagatgtgaactctgtcttgtatatttatgcaatagataaataccccaagcttttctaagttaaaattatggtttttccattttaaagtgactcccgtctctaaattatctttcaaaggaaaaccattatttgtattctctagcttatggaggctatctggaagaaataccttacgtttttacttgtttctgcctactttggtcgagttatagtggaatgtacttgagtcaccacccaggaatataattataagctatgataagcacttaattctgcagtgggaacaaaagaaatcccaaatctatgtgtgaaagttggaggaaaggcaactttaagaatgcctgaaagcgttattttttgcttacatttcaaatattaggaagtcttgtggaaattattagaaaaaaatggaccacttataaaatgtcactgtaaatggtatttgtagacatgtttttagtctttctccaaaacggcctgacagattcttgttttcaggttaatcttaagtctgctgagtgcttaaacagtatatcttatatttacttactgtttcccatcccccatttctaagaatgttcacaattggattttatttaatatttaaataaaccaggtactacttttccatgttttcagccataaaaacagatacagaaaggctaaacgacttgtcccacatcatatcttttaatcttcacaatcactccgtgaggactatattactgactccattttacatgtgaggaaatgggtttagctagatgctctgtgctcaaagccagacagaatcaggatctaaagccatgtctaactaactttcctttggccaacctacaagcaccatttatgtcaagcttatgaaatttggtctcctctacatagttgcctctcaaataaaccactccttaagtaggaataatcattaaaattaggctcacttccctgagaaagaaggtagaaattactatggtttctttggtgatttgtgcattatttaaacacgaaaacagaaagaaaattcagagggaaatgtttagcaggaatttacatgtccttggcaggaaacagttagcccttgtatcttctttatggaagaaaaagctggttacaaggtgctagtcccaggctaactcaagaatataaaccaagaagaaataaatagagaacaacagaaaacaagaggccaatggacatcgccaaaattcagatttctggccacaacctcatccctggtgccctaccaaaggaataagaatgcttattaattaaacaacagtcattagtcaccctaattacagaagagagatggagattagcaatatctgagtccttgagactctcacacactaattgtatagaaagacaaataaaaaatttaatagaaagtaataagaggagacacactgtcactgtctgttttgtgttgctataacagaaaatctaagactgagtaatttgcaataaacagaaatgtattggctcacagttctggagacgcagaagtccaatataaaagtgccagcatcttgtaagggcattcttgctgcatcatcacacagtagaaggtgagagatcaagaacaggctgttactgatcccatctatggtgatggagctctcatggcctaatcatttcttaaagatcccacctattaatattgttacaatggtaattaaatttcaacatgagttttggaagggacaaacattcaaaccatagcacacaccagtgcaggttgatgagcatgctggaagacttcttggaggagctgatatacaagtctatgcttgatagatcagtgggagtttgctaggagatgaacgtaaaagaaagcaaggaaaggccaagtgaatggcaagtgcaaaacttgagaaagtatatcatgactgggtgatagccatcagaaagtgtggctagaaggtagcatgcctggcaggaagtagcaccactccttagtgactactgtttaatcatgtctcctctatgagttctcaggaataagactgtaccagaaatctgagctgtgaaaacttagttttgttccattggtctctttgtcttctactgttctttatccttagtttatggttttgttttaggtaaaagtcacattttaccctgtgtagaggataggtgtgatggttaatattgagtgtcaacttgattagattgaaggatgcgaagtaccgatcctgggtgtgtctgtgagggtgctgccaaaggagattaacacctgagtcagtgggctgggaaattcagactcacccttaatctgggtgggcagcatctaatcagctgccagtgcagctagaatataaagcaggcagaaaaacgtgaaaagaatagactggcctagcctcccagcctacatctttttcccatgcttgctgcttcctgccctcaaacatcagatgccaagttcttcagttctgagacttcgactggctttccttgctcctcagctattgtgagacctcgtgatcacgtaagttaatacttaatgaaatacacttttcacatgtatatatctctatcctattagttctgtccctctagagaaccctgagcaatacagattttggtaccaagagtggttctagaggaacagaatattaaggaaggggttctttcattggttttggggtttctggagttggctgcttaatatgattggacctaaaaaatgctaaggactctacttttttttttttttttttgagacagagtcttgctctgtcacccaggctggagtgcagtggtgcaatctctgctcactgcaagctgtgcttcctgggttcacaccattctcctgcctcaacctcccaagtagctgggattataggcgcccgccaccacgctggctaattttttgtatatttagtagagacagggtttcactgtgttagccaggatggtctcaatctcctgacctcatgatccacctgcctctgcctcccaaagtgctgggattacaggcgtgagccactgcgcccagccaggactctgctttaaatagtatggagaacactgatagtccttggcgtgaactgtatagagagttatgtaaaataaatgcttttgacactcctgatccactgctcatgagaggcaaggagtttagtgactctatacataatacctttgaccatatgtggagaaccaaggaacataataaagttggttggttgctcctaagttcagtggacaaagtgacaaaagaaaatgataaacccagggattctaacttccagcttcaggaggagacactgagcctcagatctgctaagactaccctgagtgagtcttatatcctctagagaaagagctgaaattatggaaaaacagacacaagctcttatcacgtgagtggctgacctgcaatgaaaggtgcacgtacagcctcgccaggtatctactgttaaagtgaaggcattgattagaaaagaatgggaccccaaaacttggaatgtggatgtgtgggaggaccctgatgaagctggggacactgagtttgtaaactctgatgaactttttttgccagaagaaacagcttccccatccccagtagtggcaacatcccctccccaacccatgctcccatcagcctttccacctttgtctgaggagctaaaccctgtgctgcctgaggcaacagtgatggcctcccctgaggcagttgccaggcaaaataatgttcattctcttcaggagccccccgcccgccacaacacccctgttagcttcaagacatatgactagattaaagttccggtgggcccctaggtgtaaggtcgagagtgtgacccataaagagttgtgctacactcgaaaataaatgcttgagttttctaattcatataaacagaaatctggagaacaggcatgggaatggatattaagggtgtgggataatggtggaaggaacatagagttggatcaggctgcatttattgatttaggcacactaagaagggactctgcatttaatgttgcagctccaggaattaaaaaaggctctaatagtttatttgcttgattagctgaaatagggattaaaagatggtccactgtgaccgacctggaaatgcctgatctcccttggtttagtgtagaggaaaagatccaaatgtttagggagattgtgatggtgaggtggattagtaaatttggacctactcatctcagctgggagggtccagaagatatacccttgacgaatgccttgagaaatagatttgtgagggcagcacctgcatctttgaagagccctataatttctcttctctgtatgtcagatctcacagtgggaaccacagtcactcaacttcaaaatttaaatacaatgggaataattgaatcctgaggtggcaggggccaagtgcttaccaacaggtgacctcagcagagaaggattttaataatcaagtggataggatgacctgttctgtggacaccactcagcctctctccccagtcacccctatcatcacccaatgggccaatgaacaaaatggccacggtggcagggatggaggttacgcatgggctcagcaacatggacttccactcaccacggctgacctggctatggcaactgctgagtgcccaatttgtcagcagcagagaccaacactgagcccacgatatggcaccattcctcagggtgatcagccagctacctggtagcagatttactataatggatccagtaggagatccagtgttgtcttatttaagtttaaaattagtgtgtttaattcataaatcctgaatagatactctttcccacactgtaagctgggcctgagagagagagagagagacagagagagatattaaacacaatcttacctcaaaagctgcctcatggtttaatgagaaagcaggcatataagcaaaaattataatgtaacatataaaatacaataatagaggaaagagtagctgggagttgaaagtgggaagactattccaagcagagggaatgccctgtgcaaaaacatataggtatttacaagtaggggattcttggaatttatgaatagtcacaaattctagtctctgttatgtatctttccattctatctccctgtgatcaattttcttttagcttccacatataagtgataactagcaatatctttctgtgcctggattatttcacttaagagaatgacctccagttccatcaacattgctgcaaataacatgatttcacgctttttgatgtctgaatagtattccattgtgtacatataccagaatttctttatcaattcatgcattaatagacgcttacgttgattccattatctttgctattgtaaatagtgctgcaataaacatgtgagtgttggtatccttttgatatatttatttcttttcttttgggtagattcccagtaatgggattgctggatcagatggaagtttttagttctttgagaaatctccagttttatttttagttctttgagaaatatccatactggtttccatggtggctatagtaatttacattcccaccacgtgtataaaagttcccttttctctgaatgctcaccaacatctgtcatcttttgactttttaataacagccacgctgacttgagtaaagataactcattatgattttaatttgcatttttctaacaattagtgatgatcatttattaatgtaactgttggctgtttgtgtgttttcttttgagagatgtctattcacatcctttgtccactttttaatgagattatttacttttttcctgttgaattgcttgagttccttgtatattctggatattagtcctttatcagatcatttgcaaatattttctcctgttcagcaagttgtctcttcaatctgttatttcttttgttgtgaagaagctttttaatataattaagtcacatttgcctattttcatttttgctgtctgtgttttgaggtctttgtcacaaattatttgcctagatcaatgtccaggaaagttttctctagatgttcttcaatatttttataatttcagatcttacttttaagtctttaagcaattttcagttgattttttatatggtgacaaataggagcccagttttattcttctgcatgtggctatccaatttttctggcaacacttattgaagaaggtgtcctttccccattataagctcttgtgttttgtcatagttcaattggctgtacatctgtggcttcatttctgagttttcaattctgttccattgatctatgtgcctatttttatactaataccacgctcttttcaatacaataatcttataatatattttgaagtcaggtaatgtgagcctccagccttgttctttcattttggagatcctttgtattgttttaagactccattttatttatatctgttctgatttttattatatatatatatatttttaattttgatttgggtttgttcttgcttttctagctccttgagatgcattattagactgctgatttgtgatctttctacttgttttatataggcacttaattactataaacttcactcttagcactgctcttgctctattccacaggttttcttatattgtgcttccattttcatttgtttcaagaaatttttttagctttattttaatttcttcattgaactaattcaggattacatggtgtaatttccatgtatttatataatttccaaagttcctcttggtattgttttctagttttattccattgttgtctgagaaggtacttgatatgatctcaatgattttaaacttgttgaggtttgttttgtggcctaacatatggtctattttggagaatgttccatatgttgaaaaaaataatgtatattctgtagttttggatagaatattctgtaaatgtgttaggccagttggtataagctccagtttaatccaatgtgtttttttgttgttgattttctgtctagatgatctgtctaatgttgagagtgtggagttaaagtcctctactgttattgcagtctatctctctccttagaagtagacttaaatattcttatagcaatatttgctttatgaacctgagtgctccagtgttgggtgcatatatatttaaagtggagatatcttcttgctggattgattcctttatcattatgtaataaccttttttttcctttttttactgttcttgacttaaattctgtcttatctgttacaagtattgctactcctgcttgcttttggtttctgcatgtgtggagtatctttttccatccctttacttctagtctatatgcattttactggtaaaatgagtttcctgtaagcagcatatagttggatcaggttttataatccatccagcaattctataccttttaattggagcacacaatctgtttacatgcaaggctattattgatatatgagtctttgcttctgtcatattgttttctgcttgttttatatattctttgttcctttcaatttcacattgattgttgttctgatagatttctgtagtggcaccgtttgcatcctttctcttcttcctttgtgtgattactttaccagtgagcttttttttttctttttttactttgatgtgttttcatgatggcaaaagtagtcccttcatttccaggtttaggactcccttgagcatttttctatggctggccttgtggtaacaaattctttcatcatttgcttgtctgagaaaaactcttcttcatttatgaaagatttctttgctggaaaaaatctttgtaattatggctgacagttttttttttctttcagcactttgaatacatcattacattttcttctggtctataaaatgtctgctgaaaatggagttttctctataggtgactatgtgcttttctcttgcttgtttttatgattcattctttatctttgattttaaacagtctgactccatcttgaagaagaattttttaaatattgtatctgcctggggatccctaaatctcctgtatctgaatgtctaaatctcttgctagacttgaaaaaatttcatctattatttccttaaataggttttctaatcctctctttgtctcttttccctcaaggatgccaacaatttgagtattcaattgttttatgttatctgaaatatcacaaaggcttcctcattttgttttatttttcttttctttcttttttctttttacttttggtgtaaccaggtgatttcaaaagacctatgttcaagttctgagattctttcttttgtcttatctagtctactgtcgaaggtttcaaatgtgttttgtattgtcttgaataaattcttctgttccagaatttctatttggttctttttaaaaatacctatctctttggtaaatttcccattcatatcctgaattgtttttctgatttctttgtattgttttacagaattcttttgtatctcacttaccttctttaaaatccatatttattttattttatttatttatttattgttttgagatagagtctcactctgtcacccaggctaaagtgcagtggtgcaatctcggctcactgcaacctctgtcccctgagttcaagtgattctcctgcctcagccctctgagtagctgggaatacagatgcctgccaccatgcctgactaatttttgcatttttagtagagacagggtttcgtcttgttggccaggctggtcttaaactcctgacctcaaatgatctgccacctcggcctccctaagtgctgggattacaggtgtgagccaccatgcccagcccatattttacattctttatctgggatttcaaatattccttttcaattaagatatattgctagagaattgttacattccttcggcagtgtcacatttcctttttcatgtttcctatgtctttacattattatctgcaaaccttgtgttaacagtcactttctcctatttttgaatttacttttatcagagaggactttatcctgagaatgtatctgtggtattggttcagtagggcactttggctttgattctgggtatgtgcagtagtgtatgtagactctgtattatttccttggctgtaaacagcattattagtgctttctgtgattttctcagggaatcagggtgcagttattagtggaggctgtaatgaggtagtgctgggaactggaaagccagatggaccagtatacaggccccagttgtggcatcagttggctaagcatacctatctttatgtcccagggtggtgtatgctggcatttgttttgtcagttactaggagtccaatttttgggcctcccgagtgattcacatggatgtcctggtgtggacgatgacagtagcagtggtgggatgactctctgtgtcccaagctcagattgaggaaataaaatgactaaacttatacacgtaggaagtacctgaggtagaatttaaacctggtactacatgactccaaagcccattctctggttggtgatggcaatagtgcaaagtcacccacagcctcaggcatgctgctctcaggctctcctgctttctgtggcagcagaatcacagcacacatagtgaggcagggaccccatccttcatccctgggcacagacagaggccatgccaccagttgggtcacagtcaccactcacagcctcttacaggcagccctctagcctgtctacctcagcctccagtggcaacagaattgggtgtgtgcagtgggaagagggttcttgttctccatgcatgagcctgagcacagaagccactcaatggtcagaaaatctcataattatggatttcattctctgcttaaaaaaccaagtacaaagtttgtgccactgctagaatgaggtcacttctcacagccccaaacagggaggtcacaggctctggaaagtgcatactttggtttcctttgttctggaagatacctttttgttatactttatgatcctttccccagggattaatactgcctgtgggtagggtaatactccctgcatcagctctgggtacagccaatgctgtgttgctgcagccctctgagtagacacaggaaagtcagcaggagctcctggaatgtgcaaatatgcaagctgtggttcccaggactgaatgtagtcttatgatgcctgcactcccaaaatggcacctgccacagacacttagttctcagagtggggtggggcagagtgagttacccaacatgagttccctgtctggtgcaatgctcttgaggagtctccaaattaccacccatgctagtgtcagggcttgtcagggtagaggaattttcatgcagttttgatagcagcagtctgcagcagagatgtggactgctaaagctctctcatccttttttcacaataccaagtccctttgggtttctggctgatcttggattcctctacttgattccttctccttctttgcctcaggtgttccccatgagttctctgttgaactctggcattatttcctagacattctattcaatgtgtgattatctgctcataattttggttcttctttctggagagggcaagatgtctctagccagccatcttgaactgtgatctaggatactctacttagctcctgagtgtcattccaccattgggagggagaaggagcatagatgctatggagttgagtgcaagagtcaatggtattttctcatagcagcctgaagaaactaaattatgagaccatcatggaggccagttccagaagaaaacttcaggtaagagacctaaatttgaaaaataactttaagattaatacatgtgtattaatcaaaaatctctgttgcatatgacagaaagccaactacttgctttaacaattatgtattggtgctcataattatggagaacaaatggtagaactggatcaaggtctcaaataatgccctaaaaactctctctctccccacttgatttcagattctgtgtttatgttggcttccttctccccgtctccttcatgatgaaagagaaacaactgtcagcagggttccattctatatggcttatacttcaaagagaaagagaaacttgtctctccccgattcagaatgaagtctcagcagatgatttttactgattgctctagcatggataacttgacatcactttatttatcactgtggccaggagaagtagggaccataataggtcaggccaaggtcaaatggaaatctctgtgttaggaggggtagaataccacaactgaaaatctcatcagaaccacacggcatgagcaaggcaccaatccacaaaggtaagaagatattaccagaagggaggaaagaatgttggcaaactaaaacaatagatgtcctgtataaatggtatctatggtgaagattatttaaacttaaatgggaatttgaaatagaacatatttaagactgaggtagaacaattaagatgaatgctatttaagatttggttgggacatgtaagatggaaaataactaagacaggtggggacttaaattcgggtaattttaaatatatgattaatacttaagggataagaatactatttaagactgaagtatgttaattaatacaagtatatatgaaactgataactatttacaatgagttattaataaaaggataatgtttataaaataattgaaaactgaataaatgtaaaatgaatttattaagtctcttcaaaggtgaattactaaattgtgatatacatatatagatataaatactataaacctgatgatatatataatatctccattttatagatgagtaaactgaggctcagattaaggaaataaaatgactaaatttatacatgcagtaagtacctgaggtagaatttaaacctggtactacttgactccaaagctcattctctgatatactgtgttacatgagagtattttaaatggaagatatttataattgagaagattttttgatagggaggagtggtcacagtgatatctgacatataattaagtcactcaagatggagggaattatttgattgatatgaggtttttaaaatgtgaaatgcctaaagcctcacttgctagctgaaattggaacatgtgtgtccatctcagaaggcatattccctcagaggctgtggatagggcagaggaggcaggaagggcccatactttctttaaaatacataatgtgacattatgagaagcagctgtattttctgagggacaggagactaaaattggtatgggatccccagataacttttctgggaggtggccattgactatagagattgcctgccacgagcccatagacacaggtacaagaggttgtacggtggtttttcttggaaaaaccaaccaatttttttaaatttctggatacatttccggtttcatctactcattcccagagggtcactttctcagtttagtattttacacccttcaaaatcttgtagacagcttcatcctcattattcataacacagcctcatctcttagtcaaactgttcatcacaggctttttgcactacatctttcacagcacaaatctgaaattatacttcagagattgagggagcacttcagaatcatgtgggaatgttgactataggcaatgccacagaatctactcccagcaaacgggccaccttacctggctgccaggtagacctgccaacacacacgaaatatttcttggaaaaatcatcttccagtaatgcctttggtttcaatttttaaatatttgatgtaaaaatgtttctttatcttggctagaaaccccttctcaatttaggattctctggagagaacaatccagggaaaagagatgagtttagaaaaatctaagatctctatttaaatcctggctctatccaggctctgatatgaagctaggaatagaagtataaaagtcatcagtttataaataatcactaaagccatagcacaagataaacacactcataaaaagagataaagtgagaagagcagagggctcagaacagaactcttaggaataccaatatttaaaagttgagcagagttggaagagctcaacataggaaatagtagacaaagctctagattgactacaaagccttgcacaagtggctatagttcccatagttggagagattaatcaaaattctcttaggtatttcagaaatgtctgatggggtcattcatttattcattcaacatacagttttgggaatctgcagaaagaaataaaatgcaaaatgaacaacatcttcaaattcattgtgtaactattatttcaaaaagaagttttcaaaggaatagtctaatttggctgccaccataaagtgaaaatatttggctcaattcttttaggagaaagatgatggaatttatgtaacttaggaataatctgcaaggaaaaaaacggaactttcagtaaatctgcctgattccaagtttgctctataaaaaacaaatctccaagtctcaacagggcatactcagctgcaaagccatctgtattcgttttccattgctgtgtaacaaattaccataaacttagcagtttaaaataacagtcatttattagttcccaattctataggtcagaaattcggcatgatatgactggattctctactcagagtatcacaaagatgaaatcaagatatcagctgggctggaggctctagaagaaaaaaaattctgcttccaagcacattcttgttattagcagaatttagttccttgtgcttgtagaatggaagtacacatttccttactgtttgccagatatttgactctcttagaggtcacccaaatttcttgcttcatgaatctgcccatcttcaagccaataacagcatgctacatccttcttgtggtgctttgaatctctgactttctccatctttgacttccagacccaaatctaaaggactcatgtgattaggttaggcacacctagataatattcctattcaagcataattgatttgagacctttttgatgtttgcaaaaatcaattttgccatataacccaaaataatcacagagagtgatttatcaccatattcacaaattctacccacactcaaggaaaggaaattataaaggaagtatataccatgggagaggagggagagtcttttgggagcatcttagaattcggcctaccacactgccctaaagtagcaaacaccagggcagtcatacattcaaaattcacctcaggcacatctgccttttatgaagtcctttttgaccaccccacctgcaaaccctggtaggaataattatttccaacttttgttaaaacatgtgtaaccctttagtacactgacttatttacacaattgtattcctttatggactagggtctcctcagaggcagagactgagtgtgatttgctactataccttcagtgccgattataagaattggtacagaacaggtgttcaaagacaattgtagagtaaaggaaaaaattacctcacccattggggaacctgaatactgctgtttttagaaagaaaaaaaatagaactacatttggtagagaaggttaggatggctgaacaagtgagtgcaaaaaagtattgagatccatacatatacaatattagacagaactttggatcacatcctctttttttctctccttttgcccaatactaaaccttcacccaatgttctggattccagttggtccagtttccaccaggacctccctctatctaattgtataccctctctcccacaattttcaattacatgacctccactggttccttcacagcagtattaaaacgttcggatttctcttcagcccaaatctgttttattatgcttctggctcaaggcagagtccatttcctccatcccagctaacaccgttttactatacttatctggactaattggtgtccctgtccccagtcttgccctactccaatccatacttcatatcaatgctagagtgaattggaaaatattaataaggatatcatactgtgcttaaaactctttaatatattcccatcacttagtgggtcaaggtcaaactccttaataaggcatttgaaaccttgtcgaatctgtgtttctggatattttctgttattttcccatcagtcactccttctcccacacccacctgatgattacatgggggttcaatagtctcttagcacacagtacatgcttttaccatcttctatatatttctcattttctacatttttatattaccatcttctatatctttctcatttcatctacctgagatgttctgccctgatactctaatagacagaattaattgttgttacttcattcttatgactcttattttagcacttctcacataaaacatgtttcctcttctgactatgagctctctgactatagactaaagattagttcccagaaaaaaacaggataaggatcccctaaaggaattatcattcatgccttcattcctttcccaagagtttcctgagtgtcttttctgtgtgaggcactgtgctgtgtgtgtgtaggagacataggggaaagccctgctaaggtggtcactggcaggcacttatttttaccatcccttctgccactaatatagtcaggcacatagtagatgctcatgccagaaaaatatagtttaaaatgaattagttcttccattgttatgtgtgtatccacagcatctaccagtgaaccaggcaaggggaagtgcttaataaatgtttatgaatgaaaggcaaatgactgatcctacacagatggaatgaggtgactaaggtcatgccactaaacaaaacttcttcttcttctaaaggggtattaaccatacaatgtcaccattcattaacaaattctttaagatctgatttttaaatagtgttatatccttgctaagccattaacaatgggaaaataaaactgttaaattccaatcagaagtttgcaaatattatgccacaaatatcctctataatgactctttcacagacagcagatgtaccccagatttaatagaactacccagctaccaagttatggtatgatatggcacctggcaaagacacttttccagaaatattcctaaataagagcctcagccctctctattcaaccctacttcatccccttcaatcaacttttagctaaaagcaaggaaaacaataaaataaatacaatagaatctttctcatgctctcaaggcaataaagttaatgatatgttgctactaaaatttctcattttcttttatgtcagagtttgaccataaatgaaacaatgaaaaaagttacagcctcctcaaatgtgcccaatcagataaagaacatttaattaatataacttgatagaaggtttaaaaatttctcaaaccttttacatagaatcagagaggaggtaatgaatattaaactcagagccgtgtattttacagataacagaatcaattgggacctatgagaagacagctttttccaatattataaaataaatggaaggcagatctaagcaagaggccaagtgtcctgcctctcacattgattcctttcagctttctaaatttctaaattctggtaatagaacatgaccagtccatgggcattccaaaattcattagtgattttaaaatttatccggagctatttattccagtacccccattcaaagcagccagcatggaggaataatttgagaaaaaaactaaatcctaaaatgcaggtttcttgaagctgctggagatgtgaaattcaggagatggaatttttaaggaaaaactacaacttgtgacagaaggcaaagaaagcttaacaatcagacaacgatattccataacctgaggaaaaagaagggaaccagcagagcattgagatggcaaacagaaacaaaataaactcctggagaagttgttcaattgcacagatactatttatggttccccaagtttactgaatgaagttaaaaggaagctgactccaagtcagtgctgggaagtaccttcataccaagagcggccaaatgtggaacaggcttccttgtgaagtcaggatttccctataattgaagataaccaggcagaggctgggcaatacagaggagattctatgtggtgctaaaggctttatgaatatattctatgctttcctgtattcttttcaactttgagattctgttcttccatggtagaagtttaacactaagagaaaatttgggctgggattgaggagttttcttgagtccttcaaattatactacataattaactgcctacattgtcccttcaaatgaatttaatttcaattcattaagtacttaagggagtatgtacaatattttctgaatgctagggtgagggttggtaagggttacagaagtgagtataacgtggtccttgtcattaggtgagtctcataagtctcataagttagtgtccagctacacaatggagaccagtgtggttgttctatatacatgatgttactaaagccacagtaacttgctaaaatagtatggcatgccttaataagtatgaatttactgtcttgctatgcaaacatttataatcatattcaccaagtttattgaattgtttctctgggccggactctgaactaagatattttctatcactatcaaccctctatagtaggtaatattattactctattttaaagagaggttaagtaacttttcctagatcatctagctaaaaggtggttacaaacacaggcagcctgatatcaaagcttttgtgcttaatcactgcttagtcactgcatttatctccaaatctatgtacatatgtatgtatgtatgaaaagtatgtatatatgtttacctgatgtcatgaagtacagagaggagagcacagaattcagacataggcaaaattaagtgtctgttaaaacttctctacttactatttctgtgaccttgagaaaatcaagtaatatctcttactttggattacctcatctataaagctggggtgaaaatatttgtctaacggttaaaatgaagtggcattttaaaaagcactttgtaaaatatatagcactatagaaattagttattgttattttggctgatcataattttaccaccttaattctagcactctctctagattctcttaaattcaacatctaacataaattccaaactgaacaatttccttaccatctccattgcttctcctctagtccaggttactatcttttctttcatagaatgctgaaacagtccccaaattgacctctctatgctactgttgtcccacttatagtgcattataaatcagcttatgtctagtttcacattatgtttagaggaaaatccacattccttgctatggcctaaaaggcttcatattatctagccatctcttatattcttatctgccagtctcttatacctcatctcctgctaccttccctttgctcattgtgttcaaccacacttacctcactgtttttgaacacatcaaacttttacctcccaaggtcttggtactggctatactctctgcatacattctttctaaaatagttccctttcccttacttaaccagttattatttctaccttactttttcttttctttgcagcattgtctatagataatgagggcaagaactttgatttattcactactacatctccaacttccaagagagcctactggctaacattcaaatcacacattatcaatcaatcaaagtaaagataaaaatactggagtcctgcttttcttttaaatgagcttcccgccctttctgctcacaccttcatcttccaagtctttaatttggaagtcaactcagtaagcaccagatagtgttgagtgagtgttgaaactcaggctagggatactcccttcatcttggagaggaactctctcaaaatcaggcctagaaatagaatttaaacagagccttgtcaggccttctttacttcctgcaaacctacatttgatcaggattttagaccatgaatcattgtatgcacgaacagctgcaaggccctctggccatccatttctagaggttcaagaggctctttgagagcctttgtttaatgaagcatattttacttttgatttattacaactaccccaagtgtcctggcttgaaattttaaggcattagtgtcagttattacattataagtagtttccatcatttatttatttttcctgtgtgaggcaatttatttattttaaatttattttttatttcaacaggtttctggtaacacatggtgtttgcttatatgaatgttattgagtgtcaatttccgagattttggtgcacccatcacccaagcattgtacactgtatccaatgtggagtcttttatccctcgccccgctcctaccctttcctctgagccccgaagtccattgtatcatttttatgcctttgcatcctcataacttagctcccaattatgagcgagaacatacgatgtttggttttccattcctgagttacttcacttagaataatagtctccaattccatctggtttgctgtgaataccactattttgtttctttttatggctgagtaatattccatgctatatatatataccacattttctttatccactcattgattgatgagcatttgggctggttccatatttctgcaattgcaaattatgctctataaacatgcatgtgcaagtatcattttcttattatgacttctcttcctctgggtagatacctagtagtgggattgctggatcatatggtaaacctacttttagttctttaaggtctttaacagtgttttccatagtggttgtactagtttacattcccaactacagtgtaaaagtgtccccttttcaccacatccatgtcaacatctattattttttgattttttgattatggccattcttgcaggagtgagatagtatcgcattgtggttttgacctgcatttccctgataattgatgaggttgagcatttttccatatgctcattaaccatttgtatatcttcttttgagaattgtctattcattatctcagcccagattgtttttgttcttgctgatttgtttgaattctatgtatattctggatattagccctttgttggatgtacagactgtgaacattttctcccactctgtgagttgtctgttaactctgctgattatttcttttgctgtgcagaagcttttaagtttaactcggttccatctttttatctttgtttttgttgcatttgcttttgggttcttggtcacaaaatctttgcctaagtcactgtctagaagggtttttctgatgctatcttccaaaatttttatagtttcaggtcttagatttaagtctttgatccatctttagtttatttttgtacaaggtgagacataaggatccagtttcattcttctcaagtggcttgccaattatcccagcaccgtttgttgaatagggtgtcctttccccactttatgtttttgtttgctttaccaaagataaattgacggtaagtatttggttttatttctggcttctctgttctgtaccattgatctgtgtgcctatttttatacctctaccatgctgttttggtgactatgaccttatagtttagggtgaagtcaggtaaagtgatgcctccagatttgttctttttgcttagtcttgtttttggctcgtttttggctccatatgaattttaggattgtttttacgggttctgtgaataatgatggtagaattttgatggaaattgcattgaattgtagattgcttttggcagtatggtctctttcacaatattgattgtacccatcaattagcatggaatgtgtttccacttgtttgtgtcatctatgacttttttcagcagtgttttgtaattttccttacagaggtctttcacctccttgtttaggtatattcctaagtattttattttattttttgctattgttaaaggggttgaatttttaatttaattctcagcttggtcactgttgctgtatagcagtgctactaatttgtgtgcactaatttggtatcctgaaactttactgaattcatttatcaggtctaggtatttttttagatgagtctttaggattttctaggtatacaatcatattatcagcaagcagtgacaatctgacttcctctttactgatctggatgccttttacttccttctcttgtgtgattgctctgactaggacatccaatgctttgctgaatagaagtggtgaaagtgggcatccttgtcttgttccagttctcagggagaatgctttcaatttttccctgttcagtacaatgctagctgtgtgtttgtcatgaatggctcttattaccttaaggtatgtcctttctatatcgattttgttgagggatgctggatttaatcataaagggatggtggattttgtcaaatgctttttctgtgtctattgagatgatcaggtgatttttgtttttaattgtgttaatgtggtgtatcacatttattgacttgcagatgttaaaccatccctgcatccctggtatgaaagccacttgatcatggaggattatctttttgttttgttgttggattcagttagcgaatattttgttgaggatttttgaatctatgttcatcagggatattggctccttccttccttccttcctcttttctttctttctctttctttccttttcttttatttcttgttaattgcttctttcgttttggtattagggtgatactggcttcatagaatgatttaagaagcattttctctttctctagcctgtggaatagtgtcagtaggattggtaccaattcttatttgaatgtctgatagaattcagctgtgaatctatctggtcctgaacttcttttggtttggcaatttttaaattaccatttcaatctcgctacttgtaattggtctattcagagtttctatatcttcctggtttaatctaggagggttgtatatttccaggaatttatctatcttctctaggttttctagtttatgtgcataaaagtgtgcatagtagcctttaataatcttttttatttctgttgtatcagtagtagtatctcccatttcatttctaactgagcttttgtatttctgctgcatcagtagtagtatctcccatttcgtttctaactgagattttttttggatcttctctcttcttttcttggttaatcttgctaggtctaccaatttcatcatcttttcaaagaaccagctttttgtctcatttatttcttgtatttcttgtttgtttccttcaatttcatttagttctgctctgatctttgttcttttcttctgctggctttgggtttggattgttcttgtttccccagttctgtgaggtgtgaccttagaaagtctatttgtgctctttcagactttttgatgtaggtatttattgctatgaatagttctcttggcactgcttttgctacatcccagaggttttgataggttgtgtcactattatctttcaattcaaataattttttaaatttccatcttgattttatggttgactcaatgatcatgcaggaacaggttacttatccaattttattgcactgtggtctgagagagtacttgatacaattttgattttcttaaatttactgagacttgttttgtgccctatcatatggtccatcttggagtatgtttcatgtgctgattaatagaatgtgtattctgcacttgttaggtagaatgttctgtaaatatctgttaagtccatttgtttctttgttgactttctgtcttgatgacctatatagtgctgtcagtggagtattaaagttccccactattacggtgttgctatctacctcatttcttaggtctagtagtaattattttataactttgagagctctagtgttaggtgcatatgtatttaggattgtgatattttccttttgggttagtccttttatcgttatatgatgtccctctttgccttctttaactactgttgttttcaagtttttttgtctgatataagaatagctatccctgttcacatttggtatccatttacatggaatatctttttccagcccttttccttagatttatgtgagtcctcatgtgttaggtgagtctcgtgaagatagtggaaacttggttggtgaattcttatccattttgccattttgtattggcattttaattgaagcatgtaggccacttacattcaacgttaggattgagatgtgaggtgctattctattcatcatgctatttgttgcccaaataccttgtttttttcttttcattgtgttattattatataggtcctgtgagattcatgctttaaggaggttctattttggtgtattttgaggatttgtttcaagacttagagttctttttagcatttcttgtagtgctgtcttgggagtggtgaatactctcagcatctatttatctggaagactgtatctttccttcatttatgaagcttagtttcactgcatacaaaattcttggctaataattgttttgttttaggaggctaaaaataggaccccaatccattctagtttgcagggtttctgctgagaaatctgctgttaatctgacaggttttcctttgtagggtacctgacgtttttgtctcatagctcttaagattctttccttcatcttgactttagatagcctgatgactatgtgcctaggtgatgatgtttttgcaacaaatatcccaggtgttctttgaggttcttgtatttggatgtctagatctctagcaaggctggggaagttttccttgattattccctcaaatataatgttttccagacttttagatttctcttcttcctcaagaacaccaattattcttaggtttggatgcttaacatagtcccaaacttcttgcaggctttgttcatttaaaattctttttttgtctttgatggactggattaattaaaaaagcttgtcttcaagctttgaagtttttcttctgcttgtatgattctattgctgagaatttccagtgcattttgcatttctctaagtgtctccttgatttccggaagttgtgattttttttttatttatgcgatctatttcactgaagaattttcctttcttttttttttattatactttaagttctggggtacatgtgcaccacatctgccatgatggtttgctatacccatcaactcttcatttacattaggtatttctcctaatgctatccctcccccagccccccaccctaccaacaggccccagtgtgtgatgttcccctccctgtgtccatgtgttctcattgttcaactcccacttataagtgagaacatgcggtgtttggttttctcttcttgtgttactttgctgagaaggatggtttccagtttcatccaagtccctgcaaacaacataaactcatcctcttttatggctccatagtattccattatgtatacgtgtcacattttctttatccagtctatcattgatgggcatttgggttggttccaagactttgctattgtgaacaatgctgcaataaacatacatgtgcatgtgtctttatagtagaatgatttataatactttgggtatatacccagtaatgggattgctaggtcaaatggtatttctagttctagatccttgaggaatcaccacaccatcttccacaatattagctgtgtgactttgtactagtcattttctgtttctgagtctcaatttccttgtctatataatcaggcatttgggctagatgaatgctaaggctatttccagttcaaacattcaatgataatagctcattgaaggcagagactacttctttattcatctttgtatcttcactgcctggtaggtagcatgtattaagtatttatttactgtgcatttgaactaaacgtaagtatagaactgtagagcagaaagaatagaaaagaagcaccatcttaatataacttagggagatagaatcaataagacttggtgacagattggtaggagagtgaggaaccacactgaccacattgaaatgaaatacagaccagctgaccagactccagcaagatgaaccatcagtgactaaatgactgttggtgtatccttagaaaaataagcttaaataatttgggctatttattagggagaagagaattctcaaagggaaatggatcagctgccacaagctcttcattcaaaaaatagcttaaagcttggattaaaagcattaaagactatttcatgtcactttggaatatcccaatttttctgatgttacagggttacaaatgttgaagtcatgggctttggctatattgtttctaagagaggaggacataatgttacttagaactgagaaagacctgataacctgataattataatttcagaacttaagtgagtgatagtctgttggagaatttttgtgctgcttttcatgtcaaggacatctgggacatataaacctcaagatccccaagatatttcggaggtttatggcaataaggttacttgaaatggactattctgagatatctaggtaaaataaagactagggagatcatttattctaatcctgtcatttgactaataagaaaatggggaaagttgtctaaggttacacattgagttaatggcagagctgctattgaataagttaaaaagaaaggaaactaatgttctttgaacttccatgggccaggacctttacatgtattatctcaattaatgcaatatacataggacataggtgtaatagcttcattttatagatggaaaaatagatgtagttatttgcttgcccacggttgtattaagtttcagagtcaggattggaccccaaattgacttgactctagcccatgcctgacactctgctaccttgccattattatggagaacatatataccctggttttccagagacagtcctagtttatgcaagttatccaggaataattatcaatagtactcttccacttaaaaatttcaggtttggaagataaatttatgaccgaccacattttactatgaatagaaaaatgtaaagcactgctcactctctttcaaagaaaatttagggacccagcagcttactgcccataaagcttccttgtattactcatggatcttcagagaaaagtgggtctcttttaagataaaaaggatgttccttctcatctgctactttctgaggctttctctcatacacaagttaaaggttatcagtaaagaaagacattcattagaaaaggagatggggagtaattaagctgggaaagggattctgtgtaacctaattctgacataataagtaactcacaaacaaggggagagccacatattaatttaaagagcactggcacagaaaactctgggaagattaatgatgacattgaatcaaaacctcatttcaactgagtgtgctaagagtataaataacatctgaataacactacatttactaagtagtttcatttgttcatgcgttcattcatcctattctgtgctgagcctaagctaagtactataacttcctgagggcagaggctgtgggttggtcttatttccagcatctggtacagtgactgctgcctaataggtccacaataaacacatgttgattaatttgagtgaatacaaagatgactgagagacagtctaaagcatttagactgtgtaatagaagagaaagacaaacagaatcagagaatataatgtcctgagtacataacagagggaaactgtggaactctgcaaaactgagaaggcaactaagatagcatagaaagtagaggtcagaataaacttcctgtaggagctgacacgtgggctgaattttgaaataccacttggcaatatatatactctcacttgattatgcttagacctaaatggagattattactgttttacagagaaagaaactaagtcccagggaggcttgcccaatgttacactatgttcacattaatttatttactccttctttatctgtgaagaagttacaagatgagggtaggaactttggcaaggattacaaataacggaggaagcctttgtgatattttggaattaaagaagagattctagttctgagtacaccttctttgattctggagaacaaggagaaacaaaaccaagcccaaaatgaagaaagctttaagagaaaaacacaaaggcgactttaacattgcattagtgtgttcttttgtttttagatcagacattgttgagaacttactggaaacacagagatggaacacaatatgtctcatttcaaagagcccaatctctagtgagataacacaggcacatatcagcagaggaggaaaagaagggctgatacccaagccacgaatagaaaaaaaaatcatttgcctgtgtggaaattctcagtagcttgaacatagtaggtcaagcatgtcagtaaatggaaacatgggaggaaggctgtgggctccatgatgagagaaactatgacaaaactgatgcttgtatcacacccccacccaacaactaccaccctctactcctctcctggtacctagctcaagaccaggtactggataggtttctattaagcctttctgaatgaacaaacaaatgaatgaataacaagtaacatgcacttccctcacaaagaacactggcattttaagaccagccttgatgccttaaaccaaacaaagtagaatgtcaggccctgggtgaggtacatacactgtggagctattttgagaaaatataatccctattctgtcatttcatgtagggaaacaataatctcccaaccctgactgtattccctaccctacccctacatacacacacacacacacacacacacacacacacacacacacacacacacacacgcagacatgtcagctggttctgggtgccaagaattatggaccattcttactggattcctatactttctatactaacagatcttaggcaggtcacttttcctcttagagcctgtgtcctcatttgtaaaactgtcagaataagagctgccttacctaccctgccagactactgtggggctcacaggagataaggagctttaaagtgatatagaatctgtcctctccctatctcctccatatcaacaaatgcgaccatcttttatatatccccagtgccttaggcacagagattgctccttgaatttttgtcaaatgaatgaaagtaaacattattattctaggctttcaggagaaagacaaaaggaattcagcagcccaatgtaggtaatacaagcattcctaagaagcacttcactgacaaactaaagggaatggagcccacatataaagaggtggtttggtaataaatcacacatttgcataagctgtgaatcattctgtataattagaacaaatagtttacctataaatcaaggctctgacatctgtgaaagtctgatgtttattcccctcaaaacaccaaattatactgagaagataacaaatgatctttctgtggggagaaaggttgaagaaggcgtcttaagggagaaagattgctaaatcaaatggtttagatgaaagtaaaagagtcttgagatgattcccaatgactcattttattgcttcagaactatatacctgggcgtggcaaggcccatggtagagtagcattttgtgccttagaatgtaatttcacagcaatcccaggttcatatatatctgaatcatttcaattattggatcaatagtggctttccaatgatctggctgtttacctgtatgataacattctaaaaattcctcacgggtttggccttcattagtgttaattcaggacttcatcctttccaatctatgttcttgagaatcattttatagaatttgggttccccaaaaataagctactaccattcataggcagtacagaaaacagaaagtgtctaaaggagcatctttttcacaggaatcaagatttgactgaaactcacaagtcaaagaagagaataggaattaaaatccaacggatcaaaatgcagcctcatcacttttatctcttgccaggttttgttaaccagcataagagggaaaatcgacagaggcaatgaatgggccttgctctaaaaaggcccttccatctggtgcagtgccgaaaccatcagccctgtaattaaaatgcaattgccatcccctgccacaatcccaggatggccattttatctgcatgagatatagaggggaaatcacaatttttttacacttttctggctccattgagtttattctccttctattaattaatctaactacactaggggctccttcttactctgaaaaccagggtggcacaaaccacacatgggatatctgaagcagcatgaatttttaaaactgggttcgtatcctcattacagaaagacttaattacttctgactaaatctgtaattaaaatatatcactggagcagattcacctgcatgtgtaggtgttggcatgcacacccttgtgatgggcaaagatgaatcatccagagatagtgtgcagagaaggaaattttactcagtggcaagataattctaagagaagttcaaaattaaagtcagagaaaaaaatctgatgacatacaggagtaatcccattaaatcttaagaaaattataccatacccaatagctaatcatgacaaaaagggatgtgctagggtggaaggaaactaaggtaggaggtgacagggaattggggttgaattgggaaggcagccaaacgtaaaagtcaaccatgacttctctaccatgaaggtgagtcaaggttgtagttagaaagacagtgtgagccagttagaaagtgtgagtagttagaaagacaatgtgagccagaaatagaactataaatagtatgcaatcttgggtatctgctttatgtgttgtttagaaagtgttaagtggttagacatgaaagatcaaatgaactattccagcctggagtattgtaagaaataaaaactactaaactgtcagatagaagaggttcaatatttgttctcatacacataatttgtctctagcttgggtaagtccctttctctttaggcctgtttcctcatctgtaaaataggggcagtaattatctatctcatgcaccaagacactatgtgcatctatacaactgtgagggcaccatccacgtcaactatgagcaatgcaggactactgtgtgatctatggcctgagaagggaagggtctttattgcactagaaaagtctgtgtaagtacattacatttttagtttgcatgaccttaagccatatactgtcatttgttatgagtttccttatgattaaaattaaggtgttggacttcacgatttcttaaggtcttgttcaattctaatatttaaaagtattacagtttattcacacattcgactaaaattcaagtaggacctaagacaagtgcagaaaattaaaaaatagttgaaatatgttcctttcctttaagagttcccatttgggtggactttatgctaactatataaagtccttctaggtaagacatttcatgctttttaactgtattttcttaggccctgatatgcaagtgcaattatcaaattatagcattgtaaaacattaagctaataagactaaacaattgcaaattttaaatgacatttaaaattaggcaaaatcttatctttagacaaataaaattgcagttgatccttcaacaacataggtaacataggtttgaaatgcatgggtccacttatacacagattgttttcaatcaaatgcagatgtgggacttgagtatgtaaggattttggtacacataaggtcctgaaaccaatccatgaaatatagtgaaaagtaactgcatttggaatgtctttggattattttaatatgaaatactgaactggaattcagaacaaccaactctagtcctggattaactgctagtcacttgagagcttaagtcatttggtctctcagagtatcagctcccagatttgtatcataatcctgaaggatacaatcccaaatgccataatcctgaatgttgaaattctgaaagatcaaagtcccccaaaatacaaatccctaaattctaaaatccctaacatctaaaatcttgaaaatcacaatcacaggataatttgcctcatgtcagtccagctcttatggattatccctatgcaattgcccataatctattcctgtaatacacattctcatgtcaaattttctttgccgttcgtttagttttcttcactattttcaaatttcagcattatttttttacaattcactatgctatgtatttcatcttcacatcatttccaataccgaaggaataaattgtgtggagacctttagagagttctaatttgttttatgcattttttgcaaatttgactccatgaaagtgcattatcacaatattgactttgtatataagcattgtatgtgtatataaaaatgttgaaatttcctcagtaaatgaagaaatgccctttttgtacacgtacatttgtgaaatataaaatttctcaagatctcagctctttggatgactacgtacacagtggtgacccattgtagtttttgatctgtctcatcaaacgacttaggttgtttgtcatggtatttcagatgaacacattataaagctgggtacacacaattaccaaccacagtgatgcatgtttatacatttcccttttcacctatttctttatgcatatgattcatctgctcataactgttacaatgatgtgactgttgttagtatacttaagtgtttatgcttgcaaaaatacatatgttattattgcctattttattgttaagatatcctatgaaatgttttgtcatgtttttatgtttctcaaatgtcctttaaaatgtagggaaatatcttttaaattttttaaaattattttttccagtattatatttcaatcttttgagatttcaacatttgggattatggtgtttaggattgtatctttcaggattatgatcagctccttcagtctccttccaatcaaataagagattgggccaactaagattatctctgagcttaaagctttagggattcatattttagttagtgcattatcaaattatttaaaataattgcactgcaaatacatacactttggtatgttttgcattttaccaaatacaagtggtagtatacatttataccaaagatgaccaaactctttctgacatctcataagacacccctaagtcccataaatagttgatgattcttgctaaaccagataaagtttgtaaaatgaaatttacagaaagttaaaattatcattgaaccagttctttcaaattccttcataataattttgatttaagctgctgctaagaagctgaactcactgatttaaattttgctatgtgttctcacctccattcactgctttcttactaaataagtattttgcatccattttatcttttaatttcatcttcggttaagcagattggctgaagcacagagtctatgtaagagaggaatacgagacaggactggatatagaatcctaaccctgacacttcctaatagtgtgtcctcgggtaaatgattcaatatcccctagtctcagtctctctacctgtaaaattagaataataacagtcactccacagaattattttaaaaattaaaagttatatacagagaatttcaagtacaatgtctaaaatgtagtaggtattctaaaatgtattttcttctcactgtaccccatctataacatcatccacagatgaaacacttttccagaaaacagaatttatttaatcaggaaattttgtcttagatataatagtattaaaacaatatctatatcaaatgtatactatagatttcttgaaataatatgtcagattatactcgctccatacattcatcaaaaagacttagaagttccaggcaatgctacccttgtaaaatattcctataagatatgcactatttgagagagagaataggagaaactaatttactatccgtttctctatatctttgacctctaaacaataagatagataccaaaacataatatacttaggttttattagcttaactactattagaagtgtcattaccaaataggttatgtgttagcaggtggaacttgactctggaggcagagctaggacaccagaccaaattgaggactagctaaaacagggaatgggtggaagtagctttccataagacatgcccaccactatgccctgtcagtttaccattgccatggcaacacccaaaagttactaccccttcccatggcaataatctgacgacctggaagttatcaccctatttcaataaatttcggcataatctgccccttaatttgcatacaattgaagtgggtataaatatgactgcagacatgcctttgagctgctactctaggcaactgcttatggggcagccttgctctgcaaggagcaatacctctgctgctgctgtacctgcggcttcaataaaagttgctgtctaacactaccggctcactcttaaattccttcctgggcaaaaccaaaaaccctcttcagctaagctccaatgtgggggcttgcctgccctgccttagttaagattttagcttttatagatgctctgtgtaagaaatgctcacctataagaaataatctaatatctttgaaaaatctcagcttaaagatatcatgaatttaaccaaagcctctctctacaaggaatacacataacaatctctcctaaaatgtagatccaggaaaaactttctagtcaacagatttgcttccttttatgaaacaaaagcaataatataagtcattatgttatttttgctttggtatcaaggaagcttaaaggtatatctagtgttttatttaaacactagatttttgtccccatgagtaccttcacaatctcatttacactgcattcagaatcttccaaaaatttgtttttgtttttgttttcagtcttaacttctcaaatattcaggagcctgcttctaggaagatggagcacatgtatgtttccctaattctcttgcagggtaaaactaaaactcttggactttatacacaacaacgaacataataagactcctaaaggtggagggaagcagcagactaactagggaccttgggacccagagaatgacatggtggtcagttccatgggttttctttttgcctcaaagatgcaagaatgggtactacagaagccaaaactcctgaaatgccagtaggtacaaacaaacaaaagccaacaaaaatctgttccctagacaaaggatcaggaaagaggcagcccaacaagacaagaaactcttagaaaataaattttctactatagccaacaccacagaaaaaaaactgtgaccctattatactcacaggaacaaaagctagtgagttgtctagactttcaccctctccatactgtaacaatgtgtcccaaccccaccatcagagtggtgtcagagatggccaagtaagaagctgagaccttcattcctgctgggtagcaatgagcctccacctacaccactatggtgtcagtagaggaaatgtggggtaccagaacttttactcacctcagaagaaatgaggatcccctccttgcttgtgtagtgtcagaatagtcttgtggaaaatcgtaatttttaccacagcccagaaccctgcccagcagtaacaagggaccccttctgttgcagctgtcaagtgaggaacttgtaattctactcccatctgcaataaggtggcaacatcctctttctttcagagtatttattgtctgcagaagtcaatcaagacatattatttaagtctgatgtggagtctcataatctaatacacaaaatggtcaagttttactaggaaaccacatataccaagaactaggaatatcttaaatgaaatgagaaaaatgtaattagtagatacgaacacagatatggcagatatttagaattatctggcaacgattttaaagtagccatcatcaaaatgctttatcgagcaaatataaacaagcttgaaacaaaaaaataaagaatcccctcagaaaaattaagtctcagaaaagaatatgaaaagggacagctcctgtagaaaacagtattgtggctcctcgaaaagttaaaaatagaaataccagattatccagcaattccacttctcagtatatactgaaaataattcaaagttgagtcctgaagaatatgtgttttgctttgttttgtttagtttttggattattattttcattaattttattttagattcaggggtacatgtgcaggtttgttacatgggtatattgtgtgatgctgagtattgggtttctaacaattctgtcacccaagtagtgaacatagtacccagtaggtagtttttcagccaatgcctcacgcctttcctccctccttctggaatccccagtgtttattgttcccatctttgtgtccatgtgtaccgtatgttttactcccatttataagtgagaacatatggtatttggttttctgttcctgcattaattcgcttaggatagtggcctccaggtgcatccatgttgcggcaaagaacattatttcaccctctttatggctgttgtatatgtatcctattttctttatccaatccaccattgataagcatctaggttgattccatgtcattgctatggtgaatagtgctgagataatcatgcaaatgcatgtattttttggtaaaatgatttattttcctttgggtatatacccagtaatgagattcctaagtcgaatgactgttctcttttaagaaatctccaaactgcttcccacaggggctgaactaatttacattcatgccaacggtgtataagtgttccttttcttcacaacctcaccaacatctgttatgttttgactttttaataatagccattctgactggtatgagatggtacctcattgtggttttgatttgtatctgtttgatgattagtgaggttgagcattttttcatgtttgttgactacttgtatgtcttcttctgagaagtgtctgctcatgtcctttgcctattttttaatagagatgtttggtttttgcttgttgatttaagttccttatagattctggatactagacctctgtcagtttgcaaataaaatttttcttattctgtaggttgtctgtttgctctcttgatagtttattttgctgtgaagacactgtttagtttaattaggtcccacttgtcaatttttgtctttgttgctattgcttttaaggatttagtcatattctttgcatagatcaatgtctagaagagtatttcctggattttcttctagtatttttatagttttaggttttacacattagtctttaatccatttttagttaatttttgtatgtagtgaaaggcaagggtccaatttcactctgctgtatgtggttagccagttttcccagaagcacttgctgaatagggtatcctttcccagttgtttatttttgtaaactttgttgaatatcagttggctgtatgtgggcaggtttatttcagaggtctctattcagttatgttgatctgtgtctacatttgtaccagtaccatgtcattttgtttactgcagccttgtagcatagtttgaagtcaggtaacatgatgattccagctttattctttttgcttaggacttccttcgctatttgggctcttttagttccatatgaactttatgatcattttttctaattatgtgaaaaaatgacattggtaattggatagaaatagcattgaatctgtagattgctttgggcagtatgaacattttaatgatattggttcttccaacctatgtatgtggaatgtttttccatttatttgtgtcatctccgatttctttcagctctgttttctagttctcattgtagagatatttcacttccttggttatatgtattagtgggtacttttgtgtgtaaattgtaaatgggattacattctcctttttacacatttttttgagacagggtctcattctgtcacccaggctggagtgcagtggtgtgaacatggctaacaggaccccgatctcctggatgcaagcctgcagaacaactgggaccacagccacatgtttccattcttggctaattatttcagtgaattcttgacttggttctcagcttgaacttttttttttggtgtattaaaatgctagtgatttttccatgttgattttgtatcctgagactttgctgaactatttaaaaaaatagctctagggatatttggcagaatcttcagggttttataggtataaaaaaggtattgaagagtttggtatttattgtagtcttctcagtctggccttgtttgtacctgtcctttttggaaagactttccaggtatttgaaataactggagtgttgtaatttaagctgtatctgcattaggagccaccccaagtacattagcaaagagagaaaatctgacttcctcttttcctatgtagatgccttttatttcttcctcttactggattgttccagctaaaacttccagcagtacgttgaatagtagtggtgaaagtggacattattgtcttgttccagttcttaggagaaatgtttccagtttttgcccattcactatgatattggctgtaggtttatcatagatggcttttattattttgaggtatgttcctttgatgcctagtttgttgagggtatttaacatgcaagcatgttggatgttatcgcatgcttttcctgcatctattgagataatcttatgggttttgtttttaattctgtttatataatgtattacatttattgatttgcatatgttgaaccatccttgaattccaggaataaagcccacttcatcagggtgaataagtttttgatgtgctgctgcattcagtttgatagtattttttgaggacttttgtgtctatgttcatcagggatattggcctgtagttttttttgttttgtctttgccagactttggcaccaagatgatattgatttcatagaatgagtcagagaggagtctctcctcaatttttttggaattgtttcagtaggattgatagcagttcttctttgtacatcaggtaaaattggctgtgaatccatctcgtccagggcttgtgtttgttgtaggtatttttatcccttattcagttttattactcattattggtctgttcaggattttgatttcttccttgttcaatcttccaaagttgtgtgtttctagaaatttatccatttcctctagattttccagtttttgtgcatagaaatgttcacagtagtctctgaggatcttttgtatttctgtgggattggtcgtgatgttacctctgtcatttctaattgtgcttatttggatcttctctctatttcttttttaatgtagcaagcagtttatcaatctcatttatcctttcaaagaaccaactttgtatgttgctgaacctttgtataattttgggagtctcagtttcatttagttatgctctggtttcagttatttcatttcttccactagctttgggtttagtttgtttttgttctagttgctttaggtgtgaggttgggttgttaatttgagatctttatattgaggtgcttagcattgtaatctttcctcttaacactgcttttgctgcatcccagagattttggtatgttttgtctctgtcttcatttatttcaaagaatttttttttatttctgcctaaatcttgatgtttacccaaaagtcactcaggagaaagttgtttaattttcatgtatttatgtgaatttaagagatcttcttggtactgatttctatttttattccattgtatgcttagtataatttcaattgttttaaattcactgagacttgctttatgacagagaatgtggtcaatcttagagtatgttccatgtgcagatgacaacgtacatcttgaggttgttgggtggattattctgtagatgtctattagatacaactgatcaaatgtcaaatttaggtccatatttttttcattagttttctgcctcgataatctgtctaatgctgtcagcgagatgttgaagtcccccactattattggtggctgtcaatattttttcttaggtctaaaagtacttgatttttgaatctgggtgctccaatactgagtgcatgtatccttacaatagttaggtcttcttgttgaattgaacacattatcattatataatgcccttcttggtcctttttcttattgtttctgacttaaagactgttttatgtaatataagaatagtgatctctgctattttttgttttaaatttgtgtgatagatctttctccatccctttaccttatgagactatagcatttctggacctgccctgggcctgagggttgctcagtacactgaaaggtgaatcccaggcatggcagcattcaccacaagctgactgaagagcccttgggcctgaagataaaatcaatagaagcctggcagtaagtactccctaagggcctgttgtggtatagtccatatgatgaaacttctctgcctgtggaaaggggaggaaacaatgggaaggactgcatctcatgatttgagtgtcagataggccacactaaaatagaataccaggtaggttttttaagttttcgactctagtccctggtcctcgaacagcacctctggacccatgcagggccttgggaactcacctcactgaagggaaggatataaacttggatagcttcactagctgctaattgtagttgcagggccttgagcaaacataggtggtagcaaggtagtaattacagcagaccttgggcaagacacagtgctatgctggcttcaggtttgacccagcacagtcctagtgatggtgactgcagaggtttttgtgtcaccagaaccctagatccacgtagcttagagtggagagaaatcagctccatttgtttggaagaaagtaagggaagagatcaagagtctctgcctggtaatccagaaaagtcttttggatcttacccaagaccaccaaggtggtacctccatgaggctacaagaatcatagcattactaggcttggggtgccccctaatgtggatacaacttaaatcacaacactcaagttctttcaaacacctggaaagccttcctgagaatgacaggtacaaacaaggccagactgagaagactgcaataaataacaaacttttcagtgctgaagaaatctactagcatcaataccatctagaaaaacatgaccttaccaaatgaactaaataaggcactggaaaacaatcctggagaaagagatatgtgacctttcagacagagaattcaaaatcactgttttgaggaaactaaaagaaattcaagataacacagagaaggaattgataattttatcaaataaatgtcacaaagagatttgaaaaattaaaaaagaaccaaataaagattctggagatgaaaatgcaactgacacactgaagaacacatcagtcttttaatagcagaactgatcaagcagaagaaagcataagtgatcttgaatacaggctatttgaaaatacacagtcagatgagaaaaaattttaaaaaagaattaaaagaagaaagcctgcttgcaggatttagaaaatatctttaaaagagcaaatctaagagtcattgggcttaaagaggaggtagagaaaagatagagttacaaagtttattcaaatggataataacagagaattcccaaacctagagaaagataacaatatctaagtataaaaataaaataccaagcaggtttgaccaatagaagactaactcaagacatttaatagccaaactcccaaaggtcaaggataaaaaaaggactctaagaggagccaaaagaagaagaaggagaagaaagaagaagtaaaaaagaaagaaataacatataaggaattccaatatgtctagcagcagatttttcaatagaaaccttataggccaggagagaagcatgacatatttaatgctctgagggaacaaacttttaccctagaatactatctggtgaaaataaccttcaatcatgaaggagaaataaagacttacccagacaaacaaaagctgagggatttcatcaacactagacctgccatataaaaaatgctaaagggattacttcagtcagaaaaaaaagaatattaatgaacagtaaaaaatcatcagaaggtaccaaactcattgctaatagtaaggacacagaaaaacacagactattataacactgtaactgtagagtgtaaaccactcttacgtagaaagactagagtatgaaccaatcaaaaataactacagcaacttttcaagacatagacgatgcaataagacataaatagaaataacaaaaagttaaaaaggaagaaatggagttaaaatgtagagtttttattaattttctttttgtttgtttgtttatgcagagttaagttgttatcggcttataataatgggttttaagatactatttgcaagccttatgttaaccttaaatcaaaaaacataggatacataaaaaataaaaagcaaaaatcaaatcataccacccgacaaaatcatactcactgaaaggaagacatgcaagaaaaaaggaaaaaagagaagacctcaaaacaaccagaaaagaaatataatggtaagagtaagtccttacttgtcaataataacactagaaccgacaaattaagtaatgctgtaggatataaaatcaatatacaaaaatcagttgcatttctgtatgccaacagtgaacaaatcaaatcaggaaagttatcccatttacaataactacaaatacaatgaaatatctagattttttttttttacttttattttaagttcaggggtacatgtgcagtatgtgcgggtatgttacataggtaaacctgtgttggggggttggtcataaaaattatttcatcaccccggtgttaagcctaatactgattagttatttttcctgcttccctacttcctcccaccctccaccctctgataggccccggtgtgtattgttcccctctatgtgtctgtgtgttatcatcatttaggtcccacttataagtgagaacgtggggtatttggttttctgttcttgggttagtttgctaaggataacggtgtccagccccatccatgtcatgcaaaggacacgatctctttcttttttttatagctgcacagcatttcatggtgtatatgtaccacattttcttttctttttttcttttttttttttttttgaggcagagtctcgctctgtcgcccaggctggagtgcagaggtgcgatctcagctcactgcaagctccgcctcccgggttcacaccattctcctgcctcagcctcccaagtgggagtggctgggactacaggcgcccgccaccacgcccggctaattttttgtatttttagtagagacagggtttcactgtgttagccaggatggtctccatctcctgacctcgtgatccacccgcctcgacctcccaaagtgctggtattacaggcgtgagccacggcgcccggctcacattttctttatctagtctatcactgatgggcatttgggttgatgccatgtctttgctcttgtgaatagtgctacaatgaatatatgcttgtatgtgtctttataatagaaaaattacaatttatattcctttggatatatacccaataatgaggttgctgggtcaaattagttctctctttaggtctttgaggaatcaccacattgtcttccacaatggttaaactaatttacactcccaccaacaacatgaaagtattcttttttccccatgacttggccagcaactgttattttttgactttttaattatagccattctgactggtgttagatggtatctcattgtggttttgatttgcatttctctaatgattagtgatgctgagctttttttcataggtttgttggccacttgcatgtcttcttttgagaagtatctgttcatgtcctttgcccactttttaatggagttgttttttttttctcttgtaaatttgtttaacttctttatagatgctggatattagacctctgtcaaatgcatagtttgcaaatattttctttcattttgtagattatctgtttcttctgttgatagtttattttgctctgcagaagtgctttcatttaatcaggtcccacttgtcaatttttgtttctgttgtaattcctttggtgtcttaatcatgaaatatttgcccctgcttacgtcctgaattatattgccatagtgtcttcaaaggtttttatagttctgggttttacatttacgtctttaatccatcttgagttaatttttgtatgtggtttaagaagggatccagtttcatttttctgcatatggctagccagttattacagcatcatttattgaatagcgagtcctttcccccattgcttgttttcgtcaggtttgtcacagatcagatacttgtaggtatgtggccttatttctaggttctgtgttgtgttccattggtctatgtgtgtgttttcataccagtaccatgctgtcttggttactgaagccctgtagtataaaggcaggtagcgtgatgcctccagttttgttctttttacttagggttgccttggctttcgggttcttttcggttccacatgaattttaaaatagtgttttctagttctgtgaagaatgtcagtggtagtgtaatgggaacagcattgaatctataaattgctttgggtagtatggccattttaacaataatgattctttctatccatgagtatggaatgtttttccacttgtttgtgtcatctctgatttgagtggttggtttgtagtctcattgtagagaacttccacttctcttgttagctgtattactaggcattttattctttttatggcagttgtgattggaagttcattcgtgatttggctcttggcttgactgtttttagcatataagaatgagaatgctagtgacttttgcacattgattttgtatcctgagactttcctgaagttatcagtttaagaagcttttggactgagatggagttttctagatataggatcatgtcatctgcaaacaaaaatagtttgacttcttcttttcctatttgaataccctttatttctttctctttctaattgctctggccagaacttctaatactttgttgaataggagtggtgagagagggcatccttgtcttatgctagttttcaaaggaattgcttccagcttctgcccattcagtatggtgttggccgtgggttggtcattgatggctcttactattttgcggtgtgtgatttcaatacctagtttattgagagtttttaacataaagagatgtgaaattttatcaaaaggcttttctgcatctattgagatacttatgtggtttttgtctttagttctatttgtgtgatgaatcatgtttactgatttgtgtctgttgacccaatcttgcatcctggggaggaagcctactagatcgtgatggataagctttttgatgtactgctgtactcggtttgccagtattttgttgaagatttttgcatttatattcatcaaggaaattggcctgaagttttctgtttttgttgtatctctgccaggttttggtatcaggatgatgctggcctcatagaatgagttagggaggagtcagtccttccttttcgattttttgaaatagtttcagtaggaatagtaccagctctttgtttgtacatctggtagaaatcagctgtgaatccatctggtcctgggtaggtaggaccaggtttattggttggtaggctcttcattactgcctcagagctcattattgggctgatcggaaattcagtttcttcctggttcagtcatgcgagggtgtaagtgcccagggatttatccattttttttctagattatctagtttatgtgtccataggggtttataatattcctgtttatatttctgtggggtcagtggtaatatcccctttgtcatttttaattgtttttatataaatcttctcccttttcttctttattagtctagctagcagtctatctactttattttttttttaaaccatttctggattctttgatgttttgaatggtttatcatgtccctatctcctttagttcagttccgattttggttatttcctgttctctgctagcttcgagatttgtttgccattggttctctagttcttctagttgtgatattaggttgttgagatcttcctagctttttgatgtgagcatttagtgctataaatcatcctctcaaaactgcctgagctatgtcccagagattgtggtatgttgtatctttgttctcattattttcaaagaacttcttgatttctattttaatttcattatttacccaaaagtcattcaggagcaggttattcaatttccatgtaattgtatggttttgagtgaatttcttagtcttgacttctcatttgattgtgctgtggtctgagagaatgttatgatttcagttattttatgtttggtgaagagtgttttatttctgattatgtgatcaattttagagtaagtgccatgtggaaatgagaagaatgtatattctgttatttctggatggagagttccgtagatatctgatgcatttgatccagagctgctttcaggtcttgaatatctttgttaattttctgtcttgatgatgtctaatattgtcagtgagatgttaaagtctcccactattattgtgcaggggtctaaatctctttgaggatcttaaccaaagaagtaaataatcttggcaataaaaactataaaacatttatgcaagacactgaacaagacaccaaaaaatagaaaattattccctgttcatggattggaagaattaatatagctaaaatgtccatactacccaaagcaatctacaaattgaatgcaatccctctcaaaataccaatgaaattattcacagaaacataaaaaaattcctaaattcatatagaatgatacaagacccagaatagccaataagtggtgctgggaaacatggatatccatatggaaaagaagaaaattaaacccctatctctcaccacatacaaaaatcaaatcaaagtggattaaagacttaaatctaccttaaactataaaactactacaaaacacattgaggaacctctccaggacatagaactgggcaaaggtttcttgagtaacgctccgcaagcacaggcaaccaaagtaaacatggcccaatgaaatcccatcatgttaaaaaaaaaagaaacttatgcacagtataggaaacaatcaagtgaagagacaacccatagaatggcagaaaatatttgcaaactatgcatctgacaaggaattaataaacagaatatataaagagctcaaacaactatataggaaaatatctaataatctgatataaaaatgggtaaagatctgaatatacatctctcaaaagaagacatacaaatggcaaatgggtataaaaaggtgctcaacattattgatcatcagagaaatgcaaatcaaaactgcaatgagatatcatattattacatttaaaatggcttttccaagagtcaggcaataacaaatgcaagtgaggatgtggaagaaagagatccctcatacactgtttgtgggaatgtaaattagtacaaccactgagaaaaaacggtttggaagttcttcagaaactacagatagagctatgttatgatccagcaatccctctcctaggtatatattcaaaagttgggaaatcaacatactgaagagatatctgaactcccatgtttatttcagcactattgtcaataggcaatatttgggagcaacctaagcatccatcaacagaaaaatggataaagaaaatgtggtacatatacacaatggagtactattcagccgtaaaaaaagaatgagatcttttcatttgtaacaacatggatgtaactggagatcattatgttaagtgaaattagccagccacagaaagacaaaattcacatgttctcccttatttgtgggatctgaaaatttaaacaattgaactcatggagacagagagtagaaggatgattatcagaggctggaaagggcagggcggtacagggatggggtggggttgattggtacaaataattagaaagaataaataaggcctactatttgatagcataacagagtgactatagtcaataataatttaattgtacatttaaagataacaaaaagagtataatgggatagttagtaacacaaaggataaaagcttgaggggataaatatctcattcttcatgatgtgattgttacacattgcaggccagtatcaaaacatctcatttaattcataaatatatatatacactatgtacccacaaaagttaaaaacttttaaaaatctttataaatgtaaaagaaaaaagcagaaaatgtggtacatatacatggtggagtaccattcagcctttaaaaagaatgagatccactgttggtgggactgtaaactagttcaaccattggggaagtcagtgtggcgattcctcagggatctagaactagaaataccatttgacccagccatcccattactgggtatatacccaaaggattataaatcatgctgctataaagacacatgcacacgtatgtttaatgtggcactattcacaatagcaaagacttggaaccaacccaaatgtccaacaatgatagactggattaagaaaatatggcatatatacaccatggaatactatgcagccataaaaaatgatgagttcatgtcctttgtaggaacatggatgaagctggaaatcatcattctcagcaaactatcgcaaggacaaaaaaccaaacaccgcatgttctcactcataggtgggaattgaacaatgagaacacatggacactggaaggggaacatcacacaccggggtctgttgtggggtggggggaggggggagggatagcattaggagatatacctaatgttaaatgatgagttaatgggtgcagcacaccaacatggcacatgtatacatatgtaactaacctgcacattgtgcacatgtaccctaaaacttaaagtataataataataataaaaagaaacaggtgaaattaaaaaaaaaaagaatgagatcctgtcatttagaacatggatagtattggaggtgattatgttaagtgaaataagctaagcacagaaagacaaactttgcatgttctcacctatttgtgagaactaaaaattaaaacagttgatctcaggagacagaggatagaaggatagttaccacaggctgggaagggtagtggagggttgcaggggatgtagagagccttaatgggtacaaactaatagaaaaaatgaagaatacctaatatttgctagcataacagggtgactatagtaaaaagtcatttcattgtgcatttttaaataattagaaaagtataattggattgcttgtaacacaaagcataagtgcttgaggagataaatacccccatttaccctgatgtgaagatgctattagagatgctcaaagctgacaattgctttggaaggagtctgtggagtgagtcccacctcttctcacactgcttcaatttgtcagaccccagagtctgtctatgcactcagaaatcagatagcaaatcaaagtattcatgtactctttttcaaatatgtacaaaatttactctcaattacctttacggaaatacagagaatcttcacctattttccaaaggtaatctcagaaagatgtcatcatatgtattgttcttttaaaataataaccatcaacaacttaataagttcacctatcattagaaccagtacctagcatacagctggttaaacacacccaaccctctgatgtcattccacaaagaatcttaaaaactcagtcatagggagaaagcccatctcagttaatgaaccccaacccatcaaaatccctcaacctgctatggcatgttccgtataagaccttgtggtccttagctctcctcatccagttttcaatgtttcctgcccatcctcctcaaattggtgacctattcaggcctctctctctggttcatttccctcactacctatttcactcttggttatgcattctcctgtgatttcagcatcacttttcactttaagtaacaggaaatcccattgtcccatctctagaaaaacgtcggcgtaagtaatcattcctcacatgatgcaaacaagttctgaaaatctaatgaaaaaatttacattcctcttacatgcaaccaaaaatgggacaaacacccttagaacaaaactgctagccccatgtctgtgtctgaagttaagaaatagagcaaaaggttagtatgaataattttctctccattgtgagcaatagttgctataattcaagctatgacataactataaaagaaatgcatacctcgtcctccaaatagctataaatgttagaaaatatattagtcaatatgttagtcaaatgtgatcaaagatgttccactcagcatagtacctctcaaaacagaaaaataattaaatgttcaaaaataagctggtgtggggtggggaaggtgaagtacaacgaagatttgtggaaatgttagtattattatgctatgctcattatgctattgagttttactcagattatttcatccaactcataacaaccctgagaagttaaaaaagtttaagtaacatgcaacagctaacatttacagtatacttccaatatacctgatattgtgctaaatgttctacaggcactatcttattttatcctcatgacaactatatgaggtaggtgtctgagaagttttgctctgtgtccccacccaaatctcactttgaattgtaattctcataatccccacatgtcaagaacaggaacaggtggaggtaattgaatcatgggggcagtttcccccatgctgttctcctcagacagacaagacaagctagtgagtgagttctcaggagatttggtggttttatatgtgtctggcatttcccctgcttgctctcactccgtcctgctgccctgtgaagaaggtacctgcctctcctttgccttccaccatgattatgtttcctgaggcctcaccagcaatgcagaaactgtgagtcaattaaacctcttccctttataaattacccagtgttgagtatttcttcatggcagtgtgagaatgaactaatacagtgccattatcatcttattttaaaaatgaaaaacctatggtctagaaaagtaactgtttcagtggcatcaggcagctagtaaactgtacagacagggtttgaaccctgatattctgagtaccgaccccatgatcatgatcatgtaattaaaggataggtttcaacaactaaatgaaggcaaagatatcagggataattgaaaccaagtgctccaatacgtaaacattagattatttgtgtttttataaatgaagaaacctaaattgaaattaaacttctgtaaacctccacagcaggaattgttattttcaaatatctgaaatattatcttatgtttactttgttgaattttaaaatttttgttatgaaatatttaggtgtactgaatacccagatttaatccatgttaatattttgccagcttctaatctttaaaaagaaataaaaattgtaaagtttttcgtataatcacctctccccagaaaaccattcttttcctttctatccctgtgataactaatgccctgcagttgttatatattctttgtccacatatttttgtattttatcatgtatgacttttgtatattaatctagtatccaacagtcttgtatgattcattctaatagttattctgtggctttctcttgaatttttttattaatttttaatttttgtggatatatagtagttgtagataattacgggataatgagacattttgatgtaagtttacaatgcataataatcacatcagggtaagtgggttatccatcacctcaagcatttatcctttctttgttttagaaacaatccaatgatactcttttagttatttcaatacacacaattaaattattgactgtactcatcctgtagtgctatcaaataccatatcttattcattttatattactatatttttgcacacattaactgtccccacatcccacccctcccactatccttcttttcctgtggttatcttctgtctactctccatctccatgagttaaattgttttaatttttagcttccacaaataagtgagaacatgcaaactttgtctttctgtgtttggcttatttcacctccagttccatctatgttgttgcaaatgacaggatctcattcttttttatggctgaattgtaccccattgtgtatatgcatcacgttttctttatccattcatctgttgatggatgcatatgttgcttccaaatcttggctgcgtgaatagtgctgcaataaacacagacttgcagatatatttttgatatactgatttcctatcttttcggtatatatctagtagtggaattgctggatcataaggtagctctatttttagttttttgaggaacttctaagctgttctctatagtgtgtactaatttacattcccaccaacagtgtatgagggctcccccttctccacatcctcgctttcatttgttattgcctgacttggataaaagccattttaactggagtaagatgatatctcattgtagttctgacttgcatttccctaatgatcaatgatgttgagcctcatttcatacacctgtttgccatttatatgttttcttttgagagatgcctattcagatcttttgcttatttttttaaatcagattattagatttttttccagtatagttgttttccctgcttatatattctggttattaatcccctgtcagatgaatagtttgcacatattttctcccattctgtggtttccctctccactttcttgattgtttcttttgctgtgcagaagctttttacattgatgtgatccaatttgtccatttttactttgggttgtctgtgcttgtggggtattactcaagaaatctttgcccagtccaatggcctggagagtttcttcaatgttccttgtagcaattttatagtttgaatcttagctttaaatttttaatccattttgaattgatttttatatggcaagagataaaggtctaattttattcttctacatatggatatacagttttcccagcagcatttattgaagagattgtcctttccccagtgtatgcctttgttaaaatgtgttcactatagatgtatggatttgtttctgggttctctattcttttctatcggtttatgtgtctatttttatgccagtagcatgctgttttggtcactatagctttgtagtataattttctcttggattttctatgtaggaaatcatcatctggaaataagaaataattttgtttctatttccaaatacttacatgtcttaattctcttccctgtattatgtgttctggctaaaacctcacgtgtaatgtcaaatagaggtagtggcagcaggcatctttgcctcttctttttctttaagagaaatgtttctaaagttttgacaacaatttgtggttttaataggcaatcattatctagtttagattaattctctttgattcctgaattttcaggagatttaatcatggttattgaattttatcttgttttttcattcatctattgagatgaacatattgattttgctacttaaatctgttaatgttgtaacttattttaaattaaacagtaattaatgtatctttgaagtttttagataaatcctacttctcagtaattaaattttctgcatattgctgtttttttcctacatattgctggattttggttgtaaatatttaagttggatttttcatcaatattcataaaatttctttctataaattgtatttctagtgtcatcttttcctggttttgctatcaaagtttgctagcctctttaaatgcttgtttatttttgttttaacttacagacatacttctctcaaatgtcagagaacataaaagccaacaagtccaaatttgtatatcttggagttattcacttttttcttagtttccatctgaaaaatcccaaggaataattctgatttgctttgcaaaccacatggttggagtttggaagtgggggcatttctaagaggaaaaaaatggattctggggagatagtgctgtagttgtgcattacatacttcttgcaagtttattttaacatgctataactggaaagaaaacacaataaaaacaaaaactcaattaaagaaaatatgaaaggggttttaagttaagcttaacttcctcctacctgtgtaattttggatcaattatatcacctctctgtactcccctttcctcagctagaagaaagaaagaaaaaatatctaccttagagataggtaaagtttaattagtttgcctatgagcttcttaaatatacataccatgtctctattctcagtactccacacaaagtagaagctcagtgatagttgaatgaatgacctaatgtacagttcatttaatgcaccctcccttgtgtctaatgcagtactggtacataatcagagtttaatatttactctgttttacaatcccaaagggcacacagtaacattagcttcaactgctttacaagtacctcccacatcagattgttttaggcctttcctgcagataaatctatcctaattataaccaaagttctgaaagtgaataggtcacccttctagcctacccatattaaagtaccaaatggtgcaaagggagagtactagggagaaaataagagtttgttttaaaatgcgtatcttctccccctcctcaaaagaaagaaaaaaatggcataagactttaagcacctagaaagctgcattgactttgaaatgccacatttgaccttagttcttgacacataaaaagtttaagtcatttatcttttccaaaaggaattaccatgattcaaaaattactcaggagactgtgggtatatgcaaagaactagatggaagccaaagtttaatgaaatactggtgaaaccttctcagaaaaggctggcttaatcaagttagttgactctcttgttaaagtaaatttgctacaacagcagcagctgccatttatctgagcaacttatatgtgggacagtcaggattaaaattcagatctgtctgatgtcaaagctcatgttctttccaaaatgcaatatagtagtctcctcttatcttcagggaatatgttccaaaacccccagtggatgcctgaaaccacagacagtagaaaaccctgtatatattatgttttcccaatacatacatatctttcataaagtttaaattataaattaggcacagtttgagattaacagcaataactaataataaaatagaataattataataaactgtaatgaaagtgatgtgaatgtggtctctctctctccctcaaaatactttattgtactgctctcacatttcttgttatgatgtgagatgatacatgcctacctaatgagattaggtgaggtaagtggcataggcattatgacataacattaggctattattgaccttctgataacatgtcagaaggaggatcatctgctttgggtgatcctggatcatagagccatagcaatattgatggttgaatgtttggagcagacaatgtcaatgattaacagacaggttgtgtatatagtgtgaatatgctggaaaaatgggctgattgatgttctgggcaggacagatgaggggcagctattcagaacagcttgaaatttaaaacttatgaattgtttacttttgaaattttccacttaatatttctaaaccccacttgactgtgggtaactgaaactgtgaaaagcaaaactgttgataaggggggactactgtattgctttctaatcaaaacagttccgaaattcaccaaaggactttattgtgattgcatctgtgttcctttttaccacatataggtttggtcactgtattaataggactatcagatttcaagaccatatttgtatgagtgataagtgggtagaatatggaagcttccccatgtaagtacagctattaagacaggccttcatccctcatgggatccaggagcttttcatctctatttcccggccaattagttatgaatgaactgtggaaagaaacagcagagccctggtgtcatggaaggttagaagagcagataacctttactgagcactgtattagtctgttctcatgctgctaataaagacatacccaagactgggtaattgataaaggaaagaggtttaaatgactcacaattgagcatgactgggtaggcctcaggaaactcacaatcatggtggaaggggaagcaaacatgtccttcttcacatggcagcagcaagaagaagtgccaagcaaaagagaaaaagccccttataacaccatccgatctcatgagaactcactattaggagaacagcatggaggtaactgtccccatgattaaattgcctcccactgggtccttcccatgacacatggggattatggaaactacaattcaggatgagatttgggtggggacacaggcaaacaatatcaagcacttactaagtatcaggctttatactaagcactttgtatatgttaatgcttactacaattccttgaaatagttattataatacttagaatatggagccagggttctgtcagaaacaagagcagataatttttattgagcacttactaagcaacaggctttatactaaaaactaaaaactttatatacattaatgttcactgcaattctttgaagtagttattattacaatatttataatgtatagccaggattctgccagaaagtgccatttcactgacatctgaaagatgagtgggacaacagacaaaaggtatgtttacaggagtagtgagaaagcttttcaggtagaaggaacaacatacacaattccccaagtcaaaaggcagcaggacacattccaggaagtaagaaggccagggtaacaggaacccaagagaaggagagaaccatgtgagaggaaactgaaatgtgggctggggtcccttctcataagaacttgtagtcaaaccaatgtgcttcccaaatcttagtcactgggacatgtcttcatgagttttgaattgtttttgtatcattttgacaaaaaataaatcctattttttaaaattaaataaattgttctctctagtaagtaaatagagtttatttagaaagtgttaggctgccatatctcttttttaaagatccaaggaaaggggtttgtatacatgctaccactggcattttaaaaggtgtgggagtaacaacatccctctgatggcagcaaagatcagaggaagggactggaaaggtaaagataagactttcgaaaacagggtcaccagtctagccctgctcccttccctctagagcttactctgttctaacctcagttcttacaggacagtttagggtatattttaattaagggagttaattttctcataacccttacccagtcttaacaattaaattcactgaagcccacattaaacccccagtggtaagaaacacaatagggtatatgagctatgacttttgactctgtgggtctgttcttggcttcatcattaatatggtgaatatctttgccttgagtttttttttttattatactttaagttttagggtacatgtgcacaatgtgcaggttagttacatatgtatacatgtgacatgctggtgcgctgcacccactaactcgtcatctagcattaggtatatctcccaatgctatccctcccctctccccgcaccccacaacgtccccagagtgtgatgttccccttcctatgtccatgtgttctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctaatactgttagacatttgggttggttccaagtctttgctattgtgaataatgccgccataaacatacgtgtgcatgtgtctttatagcagcatgatttatagtcctttgggtatatacccagtaatgagatggctgggtcaaatggtatttctagttctagatccctgaggaatcgccacactgacttccccaatggttgaactagtttacagtcccaccaacagtgtaaaagtgttcctatttctccacatcctctccagcacctgtttcctgacttttagtacaattttaatatactttaattgtcattttttgtggtatgaattgtcttattaaaatataatttttaagcagttaaatttatttacttaattagagttctattgtctcctcaatatccacattctcagaagccaattacatctgcaaatgggaggaatatggagatggagagaatatacgttttagtacactaacgtctaattataggattgcattggtgcacatggtacctggaatcatataaaattttatctaacaaaaagaaatcctgtgctgatctttcaacactaatatcttacaactagcttgtccaacctgtggcccgtgggccgcatgtggctcacagtggccctgaatgtggcccaatacaaatttgtaaactttcttaaaacattatgagttttttgctatttttcttatagctcatcagctcttgttagtgttagcatattgtatgtgtggcccaagacaattatccttccaacatggcccagggaatccaaaagattagacagccctgtcttaaagcatgaatgttagcacagaccatgttcgtctctgcctcatgtgtggatttttgatttcagaaggaacaaaaaaaaaaaccaggtttggagaacctgatgtgactattttgattagtgataaagtataaaaatttccagaaataacaataacaatagtaaaaatcatgacaacaatgtacaataataggggtcttaatggtttttaaatgcttttcatataaactttttccttttatcttcacattgatttaaaaaaaggggaggtattattagtacttcataaataaagaaattaaggatcaaaaatgttcacattttggggagtaagttggaatgcccacaaggaatcagaggcaaatctgatcagactacttttcctgaactttcccattagaaaaactatgagatcttgggaagccattggaattctctatccttaatttattcatctgtaaaatggtctacattatagggtatggacatagagggatagaaaaagacactgaatttcactggagggaagaattagtgtggataaaacagggcctgtgcctcccacagacacctgtacacaggataaagactgcaggcaaggccaagactcagaagattgaatgggctattccaatgagatccttaagatatatcacaaagaaggcagtgtggtggagcacaaaattacaagcatacacatcaaactaagtcagtcctaagagattactagctctgctacttggcagccatttaaaatggagtcttttttttcaattatttattttaattggcaaaaatattgtatacaattatcatgcataatatgattttttgaaatatgtatacattgtggaatggctaaagtgagctaattaacatacaaagcctcacgtacttatttttgtggtgagaacacttaaaatctactcagtgattttaaagaatacaatacattgttattaacaatagtcaccatgttgcacaataaatctcttgaatttattcctcctaaccgaaattttgtatcctttcaccaacatctcacccaccccaccccaccccacccaagcccctagtaaccactatactaaccttcacttctatgagttgaattttttttagattccacatagaagtaatattatgcagtatttgtctttctgtgcctgtattatttcacttagcattatgtcctcaaggtccatccatcttgtcacaaatgacaggatttccttttttaaggctgaatagtattccattgtgtatgtataccacattttctttattcattcatcggctgatagatacttatgttgattctatatcttgaatattgtgaaaaatgctgcagtaaatatgggagtgcagatatctccccaacatgttgatttcatttcctttggatatatacccagtagttggattgctggatcatatagtaattctagttttaattttttgagaaacattcttactgttttcaataatggccatactatcatacattcccaccaacagtatgcaaatgttcccttttctccatatcatggttgccaccacctgtcatcttttgtctttgtggtaatagtcactccaacaggtgtaaggtgatatttcattgtggttttaatatgcatgtccccaatttttagtgaggttgaacattttttatatgcctgttggccatttgtatgtcttcttttgagaaatgtctaatagtacctttgcccatttttaaaaatagggttatttgttttcttgctattgagttccttacatattttgaatattaaccccttatcagatgtaaaggttgaagatattttctcccattccataggttgtctcttcactttattgattgttttctttgcagtgctgaagcttttaattttgacgtaattacatttgtttattttcaattttgatgcctgtgttttggggtcatatccaaaaaatccttgcccagacatggagccagtcataaaaccagtgtcatgaagcttttcccctatattttcttctagcagctttaaaatttcaagtcgtatatttaagtttctaattcattttgagtttatttttgtacatgatgtgagataaagtctattttcattcttctatatgtggatatccagttttcccaataccatttattgaagagactgtcctttactcactgtgtgttttgggcacgttcgttgaaaataaattgaccatagatatgtgggtttatttctgggttcactctctattttcttggtcaatgtgtctatttccatgccagtgccatgctgttttcattactataacacattttaaaatcatgtagtgtgatgcccccagctgttctttttgctcaaggttgttttggctatttcaagtcttctgtagtcccacatgaattttaaaatttgttttttcaatttctgtgtaaaatgtcattagaatttttatataaactacattgaatctgcttttcatctggggtaatatggacatttttaacaatattccaatttatgaacacggtatgtcttaccatctatttgtattttcctcaatttcttttgtcagtgttttgtaattttcagtgtacaggcctttcatttccttggttaaatttattcttaagtatttcattttcttttttgtagatgttgtaaaagagattgtttcttgatttattttttggatagttcattagtaagtgtgtagaaactactgataattgcatattgacgttgtatcctgcaactctactgaatttgtttatcagacctcacagttttttgttagactctttatcatgtttgtagactgtgttatctacacacaaaaacaatttagcttctccctttcctatatgaatgtcctttatttctttctcttgcctaattgcttggacttccagtactatgttgaatagaagaggcaagagtgagattatgcagtatttgtctttctgtgcctggattatttcacttagcataatgtcctccaggtccatccaggttgtcacaaattacagaattatctttttaaaggctaatataatattccgttgtgtatatatactacagagttggaggacattttgctaagtgaaataatccaggcacagggaaaaaaaatactgcataatctgactcctatgtgtaatgttgttcctgttcttagaaaaaaaaagctttcaattattcagggttgagcatgatgatagaggtgcattggtcatatatggcctttactgtattgaagtacattcctcttatacctaacttgttgatggtgtttatcatgaaaatacattgaactttgtcagatgccttttcttcaactactatccttcattcagttaatgtggtattgttgtacatcacgtttatacatttaaattatgttgaaccatccttacattccagggataaatcctacttgatcatgggtaatgataactttcatgtgctattgaatttaggttgctaacattttgttgaaaatttttacacctatgttcatcgaggatattggcctctaattttcttctctgacagtgtccttgtatggctttggtttcagggttgtcctggccttgtaaaatgagtatggaactattccctcttcttcaattttttgggagtccttaaaaaattgatattaattcttctttaaatgtggtagaatcagcaataagaccatcaagagatgggttttcttttatgggacactttctattactccttcaatctcctttctcaacatttgtgtgttcagattttctatttcttcatgattcattcttggtaggttttatgtgtcttaagaatttatccatttctcctaagttatccaatttgttggtatataattacaaataaaatccttttattattattattatttcaatagtttttggggaacaagtggtgtatggttacaagaataagttccttaatggtgatttctaaaatgttggtgcacccaccacccaagaagtgtacgtggcacccaaagtgaagtcttttatcactcacccccttccagcctccccccaagtccccagagtccattacatcattcttatgcttttgtttcctcataccttagttcccacttataagtgagaacatatgatatctggttttccattatttagttacttcacttagaataatggtctccaattccatacaagttgttgtgaatgccatcattttgttccttttcatggctgaatggtattcatatatatatatatatatatacacacatatgcacatatcacatttttttatccttgtttgttgatgggcatttaggctggttacatattttggcaattgagaattgtgctgctgtaaacatgcatgtgcaagtgtctatcatatagtgactcctctgggtaggtaacccagtagtgggattgctggatgaaatggtagatctacttttcattctttaaagaatccccacactgttttccatactgattgtactagtttacattcccaatggcaatgtaaaagtgttcccttttcaccacatccacgtcaacatctattattttttgattttttaaattatggctatgtttgcaggagtaacttggtattgcattgtggttttaattagcattttcctgattattagtgatggtgagcattttttcatatgtttgttagccatttgtatatcttcttttgagaattgtctattcatgtccttagcccactttttgatgggattatttgttttcttcttgctgatttgtttgagttccttgtagattctggatattagtcctttgttggatgcatagtttgcaaacattttctgccactctgtgggttgtctttactctgctgattatttattttgctgtgcagaagctttttatttttagtttaattaggtcccatctatttatcttttttttttttgcatttgcttttgggtttttgttcatgaactctgcctaagccaatgtcaagaagaatttttctgatgttatcttctagaatttttatagtttcacatcttagatttaagtttttgactcaccttgagttggtttttgtataaggtgagagacgaggatcaacttttattcttctacacgtgtcttgacaattatcctagaaccctttgttgaatagaatgtcctttccccactttatgtttttattcactttgtcaaagatcagttgactataagtatttgttttatttctgggttctctattctgttccattggtctatatgcctgtttttataccagtaccatgctgttttggtaactattgccttgaggtatagtttgaagtagaataatgtgatgccaccagatttgttctttttgcttagtcttcctttggaaaagcgggctgtttttaattccatatgaattttaggattcagttatctagttctgtaaaaatgatgatggtattttgatgaaaggtgcactgaatttgcacactgcttttgccagtatgatcattttcacaatattaattctatccatccacgagcatgaaatgtatttgtttgtatagtctataatttctttcagcagtgttttgtagttttccttgtagagatctttcaccttcttgattaggtatattgctaagtgtattttttgtttttgtttttgttttatgtcatggttctaaaaggggttgagttcttcatttgattctcaacttggtcactgttggggtatagcagtgttactgattttgcagcagcaaactctttcaatgagttctttcaaatgatctctgaatccttttggttttcctggtatgttcctgaaagaattatggttttactccaaaagaatttcctttgctctggctggtggttattggagtgaaggctcacaaggtgagtctccacacgctgttctgtccatccaagttggagctacacgttagtcctgtctcctatctgccatcttcctcctgccaataacagtcttttgtgatcctctgcatttctgtggtatcagtggtaatgtcttttctttcatttataattttatttgagtcttctccctttttttcttagtctacctgaagatttgtccatttttatttatcttttcaaaaaaccaactcagtttcattgatttattattttttctagtctgtgtttcacttatttatatttttatctttattatttccttccttttctagttccttgaggtgtaatattaggtgtttatttgagatttttcttattttttaatgtagaattttattactataaacttctctcagaactgcttttgctacattcccataaattttgatatgttgagttttcatttttatttgtctcaagatatagtttaatgtctcttttaatttctttattgaatcattgcttgttaagcagcatattgtttattttccatgtatttgtcaattttccaaaatttctcctgttattgacatccagtttcataccattgtggtcagaaaagatacttgacataatttcaatcttcttaaatttgttaagacttgttttgtaacctcacatattatatatcctgaagaatattttgtgtcattttgagaagaatatgtgttctgctgctgttgggtgggatgttctctttacatctgtgtaatggttaatattagctgtcaacttgattggattgaaggaagcaaagtttctagttgtgtctgtgagggtgttggcctttggccacagactggaggctgcactgttggctttcctacttttgaggttttgggacttggactggcttcctttctcctcagcttgcagagagtctattgtggtagttcacattgtgattgtgtgagtcagtactccttaataaactcctcttcatatattcatctatcctattagttctgcccttctagagaaccctcacaaatacagattttgctaccagaagtggggtgctgctgtaaagatatctgaaaatgtggaagtgattttggaactcaaaaacaggcagaagttgaaagagtttggagggctcagaagacaaaaaattgggggaaattttgaaacttcctagagacttggagggctaagaagaaaaaatgatgtggaaaagtttggaacttcctagagaattgttgaatggttttaatgaaaatgctgatagaaatatggacaatgaagtccagactgatgtggattcaggtggagatgaggaagtaattgggaagaggaataaaggtgactcttgctatgctttagtaaagagactgatggtattttacccctgccctagagaatctgtggaactttgaacttaggagagatgatttaggatatctggtggaagaaatttctaagcagcaaagcactcaagaggtgacagagcataaaaatttggaaaatttgcagcctgacaatgctattgaaaataaaaaccattttctggagtgaaattcaagctggctgcagaaatttgcatgagtaatgatgagccaaatattaatcagcaagacaatgggaaaaatgcttccagggcatgtcacagaccttcctgagggcccctaccatcacagacccaggggccaaggagggaaaaaatggtgtcttgggctggttccagggcccctttgctgtgtgcagccttgggacttggtgccctgtgtcccagccactccagccatggctaaaggaggccaaggtacagtccaggctgtatcttcagagggtacaagcccccagccttagtaacttccatgtggtgtttttcctgtgggtccacagaatacaagaactgaggtttgggaaccttcacctagatttcagaggatgtatgcaaacacctggatgtccaggcaaaggtgtgcttcaggggcagagccctcatgaagaactactgctagggcagtgcagaagggaaatatggggttggagcccccacacagagtcctcaatggggcactgcctagtggaactgtgagaaggtggccactgtcctctggaccccacaatggtagatccattgacagcttgctctgtgcacctggaaaagccacaggtactcaacaccagtctgtgaaagcagccaggatggatgctgtaccctgcaaagccacaggggcagagctgcccaaagctgtgggagcccacctcttgaatcaggtgacctggatgtgagacatggagtcaaagaagatcattttggagctttaaggtttacttactgccctattgtattttggacttgcatggggcctatggcccttttgtttaggccaatttctctcatttggagtgggtatatttacctaatgcctgtacccccattgtacttaggaagtacctaatttgcttttggtggctcataattggaagggacttaccttgtctcagatgagactttggacttggacttttggtttaatgctggaatgcatgaagactttggtagactgttggaaaggcatgattgtgttttgaaacatgaggacatgagatttgggaagggctgggacaaaatgatatgatttgtctgtgtccccactcaaagtctcattacaaatgaattgtaattctcataatccccacaaatcaagggtgggacaaggtggagataattgaattatgggggcggtttcccccatgctgttctggtgatagtgagtgtgtctcatgagagctgatagttttataatcattggcatctctcctgcttgcactcacttcgtcctttcaccctatgtagaaggagccttcttcttcgccttctgccatgattgtaagttttctgaggcctccccagtaatgcagaactgtgagtcaattaaacctctttcctttctaaattacccagtctcagaggtatttctccacagcagtgtgagaatggactaatagtctgttacacacatttgatcttaagtatagttttattccaatgttttcatattaattttttctctggatgatgatttgtccactgctgaaagtgtgatcaatttatatctcccttcagatctagtaatatttgctatatttatttagatgctccaattttggggtgcatatatatttacaattgttatattcacttgatgagtttacccctctctcattacataatgtcttctttgtctatttttatagttttgaacttaaagtctattttatatgattaaaaatacagctacccttactctcttttggtttccatttgcatggcatatcttttttcatcccttcactttcagtgtatctgtgtccttaatgtgaggtgaatctcttataggcagaatatacttgggtcttgctttcatttatctattccagcatgctatggcttttgattggagaatctaatccatttacattcaaggtaattattgataggtaaggacttactaccaccatttttgttgttttattattattattttttagatcctttgtttctttatttctctcttactgtcttccctgtgattaaatgattttctgtagtggtatgctttgattctttgcttttttatcttttgtgtacctactataggtttttgctttctggttactatgaggcttacataaaatgttatacagtaataacaggctattttaggctgataatttaactctagtcacatgaaataactacactttcactccaactcccattttatgtttttgatttcacactttacatctttttataatatatatcccttaaaaagtattgtagctattgtttttactagttttgtcttttaaccttaatcctaaagatataagtgacttagaaaccactattacagtattttagtattctgaatttgattgtgaagttactttaaccagtgagttttatattctcatatgtttttgtgtcactaattagtgtcttttttttttcaactttaagaactccctttagcatttcttacaagtctggtgacagtgaactccctcagctgttgtttgtctaggaaagtgtttatctctctttcatttctgaaggatagctttgtcaggttcattagttttagctgtcaggtttttttgtccttcagacctttgaatatatcatcctactcttttctggtatgtagagtttctgcctctagcattactggaactcccttccctggaactctcttccatgtgatttgcttcttttctcttgctgttttcaggattctcttttgtctttgatttttcacagtctgatttaatatgtcttgatgtagtcttgtttggattgagtctgcttgtagacttttttcttttctgtatctggatatatatacatctttccctggatttggaatattttctgttattatttctttaaataagctttctatcctttagtctctctcttcttaattcctataccatgtacatttgctctgttgaagctgttctataattcccgtaaactttcctttttcttttttctcctctatatattttcaaataatctgtcttcaggtttacagattcttctaattgatcatttctggtgttgatactctctattgcatttttcatttcactcattgtatttttcaattgatcctcatttccttatctaaaaattgggataatattgtatctctctcagggaaacaataagaaaaagctgatttagtgtatgtgtaacatctattagaggggtcagcgaactttttgtataaagggctatatagcacatattttaagctttctgggctaggcagcaaaccaaggatgttatttaggtactgatataacaagaaagaaaaaaattttacaaaaatttttcacaaaatcttttacacaaatttttattagaaaaatgtaacatataataatagcaaattaacttttgtttttgttaatacatgttgatatggtttggctatgtccccacctgagcctcatcttgaattgtagctcttgtaattcccacatgttgtgggagggacccagtgggcggtacttgaatcatgggggtgggtctttcttgtgctgttctcatgatagtgaatcagtctcatgagatctgttggttttataaaggggagttcccctgaatatgctctttttgcctaccagtatgtaagacatgactttactcctcctttgccttctgccatgattctgaggcatccacagccatgtggaactgagtcaattaaacctcttttctttataaattacccagtcttgggtatgtctttattacctgtgtaagagtggactaatacacatttctagtaattaaaagaatggaatatggtgggaaataatagtttacttaattggggaatcaaagtcaatgttgcctatcagcaaattggttgcaaagcccatctataaaaacatttttattcacaggccatacaaaaacagataagctgggctggacctgagggctatagtgtgccaatctctggtgtatttcattgatggttcccaatgaaccatacctccccatattcacacccttatgtactcctctccctttgaatttgggctggatctgaaatggccttttaattaacagaatgcaacagaaatgatgctgaatcagctgaagacctgtctcaagaagatgtggcagcttccattctgcattcttgggtgtcctaaaccaccctgtaaaaagtccagctatcctgctagagagatcatatagaaaagccacattaagagggagaaacccagagacaactgggagagagaatgaatcttagccataccagcatcccagctgagcctatttctcaaccattagctaggaccaattaccagccatatgggtgaaccatattgatattccagtcctggctatatctgagacactaccacagccacaagagagagccaaattgggaccaaaagaacggtccagctgaacctagtcaatctcatgaacagactcatgagagacagtaaaagctaatatatttaccaacttacactcctgttagaaatctgtgatagttctatagttttgcatccttgctaacagtattttcagtttttaattttttttttattctggtgaatgtgtgaagttgaacacttttcaattactccttccccagtcatcaagactcaaataaaatttttcctaaacctagagttggaagctgcaggttattcaattgagaacttgggtgcttcttggaggaaaaaataattattgataaatgtttttaagttcttgcattaaatattttatttcttaaaaggagtgtcttattattaggtatgaatttaataactctcacagctagtaatgattttaagaataaatatgagatagattacaaggattcataattttattacttcactggtttatgcaaacaacccaagagctgggaaatatgattttcagagtggtcctaccactctgaaacttaagcaacttgcttaagttgctcttaaggaagacatttttcttcttgattttgacttagtaatacatcaaatgagactgataatagcatttgcaatctcacataattgttcaatcaacaaatattttctgagtacctattatgggcaggtactggggatacaatggtaagcaaaaataaacatagcctctagttcatgaagtttatactctagtgtaaacactaatccaagattaaacaatcaatattttaatacataatagtttcatgtataattattaactaacaaatagactgtaaagttaagttagagcatcagaacctcataattaagagttaccttacagattatctattacaatcctccaatctctttttcaaagataaacaaaatattaaaggatggtttttgaaaagttaaaagttccagataaatgagaagtgccaacattactgttatgtaatttcagaaagataactagatacacttatgttccagcattaaaaattagaaataaaacagcttaaacccagtatctttgaccttcaatgtggcccatagtagaaaaattaatagtgaaatttcattaaccaaaataaagtaggctctgactgtgaaagtgatggactgagggcccacgcagaggacaaaaagttcagaagagaaataaattttattgacccacaatgagagagacatccaggtctcttagaaaagtaatatgtttagagctggcttggaactctgacctagtttggctagatattcatgggtttaaatccctgcaaccttctatgcaaccttaggcaaattacttatcctcttagacctaagtttcttaatttcatccgtaaaatgaaaataatcatgaccatctcacatgattattgtgaacattaagaaaaatgaggtatataaagcatcaggcatggctaatagtttccttcttttctcctgactgtggggattatagcattgattacaggcaatctcaaatttgtgatatgactcaatacagcaattaccatatgcccaaactcaattcatccaataagacatgagaatgatacagagaagaaaaacatgatccctgcttaaagtacttatcatctagtagggaacatggataagatacccaaacaccccaaacacaaagccaactatgatattataatacatacctgaagtgtggcataccaaactgtgttagtattcaaatgggagaagacacttcaggatgaggtgggggcagggaggatcaaagaaagcttcctagagaggttgcccttgaaagaggcttgaacgacggattagattttggcagccagagatacaaggagaagattcaaggtggagaggaaacacacacaaaggcaaagagataggaaagtgtatggcagattaggttaagcagaggataaccaattattttttaagtaatattgagtgtctccatatgtcagggcctgtattgagtatttacatgcattattttatttacctgtggaggtgttttattttcctcaacttttagatacttggaaaggtaaataatcttgccaaatattttttacagctatttaatcggagacctgggttataaaaacatgtgtctcttattccaaagaccactctttataactaatgagtagtgagaaatgcagctagaaataaggacaccagggaggcctctaaataccaaggtgaaaagtttgcattttgaattaaaaaccaaatagggagtcattggaggtttctaagcaggaatatgacatggataaagattatattacataatgtttaagagcttagaattcatagctaaactgccttaaattgaatctcaatttttctgcttacaacctttatggccttggagcaagttaccaaatttttctgtcccttagtttcctcatccataaaataggggtaacaatattacctcccacaatgttgtgggaaaaataaagtccattaatatatatgaaatactagaattcctggcttacagtgaacacacactaaatattaggtgctgctgctgctattcctttaggaagaaaactactgaactcttgtatctcaatctgacaattcagccttttattcaaggatgagcaaaaggctaattgtacattgtcagtgaaggcaaggcttgctttgtgagttaataagaatccaggaggaatgtttaatataattaagagggtaagtagctcaggacattctccccatagcatcatcctctagttcctctccataatgataaatagaaattgaagctcctgacttccacaatggttgaactagtttacagtcccaccaacagtgtaaaagtgttcctatttctccacatcctctccagcacctgttgtttcctgactttttaatgattgccattctaactggtgtgagatggtacctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttgtctttggttgccattgcttttggtgttttggacatgaagtccttgcccatgcctatgtcctgaatggtaatgcctaggttttcttctagggtttttatggttttaggtctaatgtttaagtctttaatccaacttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattcctcagggatctagaactagaaataccattttacccagccatcccattactgggtatatacccaaaggactataaatcatgctgctataaagacacacacacacgtatgtttattgcagcattattcacaatagcaaagacttggaaccaagccaaatgtccaacaatgatagactggattaagaaaatgtggcacatatacaccatggaatactatgcagccataaaaaatgatgagttcatgtcctttgtagggacacggatgaaattggaaatcatcattctcagtaaactatcgcaagaacaaaaaaccaaacactacatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatatgtatgtaactaacctgcacaatgtgcacatgtaccctaaaacttaaagtataattaaaaaaaatttttttttaaaaaaattgaagctccttagcttggcattttctccccaatgcgttttataatctgccttcttcttgggagaagaagactatgaaatgcagtggggagaaaataccaagtcagaagacttggattccaatcacaaacctgctactgattcattctgttggacagaatgacctctcttttaacattgtacatggacagttgactctcctttttagttttgaaaagttaaaagtttcagataattgagaagtgccaacattactgttaatgtaacttcagaaagataactagatgcacttatattccagcattctgagtcctcaacagtaaataaggaatgatgcttgccctctgcatggatcatcatgagaattaaatgagatataggatatgtaaaatatcttggtttgcagggtgctatgtacatagtaggtattcaaaacactgttgaataaagttcttattctattcgagaagtgtctttagacgtaagaaaaaaggtaaagcagatggtggaatatttctgcatttcagccttggagaagataaaaagctctatattgaaaatgtcccttaaaatgtgtaagaagagggttggtatagtggaaagagcctgagattcaaagtaaagtggaactaggattaaatcctacctgcaatatttattagctatgaaatattgaaccagctatttgagcatctgctttttccaaatacaaaattgaaatattaatacttgcctcataggttggctcagataattaaattaaacattactcctgaactgtaatccctaatgttggaggtggggcctggtaggagatatttggatcatgggggcagatccttcatggcttggtgctcttctcacaatagtgagtaaattcttacaagatcttgttaagtttgtggcatttcctgccaccccccctctttcctacttcaccatgtgacatacctgctccctctttgccttctgccgtgattggaagcctcctgacaccctctccaaacccagaagcagataccatgatgcttcttgtacagcctgcagaaccatgagccaattaaacccctttgcttattaattacccagtctcatgcatttctttatagcaatgcacaaacagactaacacaactaattatataattctttccagatattactgatgagaaaacagaggcacagggcacacaatctcaccctagatcacagagctagaaagtgaccaaaaaaaaagtagaataaaactacatatatttaactctcctccaaaagttgtactcttttcaaaaatcttgtaaaaaattcccaagtactttccctctgttatctcattttatcctattcttgaagaaactctattatatagactgaccaggaataactatccccatgttacaaatgggaaaagagaaacttgaagaagataaatgactaatgtcagacaaacagcagtcacacttcaacctctgccatgtggcagaactggaaaatgaacctctatctttaaactccaagttcagtgttctttctagtataaatctgaatttcccaaataccatgccagaatgaatatttctccttaaattcagactcctccgatattaatccaaattaataatgttttgctgtggctatttctttttaaaatttccaacttttattttagatacgggggtacatgtgcagatttgttacataggaatattgcatgatgctgggatttggaatatggatcctgtcaccatggtagtattgcctgatatgtagttttttaacctatcccactccctccaccctctaggattccatagtgtctgttgttcccatatttctattcgtgtgtgctcagtgtttagctctaatttataagtgagaacatgtttggttttctgttcctgcattaatttgcttaggattatggcctccagctccattcatgttgcttcaaaggacatgatgattgattgtgaatgttttctacttttacaacttttcctatgtttatagaaagacctgtcccagaaacattcctttcattacagataaagatatttcaactcaacagtcttctttatggtaagtgatttatattttcttcttaatttacaggtgttactataaatgactatttcaattgcttttcaacttttcttgctgcgctgggtcaactgactgcttgactgacaaattaatcagttaacaaaaatggcctgaccagttgctgtttgccagacactgtggtgggcataagcagggttgctatatacagttatgcagggtcttccttgcacaaggactccatttcatgggctaagactggcccctaggtattttattctcttcgaagcaattgcgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagataaacaatcatgtcatctgcaaacagggacaatttgacttcctcttttcctaattgaataccctttatttccttctcctgcctgattgccctggccagaacttccaacactgtgttgaataggagtggtgacagagggcatccctatcttgtgccagttttcaaagggaatgcttccaacttacaagggacgtgaaggacctcttcgaggagaactacaaaccactgctcaatgaaataaaagaggatagagacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatcaccaagtcaatccgaagccaaaagaacaaagctggaggcatcacgctacctgacttcaaactatactacaaggctacggtaaccaaaacagcatggtactggtaccaaaacagagatatagatcaatggaacacaacagagccctcagaaataatgctgcatatctacaaccatctgatctttgacaaacctgacaaaaacaagcaatagggaaacgattcccaatttaataaatggtgctgggaaaactggctagccatatgtagaaagctgaaactggatcccttccttacaccttatacaaaaattaattcaagatggattaaagacttaaatgttagacctgaaaccataaaaaccctagaagaaaacctaggcaataccattcaggacacaggcatgggcaaggacttcatgtctaaaacaccaaaagcaatggcaacaaaagacaaaattgacaaatgggatctaattaaactaaagagcttctgcacagcaaaagaaattaccatcagactgaacaggcaacctacagaatgggagaagatttttgcaatctactcatctgacaaagggctaatatccagaatctacaatgaactcaaagaaatttacaagaagaaaacaaacaaccctatcaaaaagtgggcaaaggatatgaacagacacttctcaaaagaagatatttatgcagccaaaagacgcatgaaaaaatgctcatcatcactggccatcacagaaatgcaaatcaaaaccacaatgagatatcatctcacactagttagaatggacatcattaaaaagtcaggaaacaacaggtgctggagaggatgtggagaaataggaacacttttacactgttggtgggactgtaaactcattcaacaattgtggaagttagtgtggcgattcctcagggatctagaactagaaataccatttgacccagcaatcccattactgggtatatacccaaaggattataaatcatgctgctataaagacacatgcacacatatgtttattgtggcactattcacaatagcaaagacttggaaccaacccaaatgtccaacaatgatagactggattaagaaaatgtggcacatatacaccatggaatactatgcagccatgaaaaatgatgagttcatgtcctctgtagggacatggatgaagctggaaaccatcattctcagcaaactaccgcaaggacaaaaaaccaaacaccacatattctcactcataggtgggaattgaacaatgagaacacatggacacaggaaggggaacattacacaccggggcctgttgtggggtggggggaggggggagggatagcattaggagatatacctaatgttaaatgatgagttaatgggtgcagcacaccaacatggcacatgtatacatctgtaactaacctgcacgttgtgcacatgtaccctaaaacttaaagtataatttaaaaaaaaaaaagaatcaagactgcccccccccacaaaaaaaaatgactggcccaatggagggggtacttttttctaactcacacaaagattcattaggagctagctctagccctgatgctgggatacagaaatggatatgacagtgtccttatctccaaggatctcacaatataatagggaacacaggcaaatacacatgcaattatactatagcatcacaaatggtgttataaaggaaagtccaaggtgccatgagatcacataagagggacaactaattcagcctggaagatcaagggaggttctccaaagaaggtaacaactaaactgagcccaaataaatagatgttaaagaaatacttgtagataaaaaagaggtgtgctgtctcccacagaaagagaacaattttagcaaagaaacagaggaaagaaacatcattgcatgtacagcattgctgtgggataacatttgaggttaagttttaagaggcaaggtggggaaaaggaaaagaagaaatcagggacagatactgaaggctttgccaaactaaggagtctgttttttatatgaggtgggtaatgggttgccattaagagaaataaaccaggagaggatatgtgattagatttgcattttataaagattcttctgacatggggatggaggaagtgctgtgtctaggactttcatataacaccattagagatgtttcaaagaattatttgttaagtaatccaatttagattttcaaagcagagaggaaaagtaatatccttagaaatgttcctatgactctcactctgttaggcatacatgtcaagtagacagacattcctataagtgatgcaaatctcatttctgaatgattttataaagctcaagcttgtttcatataataaaaacgataatcaaaacataaatttaaatataataggccatacttcaacagattccgtttacattattcctatacaaggtattatttatgatggtgcatggacacctaatctcgatgttgtgaaggtgacccaggctgggtggggaaggcagctgagccagtgaaagcatttacacatcacctcaagtgtgtatcacaaagctcacctttgcatgaagggcaatttggactgtgaagaagcagaagtccaaatcaaggacaatgagagtattgaactaatgtatctagtatcaagacccaaagtccattcttaaaggaaaacatactccaagaggggaaatttatatgaattctaaaactctttgaaggttgaggacaaaaaaaaaatcagtattaccagggtagaaatgggtatttctcctagtatcagtagcatggtcacagcacataatatataaaagaagaattttcacttgccaccataatgtcttactgtttttctcatcccaaggtttttgctgaaagaatcaagagttcagtgacagaagaatgagggtcagagaagcatgaagacaaaggagaatgagggtcatttattcaataaacatttgtaacactcatactataagccaggcactatgctaggagcgttcagaagtactgtctcacttaataaagcactactacctccattttgcagataataaaactgaggcaagtatacttaagactagatgaaaagtccacatagagtttatctttaagtacaaagtacttctttacaaaaaattaaaatatagagactcaaatttattagaaatattcaatataacaatcttttaatgatttctggaagcatttacaaccataaatatatatgtactattttaaaaggtaaatgtaccatggcaaactgctgctgctacctttcctaccaatctaatattgaatcagactaaatatgttaatgattcactgttacaaattctgttcctttatcaataatctccctacctttgctattgtaccctgaatcatattatttgttcattcattcattcactcattctacttggtgcctatcatttgccacatgcagtccatagactgaagtataatgggaatccactgctgctctcaagagattcacagtttgtaagggaagccagacaactgaacagataattaacatacaatgtgataagtgctgtgatataaggatgttcaggggggctgtgtagcatagttaggttacattcattcagtctggaggccaatatatcagggaaaacccagggccttcctatctataaaaaatactgagatccaacacacttttcaaaaagcttccctcagcccaatcttcccatgggcggtttctcctcaagacctgtgactctatgacaccaaacccttctccattcactcaaccaatatttattgagcatttccattatgccacacattgtgctaggcactgaagttacaaagctaaataagatagagatgtttcttgtaccatgagtttgtaatctaataaaagaatctgctgtagcctttgaaaagattgctaattatataacatcagtgtcaataagcaacttgactttcgtacacccttgctgtgtgacttttgacaagtcatttcacctctctatccttggtttcttcatttgtaaaatgaaaataatatttgccttattcagtttaaggaattttcaagatcaaaggatataatgaatgcaaaagcaccttgatactataaaggaatgtaaaactatgaggaattttgtcattctcatgattaaaagatggttctgatttaattaaatgtatgaatcacaaaatacttaaatgcaattgtattactttttaatatttgtcgtaactaaaagcaggccaataaactacgatttagtacagatcatttggagattcacttaaaggcacacatataaagtattcacattgatttgtgaaagtagacatttctgaactgttcaaaagctgtcagatctctggagggttataaataatccctcttacaaagaggtttatacaattatttgctctactaaaaataagtttgcatagaaaatgcaaacattagcctgagttatttccattttcatattaactgaaactatattaatgggtttctactactttgaagttggagaaaggcattgatatgccatagaagatagaaaatagaatttgtcatcagaataccaaacctgacttatggctataccatttgatgcctatgtgatcttgggtgagtctcttaagagagaatgatattggttttttattctctaaaatatggaaaataagcatagacaaatgacaagttcattatgagaaataagtgagatagaacatctggaaaagcttttcttttaatctataaaacaacttaaagatgttaactgatattaatattatcactttagtctgtattttaactctacttacttaaataaatgatgttcatacaattagtttgcttttatttaataccggagttcatcctgttttacaggtgaaaaataaaacagaggccaaaacacattaggagtaagaaatagcacagactagaaatgagaaaatatgaattttaatattattttcaccaccagtggctttgaaaccctatgtagtcacatatcttttttataccttaggattcacttttgaaaactgaggcaaatactctaccttgatcactctacaggtattaaaaacacaatgtgaaaacaacaactctgattcccccaaaatattttgccatggccaagtcagataaacaaaagaaatttaccaactcaaatgagactatgcaaactaggtgagtctatgaagctgagtttggcagagactaaaggactaaaagtggaaagtagggagtgaggcatagagtgctgtagaactgacaatttcataaattagattgtttttgttcttgctgattttttaatgttgtccttgtggctgtcaatgtgggacagtgaataagggaagtcagaagtgagggccccagtagtggtttaaaaatatagatggagaatgcacatacaaggtcttgctcagattctaagaacctgaacaaataacaatctactactcccttggcaatgcaagatcagcgttggagacaagtgacctgataatctactagtgtctcactctttattctaatgatctttggaaggctatgattacctgctcattgctcctgcctgttagtatttaacttcctcctctggttatgcttgttttatttatcattaggcactgaagctcagatcctaagggctttcaagagcctatgaaaatgttttgagacttgaagaaaatatcatctcaaaaataaaacaaaacaaccctgcaaaactgaaataagtaaaaattaaatacctacaaaaatgacaactacccaactgaacttcaactcaactctttttaaagtatatattaactttacttaatttgaatggtacattttaatgtttgatatgatgagagttagaactcaaaaagtaagaaagcctagagctttcaaaagtcataataaggccctacctgttgcttctatctctactttaccctgaactttgaataccctactttgaatatcttgactgctcccattacaatctatactcagctataatttagactttgggtttctaaatcctcatacgaacttcctgctgacctggctgcctgatctgattcctcctctagacgctgatttccaaacacacacagcactcctctccctttctgccaattcctattgaaaatagagtgccacctcttagctttcaatgtagaagtttatcactcaccaaagatcactcactttttttttttttttttggagacggagtcttgctctgttgcccaggctggagtgcagtggcatgatctcagctcactgcaaccttgtctcctgagttcaagcaattctcctgcctcagcctcccgagtagctgggactacaggcatttgccatcacacccaactaatttttgtatttttagtagacacggggtttcaccatgttggccaggctggtcttgtactcccgacttcatatgatccacccaccttggcccctcaaagtgctgggattacaggcatgagccactatgcctcacccattcactttatgtagtacatttataacgtacatttatacagtacatttacaattgccatcaagaaaaattttgctgcccaaagcaatctacagattcaacactattcctatgaaacaaccaatgttatttttcacagaattaaaaagactactctaaaattcatatggtacaaaaaagagcctgactagtaaaagcaatcctaagtaaaaagaacaaagctggaggcatcacattacaggacttcaaactaaactataagtttatagtaaccaaaacagcatggtactggtacaaaaacagacacatagaccaatggaacagaatagagaatccagaataaatccacacacctatagaacagaatagagaacctagaataaatccatacacctacacccatctgatcttcaaaaaaatcaacaaaaataagcaatggggaaaggactccttattcaataaacagtgctgggataactggataactggctagctatatacagaagaataaaaatggacccctatcttttaccatagaaaaaaactaacacaacatggataaaatatttaaacataagacccccaacctataaaaattctaaaagaaaaactaagaatatcattttgaacatcagtcttggcaaagaattaatgactaagtcctcaaaagcaattgcaacaaaaattaaaatttacaagtgggacctaattaaactaaagagtgtcttcacagcaaaataaactatcaacagagcaaacagacaacccatagaatgagaacaatagacattggaaactattagaggggggaatgagtgcaggggcaagggctggaaaactacctattgggtattttgctcactacctgggtgatgggatcattcgtaccccaaacctcagcatcattcaataaacccatgtaataaacctacacatgtaccctctgaatctaaaataaaagttgaaattataaaaacagaaaaatttgttacagtctgtcctagaactgccaataactgccacaatctaatcatactgctatgattgcatttatcatattgagttagattttttttgtttattgtaattttctctttatcatagatccaccatttactatctgtatgaccttaggtaagtttcgtaagctctctgagccttagttttcttatgagtaggtgggtataataatatggagtctctgatcctctgtattacctaatcaacatctagcctgtttcaaaccttaataatcacttcttcagagaaatctccctgtgtcactagaccatacgcaacatgccttctcatcgtaattttttccacacacatttttcctacacctgtttattgtgtgggaatatttgattaatatctacctgccctattagactataagaactgtaatcactagtgcctggttttgctcaattttacatcccagcccagtccagtagctgccttatgatagattctcaataaatatttgttgaatgaataaacattttctttttcatgatcctggcttttatttcaaatttttaggaggaccactcaatcacaaatggaccctttcacttagctcctgtaatttctttccttagagctagaccatgatctgccatttctctagccactacctagcatctctcccctgaatcaatctggaaaaaacctttctgatacagtgtagaagcacagcatgagcacggatcaggtatcagtaacacctagcacttagacaatacttaccattgatgtacttccaccattagtgccaggccagtacattagtttaaacagtgcttgccctctgctcagcaaaggtgtacctgccccttggaaatgttcaatccagagaaggtggtagggtatatttcaggggtgcatagcaatgtatgaggaggtcacagcacaggactcttgctgttaaaatccaccccgattacctgaaattccttcattaagctaatctttggagttcttgggctgttttctcatcattaagatcattccattaactcctgagatctgggattcagctatattttcatacgaatcaatgacaaatatcatccataagttggatagtgcaagaaaaggttatctgtgggagatattaaggttatcaaaagaacattttagtgaggcataaataccaagcaaaataggcacatgattgaaaataagaagaccttaactctagttatgtttccaccatttactatatgtgtggctctggacaagtccctgaagttctttgtgtctcagatcaatttccccattacacagcgcagagtcataaggattaaataagaacataaagtgttaagaatatatatagtgctttgtgtagcactggaccttaaatattggtgcaattatagtatttttcacttgattccaaaaaactggtatttgtttgatttctttcagattgaacctaatttccataactttaagtacataataactgggaggtgaagacaaggaaaaggaagactatattctgaaaagacccttaacacgtgacgtaaggttgattttaatccttccatttgactgatgtcaactcaaattaatataatgtaaaatcagataacttcatcatattaatgaataaatcaattagatagttatcaagcaaccacacagtgttacgcactgaatgcagaaatgaataagccatgattatccctgcactcagcctaaactcacatataagttctaagtgggtagggttcatgcctgtctttccaatatctatacccacaatggctagccaagtgccaaatagcaagggcctcagtcatgtggtccagggttcagacaatgatgagcattatcaccatcatcatcatcatcatcatcatcatcatcatgaagacagcactaacaatttcttgagtgcttgctatgtggcaagcactttgtacacattgtgtcatttaaccctaacacaaatgctacaaggtacagtaagtatattatgcattatttatatcaccacctacctccttcatacatctgccctggccctcaagacttaagtttgatattctaagcacacacattcatctccttactactatgaataataataataaagaatactttctatgtaccagattctgttctacatacattaattatattgaagcatttcagcttcacaacactcgtatcaggtaagtattgttaatatcctcattttatagacagggtaagtaacttgtccaagtacacacagctagcagagtctggatctgaacaaaagtagtcttcagtcaaagtctgtggtcttaattactctgcaatgtccagcaggtgagacaaagtaggagcaggatcattttaaccaaaagagaatatagtcctgggcatctaaaagcctggttaaagatgtattatagttaaggttcttatatctggcctctggactgaccagtgccatactggaatatctctgcagggccttaaataaggagtccacatggtcactacagttatgcagaacttttttttttccattatcagacacacattataatgtctctctcttgccatacaatccatccctctctgcccaggaaacttcaaattttctttaaagacacttcccaagaagcttttcttggccccttctttgtaacaccataataatttactcatgcctttattatgatacctatgatactaccttataaccactgatatcactcctactaatgcgtgaaccccttatgaataataaaccagtctaattcactctaatagcaacctcagagatgaacaatggcagaagtaagccttaattttttaattaaagagtatgggctttgggcttagtgaaatccgatttgacccttgctcaataatttacgactgcattatcttgggtaacttattcttctgttttcccttctacaaaatggaaacaataatatgtaccttgcaaggttgctgttaggaatatatttattaatctcagcttatatttactgaatgccaactatgtgccagggataattctgggtactggggatatggtggtgaacaatatagacaagatccttgcttcactggagtttatattgtattggaggatacaaataataaatacattaacaaacaagaaaaatctgataatagcaggaattataaaaagaattaaaatagtgatataataggattatatacaaacctgctgtagagtgagtggtcagggaaagcttgcagaaaatacaacatttactgagatctcagtgacaagaagaagccatgagaatagaggtagggggagtgcctttctaggcaaaggaactagccagggtaaaatccttaaaggcagtaatgagcttggtgagcctgagagaatcttttcttctttttatgtaatgtcttccctccctttcactcagcagaaataagacaggtctatagtagcctcttgtttgggcatggaaataaagaggagggggcaacaggaaggaagcacagtatcaggcattcctttactttacctagatcttatgtaaaaggggaaaagaagcaccctgctcaccagggaagaggccagacgggagttcaggggcacagacttcactaagaagaaagagcattccatcagcctaaagtgtatcgtgaggagacactccacagaaacctaatgatggctgcataaacattaggcctctgcaccgggcacagtggctcacgcctgtaatcctagtactttgggaggccaaggcgggtgggtcaggaggtcaggagatccagaccatcctggctaacacggtgaaaccccgtctctactaaaaaaaaaatacaaaaaattagccgggcatggtggcgggtgcctgtagtcccagctactcgggaggctgaggcaggagaatggcgtgaaccctgggaggtggagcttgcaggtgagccgagatcgcaccactgcactccagcctgggcaacagagtgagactctgtctcaaaaaaaacaaaaaaacaaaaaaaaaccattaggcccctgccttaggattagcaattgctcaataaacacctactggatgaacaaataggcttttgctgcaatgtaaggccttgctttcacagaagagtcattaaataaccctatcttactgaaaactctgtcataccataaaaagatataaagagaaaaaaactacaaaatctggagagtctggcctattttactgctcttgtccttgatcttacatttgtactttgtgtgtcttgggatgctcacttcataaatattttacacaaataaaaatagaaacttctaaactgtgaccagaacaatacatttgaaagctgcataatataaattgcctttgcttaataagagaaaaaaaagaaggagcataatgtcataaataagtcatttatgcttactgactaaggaatctcccatttggagagtcaaatataaatataggtaggtggataccaaaaaaagccagtctccagtggctttgcatccactatgaagcaacaaatttaaatgtatcattaaaaaaacctcatccctagtgacaagtcaatgtctagaagacagttaaatgagtgttcagcagaggatgacaaagagtttggagcatagaatatgacagagttctttccatgaacatcgattacaacaaggcagcagttattctgtctggaagagaaacatttattctgtgtttgacattgtgcatggtatctaattgaccagtaatagcattttctgtgtaattctggagtgatttcttaaaggtaaaagcagtagaaaaagtacattttctgatactgtccagcagcagccagataactgagataactgatgtactttaattcaactttatttgaagaaaaagcaaacattaggttgatgatactgtacttagaaattatttatcctttctcttatttaagtaacatttgttaagtaaatactatgtgtcagatcctaggctagaaactaaaaataataaaacctctccttgactaccagacgctcacaaggcagatgtaccctatataactaactgtaattcagtttttttggtctttaaaagaaggtgtatccaagtgctcaatgagaacattgtactctttctccacgaccattcctcaaggtccctgaccttaccaagtggcaggtaccggagacctgcaccttatatcttagtcccatccagtcatcaagcccatgaacatcaagcatgtacatgaaaagccctatccgtatcagaaattggtatttagaataaggcttataacaccctgacctcagggcttagtgcttgggagcaggcccaacttactcattcatttaatcaaaaacattaaataagcttttattagatgctgggtcataagcctcaatgtaccatttacctgcagactttcttccattgctatcacaggggcctacttctttacatccaggatatgcccaagctcttagttttcacttcagttatcaataagatttcctgtgagaataaagcactattttaaactccatcccacttgactggacaaattacaactcttataacgtttatcaagccatccctttggggaatttgccaccattctcggtgccccatccactagctcggatcctttcaatctctaactccagccagaatgaagagactgctaaccatgaaatatgcaaatagctttgcttcaacctagaaatactttcagacttgctcaactcagcagacaggaaatacttgggatgcagttatatagcacttggttatcaaaagttagactcctccacacctgatccaaaggagtggatctgcagcttcaaatctgcaatgtgtaactctgacccccaggtcatagctgattgactgagttagacaaattagattttttttcaacaggacatcaaaattaggagagacagcaagtctctgggtacgtagtcccctacaaagtgactgattttagagatgctgaggaagtatgacgtttgggatttgatgactaatatgatgcacagggtagattataagataaagagaactgcacggtcaccacattctgtcttgggcaaggagatgtagaaaaagcatgtcaggaaggaaaagcagagaaaaataaaggctgagataaggaacaaagagtgtccaataagtactcatggtacttatgagacacttacgtatcttattataaactcttgtttttttcaacttaaactagcttgagttgatttctgccacttacaagcaaagaatcctaatcaatatagcacttctatataatttggctccataaacttgttagtgtccccaactgttccaagatccctctgctctctttatgattaaacctggttcatttgttcactcatccactcagtcctctagaaacatttactatgtaccaggtattatgctagacataatccccacctcaaattacttattaacctataggggagataagtaagcaattataatatagaacaattggggccagaaaatagtcaaacatgaagctctgggagcacaaacgtttaggtggtacccaagggtttaggtgatcaggaaaaaatttccagagtgattgacatttataagatgagtgggagattggtggacgaaaaatttttaaaaaaattagaaagtaaggggaagaatgatatttcaggcagaggaaagagaatgtacaaagcaaggaagtttgagatcctatggtttatatataagaaattacaagtagttctttacggttggagctgtgtgggtgtataaacagaggggagtaaatagtaggagatgaagttagagaggtagaaaattctaggtcataaaaagtcttgtacattaagctctagaatatgaacttaattttaaacactacaaagtcattaaagaatcatggaccaaaaagttataagatcagattattattttagaaacattattgtgtcaatctggaggatggattgcaaaatgggggtgcagggctgtaatcaggagagagaaccataaacacaaaaaggctaggaagaaactgaatgcagtaatgctgagaataggtaaaagcctgaaataagaccgtggtgataaatttgaagagtaggaaatgtctttgagagataatggggaatataatctgtggtacttggatatttggattttgggataagaaaaaatttgaaaagactattttatttccatcttgtattacagttcaaaagatgataccctgaatgaaatgtagaacaaaggagaaagagcaaatgtaaggaaataaatctggccaggcatggtggcttatgccagtaatcccagcactttgggaggccgagcaggcagatgacttgaggccaggagttcaagacaagcctggccaacatggtgaaaccccttctctactaaaaatataaaaattagctaagcatggtggcacatgcctgtaatcccagctactcaggacgctgaggtatgagaatcacttgaacccaggaggcagagtgcagggagctgagattgtgccactacacttcagcctggacaacagcgcaagaccctgtctcaaataataatactaataacaatattattgttactattcaataacagttttagacagtttagtttgaggtgtatgtgaaatgctcaagggtacatgtgtaggaggcagttacaaatggggtatggcttctagcagacagttaagggctagagataaatgttccgggaccttattgaagctctgggtgaatattaaatcataaaaagagagtgcataacatcagcagagcgggggtaagagaagaaactctgagatatttaagaggtgaaagaggaaaaggagatgggaatggagaggaaaacagggttaggtcatcaaggcccttgtgtcacaatacttggcacacagtagggctcagtaaatatttattttttgaatgaataataaaagattaccacttgcttctgtacatggtatgaaactactgaacatttctaagagacttgacttcactgaacctaaattatcatcaacattgtcgtcatgatcattgttatcatcattattatcattttcccttacatttggattttacattattgttttaaaaagtttccacagctatgttttcaagtagaatttgtaaaaaaaaaaaaacaaaaaaaaactctatgagtttttttttattattatactttacgtttgagggtacatgtgcacaacgtgcaggtttgttacatacgtatacatgtgccatgttggtgtgctgcacccattaactcttcatttaacattaggtatatctcttaatgctatccctctttttatatgtggaaatattgaggcttaaagcaatgaagtagctagctaaaagcttgtaagaatcctcaggtttttaatctgacttccagttcagttttcatttaagtatatcccagccacctctctgaaatagtctcttaaaatcacatggtattttgggattgggaaaataatcatatgcaccatcctatttgataatatatgggtttatttgtggatattacagatacctgggttgcattggactgagaggcttcttgggacttagggatttcaggattaaaactaagaaagtccaaggaaaagtgggaacagttaattactctaccatttattatcatcctgaagagagtaaatataataaaatgattaagaatataagccctagtgttagactacctggattcaaatcctgcatcctatctcatactggcaaagcaactagacaaattactcaacttttctgtgcttctgttgtcttatctataaaataggggaaataaaaatacctaaacactgaggattagatgaaatagtatatgtaaatacctaggtcaatacctagcacagagcactcaatcaataaattctcacctcatatgtattatttctattctttcccacagtttgcctctaaattatatgtggcttagtatttttattttctaattttgatatcaagttagaggattttggtatctttggagagtgacttcacaggataagaaagaaaagaaccctagcatcagtctctgcaagtgttctttctctgagacctaagctgctgagaagagtgcactgggctgtctttaagtctggctcatttattttgtggcactaggcatgtcagtttccctctctgggtttaagtttactcatctgcaaaacaaaaagatttaaatgatctgtagagtcccttctatgttgggcattctatgatgtctctattccctagactttactgaaagaatgacagaggaaacaaaccctactctagcaacccttttaaattccaaagtccagagatgaaaaaatgagaataaccaaaggatttctgtgaaacagtcataaacttacaataattgtgactttttaaaaataagaaatcagaacaacaattcactgttgactatttagtaataggtattgttctcattattttatagatatcatattgtcatcatattctaattctcacaacaaccctgtgatgtagttattattatccctatttacagataagacaactggggttctgacaagttctataatttatcaaagtcacacatctgtcaagagatgagagcagatctttaatttgaatgcatacaattcaaatgcccatggttttcctacactagcacgttactattgatgactatccatctcaccccataagaggctctcacatttagagtatagacataagataacataaaaacacaatttcataatatcctcaaaagaaaactatacacatatgctaatggtctgtcccaacattacaatttatgggaaaaggtatatacaatacactctattttgactttagtaactctcactacgactgctcaggaaagcaaagccaccatctgtagaatggaatatggtcttttgttagttccccttcatcatattttcccatcagtttgatttcacaggaaagaaatccccttccctcatctgtatggtacctttcagctgagccaagggaactctagctgaaagcaaactagactgtcatctctatgaaggcaggcaggatcatgtctgctttgttaaacatagaatatcagtacctaaaacaattcctgaaatatagaacatgctcagggaattagcttttattatattatgctgcagtatagcctagtttgtcctgatgattacataaccctaaatcaaatggatacaaaagagctgagattcaaattcatgtttttgtgataacaaagctcatactcttttcactaagtaaaaagttaaaacattgaatttcatgttgctcaggaatacttactcatcccttcttctaatcccttccttgttcattatccaagtaaatacaaaattaggtgcatttccctaatttatagttgaattatataccactccaattaaaaattatgcctttgtgttacactgcaagacagaaaaatgttactgggccattgaccatgtgctttcacctttaattacatttagtttaatatacttttacaaagaaaagggaatcaagaagtattatctgttaagcatccactctattctaggcattgtcctggaagctttaagtagattaccattatttagcttccactgtttctaaggtcacctatctaccaagtgatggcacagaaattcaaacccaggtctgtgcattttaaaatctgtttttattttgctattccctttccattttgcatgggcacagtgtcctttttatactgttatggtttcaggaaaatccactgcagtttttctgccctcctgacatggttctcttatttgccagagaatgtacctcttaaactatcttcaggcactattatttctggcattccacagtacaattctgctagttttccaattcctacctacctctcagtctagtctgtttatatgtctagaagttactatgaactcattaactgattttcttacaagttagtggcttctgatcctctttattccacccagtgcttcacttcccttctcttcacaaccacacccacaataccacctacaccccgcccccacacacagacatccagacaggtaatccatgtttctgctattctttaatctgggtcctggacttccactatgccctctgactctgcgcttctaaactcaacatgtacctttaaactggttgtgctccatgacctggtcagtttagaaaataagccacaaatatgaatgcttaatcctggtaatgatctaaattcttcacctcaagtcaaaagatgatctttttccaggggtcctcaatctgcttgcacttattcttgttctcccgtttccattttcctttctcagaagcccagctacagagaagcttcaaatacaaccttaggggctgaatcagatgactactcaggtctcttcctgcatggagattttaagattctggattattatgccaaggttttcttagtgcaaggtcttcaatctattctcctgttagctatactctactcttcaagtcctgaggattatcactatcacaaccatttaatcagatttctgtatgccttgctgacacataattcagatttctctaggatcctatatgattcttgagcccatatttgcccgcttcaacatccacaaattccctcatattcttgtctgctgggtttctgatcctgcttcaccttgaccttggatttgaacatattcttagacacctgatctttggcttggcttttaactacctagccccaacactagccctgcaagtgtgagtcacgctgcaggttgggcatagatttgggaatgagttgaagcacagaatctgcagatttggggatttcgccaaagagaagggtctagggtttctaaagaggggtcaaatttctataatactctatcaactttctaagtataaccaccaattgaataaacatttcttggacatcaactaaaaagcatttttctattcccttgcatgtgttagctcattaaatcctcacaaaagccccatgaagcagggatcaacaccattttacaaaaaaaaaaaaaaaaaaaaaaaagcacaaaaattacctatgggcacagaatacaagtcaaaatgcatgccacaatatggctaaaataatgatgttctttaaatagaagtcagtatatttctgtaaattagttagtcaaaaaagcaatttacaaagaaaaaatatatcaaccatttattctgagataaaagggtacaatacctgtaaccctaccaatatctccctgcccaggctataatatgaccaattcagtcagtgtctttgctcctgcctcacatacacctttcccaaagccaggttaaagaaaacactttctctgagagacattaagtcttcagtcaagtgtttgcaagtagcacatgacccaaaaggatgatgttcctagacagaaaaggtccattatttgcttaatagtatacatagtagcactcaataaaaaagaatgaccttcccagacagagaaaggccactcctacatcgagcaggtatgagagccctgggtttgcagagggagatcttcccagatagaggaggctcttgcaagggtttatgaagctgaacactccctgtaagaatctccatctaatctggcaagatttgacctactttgtacaaaggtcacatttcagtattttagaagccaagaccaccagatcacaccgtgaagttcacggtactgctgatggataaaagttgctcatatggagaatcagaaaaatgtttacacattgaaacaatgataagaaatgtgattaaagtattactaaaattggaaataacctctttaggacatcacccctcccctagccccaggctgcacagctcttggctcccaaagacactccttccttccccttgaaaagaggtgagggaagagtgaaaaggactttgtcttcaatattgacacttttacaagatgacagtatgtacatgaaacagtatattatatgcatcaaacagttcagtgaaacagagtagaaaatccacaaactaacccaagtgcagagaataactttatagattaaaaaatatgtcatttgaaagcagttgggaaaggatatattagtcaataatggctaagatcatctggctaaccatttgggggaaaatatattacaaacctatctcattctatacattaatatattaatataatataatatgtaatatgacataataatatgttatattattatatattataatatataataagataagataaaaataaaatgtaaagaaaatgaaatcacaaaagtgttagattttggtatttatataatttagtgggaaaaaactctgactacaataccaaaccagacaacttaaaagattgactgactttactaaaatatactttaaaaatctacagaaaagagaatgaaaaagggaaaagtgagcaaactgagtataaaatatataacaaataattatttgacatgtgctacctttttatccaacattgacatttttggtattaattttcttttactgattattcattaaacttttcgtttggttttttttgtttgttttttgagacggagtctccctctgtcctccaggctggagtgccgtggcgcgatctcggctcactgcaagctcggcctcctgggttcacgccattctcctgcctcagcctcccaagtagctgggactacaggtgcctgccaccacacccggctaattttttgtatttttagtagagacggggtttcaccgtgttagccaggatggtctagatctcttgacctcgtgattggcctgcctcagcctcccaaagtgctgggattacaggcgtgagccaccgtgccccagtgaaataatgtttcagaagaataaattttattgaacattttttgagttccttttagtagttgttactagttttctattaattacaagtcataaaatatttatttagctttcattgtatcatctttctacttttaagaatatttctactctgagttccttaagctataggacaatttgaaaacaaaataccaacagtaaataacaaagaaaaagaacaatgagtactttagcaaaatggaaagagttgtggtgatgtcttaacaataagcttttagagccccctgtgtgtctatattgtatattactaggaattctgtgttgcttgagatagtagacacatcacagcaacagagcagaaatttttatctgtgtgtgtgcgtgtgtgttcatgtgcatgtgtgtgttggggtcatgaaatagttgataatttttgcatttaatttttattttttgtattctgaataaaaaaattagtaacattagctttaaccaaacactacaaattcaatgtcaatcctatcaaagaaaataccaacatcatctttcacagaattagaaaaaacaaccctaaaattcatacggtaccaacaaaagcccaatagacaaagcaatcctaagcaaaaagaatgaagctggaggcatcatattatgtaacttcaaattatattacaaggctatagtaacaaaatagcatggtattggtataaaaatacacacattgattaatgaaacagaatagagaacccagaaataaagccacatatttacatccaactgatcttttaaaaagatgacagaaacctgatgtcaggagttcaaaatcagcctggccaacatggcaaaaccccgtctctactaaaaatacaaaaattagccaggcatgtggtgggcgcctgtaatgccagccatcgggaggctgaggcaggagaatcacttaaacccgggagctggaagttgcagtgagccaagatcatgccattgcactccagcctgggcgacaaagcaagactccatctcaaaaaaaaaaaaaagttgacagaaacatatgccaggcaaaggacaccttagtcaataaactgtgctgggaaaattggctacctatatgcagaagaatggaactggacccctatctctcaccgtatataaaaataaactcaagatggaataaagacttaaatgtaagacctgagtctataaaaatactagacaaaaatctagggaatctcttctggacattggtctaggcaaacaatttatcacgaagatctcaaaaacacaggcaacaaaacaaaaatagacaaatgatagttaactaaactaaaaaaacttctgctcagcaaaagaaataacagagtgaacagacagcccactgaatgagagaaaacatttgcaaactatgcatctcacaggggactaatatccagactttacaaggaactcaaacaactcaataacaacaacaaacaatcaagtaattccattaaaaagtgggaaagggacacgaatattttatgcctttcaaaagaaggcacaaaactggccaataagcataagaaaaaaatgttcaacatcactaatcatcagagaaatgcaaattaaaaccacagtgagataacatcttacccctgtcagaatgacaagggtaagtcagcaggctgggcatggtggctcacgcctgtaatcccagcactttgggaggccaaggcgggcagatcatgaggtcaggagatcaagaccatcctggctaaaagggtgaaaccccgtctcttctaaaaaaaatacaaaacattagccaggcatggtggtgggtgcctgtagtcccagctactcggtaggctgaggcaggagaatggtgtgaacccaggaggtggagcttgtagtgagccaagaaagcgccactgcactccagcctgggcgagagagtgagactccatctcaaaaaaaaaaaaaaagtcaacagatgttggtgaagatgtggagaaaagagaacctttatcaactgttggtgggaatgtaaattagtacaacctctatggacacctgtatacagagttctcaaagaactaaaaatagaactatcatttgatctaggaatctcactactgtgtatctacccaaaggaaaagaaatcaataagtcaaaaagatatcttctgcacttttatgtttatcacagcactattcataataacaaagatgtggaaccaccctaagtgtgaatcagtggatgactggagaaagaaaatgtgatatatacaaaacagattaccattcatccatcaaaaggaatgaaatcatgtcttctgcagcaacaccagtggaactggaggttattattggcatcttctcatctataaattgcagctaaataatgcatacacataacagacattggagacttggaagggtgagaaggtgatgagaaattacttaatgggtacaatgtacattattggggtgacggatacaataaaagccaagactttatcactatgcaatatatccgtgtaacaaaatacaattattttaaaatgatgcatcatattctgtttactttcagtgaatggaagtatttgacagagaaatacctttggaaaaaaatacacacaaagactgaaatacgctgataattatcattagtggcaaaatgagtgaaaatcataaaaggacaatttaccaggaaaatgtaaacttagatgcaaaaatactcaaactcactaataaatttaaaaatggaaaaaatttgaaagcataaaaatattgtttttcatctaattggtaaagatgcaagatagtcatcattaatgttctcaaggatttggataaacagttattttcattcactgcataatgagagtataaactgatacaaacatttatacaggataatttgacaatacatattttaaaatacaaataatttgatccaacaattgcacttttaggactttatttcagggaaataattaaagatgtacacaaacgcatttgtatgaggatgcttcagtatactatcatttatagcaagaaataacataaaaatagaaataacctaacctaaatttcaaatagtaagtctccagttacaatactatatagtccttaaagagttatgatatgttatgtagtatatttattgatatggaaatatatttatgacataaagttgaacaaaaatataaaaatatacagtataatgtcagttttgtaaacaattattcatatctaattctggaatgatatttattaaaacattaacaattatatgtaagtggatgaattaaggaatatgtgtttttgcttgtttttacttatctgtatttctgattttttctacaatatatattagtttaatttcagaaattagttttaagagcatgttatttgatcaaaatctaggaaatatcagcatatgcaagttttgtttccagtagttcgggagccagccttccacacacacacttcaatctcctctctggctgtgttttctatatatttgttaatgtccttctgttttggctgtatcctccagtttagcaatgtgcacttctgattcccttgacctttgaatcttctactttgctccttgaactcttcctactggattactcaggaaagtatctgcataataaaccctcactggcataatcctaggagccgcatatttatatacaacccttaaaaagagttatgacttttctggccttgcctttttttggtgtggcctctggtggagtttatcaaaacaatattgaatgagggctgtgagtagccaaagaaggcttgccagaagaggagccacctgaccttagctgggaaagatgaggtggaacctggagaaatgggcattaaggagaaaggattttttaaatgttcaggtgtgaaaagcagcatgagcagaagcatggtaagagcaagtaaaccagccatttggagtggagtgttcatatggggctcagaggaggaggcagtgctaggaagtatggttaaaaaaattaagggcaaattttgcatgattttgagttggaactttgttatgagctatgagcccagaggggaagaaaagttaatagaaagtaaaagcaaaccacattataagaaaaattagactaaatattacaagacaggaaaaatgttttcaataatgcctaagcaacttgtattagttagccctactcaatttggtgtcaatttacctttccagattattctctctttactctccccataaactttacctatgttacaattagccaatctttaaatatatcttatctttttattcttccatgactttgtatattacttcctctgtctagattgtcttttcttacttttccaacaggcaatatactatttattcttcaaagtctaactcaaatgccaactcctctgtgaggtagcacccttgatctctccaagcagttacagtacttggcatttttgctacagttactgtggatgtgttgatctttccacttgaaccagtaccttctaaatagccaaaacaacttattattcatctctaaatcccagaacctagcctatggtcaagcatatagtgggtgcttaataaatgtttgttaaaagcataaccaaaagttagcaaaaggatgtatactatatggcaataaaaagagactgggttatagaaaatatatatatattgttttccttaattttctactaacttctatatccaagtgagaagtattatttaatatagaaagatattgaatcacttgaatcataatgaatcattttaatcattcaactaaatttattttaattaacaaatacctttatatacctttcctagccttgcataacattaagctaagtccaatctttataaaccagttaactccttagcataatgaacaagttatcttcatttttcttattagagtaatgttagtgaaggcggtccaagtttatatataataattgtaccatgccaaggtacagaagaaataggcttggagaaatcaccaagaaaattattctacctgtctaaaatatggcttttgtatcatacaaaatgaaagacaaatcaagcatgttttaaaatgcagtttccttttcagtaaaatgggaataaaacttacagactatagagtttacatgaaaattatatgtgacaatgcttgtaaatacctggactgtatttgtgagaaaagaccgcgtgctggcagccctcactcactctcggcacctcctcagcctctgcgcccactctggccatgcttgaggagcccttcagcccgccgctgcactatgggagcccctctctgggctggccgaggtcagagccgcctccctctgcttgcagagaggtgtggagggagaggcgtgggcaggaactggagctgcgggcggtccttgtgggccagcatgagttccaggtgggcatgggctcagcagaccctgcactaggagcagtcagcaggtgctgccagccccgggcagtgaggggcttagcacccgggccaggagctgtggagggtgcaccaggtcccccagcagtgccggcctgccggtgctgtgctcgaattctcactgggcctcagctgcctctccgcggggcagggctcgggacctgcagcccaccatgcctgagcctcccccctgctgtgggctcctgtgcagccccagcctccccaaggagcgctgccccctgctccacagcgcctggtccacccaagggctgaggagtgcaacggcgagggaatggcgggcagctccacctgtggcccctgtgcaggatccactaggtgaagccagctgggctcctgagtctattggggacttggagaacctttatgtctagctaagcgattgtaaatacaccaatcagcactctgtgtctagctcaaggtttgtaaatgcaccaatcagcactctgtgtctagctaatctggtggggacttggagaacctttacgtctagctaagggattgtaaatacaccaatcagcactctgtgcccagctcaaggtttgtaaacacaccaatcagcaccctgtgtctagctcaaggtttgtaaatgcaccaatcagtgctctgtggggacttggagaacgtttgtgtctagctcagggattgtaaacacaccaatcagcaccttgtcaaaacagaccaatcagctctctgtaaaacagaccaattagctctctgtaaaatggaccaatcagtaggatgtgggtggggccagataagggaataaaagcaggctgccccagccagcagtggcaacctgctcaggtccacttccacattgtggaagctttgttctttcactctttgcaataaatcttgctgctgctcactttttgggtctgcactgcctttatgagctgtaacactcaccgcaaaggtctgcagcttcactcctgagccagcgagaccacgaactcaccagaaggaagaaactctcaacacatccgaacatcagaaggaacaaactccggacatgccgcctttaaggactgtaacactcatggtgagggtctgcggcttcattcttgaagtcaatgagaccaagaacccaccaattccggacacatttggatcacaatgaaccctcaagaatctaaagctaatgttacttacttaagaaacctaacttgtccgggtgtggtgtgtcacacctataattccagcactttgggaggcccaggtgggcagatcacttgaggtcaagagtttgagaccagcctggccaacatgatgaaaccctgtctctactaaaaatacaaaaattagctgggtatggtggcgtacacctgtggtgccagctactcaggaggctgaggcaggagaatcctttgaaacctggtaggtggagcctgcagtgagctcagattgcaccacttcactccagcctgggtgacagagtaagactccatcaaaaaaaaaaaaaaaaaaaaaaaaaaaaactcaacaactctagaaactaggattttccaatcctgaatgaatatttggctttctagatgctaagcaacgagatgattggcatatggctaagacctccttccaagggccactaggtgacaataacaaggagagaaagtaattaatttgaatcactaaatttgtaacataaccaatcacagagctttatatgtcttgtccccttgccagttctgtccctctctagtctacacctctaatccataattctgagccctacttgccaagtcaactctgatctattctcctcaataagcattccacaacgaataccatctcccttgtcatacttgtggatgctgggaaggggattaacctggtgggaagactgatgaattgactggcagggaacctgtgttctagtccctgctctactccttattagtcccttctctattccttacaaccctatcctttcactttgttgtaggtaaaagaaacaggaaactacattctaggagaggaaaaaggggacatgtaatggtttgttcagaggagaaagttttaagttttgaataaaatagggcaagcagaagaaaagcacactcaggccttttagcgatgtctgaccacatgttgtaaggagccgagaatactgtaaacaagctaatatatcagcaagagtgttctgaaacttaagtatttttctcgtaatgggttatcttgtaaagccaggacagaaataatatgtattagcctataaagggcattagattgctaatctccttcaggttgccacatatttgtgaactaaatgtgctatatattgcccctagtcctccactgaatgtcctgattactgatttgctggtgccatagtgtagcccagagtccctgggctttgggatatgcactgtgaaaaagtatcccctcgtaactgttgcactttgaattcttgttgtttcacaaaagtggtagaaagaagttcagccctggaaaaaacaaaaaactgttggatccagacatgtttcagctggggatgaacattggtgaaaccccctcattaccatactaaaattcccacccacagaggagcttatttgccatttttcatacacgtgacatatgtagcatgaatgacactgtgcctgcgctgccttttctccatctctacatacaatgactcaggtaaccagcccaataaatgccccgttttcactgtttttcaggaatgccctgctttaggaactgtgctcaatgtcctccttacttgttcaaagtaatataattctcttgttaaatcctccttggttatggtcattggactgtcacctgctagcaactgaacccacctgttgtatgggtaacaatgtatctgcctcatgtaagcagaagctagtatgtgggtaaataatcacattattttgtccttttgtttccttatttgtaatataaaagagtaaaataggagtccttattttactaccattagcatggtaaagccagaactaggacttttgtatattcttctgttattgagaattgtgttctcacataaataccgtgctcttccttttcagtggtatgtatattcagatataaaatctctaaagaaaatctgaggtggtaaatccaataaatatttatcaagcactagcactaagcactaaacaaaatactaacaatataatccagaatcacttctgctaccattttaaggtactttttatgtgcgcagcataatcattttatgtgtatttccccatttatatctcatcacatctgatccccattttacagattagaaaactgaggttcagattagtctggtgtacagaactatctgtggcatacagatttgactggtttcaaaacctatggtcttaattctataactgccttgaacataatgcagttaaactccctaacttaaagatgaagaaactgaaacccacagaggttctcttgagagaacgaggtgaaccccggacttctttctacttcttgaattctgtgagcctatactatctacttggcacatgttcattacttatttacataatctggcacatgaatatgttcctaactatctaatattccttggtagcaaactctaaaatagtcctaaattaatcccacctcctaatagtcacattaccgtttaattcctctccaataggtgtgaataaaacctgtgacttgtttctaaccaagtcataaggtatgaaaaaagtgatgagatgtcacttaaattatgaagctacataacattataattcctatcttgctagaagactctctctattgctttttcagctttcatgttatgatgaagaaagcagccatgttggggaggcccatgtagcaaaaaactaagggcagccactagttaacagtcacttaaaaaatgaggccctcagtcaaatagtctgcaagaaactgaatcctaccaaaaaccatgtgagtttggaggataatcttccccagtcaagttttcagatgagatcccagcctggcctatatttcattgcagactataagagatcctgaagcagagaacccagctaagatatacttggattcttgactcacagaaactatatgttgtttaatccgttaatgttggggtaaaattgttatacaaaatgagaaagtctaagttcacatattagtgagagagtgagctggaattttaactctgatctctgtgactcaaagacacatatatctatggtatatgagtacctgtaatgaagtgctgtaaggattaaatgaaacatatgtaaaattttagcacagttcttggcacacaataaacattccttaaatgatttttgttgttgttttaaagttatacaactatgtctactatcaaataaaagcaaatactatttgaaacctcaaaaacaataaaggcttagaggaaatcaattgtaaacacaaatcaagatatattagattttataccctgtgtttatttttatttatttttccataagttatgggagtacaggtggtaattggttacatgagtaagttctttagtggtggtttgtgagaattggatgcacccatcacccgagcagtatacaatgcaccatatttgtagtctcttatcccttgcctccctcccacttttccccaaagtccccacaggccattgtatcattctgatgcctttgcgtcctcatagcttacctcccacatgtcagtgagaacatatgatgtttggttttccatttctgagttacttcacttagaatagtctccaatctcatctaacccaggtcacggcaaatgctgttaattcatcccttttttatggctgagtagtattccatcatatatatgtgtgtgtatatatatgtgtatatatattccatcatatatatgtatatgtatttatatatgtatattccatcatatatatttacatatgtatatatgtatatatatattccatcattatatatatacatatataccacagtgtctttattcaattgtcgattggtgggcatttgggttggttccatgattttgcaactgtgaattttgttgttatgaacatgcgtttgcaaatatcttttttgtataatgacttcttttcctctgggtagatacccagtagtgcaattgctgaatgaaatgctagtactacttctagttctttaaggaatctccacactgtttcccatagtggctgtactagtcccaccagcagtgcagaagtattccctgatcactacatccatgccaacatctactgttttttgatttttttgattatggccattcttgcaggagtaaggtggtatcgcattgtggttttgatttgcatttccctgatcattagtcatattgtgcattgtttcatatgcttattagccatttgtatatctttttttgagaactgtctattaatgtgcttagccccgtttttgatgggattgtttttttcttattgatttgtttgagttagttgtagattctgggtatgagtcctttgtcagatgtatagattgtgaagattttctcccactctgtgggttgtttgcttactttgctgactgttccttttgctgtgcaaaagctctttagtttaattaagtcccaacttttatctttgtctttattgcatttgcttctgggtgcttggtcatgaaatccttccctaagccaatgtctagaagagtttttccaatgttatcctctataattttcatagtttcatgtcttagatttaatccttaatccatcttgtgttgattttttaataaggtgagagatgaggatccagtttcattctcctacatgtggctagccaattataccagcactatttgttgaaaaggctgtcctttcctcactttatgtttttgtttgctttgtcaaagatcagttggctgtaagtatttgggtttatttctgggatctctattctgttccattggcctatgtacctatttttatagcagtaccaggatgttttggtgactatggccttatagcatagtttgaaatcaggtagtgtgatgcttccagatttgttctttttgcttagtcttgctttggctatgcgggccccttctttggttccatatgaattttagaattgctttttctaattctgtaaagaatgatggtggtatttgatggggatagcgttgaatttgtagatcccttttggcagtatggtcattttcacaatattgattctacccatccttgagcatgaaatgtatttgtgtagtctatgatttctttcagcagtgtttcatagttttccttggagaggtttttcaccttcttggttaggtatattcctaagtattttatttatttctgcagctattgtaaaaggggttgagtctttttttttttttcttgagacagagtcttactctgtcacccaggctggagtgcagtgccatgatctcagatcactgcaacttctgcctcccgggttcaagtgattctcctgcctcagcctcctgagtagctgggattacaggcgtgcaccaccatgcccggctagtttttgtatttttagtagagacggggtttcaccatgttggtgaggctggtctcgaactcctgaccttgtgatccgcctgccttggcctcccaaagtgctgggattacaggcatgagccactatacctgacctaggggttgagttcttgatttgattctctgcttggttgctgtcgttgtaaagagagatactgatttgtgtacactagtcttgtatccagaaactttgctgaattcttttatcggttccaggagctttctggaagagtctttagggttttcaaagtaaacaatcgtattgtcagcaaacagtgaccgtttgacttcctctttactgatttggatgcgttttatttctttctcttgtctgattgctctggctaggacttccagtgctatgttgaagaggatttgtgagagtgggcatccttgtcttgttccagagggaatgcttattatgttggctgtgggtttgtcatagatgacttttattacattgaagtatgtcccttgtatgccaattttgctgaaagttttaatcataaagtgatgctggattttgtcaactgctttttctgcatctattgagatgaacatgtgatttttgtttttaattctgtttatatggtgtatcacatttattgacttgcatatgttaaaccatgcctgaatccctggtatgaaacccacttgatcatggtggattatctttttgatatgttgttgaatttgattagctagtattttgttaagggttttagcatctatgttcatcaaggatatcagtctgtagttttcttttttggttaagtcctttcctggttttggtattagggtgatgctggcttcatagaatgaattaagggagggttcctttttttctctatgttgtggaatagcatcaaaggattggtatcaattcttctttgaatgtccggtagaattctgctgtaaatccgtctggtctgggactttttttgttagtaattttttaccattttaatctcattgtttgttattggtctgttcatggtatctcattcttcctgatttaagctaggagtgttgcatctttccaggaatttatccatctcttctaggtttcctagtttatgcgcataaactaggtttcctagtttacagtttatattcacagtagccttgaatgatcttttgtatttcagtggtgccagttgtaatatcccgtttcttttcttaatgaggttatttggattttctctcttttcttggttaatcttgctaatggtctatcaattttgtttatcttttcaaagaaccagctttttatctttgtatctttttttttttcaatttcatttagttctgccctgatcttggttatttcctttttttctgctgggtttgggtttggtttgttcttatttctctagttccttgaggtgtgaccttagaatgtcaatttgtgctctttcaatctttttgatgtaggcgttgagggctgtggacttttctcttggcactccctttggtgtatcccagaggttttgataggttgtgtcattattgcaattcagtttgaagaatttcttaatctccaccttgattttgtttttgacccaatgctcattcaggagcaggttatttactttccatgtacttgcatggctttgaagcttccttttggagttgatttccagttttattccactgtgatttgagagagtgctttacataatttcaattttcttaattttattaaggctcgttttatggcctataatatggtctatcttggagaaagttccatgcactgtagaatagaatgtgtattctgtggttgttggatgaaatgttctgcatatatctgttaagtccatttgttccaaggtatagtttaaatccattgtttctttgttgattttctgccttgataagctgtgtagtgctgtcagtggagtattgacgtccccaactattattatgttgctgtctatatcatttcttaggtctattagtaattgttttataaatttgggagctccagtgttaggtgcatatatgtttaggattgtgatattttcctgttggacaaggcattttaccattacataatgtccctctttgtctcttgtaactgctgttgctttaaagtgtgttttgtttgatataagaatagctacccctgcttacatttggtgttcatatgcatgaaatgcctttttccatccttttaagtttatgtgagtccttacatgttaggtgagtctcttgaaggcagcagatagttgattggtgagttcttatccattcagaagttctgtatcttttaagaggaacatttaggccatttacattcaatgttagtattgagatatgaggtaccgttacattcatagtgctatttgttgcctgtgtactttgatttttaggatttttgtttttgctttttaacttgtatttttgttttataagtcctgtgtgatttatgctttaaagaggttctgttttgatgtgtttctaggatttgtatcaagatttagcgctcctttttgcagttcttgtagtggtggcttgatagtggcgaattctctcagtatttgtttgtctgaaaaagactgtatctttccttcatacatgatgcttagttttgctggatacaaaattcttggctaataattgttttatttgaggaggctgaagatagggccccaatcccttctagcttgtagggtttctgctgagaagcctgctgttaatctgataggttttcctttataggttacctagtgcttctgtctcacagctcttaagattctttccttcatcttaacttttgataacctgatgacaatgtgcctaggcgatgatctttttgtgatgaatttcccaggtgttcttcatgcttcttgtatttggatgtctaggtttctagcaaggctgaagttttcctcaattattcccccaaatatgttttccaagcttttagaattctcttctccctaggaacaccaattattcttaggtttggtcatttaacataatcccagacttcttggagactttgttcggattttcttattcttttttctttgtctttgttggattgggttaattaaaagagcttgtcttcaagcactgaatttctttcttctacttgttcaattctattgctgagactttccagagcattttgcatttctataagggtatccaatgattcctgaatttttgactttttaagctatatattttcttgaatatttctcccttcacttcttgtatcatttttttgaatttccttgcattgggctttgcctttctctggtgcatccctgattagttaaataacaaacctcccaaattctttttcagttaaatcagggatttcttcttgttttggatccactgcaggtgaactagtatgattttttgaaagatgttaaagagccttgttttgtcatattaccagagttggttttctggttccttctcatttgggtagactctgtcagagggaaggtctagggctgaaggttactgttcagattcttttgtcccacaggctgttcccttcatgttgtactctcccccttttcctgtggatgttgtttgctgttagctgaactgcagtgattgttgtttctcttctgagtctagctacccagcaagtctacacagctctgggctggtactgggggttgtctgtacagactcctgtgacatgagccatctatgggtctcagccatggacaccatcacctgttccagtggaggtgatagcggggtgtaatggactccatgagagttcttagctttggtagtttaatgctctatttttgtgctggttggcctcctgccggtaggtagtgctgtccagagagcatcagctgtggtagtatagagaggaaacagcagtgggcagggccccagaactcccaagattatatgccctttgtctttagttaccaggtggggcaggaaaggaccatcaggtggaggcacagctaggtgtgtctgagctcagactcgccttaggtgggtcctgctgcagctgctatgggggatgggggtgaggttcccaggtcgatggagttacacaacttcatggtgtaggaggattatggctgcctctgctaagtcatgcaggttgtcagggaagtggggaaaagccagtagtcacaggcttcacccagctcccatgcaaactgaagggccggtctcactcccaccgtgccctcacaacagccttgagtctgtttccaggcagtgggtgagccaggcttgagaacttaccccaagctacctgtctcctagctgaggaaaaaaaagcttggttcttcccccgcctgtggagtctgcacactggattcacaccctcccccaggttctggccgggaggattctagcctcattcaaattgttacaaagttcagctggaaattttcttctccctgtggtgtttgcccccctgctcctctagctaccatcctgatgagtccctgtggtgccagacaggaatggcctgcttggggacccagcgagctcccagggcctttctgctcctcctctatacccctgtatttcactcatctctctaaattgactcagttccaggtaaggtcggaaacttctcctgcaaacaggccttcagtttctccagtgggagtgtgtccttgggagaggaggctctccctctcccaccttcacagttgtggtactcacagtatttggggtgtcttctgggtcctggagtagcagtccgctttcttcagaaggcctgtgaatcctcttgggattgctggtttgttcttacagtcgatttggagctatgattcacaatgcaaggccctgcatactgctctgtctgtccgagtcagagctgcaatttagtcctgcctcctatctgccatgatgacgcttgattcctatactccttgttaataaacccagtctagtatggctactcttagaatcatatttcaagtcttcattttattattaattagacaaatattcactaaatacctaatatttgtattaggcactagaatacaaagattaatatgacctcaatccttctgcctttaagttttttattgtcaatgtaagacaatatgtagcaacctacgtatgaaaggctatgaaaacacagaggaaagaaaaaaatatattcaaaaaatatttcttaaaaaatgaatgaattgatctacatttcgcattttaattagaatattcagtcaggcaggcctgagcctgagtgaaatttcattgtgtttaatcacaatatagattgtacgatggcttaaccacttaccagttgtgtaactttgggcaaattaatacatctctctgttctttactactctctattcctataatgagaactccatcatcatatcctatgtcatagtgaaacatcctaaactcacaggaaaccaggacttctcatggtggatgagaccattcttcacttacatttcttataataaaatgacaaaagttcccatattaggaggaaaaaactacaatgatagctcaagtttctagggtagtctataatagtttttgttcatcttttcttagtaccacatcccccattaacgtttccctagatatctaatgtgtcttcttgccaccctccaggacctcactgatagttggagtagataagtacaacctgctaatgtattatcagcgaaaagaccccagagatcctgttttatacttaaaaagttatcaccaccagtttatccctacctatatcagaaagaatagtatactctgtactataaaagtaaaatacttcattttcaatttgggaaaaaattgtattgtatgtataattatttttgaaaagggacttgttcccttttaaacacttctacattattataatgtttataattaaaatttaaattttcttctcacacattttggctgagcatggtgggtcatgcccataatcccagcactttaggaggttgagatgggaggatcccttgaagcaggagttctagagcagactgagcaacatagtgggatcccatctcttcagaaaattttaaaaccttagctggcgttagtggtgcaattccatctactcaggaaacctgaggggagagcattgtttgaggccaggagttccaggcagcagtgaggtatgattacaccactgcacttgagtctgggtgacaaagcaagatcctgtctagaaacacacacacacacacagtctcagagctaagacatatagaaccaggatttaaatccagaaggtccaaactacaaagtccatggtctttctaattcatcacaatactccaacagtgctatgcagagaagttccgataaataagatttcttccatgccaaagacagatttatctctccaggacaagcaatcatcagccaagagtctgagtttctcaggaagagccttgaaaatgcaaacacatttttttttatactgagcacagataaaaggttttaaaatttcagcttctgtctcagagacataataataaaacaattgaaaccatttttttagcttactaaacaaattttcactttccatttgcaaatagatcaaggctcattagtgatgtttttcaagacactccagataccaagtgtttttaataacaatgtatttttaagaaaacatgcttgagaggaggcagagaaagagcaaagtagaaggctccatcaattgtcccgcccacaaatgtgtccagaattggtggtttcttggtctcgctgacttcaagaatgaagacgcggaccctcgcggtgagtgttacagttcttaaagatggtgtgtctggagtttgttccttctgatgttcagatgtgtccagagtttcatccttctggtgggttcatgatctcactgacttcaggagtgaagctgcagaccttcgggtgagtgttacagctcttaaaggcggcgcgtctggagttgttcgttccttctggtgggttcgtggtctcgctggcctcaggagtgaagctgcagaccttcacggtgagtgttaaagctcttaaaggcagcacggacccaaagagtgagcagcagaaagatttactgtgaagagcaaaagaacaaagcttccacaggaagaaggggaaccgagtgggttgccactgctggctctctggcagcctgcttttattcccttatctgaccccactcacatcccgctgattggtccattttacagagagctgattggcccattttacaaagaactgattggtccgttttgacagggtgctgattggtgcatttacaaaccttgagctagacacagagtgctgattggtgcattgacaatcctttagctagacacaaaagttctccaagtccccactagattagctagacacagagcactgattggtgcatttacaaaccttgagctagacacagagtgctgattggtgcatttacaatcctttagctagacacaaaagttctccaagtccccactagattagctagacacagagcactgattggtgtgtttacaaaccttgagctagacatacagtgctgatgggtgcttttgtgtctagcttttgtgtctagctaaaggcttgtaaatgcaccaatcagcactctgtgtgtagctcaaggtttgtaaatgcaccaatcagtgctctgtgtctagctaatctagtggggacttggagaatttttgcaatctactcatctgacaaagggctaatctccagaatctacaaagaactcaaacaaatttacaagaaaaaaaaaaacccatcaaaaagtgggccaaggatatgaacagacacttctcaaaagaagacatttatgcagccaacagacacatgaaaaaatgctcatcatcactggccatcacagaaatgcaaatcaaaaccacaatgagatatcatctcacaccagttagaatggacatcattaaaaagtcaggaaacaacaggtgctggagaggatgtggagaaataggaacactttgacactgttggtgggactgtaaactagttcaaccattgtggaagacagtgtagcgattcctcagggatctagaactagaaataccatttgactcaactatcccattactgggtatatacccaaaggattataaatcatgctgctataaagacacatgcacacgtatgtttattgcggcactactcacaataacaaagacttggaaccaacccaaatgtccaacaattatagactggattaagaaaatgtggcacatatacaccatggaatactatgcagccataaaaaatgatgagttcatgtcctttgtagggacatggatgaagctggaaaccatcattctcagcaaactatcacaaggacaaaaaaccaaacaccgcatgttctcactcataggtgggaattgaataaggaacacttggacacaggaaggggaacatcacatactggcgcctgtcgtgaggtgggggaagggggcaggaatagtattaggagatatacctaatgtaaatgacaccaacatggcacatgtatacatatgtaacaaacctgcacattgtgcacatgtaccctagaacttaaagtataataaaaaaaattatatatatatatatatataaacaaatctttagctagacacaaagtgccgattggtgcatttacaaacctttatctagacataaaagttctctaagtcaccacccgactcaggagcccagctggcttcgcctagtggatcccgcgcaggggccgcaggcggagctgcctgctagtccagtgctaggtgccggcactcttcagcccttgggccgtccatgggacctggggcctcggagcagggggcgaggtccgtcgggaaggctcgtgcggtgcaaggggtgggcatgagggcttgggcatggcaggctgcaggtcctgagccctgccctgcagggagatggctgaggcctgacgagaattcaagcgcggcgcgggtgggcctgcagtgctgggggacccggcgcaccctccgcagatgctggcccaggtgctaagcccctcactgcctggggccggcggtgcctgccggctgctagctgctcagagtgcggggctgcccagccctcgctcactcggaactcgcactggcccgtgattgctgcgtgcagccctggttcccacccgagcctctccctccacacctccccacaagcagagggagctggctgcagccttggccagcccagagaaggtctcccacagtgcagaggcgggctgaagtgttcctcaagtgctgccagagcggacgctgaggcctgaggaggtgctgagagcgagcgagggctgctagcatgttgtcacctctcacaaggacaccaatttaacaactatctacaaaaaaagacacattcataagaaccaaaaatcaggtgagccctcatagtacctggttttaatttcatattgttgaaagaggcattgaagaaatagaaaaaatagtcttgactcactgacaccaccacacccccacaacctggcagcagcagcataattcagagtgtctctgggcgctggggaaggaagaacacagcaatgatgagacattgaactcagggctgtcctcttagagcagaaaggaaaactggaccaaactcagctgatatctgcccatggagggagaacttcacccagccctaaccagaggggaatcactgtttccagtggtctcaacttgagttcctgcaaaccctaccaccaagggctaaagtggtctgggtctctaagtaaacataaaaggcagcctaggccataaggccttcaacttgtaagtgagtcctattgctgaactaggcccagagacagtgaactggggaagcacctgacatagtgagacatcagctggggtgggaaagggagagctgctatcacccctcccctaacccaaggctgccgagattgcagctccaaaagagaccccttccttctgcttgagaagaaaacatggaagagtggggaggatttgtcttgcatcttaaataccagctctaccatagcataatagggcaccagttaagagtagtgaggccttattccaggcactagctccaggacatttccagacagaccctgggcccaaagagaaccttctaccttaaagggaaaaacccagtcctagcatttgttacctgctaactgaagagcccttggaccctgaataatcagcagtgatactcacatactacctcaagggctgtgcgtgagccttaggcttgttggcttcaggtgagacccagcacattaccacctgtggtagctgtggggaaaaactccttcttgagaaaagtagagaaaaaaataaaggggactttgccttgaaccttaggtaccagaatggccacagtgtgtcagagaaccaagctggattttgggatccctgattctgtgttttgtttgttttatattttgagatggagtctcactctgttgccacactggagtgcagtggtgcgatctcagctcactgcaacttctgcctgctgggttcaagcgattctcctgtgagcctcccaagtagctgagactacaagcatgcgccaccacacccagctaatttctgtatttttagtagagatggggtttcaccatgttggccaggatggtcttgatctcctcacctcaggatctgcctgctttggcctcccaaagtgctgggcttactggtgtgagccaccacgcctagctgggatccttgattctaagatttgacacttgtacagcacctctggacctgccatgggccagcagagagcccagtaccctagagggtgagttgcaggccaagcagcattcaccacaaactgacttaagagctcttgagccttaaaggaacatcaacagtattctggcagtactctccatagtctgtggtggcagtggctactgggtgaggctcatcctttggaaaaaggagaaaaaagtggaagtgctgtgtcctgtgacttgagtgccagttcagctacagtataatagaaaaccaggtagacttttaaggtatttgactctagtccctgactcctgggtggtacctctggaccctcctggggcctgggggaactcgccatcctgaagggaagaaccatggcctggctggctttgccacatgccacgtatagagccccagagcctttatgaacatcggaagtacctaaggtcttgggtgagatccagtgctgtgatggcttcaggtctaacacagcacagtcctagttgtggtaaccatgcaggtttttgtgtcatgccacctctaattccaggaggctcagaacagaaagagatacggtttcttttgaggaatgtaagggaaaataataggaatctctccctagtaatccagagaattctaatggatcttgtacaagactatcaaggcagtaccctctatgagtctgcaagaaccacagcgttactaggcttgggatgtcatctaaagcagatacagcttaaattatgtgatggttaatattaagtgtcaacttgattgaaggatgcaaagtattgtttctgggtgtgtttctgagggtcttcccagagaagattaacatttcagtcagtggactgaaagaggcagatccaccctccattttggtggaaaccatccaattggctgccagcacagctagaaaaagcaggtggaagaaagtggaaaaaactgacttgctgagtcttctgactttgatccttctactgttctggatgcttcctgcccttgaacatcagcctgcaggttcttcagcttttggagtcttgaacttacaccagtggtttgccaggggctcttaagccttcagcgacacattgaaggctacactgttggcttccctgtttttgaggttttgggacttggactgagcctctactgacttccttgctcctcagcttgcagacagcctattgggaaattgtactttgtgatagtgtgagtcaattatcactaataaactccctttcatatatacatgtatcctattacttctgtctctctggagatccctaatacacatcacgacacccaagttctttcaaatatctggaaagccttcccaagaaggacaaatataaacaaccctaaacagtgaagcctgcaatgaatatctacctcttcaatggccagacactcaagaacatctaccagcatcagcaccattgagaaaaacatgacctcaccaaatgaactcaataaagcaccagggaccaatactggaggaacaatatgttacctttcagagaattcaaaatagatgtgttgaggaaactcaaagaaatccaagataacacggagaaaaaaatcagaatttcatcagataaactaaataaagagacagagataatttgaaaagaatcaagcagaaattctggatatgaaaaactcaattcatgtactgaagaatgcagaagtctttcaatagaagaattgataaagcaaaagaaaaaattagtgagcctgaagacaggctatttaaaatacacagagtattaaaaaaagacaaaaaacaatgaagcacacctaaagattctagaaagtagccacaaaagggtaaatctaaaagttattggcctcaaagacaagactgagaaagagatatgggtagaaagtttattcaaagagataataagaacttcccaaacgcagagaaagatatcaacgtccaagtacaggaagattatgcaacaccaaacggacttaacccaaataatcaaactatttaataaactcacaaagttcaaggataaataaagattcctaaaagcagtaagaaacaagaaacaaataacataaaatggagctccagtatgtctgacagcagacttttcaatggaaaccttacaaactaggagagactcgaatgatttacctaaagtcctaaaggaaaaaatcttttacccctgaatagtatatctggtgaaaatgtcctttaaacatgaagagggaataaagattttcccagaaaaacaaaagctgagggatttcatcaacaccagacccgtcctaaaggaatgctaaagggacttcgatcaggaagaaaaagatgccagtgagaaataactaatcacctgaaggtacaaactcactgctaatagtaaggacatggaaaacacaaaattctataacaacataactatggtgtgtaaactactctcactcatagcacaaagattgaatgatgaaccaattaaaaataataactacaaaaacttttcaagacttagtaaatatgatataaatagaaacaataaaaagttaagaagtgggtaaaccaatttagggtgtagagcttttttaagttttctttttaaaaaaaattgtatattttttgctttttatttttattttttattattattattatactttaacctttattatacatgtaccctaaagttttagggtacatgtgcacaacatgcaggttacatatgtacacatgtgccatgttggtgtgctgcacccattgactcgtcatttagcattaggtgtatctcctaatgctatccgtcccccctccccccaacccacaacagtccccactgtgtgatgttccccttcctgtgtccatgtgttctcatggttcaattcccacctatgagtgagaacatgtggtttttggttttttgtccttgtgatagtttgctgagaatgatggtttccagcttcctccatgtccctacaaaggacatgaactcatcattttttatggctgcatagtattccatggtgtatatgtgccacattttcttaatccagtctatcattgttggatatttgggttggttccaagtctttgctattgtgaatagcgccacaataaacatacgtgtgcatgtgtctttatagcagcatgatttataatcctttggatatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatgatgagcattttttcaggtgttttttggctgcataaatgtcttcttttgagaagtgtgggttcatatccttcgccgactttttaatgtggttgtttgtttttttcttgtaaatgtgtttgagttcattgtagattctggatattagccctctgtcagataagtaggttgcaaaaatcttctcccattctgtaggttgcctgttcactctgatggtggtttcttttgctgtgcagaagctctttagtttaattagatcccatttgtcaattttggcttttgttgccattgcttttggtgttttatacatgaagtccttgcccatgcctatgtcctgaatggtattgcctaggttttcttctagggtttttatggtttgaggtctaacatgtaagtctttaatccatcttgaattaatttttgtataaggtgtaaggaagggatccagtttcagctttctgcttatggctagccagttttcccagcaccatttattaaatagggaatcctttcccccttgcttgtttttgtcaggtttgtcaaagatcagatatttgtagatatatggcattatttctgagggctctgttctgttccattggtctatatctctgttttggtaccagtaccatgctgttttggttactgtggccttgtagtatagtttgaagtcaggtagcgtgatgcctccagctttgttcttttggcttaggattgacttggcaatgtgggctctttgttgattccatatggactttaaagtagttatttccaattctgtgaagaaagtcattggcagcttgatggggatggcattgaatctataaattaccttgggcagtatggccattttcatgatattgattcttcctactcatgagcatggaatgttcttccatttgtttgtatcctcttttatttcattgagcagtggttcgtagttatccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacaatggggtttctagatatacaatcatgtcatctgcaaagagggacaatttgacttcctcttttcctaattgaatgctctttatttccttctcctgcctgattgtcctggccagaacttccaacactatgttgaataggagtggtgagagacggcatccctgtcttgtgccagttttcaaagggaatgcttccagtttttgtctgttcagtatgatattggctgtgggtttgtcacagatagctcttattattttgagatacgtcccatcagtacctaatttattgagagtttttagcatgaagcgttgttgaagtttgtcaaaggccttttctgcatctattgagataatcatgtgggttttgtctttggttctgtttatatgctggattacatttattgattttcatatgttgaaccagccttgcatcccagggatgaagcccacttgatcatggtggataagctttttgatgtgttgctggatttggtttgccagtattttattgaggatttttgcatcaatgttcattaaggatattggtctaaaattctctttttttgttgtgtctttgcccggctttggtatcaggatgatgctggcctcataaaatgagttagggaggattccctctttttctattgattggaatagtttcagaaggaatggtaccagctcctccttgtacctctggtagaatttggctgtgaatccatctggtcctggactttttctggttagtaagctattaattattgcctcaatttcagagcctgttattggtctattaagggattcaacttcttcctggtttagtcttgggagggtgtatgtgtcgaggaatttatccatttcttctagattttctagtttatgtgcgtagaggtgtttatagtattccctgatggtagtttgtatctctgtgggatcggtggtgatgtcccctttgtcattttttattgcgtctatttgattattctctcttttctttattagtcttgctagcagtctatcaattttgttgatcttttcaaaaaaccagctgctggattcacggattttttgaagggctttttgtgtctctatttccttcagttctgctctgattttagttatttcttgccttctgctagcttttgaatgtgtttgctattgcttctctagttcttttaattgtgatgttagggtgccaattttagatctttcctgctttctcttgtaggcatttagtgctataaatttccctctacacactgctttgaatgtgtcccagacattctggtatgttgtgtctttcttctcgttggtttcaaagaacatctttatttctgccttcattttgttatgtacccagtagtcattcaggagcaggttgttcagtttccatgtagttgagtggttttgagtgagtttcttaatcctgagttctagtttgattgcactgtggtctgagagacagtttgttataatttctattcttttacatttgctgtggagtgctttacttccaactatgtggtcaattttggaataggtgtgatgtggtgctgaaaagaatgtatattctgttgatttggggtggagagttctgtagatgtctattaggtccgcttggtgcagagctgagttcaattcctggatatccttcttaactttctgtcttgttgatctgtctaatgttgacagtggggtgttaaagtctcccattattattgtgtgggagtctaagtctctttgtaggtctctaaggacttgctttatgaatctgggtgctcctgtattgggtgcatatatatttaggatagctagttcttcttgttgaattgatccctttaccattatgtaatgtcttctttgtctcttttgatctttgttggtttaaagtctgttttttctgagacaggattgcaacccctgcctttttttgttttccatttgcttggtagatcttcctccatccctttattttgagcctatgtgtgtctctgcacatgagatgggtttcttgaatacagcacactgataggtcttgactctatccaaattgccagtctgtgccttttaattgaagcatttagcccatttacatttaaggtaagaattgttatgtgtgaatttgatcctgtcattatgatgttagctgcttattttgctcgttagttgatgttgtttcttcctagccttgatggtctttacaatttggcatgtttttgcagtggctggtactggttgttcccttccatgtttagtgcttccttcaggacctcttttagggcaggcctggtggtgacaaaatctctcagcatttgcttgtctgtaaaggattttatttctccttcatgtatgaagcttagtttggctggatatgaaattctgggttgaaaattcttttctttaagagtgttgaatattggcccccactctcttctggcttgtagagtttctgccgagagatccgctgttagtctgatgggcttccctttgtgggtaacccaacctttctctctggctgcccttaacattttttccatttcatctttggtgaatctgacaagtatgtgtctcggagttgctcttcttgaggagtatctttgtggtgttctctgtatttcctgaatttgaatgttagcctgccttgctacattggggaagttctcctggataatatcctgcagagtgttttccaacttggttccattctccccgtcactttcaggtacaccaattagatgtagatttggtcttttcacatagtcccatatttcttggaggctttgttcatttctttttgttcttttctctctaaacttctcttcatgcttcatttcattcatttcgtcttccatcgctgataccctttcttcccgttgatcgcatcagttactgaggcttatgcattcatcacgtagttcttgtgccatggttttcagctccatcaggtcctttaaggacttctctgcattggttattctagttatccattcgtctaattttttttcaagtttttagcttctttgccattggttcgaatttcctcctttagctcagagtagtttgatcttctgaagccttcttctctcaattcatcaaagttacactccgtccagctttgttccgttgctggtgaggagctgtgttcctttggaggaggagaggcgctctgatttttagtttccaatttttctgctctgttttttccccatctttgtggttttatctacctttggtctttgatgatggtaatgtacagatgggtttttggtgtggatgtcctttctgtttgctagttttccttctaacagtcaggaacctcagctgcaggtctgttggagtttactggaggtccactccagaccctgtttgcctgggtatcagcagcagtggctgcagaacagcggatattggtgaaccgcaaatgctgctgcctgatcgttcctctggaagttttgtctcagaggggtacctggctttgtgaggtgtcagtccgcccctactgggaggtgcctcccagttaggctactcgggggttagggaccccttgaggaggcagtctgcccattctcagatctcaagctgcgtgctgggagaaccactactctcttcaaagctgtcagacagggacattttagtctgcagaggttattgctgtcttttgtttgtctgtgccctgcccccagaggtggagcctacagaggcaggcaggcctccttgagctgtggtgggctccacccagtttgagcttccctctcggctgctttgtttacctactcaagcctggacaatggcaggcgcccctcccccagcctcactgccaccttgcagtttgatctcagactgccgtgctagcaatgagcgaggctccgtgggcataggaccctccaagccagatgcaggatataatctcctagtgtgccgtttgttaagaccattggaaaagtgcagtattagggtgggagtgacccgattttccaggtgccgtctgtcacccctttctttgactaggaaagggaattccctgaccccttgcactttccgggtgaggtgatgcctcgccctgctttggctcacgcacggtgcactgcacccactgtcctgcacccactttccggcactccccagtgagatgaacctggtacctcagttggaaatgcagaaatcacccgtcttctgcatcactcatgctgggtgctgtagactggagctgttcctattcggccatcttggctccaccctattttttgctttttatatgaacagtgataattaagggtatcaaaatactgttaaattttacttacatataataaaagtatagtaatttttaaaaatattattatgattttaaaattaaaagttattttattttgttatttttcagttcctgggtacatgtgcaggtttgttacatagggaaacatgtgccatggtagttttctgcacctatcaacccattccttagatattaagcccagcatgcattagctatttttcctaatgctctccctccctcattctatgaggccagcatcatgctgatacccaaacttggaaaagacacagcaaaagaagaaaacttcaggcaaggtttggttcaacatatgcaaataaacaaatgcaactcatcacataaacagaattaaggacaaaaactacatgatcatttcaatagattcagaaaaggcttttgatgaaattcaacaccatccatgtttaaaagtttcaataaactaggtattgaaggaacatacctcaaaataataagagccatatataaaaaacccacagccaacattatactcaattggcaaaagctggacgaattccattgaaaaccagcacaaaacaaagatgctctctctcatccctcctgttagtattggaatacctctcattccccctagatagtattggaatacctggccagagcaatcaagtaaaagaaaaaaaataaagggcatccaaatagaaagagagaaagtcaaactatccctgtctccagatgacataattctatatctagaaaactgcatagtcttggaccaaaagctccttaagctgataatttcagtgaagtctcaggatacaaaattaatgtaaaaaatgacaagcattcttatacaccaataactgtcatgctgagagccaaatcaggaacgcaatactattcacaatttacacaaaaagaataaaatacctgggaatacaactaggcagggagatgaaagatctccccaatgagaactacaaaacactgctcaaagaaataagtgatcacacacacacacacacacacacacacacacacacaaatgccatgctcatggaaaggaagaatcaatattgttaaaatggcaatactgaccaaagttatttataaattcaatgctatccctatcaaactaccaatgatgttcttcatagaactaaaaaaaaacaaaaagtattttaaaattcatatggcaccaaaaaagagtccaatagccaaggcaattctaagtaaaaacagcaaagctggaggcatcatgctacctgacctcaaactatactgcagggctactgtaaccaaaacagcatggtactggtacaaaaacacagagaccaatggaacagcacagataactcagaaataaggccacacacctacaaccatctgatcttccacaatgctgacacaaacaagaaaatttagcatatcagagagatatttgcactcccgcgtttgttacaacactgtttatgatagctaaaatttggaagtaacctaagtgtccatcaacacatgaaagaattaataaaatgtgatacatagacacaatggagtactattcagccatgaaagagaatgaaatcttgtcatttgcaacaacatgaatggaactggaagtcattatgataagtgaaattatccagccacagaaagacaaacatcacatgttctcattttgagggatataaaaatcaagacaattgaactcatggagatagagagtaggatggttaccagagtctgggaagggtagttgggggctggggcaggggtaggatggctagtgggtaccataaaacctagaaagaatgggtaaaacctacaatttgatagctcaacaaggtgactattgtcaataataattatacattttaaaataagagtgttactggattgtttgtgactcaaaggataaatgcttgaggagatggataccctattctctatgatgtgattacttcacattgcatgccattattaaaacatttcatgtaccccataaatatatatacctactacttacacacaaaaataaaaaattaattttaaaaaagaaagcatgcttacatttgcgttttagtttttaatatttgcctttgacttatttatttttttatataaatttattgggtacaaatgcaattctgccacacccatagattgcatatggatcaagtgagtgctttcaggttatccataaacaaaataatgtacattgcacacaataagtaatttcttatctcccaccactgcaatacactcaccattctgagtctcctttgtctatcattccactctctatatccatatgtatacattatttagctctcacttatgagtgagaacatatgatactttcctttgtgtgttcacttatttcacttaagataatggcctccagttccatacatgctgcagcaaaagacatgatttcattctttttatggctgaatagtattccactgtgtatatataccacatttttttattcagtcatctgttgatgaacacttaggttgattccatttctttgttattatgaatagtgctgtgataagcacacaagtgcaggtatctttttgatgtgtagatttgttttccttgcatactcactagtggaactgctggatcaaatggtagttctatttttagttctttgagaatgcttcatacttttttttcccatggaggttatactaattttcattcctcccaacagtgaataagtattccattttctccacaccttcaccaacatctgttgctgactttttaataatagccattctcactggggtaagattctatctcattgtggttttaatttgcatttttctcatgattagtgatgttcagcatgctaaaattgcttcttggccatatgcatatcttctttttaaaaatgtctgcataaacattaaaaatatgtcctttgcccactttttaattggatcatttgggagttttgttgtggttttttgacttccttgtaaagtctgggtattaatcctctgttagatgcattatttccaaatgttttttcctattctgtaggcagtcttcactatgttgattatttattttgctgtgcagaagctttttagttaaattaagtctcatttatctatttttgttttgttgcctgtgtttttgaagtcttagtcatatattgtttgcctagaccaatgtccagaagaggttccctagattttcgtctagtatttttatagattcatgtcttacatttaagcatttaattcatcttgagtttatttttatatatgatgagagataaggatccaggttcattcttctgtctatggctaggcaatcttcccagtaccattgatttactagggtgtccttttcccagtgtaagtttttgtcaactttttcaaagatcagttggctgtagataagtggctttatttctgggttctctattctgtttcattgatctatgtgtctgtttttataccattaccatgctgttttattactatagccttgcaatataatttgaagtcacataatatgatgcctctagcttcattctttttgcctaggattgctttgtttatttgggctctttcatagtaccatatgtattttaggcctttttttttttctaattctgtgaaagacggtgtttgtattatgagaaagattgtattgaatctgtagatttctttgagcagtataatcctttaactacattaattcttcaggtacatcaccagaagatgcctttttcatttgtttgtgtcatctacaatttctttcatagtgtattgtggttttccttatagaaatttttcacttccttgcttagatggattcctaggtattttttttcagttatagggtaaacttctttatttcattcttagctcaatcaatattggtgtatagaaatgctacttcttttcgtacatcaattttgtatcctgcatgattactgaattcatttatcaatgctaagagtttttaggtaggcctttaggttgttctaaatataaggtaatatcatcagcaaacagagataatttgacttcctctatactgatttgaggccttttatttgtttctcttggctgcctgccctgggaggactttcagaagtatgtagacaagtagtggtgaaagtggacatctttctcttgttccagttctttaggcattactttaaacttgtcctctttcagtaccatgttagttgtcagtttttagtatatggcctttattattttgatgtttgtctcccttctgtgtcatttgttgagggtttttaatcatgaagcattgctgaatttatcacgtttttctgtttctattgagatgatagtagagtttttgtccttaattctgtttatttaatacatcacagttatttacttacaaatgttgaaccattcttgcaagcctggtataaaacccactttattgtagtctattatctttttatgttctgttggattcagtgtgcaagtattttcatgagaatttttgtgtctatgttgatctagaatattaatctacagttttctttttatgctgtgtccttgtttgcttggttttggtagcagggtgacactgggcttgcagaaagaattagggaggattctctcccactcaatattttggaataatttcaaaaaaatggtattagttattttttgtatgtttggtagcattcaactaagaatacataggctatggggcttctttttgttcaaaaaactttattacagatttactctcactactcatttttggtcagttctagcttttgcattcttctattttaatctgaagaggctgtccatttctaagatttacccattttctctagattttccagttcatgacatacaattctttgcatttatctaataatcttttgaatgcttgtggtgtcagttataatgtcttgttacatttcttattttatttatttaggtattcctcttcttgtgtattctagcctgcagtttaccaatttgtttatcttttcaaacaatcaatatttcatttcactgattttaaaatttttttctgctgtctatttcattttgttctgttcgtggttcagtcctgggagagtgtatgtccaggaatttatccatttcttctagattttctagtttatttgcatagagctatttatagtattctctgatagttgtttgtatttctgtgcagtcagtggtaatagcccccttatcatttcttattgtgttctttgaatattgtgatggttaatactgagtgtcaacttgattgaattgaaggatacaaagtattaatcctgggtgtgtctgtgacggtactgccaaaggagattaacatttgagtcactgggctgggaagggcagacccatccttaattgggtgggaaccatctaatcagctgccagtaaacataaagtgggcagaaaaatgtgaaagggagattctggcctagcctcccagcctacagctttctcccatgctggaggcttcttgcccttgaacatcagactccaagttcttcaattttgagactcagactggctctccttgctgctcaagcctacacacaagttattatgggaccttgtgatggtgtaagttaatatataataaattctcatatatatatatgtgtgtctgtgtgtgtgtgtctgtgtgtgtgtgtgtgtgtgtgtgtgtgtgtgtgtgtgtgtgtatacttttagttctatccctctagacaaccctgactaatgcagattttagtaccaggagaggttctagaggaacagaatattaaggatggagttctttcgttggttttggggtttctggaattggctgcttaatatggttagacacaaaaatgctaggactctacttctaatagtatggagaacactgatagtccttgacatgaactgtttagagagtatacaaaataaatgcatttgacactcctaattcaccatttgtgagaggcaaggagtttagtgagtctacacataatacctttgaccatatgtggagaaccaaggaacataatgatgctggttggttgctcctaatttcagtgaacaaagtaatgaaagaaaataatgaacccagggattctgtctcccagcttcagaaacaggtactgagcctcaaatctgctaagattgccctgagtgagagtcttatatcctctagagaaagagctgaaactggaaaaacagacatgagctcttataatgtgagtggctggcctgcaacaaaaggtgcatgcacagcctcatcaggtgtctactgttaaagtgagggcattgattggaaagaatgggaccctggaacttagaatggggatgtgtgggagaaccctgatgaagctggggacactgagtttgtaaactctgatgaatcttttttgccagaaggaacagcttccccaaccccagtagtggcaacatccccaccccaactcatgctgccatcagcctgtcgatctttgtctgaggagataaaccctgtgctgcctgaggcaacagtgatggcctcccctgaggcagttgctaagcaaaataatgttgattctcttcaggagccaccccaacaccgctgtttgcttctagacctataactaaagtctcagtgggcccctagaggtaagggtgagagtgtgaacaatgatgaggtgtgctacactcgaactgtttcggttctctaatttatataaacagaaatctggagaacaggcataagaatggattttaagggtatgggataatggtggaaggaacacagacttggattaggctgaatttattgatttgggaccactaagtagggactctgcttttaatgttgcagctcacggagttaaaaagaggttctaacagtttatttgcttggttagctgaaatacggattaaaagatggcccactgtgagcgagctggaaatgcctgatctcccttggtttaacatagaggaagggatccaaaggcttagggagattggtatagtggactggattagtcactttagacctactcattccagctgagaggatccagacaatatacccttgacaaatgccttgtgaaatagatttgtgagggcagcacctgcatttttaaagagccctgtaattgctcttctctgtatgtcagatttaacagtgggaaccacagtcactcaactacaaaatttaaatacaatgggaataattggatcccaaggtggcaggagataagtggtggtactcaaccatcaaaggcaaggtgggcatagctaccgtcatggacagcagaggcaaagtggcaaacagaatagtctgacttgtgtggagctctggcattgactaatcatgatgttcctagaaattgataggacgcctactgcattctgcttgtctttatacaagcagaagacttcaaggttgaatggacaaaagactaatttcaataataaagacagagaatcatggcccctcaatcaatttctagacttgagccattttacagacccagaaccccttgaatgaaggggaagtcgggtccccttgaggaaggacctcactacattactgacaatttatgcagtgaatctttctcccatccttccccaaagagaccactggcattttgtcagtgtaactgtgcaactggggaaagggaaataatcagacattttagggactactggacaatggctctgagctgatgttgattctaggggacccaaaacatcattgtcatcctccagttaaagtaggggcttatggaggtcacataattaatggagttttagctctgacttacagtgggtccagtgggtccctcaactcatcctgtggtcatttccccagtgccaaatgcataactggcatagacatacttagcagcaggcagaacccccacattggctccctgactggtagggtaaggactattatggtgggaaaggccaaatggaagccattagagctgcctctacctagaaaaaatagtaaatcagaaacaatatcaatccctgcagggacttcaaagattagtggcaccataaaggacttgaaagatgcaggtgtggtgatttctaccacatccccattcaactctcccatttggcctgtgcagaagacagatggatattggaaaatgacagtggattattataagcttaaccaagtggcgactccaattgcagctgctgtaccatatgtggtttcattgcttgagcaaattaatacatctcctggtacctagtatgcagccactgacttggcaaatgcctttttctccattcctgtccataaggcccaccagaagcaatttgccttcagctgcaaggccagcaatataactttactgtcctgcttcaggggtatatcaactctccagctttgtgtcataatcttatttggagagaccttcatcgctttttgcttctgcaagatatcacatgggtccattacactgatgacattatgctgactggatctagtgagcaagaagtagcaaacacactggacttattggtgagacatttgcataccaaatgatggaaaataaatccaactaaaattcagggaccttctacctcagtaaaatttctagggtacagtagtctggggactgttgagatattccctttaaggtgaatgataagttgctgcatttgacctctcctacaaccaagaaagaggcacaacacctggtggtcctatttggattctggaggcaatgcattccacatttgggtttgttactctgccccatttattgagtaacagaaaatgctgccagttttaagtggggtccagaacaggagaaggctctgcaacaggtccaggctgctgtgcaagctgctctgccacttgggccatatgacccagcagatccaatggtgcttgaggtgtcagtgtcagatagggatgctgtttggagcctttagcaggccaccatatgtgaatcacagaggagggctctgggattttggagcaaggccctgccattttctgcacataactactctctttgtgagagacagctatttggcttgttactgggctttggtggaaactgaaagtttgactatgggtcatcaagtcaccatgcgaattgaactgcctatgatgaactgagtgcattctgactcatctagccataaagtgggtcatgcacagcagcgttccatcatcaaatggaagtggtatatatgtgattgggctcaagtaggtcctgaagcacaagtaagttacctaaggaagtggcatggtgttcactcctgccactctgccttctcttccccagtctgcactgatggcctcatggggagttccctatgatcagttgacagagagacagaagactagggcctggttctcaggtggttctgcacgatatgtagaaaccacctgaaactggacagctgcagcactacagcccctttctaagacatccctgaaggacagtggtgaagggaaatcttcccagtgggcagaactttgagcagtgcacctgctagtgcacttttcatggaaggagaaatggtcagatgtgtgattatatactgattcaagggctgtagccaattgtttggaagcatgatcagggacttggaagaagcatgattggaaaattggtgacaaagaaatttggggacaaggtatgtggatggacatttctacatggtcaaaaactgtgaaaatatttgtatatcatgtgagtgctcaccaacaggtgacctcagcagaggaggattttaataatcaggtggataggatgactcattttgtggataccactcagcctctttctccagtcacccatgtcatcgcccaatgggcccatgaataaagtggccatggtggcaaggatggaggttacacatgggctcagcaacatggacttccactcagtgaggctgacctggctatggccactgctgagtgcccaatttgccagcagcagagaccaatacctaacacttaatatggcaccattccttaggctgatcagccagctacttgctggcaggttgattatattggacctcttccatcatggaaaaagcagaggtttgtcctcactggaatagacactcattccagatatgggcttccctatcctgcacgcaatgcttctgccaagactaccatccatggactcaaggaatgccttatccaccgtcatggtattccacacagcattgcctctgagcaaggcgctcactttaccgctaaagaagagtggcagtaggctcaggctcatggaattcactggtcttaccatgttcctcattatcctgaagcagctggattgatagaatgatggaatggctttttgaagtcacaattacaatgccaactaggttacaatactttgcagggctggggaaaagttctccataaggccgtgtatgctctgaatcagagtccaatatatggtattttctctcccatagttgggattcatgggtccagaaatcaaggggtggatatggaagtggcaccactcaccatcaccccagtgatccactaacaaaatgtttgctttctgttcccgtgaccttatgttctgctggcctagaggtcttagttccagagggaggaacgctgccaccaggaggcacaacaacaattccattaaactacaagttaagattgccacctggatactttagtctcctcctacctttaagtcaacaagctaagaagggagttgcagtgttggctggggtggttgacccggactatcaagatgaaatcagtctactactccacaatggaggtaaggaagagtatgcatggaatacaggagatccattatggcatctcttagtattaccatgccctgtgattaaggtcaatggcaaactacaacagcccaatccaggcaggactgcaaatggcccagacccttcaggaatgaaggttttggtcactccaccaggaaaaaaaaccatgacctgctgaggtgcttgctgaaggcaaaaggaatacagaatgggtagtcattaataccagctatgaccacatgaccagctgcagaaatgaggactgtaattgtcatgagtatttcctgcttggtttgttaaaaacatgtttgtgcacgtatgcacttgtactaagaaaatatcttcattttatttcctttttcccttatcatgtgacatgagatttactgacttcatatcagcatttaagtattgttaactttatgtaatagtatttgggttggggattggtgcatttctggttgtatgaaggatcgttgtattatgttaattgtaattatgacctttttgctgtctttatttgaagattatgtatgctctcagtagagcgtatgggttgaagttgacaaggggtgaacttgtgatggttcatactgagtgccaacttgattgaattgaaggatacagagtattgatactgggtatatctgtgaaggtgttgccaaaagagattaacatttgagtcagagggttgggaaagtcatacccacccttaattgggtgggtgccatctaatcagctgccagcaaatataaagccggcagaaaaatgtgaaaaggagagaaaggcctagcctcctagctaacatttttcccccatgctggacacttcctgtccttgaacattggactccaggttcttcagttttgagattcagactggctttccttgctgctcaagcgtgcagacagccaattacggtaccttgtgatcatgtaagttaacacttaataaactcatctatatatgataaatatcaagaatatatatacatctctctcctattagttctgttcctctagagaaccctaatacaaatatgctctctttttgaagcatgtttttaaatttccatgtatttgtatactttcctaagtcctcttgttattccactgtggtctatgcagatacttggtatgatttttatttttaaaaatttgttaagatgtgttttgtggcctaacatatagtgtatcttgcagaatgtcccatgtgctgattaaaagaatatatactctgcaactgggtagaattttctttttttttgagataaagtctcgctctttcacccaggccagactgcagtggtgctatcttggctcactgcaagctccacctcccacgttgacgccattctcctgcctcagcctcccgagtagctgggactacaggcgcctgtcaccgtgcccagctaattttttgtatttttagtagagacggggtttcaccgtgttggccaggatggtctcgatctcctgacctcatgatccacctgcctaggcctcccaaagtgctgggattacaggcgtgagccactgcacccagcctagaattttctaaaaatgtattttgagtccatttggtctaaagtccaatttaagtccagtgtgtctttgttaattttcttgataatctgtccaatgctgtgagtggggtattgaagtcccctggtattctgatattgcaggctgtctctccctttaggtctagtaatatttgttttatgaatctaagtgctctggtattgggtgcatatgtagctagggttgttatattctcacgctcaattgatccctgtgtgattatataataaccttctttgtcttttttttaactatgttgatttaatgcctactttatgtgatatgagtataaccattcctgctcactttcagtttccatttctatggaatatcgttttccatgtctttattttcagtctatatgtgtctttataagtaagaacagtttcttgtatgcagcatatagtcggatcaagtttttttaaaatccattcagacaatccttatcttttaagtggagaacttaatatatttatgttcaaggttattattagtatgtgaggttgtgctactgtaatgttgttaatagtttactagtagttgtaaaaattctttgtttctttatttctgtctgtttctatttgtggtgtagtggaattctgtaatggtgcaatttgattcctttctcttcctcctttgtgcaattgctttacaagtgaattttatacttctatgtattttcttgatggtgactattgtcccttccatgtttataagtcctctgagcatttcttgtagaactggactggtggtaataaagtccctcagcatttgcttgtctgggaaagactttattccttcatttatgaagcattctcttgctggatatagaattctttactgacagtttttttctttcagtactttgaatacgtcatcccattctattctggcctgtgtggtttctgctgggtagtccactgtgagtcacatgtttttctcttgctgttttttagaattcattctttcactttgactttagaatgtctaattgtaatatgccacaataaagtcctttttgccctgtgtttccctaaaaattgttgtgcctcctggatctagatgtctaaatctcttactagacttgaaaattttcatctattaacttgttaaatagatttttaaactttttgattcttccctatccagaatactaatattttataagtttgattgctttatgcagtcacaaatgtttcaaaggctttatttttttctttatattttgcctgacggaattatctcaaaagacctgtcttcaagttctgaaattctttcttctgcttggtttggtctgttgttgaagcttttgcacatattttatatttacttcaatgatattttcagttccagaatttctttttttaaaaaagatatatatttccttggtaaatttctcattcacattctgaattgggtttatgatgtctttgtattggttttcagatttctcttgcatctcattgaacttctttaaaatcaatactttgagttatctggaatttcaagaatttatttttggttagaatctgttgttggaaaattattgtgtttctttgagggcatcatatcacctcattttttatgtttttcctgtgtctgtatgtcaatttatgtgtatctggtgtaaaacttatgtttatatttacttttgttgggagaggagcttttcttgaaggtgtgactatgatgatggttgaatggggttgtttggttttgcttctggatttatgcagtggtgaaaactacctggttttccttggctataaatagcattagtggcgtctgtggattcctcagtgtgttagggcatggttattgatggaggctttgttgcagttgtgctggatatttgaatgccagatggacccttcaggtttcagtggtagtggtgatgagctattcatgtttgtccttgtgacctggagcagtatatgctggcatctgtgttgggagttctaggcaggctgattcttgggcctctgggtggctttcttgcatgtcaattgtagtagtgctatacgaggcaagtgagtgggctcttgagttcctgggcagctgagatgccataggcaatggtggtagcagcagtggtgaagtgttctcccaggtcccaagccctgtgctcttgtgttgggagtagttgcagggggttgtatgagctggtctctgagccagcaggtggcacttgcaggtagaaacaagctgatgaggtagcagcagggtgttcatgcttgacttttgttccccaggacaagtccttaggtgtcctacgcactgggatgggctacaaatctctcagaagcctggatcccacactctgtcttagaagatggaaaaaaactgattggaagttgactgggcaaacctgtgcttgggcctcctgatggcaagtgcatgcatcagccatgacagttatggggcaatcctaaggtccctggtaaaatgtttgggggaggggtaacagcccctgtgctgaggtccttccacaaggtaggagtgggatcctggtcccagctgtcacagccttggccagcaagtgcacatcccagcaagtctccctccccagtcccagccaaccttatacttcagtcagatgaggtagttcatgcttcacttgcaacccaaaacctggccataagagcacctgcccagctcaggaccaagcctgcatagcaactctcatcctgctcagttcctgggggttgcctggttccagcaccagtggctgaaggccatgccagtctcactagtcatggaagctcatgccccactcaagcatcacttccaaaagccacaacctgactaaggccaatagtttccaaaaccatgcaccgtttgttaggagctagtattgagagtagtgtcttactatagccacttaggtctcagacaggggatgggactcagggtatgttatctcttatagttttctggccactccccaagtctgattcatctcccttattgcggattttctcctggtccctagctgatcctagctggtaacaataacataatttttcagtaacattttccaaaaccagatctatgctcttgcatgcctatcaatacccactgttttcagcaaaagtggtttttgccttagaggatgtgatactgtgatatgacaagaaatatatatatttggtcttcattcccagttcctggtgcagagttcctaaaacccttgtaatttcctaagtgatacacgtgttaggagtatcttttattttaatatttgcttcctggccctggtttctgacccagagctcctaaatcacttggaatttcctgggagataggaatattttgttccaatgaaggaacaactcttgatgggctcctggatagcttcagaataaaggctgcttaccagcttaacatatggggctttaagagcttctgggatggtgaacatatccacatactaagagggtggcacactcccaactccatgtggacacagaagcttttgtgctcaggacgcttccagacctagtcctatgtacatcttcatctggcttttcatctgtatcgtctatcatattttataataaaccagtaaatataagtaagtgtttccctgagttacatgggtgatcacagaaaattatcaaacccaaggaggggtgtcatcaaaattactgatttttagcaaattcaaacatcaatgtgggtaatatggggccccctgcttgggattagcatcagaaatggggggcagtcttatgggtctgagctcataatctgtggtgtctgcactaattccagctggttattgtcataaatgaattgtagggcacacaattggtagctggagaattgttctgtcatatggaaaacagcgacacatttggtgccagaagtgttgagagttaaaaaaaacaaaaacaaaaacagtaaatttttcctatttaaagtggctaggacactggggttcccctcagtaaacgtcctctgtcagcaaccacctatcatctctagaacagaaaaattaactccgaatcctaaccgtagagtggatcaatctgccccagttggcttatcttaaatggatgtggcatatacccttaagccagtcctgaagccccataaaaaaccaactccagagatcagcactctcactagattcctccaagtcagctttcacttgcttacaccatttactccttgttctcagtactcttgttgccttatttttttccttctccttatattatctccatgttgctatttctgctttgtggagagtctttaggtaggagacccatgtttgaattcccaaatcttactgactttagcttccagtggaaacactttacttcaggctttctgagaccagaaactagggaccccctctcccaatgctttttatcagggcaggaagattaaataagaacaatgtgtctaaaatgaatttgttggtctttgacattagttttttaaatgaatatacaagattattccaaataatttagctttagggttagaatggatcttaaacgtcatctggtatacctcccactattgccagcactgtcaatataatgtaattttcttacagtatccttccattggggggcagttatcattttattaaatactcttgaccctatgaggtattacacgtcatcttggaaagcagtgacttgtttcatagtggtttctagtccctctgagaatgctctagacaatgaccataatttttctttttaaggaatgacatgctcaatttcttttttttctcctaaaatttaccagaggtagacccaggatttgtgggtttgtgggctctgaagcttatgaagactctctttaagaaaccgaaaacaatattatgaatatgaaatcaggttcaagacctttaaaggacacatgcaagggagaaacccagaaatttaagttttgtagcttcagggtatatctgcctttatcaggactacacttaaatgattaaatatttaaagtatgctttatctcatttattgtatgaagtagctgctgttgttatttctattccaaatatgagaacatcaagtcctccaaagttaagaaacatgctcaagatcacacagcttgtaagttgcagaaccagttcattaaatgtttaggaaaatggacttgctttccctctccatcgtagttattatcctacagccaatctctggtttatctaaaccactcttaaaagtgtatattcaattcaaatagtatgaatagaacacttactatatgtcaagtaatacacagtgctatgcatttcacctattatagttagagttaattattttcagatttacttgaaccttctctggggaacaaactacagcgtagctctacatcatctctgcctcccagtgttcatgcccctgtataatctctccctttgagtactggaaggacctgtgacttgctcttacaacataatatgacaaaggtgataggatggcactcacatggttatgttacattctaaacaactctaccctgctaggaaatctgccctagagagctggtttgatgaaataaacagctatattggaaaagcccgtgtggcaaggaactgctggcagcatctaggaaatgcagaagatagcatctaagaactgcaggcagcctctaagatcagagggtggcctccagccaacagtcaccaagaagccagtgccctcaatcctataaaaggttgttgaagtctgctaacatgcctaatgagcttagaagaggattcttccctagtcaaccctccagataagaaagcaacctaaccatcatcttaattattgactttgtgagatcccaagcagatgacacagctaagtcatgtctgaactcttgatccaaataaactattatataataaatatgctattttaagtcactaaatttgtgacaacttattacacattaattagataactaatacagattctggtaatgatagtggggtgctgctatgacaaatatacaaacatgtgggagtggctttgggcacaggcagagtcgaagttggaagaattttgataatcacaaatgaaaacctaagtcttaccttttagaatcagatgccataaaaataattcccatttttcccccctgaatattctgtctgtgtattggggccatatttgacaattccctacctttacccatatgttaattacaagttctaaaataatatctttgcttgttcaaacctacaaagtgaattgcttatttttgcttagattcagaagacacaaatatttatggaaaatgtattgactgtcaaatactgagttaaattatttcttttatatatgttgcctcatgtaatccccataaaaaacactgtgtgttaggcattgctatccccattttatacttggaaaaaaaacaccgagttccaggagacagggttggtaaggaacctaagacacctctcaggaaaagtttttgttttaatttgctggattcaaagcatcagagtatgcctagagaatgactagcattcctctttgctgcaagtttctttgctcggtaacaaatttcatttcagtctatcaagacaactttttcatatgcaacattattaatatgaaaagtggtaggacagcactttagaatttacaaaaacattcacatacaatctaacttgatcctcaaaaagatcttgtgaagacagtattaatgtcccaatttagagatgtagaactaaggttcagaaatagcaggagctttgcccaaatttatacaattagataaaagaggatatcctgctcagcatgaacatagtatctagcatgcaaccataatcaataatcgtttagagactgactgactgactgaatgaatgaatgaatacattaatgttttattccaagggcagtgctcttttcgttaaagcagcacctccatgaaacaaatcagaatttaattctgagtaccttgttctctagtaaccagcaccacaaaataacagttttataaattaaaaggaaaaataattgagttatattaaattacttattcatctacacatacaccagagtgtccctcacctctgtcttgactcatctagttctgtctaaaaactctcatccattctccaccttttcctccctcctcctcccattcttcattggtttgttccattcctactcacctttaaagccttagctcagaaatcatctactttgagtggatcacctgaggtcaggagttcaagaccagcctggccaaaatggtgaatcctcgtctctgataaaaatacaaaaaaattagacaggtgtagtggcatatgcctgtagtcccagctactcgagaagctgaggcaggagaattgcttgaacccaggaggcagaggttgcagtgagccgagattatgccattgcactccagcctgggcaacaagagtgaaattccatctcaaaacagaagaaaagaaagaaaagaaaaaagaaaagaaaagaaaagaaaaagaaaagagaagagaagagaagagaaaagaaaaaagaaaagaaaagaaataatctactttgagtacctagcccacctagtccaggggcccctcctctgtgttcccatagctcatgctgcttatcttattgagatatggtgactcatctcaccattaggcaactggttttattcacctctgtatcacttatgcctaacgcaatgtcattgcatagtattcatgcatatatatatccatcataatactggcttgaactaaattaaatacccgctagctggaaccctgtatgcaaaaggctctattctttgtcattacttataaggggactgaagagtaaatatcagaattgaaagtctggcatcatgttgctaaacagttccttggcaacacaacaggtgtatatataatgagaataatagcacaaacattacattttaaaatattactccccacaacagcaacttgttgtttgcaaactccagccctgtcagagattccttctgcttctggcctccagactcatgatgcagcaaggcagtgatttttaaatttattattattattattattttcataataaacaaatacattgaaataatgaaattctgaggctctgtaatttttcaggagaaaaataaaataggaaagatcttgctaaattcttaatcaggccacatcatttccttcttaaaatctctcaatgattccctcacctaaagttcctcacccttactctatgcatcttggttcaccaggctccatactccacaccatgtaatccagccaacctgaattaatatttatttcccaagcacattaagctgttccaggccactatgtctctccttacaatcttacagcgtagaatgtccttgtatgccttatctatgcccagcaaaatcttagtttctcatggcaatgcttcctcagttataatacaccataatgctttgtgcccacactgtcctctgtaatacattctaatttataacctctgtgacactgcagtgtacctatttgtggatgctataatttccaccctgagctccttaaggacagagactgaatccgtctcattcattgttgtattcctagcacccagtacaaattttagcattgagcagacacttagagaatgtcaacgaatcaacataccagtggttatgaagacactgctcaaggcctaggaagaattaagaatgctcttctgcctgagactgggttagaatctacattctggaagcaatacttcaaagttactgtctagctcaaagactttaatgtaaaactccccagccttgattaacacctgttcatttgaaccgccaacccagacatcctggttcgttctcttatatgtgcctatatctttcttgaattcaaaattcaacaagcatggattgaggcacctacatgtgccacatactacatactaggtactgaagaattcataatggacaaaatataatttgtttcctcaaggagctcctaaatgagtgatatcattaagtcattactgaaacaacctatattatgatctcatcacactgagacacatagggattgattaacttaaccaagaccacatacatttgtaaggccattcttcaagtatgttgaactatgcttcatttatgttagaaatatgggtgaactggggatttttaagatgcatatgtccagggatgcaaggtaaattctagttctgccttcaataaattactcctttccacaagtcctggaaggagttgtatgcatacaggaaacaattaccagtgaaggtagggaggacattttattataagctgtggtttagatctcaaacctcaaaacagagaagttcaatataagctgagttgaactagaaggagcactcttttttatttaatattgttgagtataaatggctttaaatcaaagcatgatgtgagaccaactaattttatttttctcaatccctaagcatccaggtatgaattcccaatcctaattatatgactaaaggaaactcaaaccataactggagaagcaacactgtgacttgaacctaaaatcaagcttgcatttggaccctagattcctccataaatgttaattccctttttcactataccatagctgtctcaatagacttacctatggtcaaaaactgcataattgataaaaccctaaatccacagagaccaaaaagcagagtgttcaccaatattttaggacttcaaagtattggcatttgtagggaaagcatgaaagttatatgcaaatcaccataaatgtacatcaatgggaaaaattgaacatcaattaaaatggaaattatataatatttcatataatcaaatttaaaattgcatgagattggaaaatatagctttgtctatactttctaaatgctagagacaatgctggtttattactgcgagagtgaaatgagcagtattagtcccaattaagagtgaaattctgataattatttaagattaattgaagcttgttgacagactcaagagagccctgtgtgggaatgtatacttgcattcacttaaacaggaaaaacttcacccttccttatttttctttatcttgtgacaagttactcttatgagatagctattttgactcttacttggtaggcttactcctatagtaataaattgacagagtgtttctttgtaggtctgtctgtaggacctaaatacataaaagtataccccttacagtattttaaagcagtccatatgaaagtcacataaacaaaaattgtttttaaattgatatagaaatgtattaagatatatatatcctttgaccctgtaattcaaattctgagaagctatcataaggagacaaaatgagacctagcttcattgatcaagacgttgactacagtaatatttatagtagcaaaaatctggaaaccagctaaaagctcaacatcagacttggcacattaataaattgaatataattatttaaaataatgttcacaaaaatatttagcatcaataaaaccgagaatataacactaatgaaaaagataaaacagaaaattacatgcaggatgcaataccatctatgaaaaagaatttgtacagaaggaaaaaaaaaaaggaggctagtccctggcacaagggcactactttgttcgatcagttgttcttgaacagaaacaaggaagggagggagggaaaggaaggaaactaagaagtccaaaaagttgtctcgaggtagaaaacatcagcaaagttattctctacttctcttaatacatttctatatacttttcaaaagttttacgtaagagagcgtataatcaaaatgaatacatagaaaaattaatatagaaaaaatattaaaacaataaggacaaaaccatcaatctaatatcctcatgaaacttcagtccatttcaaaaccttcccacaactactattatctctggaaattagtgtttctaattaagagaaaaatatgcattaaataattagtgaaatttaactcttagaataaagagtattcatgaataaaatatcaactgagaatgaaattagctatgagtacagaaataactctggaaattccaataaaattaaactatatgtttctaaataacccatgagtcaaagtgtaaatcacaagggatattagaaaatatgttagcagaataaaaataaaaacaaggattacaaaaattaataggactgagtaaacactgcttagaggaaaatgtatagctttaaatgactatatctgaaacaaataaaatcgtctaaaatcaataactttcataccttaagcttctgccttaggaaaccagaaaaaagccctcaatctaacataaaaaggtaaacaattgagattaggtgggaggcaaccaaaaaaacacaaaacaaaataaattaaatacagaaaaatcaatgaaaccaaaagttgtttttttgagaagattaacaaaattgacagatctttaaggagaatgaccttgaaaaaaagggaagacacaaattatcacaatggggaatgaaagaagaaacattagtactagccacacaaaaattaaaggaattgtaagtgatattataaataacttgttatcaaaaattacttatataacattgaaaattaaattgactgactaaaaaaaagaaaatctgaataggcctgtattaagtaaaggaattgaattcattctctatcgttaaaatgaccatactgcaaaagcaatttattaattcaatgctattcctatcaaactaccaatgacattcttcacagaacaagaaaaaactattttaaaattgatatggaaccaaaaaagagttcaaatagccaaggcaattctaagcaaaaataacaaagccagaagaatcactctacttgacttcaaactatactacagggctactgaaaccaaaacagcataatactcgtacaaaaacagatacatagaccaatggaacaaaataaggagcctacaaataaggctgcacacctacaaccatctgatcttcaaaaaagtttacaaaaacaaggaatggagaaaggggtccctattcaataaatggtcctagaataactggctagccatatgcagaagattgaaaatcaattccttccttacaccatatacaaaaatcaactcaagatggattaaagacttaaatgtaaaacataaaactataaaaaccctggaagaaaacctaaaaaataccattctggacataggccctggcaacaatttcatgatgaagactccaaaagcaattgcaacaaaaacaaaaattgacaaatgggatctaattaaactaagggcttcttcacagcaaaataaactgccaatagaataaacagacaacctacagaatggaagaaaatatttgcaaactatgcactcaacaaaaatctaacatccagaatctccaaggaacttaaacaaatcaaataagcaaaaaacaaacaactctattaaaaaataggcaaaaaacatgaacaggctgggctcagtggctcacacctgtaatccctgcactttgagaggctgaggagggcagatcatttgaggtcaggagttcaaggccagccttgccaacatggcgaaatcccatctctactgaaaatacaaaattagctgggtgtggtggcaggcacctgtaatcctagctacttgggaggctgaggcaggagaatcgcttgaacccggaagtggagtttgcagtgaaccgagatcatgccactgcatttcagcctgggtacacagtgaggctctgtctcaaaaaaacaaaaacatgaacaaacacttctgaaaagaagagtatacatgtgaacaagcatatggaaaaaatactcaacatcattagtcattagagaaatgcaaatcaaaaccacaatgagatatcatctcacacaagtcaaattggctattattacaaagtcaaaaaataacagatgctggtgaggttgtggagaaagaaaatgcatatatactattggtgggaatgtaaattagttcagccactgcagaaagcagtttgaagatttctcaagtaactcaaaacagaactaccctttgaccccgcaattccattactgagtatacacccaaagagatataaattgtttaactagcaatttaatcaaattcagtctaatgtaatccttatggaaggcaatttgacaatgcttatcctaattaaaaatctacctatcctttaagccagcaattctttttctaggaatttatccttacagattatacttgcacatgcgtaaaatcacttttgtacaagaatattcatcatcatggcattgtttataataatgggtaatactaggctgggcgcggtgtctcacgcctgtaatcccagcagtttgggaggccaaggcgggtggatcacgaggtcagattgagaccatcctggctaacacggtgaaaccccgtctcaactaaaaaaatacaaaaaattagccgggtgtggtggcaggcgcctgtagtctcagctactcaggaggctgaggcaggagaatggtgtgaacccaggaggcagagcttgcagtgagccgagatcacaccactgcactccagcctgggtgacagagcaagactctgtctcaaaaaaattcaaaataaataaataaataaagggtaatactgaaaacaactataactatacataaactctatataccaaaaactggttcaataaattgtagcacattttcataatgaaatactatgcaattatcatcttaaaaataaggcaggacttaaattacttacatatagcaataaagtatagtggctgggagcaaaggctccagaaccagattgtcgctatatgaacccagcgctacttattgtcttgcttggggcaggttacataacctttgtcttccaatgtttcttcatccataaaatggggataaaatattatttctctcatatagttataataattaagtaaaaaactttgtttgtaaatatccttcaaagagtgcctggcacatagtaagtgctctaaaaatattaggtattattattctctacaaaataacatgttcggtgaaaaaaagcaggacttcaaaaaatatagagagtatgctaatattaaagcattgaaaaaaggaatatataaatgcacatacttgtatatgaatataatatatatggaagtatatacagtcatcctccagtatatgcaaggaattggttccaggaccccagagtaaccaaaatctgtgcatactccagtccctcaggcagcgttgcagaaaatgcttacgtgaaaattcggctctttatatatgcaggtttcaaatcctatgaatactgtattttcagtatgcttttagttgaaaaactctgcatataagtaaacccacacagttcaaacctgtgttgttcaaggttcaattgtacgaaaaactaatatcattggttatctccagggtaattggaagggaactggatacctgtacaggaaagggaggaagcttccttttcctcataggccatttgttaatttctggattttgttcaatgttaattttttaaaatctttttcttttaaactttaagttcagggatacaagtgcagaacatgcaggtttgttacataggtatacatgtgccatgggtggtttgctgcacccatcaacccgtcatctaggttttaagccccacatgcattacatatttgtcctaatctctcccttcccttgcctcccatccaccactgacagtccctggtgtgtgatgttaccctccctgtgtccatgtgtcctcactgtccaactcccacttacaagtgagaacatgtggtgtttggttttctgttcttgtgttagtttgctgagaatgatggcttccagcttcatccatgttcctgcaaaggacatgaactcatccttttttatggctgcatagttatccatggtgtatatgtgccacattttctttatctagtctatcattgatgggcatttgggttggttccaagtctttgctattgtgaatagtgctgcaataaacatatgtgtgcatgtgtctttatagtagaatgatttataattctttgggtatatacccacccagtaatgggattgctaggtcaaatggtatttctggttctagatccttgaggaatcaccacactgtcttccacaatggttgaactagtttacagtcccaccaacagtttaaaagcgttcctatttctccacatcctcaccagcaactgttttttcccgacttttcaataatcaccattctgattgtcatgagatggtatctcattgtggttttatttttttcttgagatggagtctcgctgtcacccaggctggagtgcagtggcacgatctcggcccactgcaagctcctcctaccgggttcacgccattctcctgcatcagcctcctgagtagttgggactacaggcacacaccaccacacccagccaatttttttgtatttttagtagagacggggtttcacagtgttagccaggatggtcttgatctcctgacctcgtgatctgcctgtctcggcctcccaaagtgctaggattacaggcatgagccactgcacctggcctcattgtggttttgattaatttattttttaaatatttacagtacagaaggcttataaaatttgtttaaagttgtattctctcaatattatttgtctacaaaacacttttttttaagaaacacctaaaaatcatctagtattacaaggaacatcattttggaaacattgctgtagggcttagagagtcattgagatttgcagaagggaatgacattcaggatccttctttttttttaatggtgtttcttttggatgtgattgatgacatttttaaatgaaatacccaagcttgaaatgcaattatttcatagcataagcacacaagagaaaactagttttagaaggcacagaaggttttattttcaagaataaaacccaaaacacaaatacagtttttgtcagcaacaagatatttattcacctaactctgtaacatgtcacagtcctagcagaactacatagccatattttccttcgccaaatcaaacgttttcccagagcagctcagcctaggagcacttaaactggattccaatttcccagatagacagccctttaatgcaggctctcccaagatctctcacctcttctctactccccacccagagactgccactctagcttgtacgttattgtatgagagaggcaggttctaaacacagaaagaatgagaattttgaccaaaaacccacaggtagtaaaatgagccaaggtcatccacaggcaatgtgtcttgaggagcctgtgaccacaatagcatacttctgcaggaaacatggaggtcctttgtttgtttgagacagactgtcactctctcacccaggctggagtgcaagtggcgcaatctcggctcactgcaacctctgcctcatgggttcaagcaattctcacgattaagcctcctgagtagctggggttacaggcgtgcacaccaccatgcccaattgattcttgtattttttggtagagacagggtttcaccatgttgcccaggctggtctcaaactcctggcctcaagtgatctgccagcctcggcctgccaaaatggtgggattacagctgtgaggcactacgcccagcctgtcctccctctttaaacacttatcagtaacagcacacatcagcttcatgacctccaagaatctctcaagattaaaactttaatcattctagaaatgtagatgtatgttagtaagaaggcatttgttttctatttagttaaaagttttgaactctgaagtatccttgctgggtatttcatcatttacaatgaaagtgaaaaataaattatgtcagtccttatgtcaatgtttgctacactgttcatactacagcaaatgttaacagatgttcaggtaaatagggtatcaatgatcacattttggaaagactggatgaagcaacaatggtccattttcattaataccagacttctcaaaaccttaaaaatgctcatgcttattgtgactctctcagagaggaacagagcataaagtgctctcacaaccattagtaactctcagacgagtgttcaatagcaagcaatttggggaataattccctggtgaaacaaggacagcttttaaaattgaaaaccaagcatgcatattaaagtgcatgcaatcctgcttttctcagtagcctagactgaagtcattatttattaagtacatattaggcacaaattactacaatgaacacctaattcccttagagccaagatgtgcacgccacctattcaagtaaacaccaatctccaattaggttaagaataatgaatagtattaagaatcaattagataagaactgtttgtagtgctcttaacttcatcccagacactatgttgagcattacagatatgctggacaaaatagacattatctgtgtcttaaatagcttacagccttataatgcatatagatattaaatgaacaatttcaattaattaaatgattgcaagtctgcaaaggaaaagtacagaatgcaaggaaaacaaaatggggtcctaactaagtttgggggatcaaggaatgcttctctgaagaagagtcatctcaagctgacacttagttgaaaatttccaggaaaagatgagaaagaacaccctcagcagaagaaattgcatttgggaagacatggcacattcatcaggttggaataagtccaatatgactggagtatgcagaaggaaagacaaagtgatgcaaaatgtaaaatgaggccagccccctctctctggaattggcatgttgccagcagctatacagaaggaaagacaaaagagtggcattacctgtcctcaagaaactcaagaggcaattataaaagtcaagatctccttcacatcccttgtaggttgtatttataggtattttattctctttgtagcaattctgaatgggagttcactcatgattttggctgtttgtctgttattggtgtacaggaatgcttgtgatttttgcacattgattttctatcctgagactttgctgaagttgcttatcatcctaagaagattttgggctgagccgatggggttttctaaatacacaatcatgtcatctgcaaacagagataatttgacttcctcccttcttatgtgaatatgctttatttctttctcttgcctgattgccctggccagaacttccaatactatattgaataagagtggttagagagggcatccttgtcttgtgctggttttcaaagggagtgcttccagtttttgcccattcagtatattttctgtgggtttgtcataaatagctcttattattttgagatacgttccatcatctgaagccttcttctctcaactcgtcaaagtcattctccatccagcttcgttccgttgctggtgaggaactgcgttcctttggaggaggagatgcgctctgctttttagggtttccagtttttctgctctgttttttccccatctttgtggttttatctacttttggtctttgatgatggtgatgtacagatgggtttttggtgtggatgtcctttctatttgttagttttccttctaacagacaggaccttcagctgcaggtctgttggagtttgctagaggtccactccagaccctgtttgcctgggtatcagcagcggtggctggagaacagcggattttcgtgaaccgcgaatgctgctctctgattgttcctctggaagttttgtctcagaggagtacccggccgtgtgaggtgtcagtctgcccctactggggggtgcctcccagttaggctgctcgggggtcaggggtcagggacccacttgaggaggcagtctgcccattctcagatctccagctgcgtgctgggagaaccactgctctcttcaaagctgtcagacagggacatttaagtctgcatcaatacccagcttattgagagtttttagcatgaaggggtgttgaattttgtcgaaggccttttctgcatctattgagataatcatgtggtttttgtcattgtttctgtttatgtgatggattacatttattgatttgcgtacgttgaaccagccttgcatcccagggatgaagccaacttgatcgaggtagataagcctttggatgtgccgctggatttggtttgccagtattttattgaggattttcgcatcattgttgatcagggatattggcctgaaatactcttttttgtttttgtgcctctgccaggtgttggtatcaggatgatgctgacctcataaaatgagttaggcaggagtccctcttgttctattgtttcaaatagtttaagaaggaatggtaacagctcctctttgtaactctgttagaattcggctgtgaatccatctggtcctggactttttttggttggtaggctattaattactgcctcaatttcagaacttgttattggtctattcagggattctacttcttcctggtttagacttgggagggtgtatgtgtccaggaatttatccatttcacctagattttctagtgtatttgcgtagaggtgtttacagtattttctgatggtagtttgtatttctgtgggatcagtggtgatatcccctttatctttttttattgcttcttctatcatgtttattgattcttctctcttttcttctttattagtatggtgagcagtctatctattttgttgatcttttcaaaaaaccagcttttaattcattgatttttgaatggtttttcatgtctctatctccttcagttctgctctgatcttacttatttcttgtcttctgctaggttttgaatttgtttgttcttgcttctctagttcttttaattgtgatgttaaggtgtttattttagatctttctcgctttctcctgtgggcatttagtgctataaatttccctctaaacaatgctttagctgtgtcccagaaattctggtacactgtctctttgttctcattgctttcaaagaacttacatattcctgccttaattttatttactcagtagtcattcaggagcagcttgttcagtttccacgtagctgtgcatttttgaattagcttcttaatcctgagttctaatttgattgctctgtggtctgagagacgattggttatgatttccattctttcacatttgctgaggagtgttttacttccaattatgtggtcagttttagaataaatgctatgtggtgctgagaagaatgtatattctgttaatttgggattggagagttctgcagatgtctattaggtccacttgttccagagctgagttcaagtcctgaatatccctgttaatattctgactcattgatttgtctaatactgacagtggggtgttaaagactcccactattattgtgtgggtgtctaagtctctttgtaggtctctaagaacttgctttatgaatctgggtgctcctgtattgggtgcatatatatttaggatagttagctcttcttgttgcattgatcctttaccattgtgtaatgcccttctttgtctcttttgatctttgttggtttaaagtctgttttatcagagactagggttgcaactcctgcatttttttgctttccatttgcttggtaaatattcctccaccaattattttgagcctatgtgtgtctttgcacatgagatgggtctcttgaatacagaacaccgatgggtcttgactctttatccaatttgccagtctgtgtattttaatgagggcatttagcccatttacatttaaggttaatattgttatgtgtgaatttgatcctgtccttatgatgctagctggttattttgcctgttagttgatgcagtttcttcatagtgtcgatggtctttacaatttggtatgtttttgcagttgctgctaccagttgttcctttacatgtttagtgctcccttcaggagctcttataaggcaggcccgctggtgacaaaatctctcagcatttacttgtctgtaaaggttatgaagttagtttggctggttatgaagttctcctttgcttatgaagttagtttggctggttatgaaattctgggttgaaaattattccctttaagaatgttgaatttgggcccccactttcttggcttgtgaggtttctgcagagagatccactgttagtctgatggggttcctttttaggtaacctgacctttctctctggctgcccttaacattttttccttcttttcaaccttggtgaatctgacaattgtgtttcttggggttgctcttctcgaggaatatctttttggtgttctctgtatttcctgaatttgaattttggactgtcttgctaggttgggatattctcatggataatatctttaagagtattttcgaacttagttccatttttcccatcacattcaggaacaccaatcaaatgcaggtttggtcttttcacatggtcccatatttcttggaggctttgttcatttcttttcattcttttttttttctaatcttatcttcatgctttatttcattaagttgatcttcaatctctgatatcctttcttccacttgatagatttggctattcatccttgtgtatgcttcacgaagttctacaaggctacagtaacccaaacagcatggtcctggtaccaaatcagatatatagaccaatgaaacggaacagagatctcagaaataccaccacacatctacaaccatgtgatctgtgacaaacatgacaaaaacaagcaatggggaaaggattccctatttaataaatggtgttgggaaaactgactagccatatgcagaaaactgaaactggaccccttccctacaccttatgcaaaaattaactcaagatggattagagacttaaacctaagacctaaaaccataaaaaccttagaagaaaacgtaggcaacaccattcaggacataggcatgggcaaagacttcattactaaaacatcaaaagcaatggcaacaaaagccaaaattgacaaatgggatcaattaaactaaagagcttctgcacagcaaaagaaactatcactggagtgaacaggcaacctacagaatggaagaaaaatcttgcaatctatccatctgacaaagggctaatatccagaatccacaaagaatttaaacaaatttacaagaaaaaaacaaccccatcaaaaatgggcaaaggatatgaacagacccttctcaaaagaagacatttatgtggccaacaaacatatgaaaaaagctcatcactggtcattagagaaatgcaattgaaaaccacaatgagataccatctcatgccagttagaatggggatcactaccaagtcaggaaacaatagatgctggagaggatgtggagaaacaggaatgcttttatactgttggtgggagtgtcaattagttcaaccattgtggaggacagtgtggcgattcctcaaggatctagaaccagaaataccatttgacccagcgatcacatcactgggtatatacccaaaggattataaatcattctactataaagatacatgcacacatgtttattgtggcactgttcacaatagcaaagacttggaaccaacccaaatgcccatcaatgatagactagataaagaaaatgtggcacatatataccatggaatactatgcagccataaaaaaggatgagttcatgtcctttgcagggacatggatgaagctggaaaccatgattctcagcaaactaacacaagaacagaaaaccaaacaccacgtgttctcactcataggtgggagctggacaatgagaacacatggacacagggaggggaacatcacacactggggcctgttcgtggggttggggggctaggggagggagagcattaggagaaatacctaatataaattttgggttgatggcacatatatacctatgtaacaaacctccacgttctgcacatatatcccagaacttaaagtacaataaataaataaataaataaataaataaataaataaataaataaaaatctagatgaaggcaaaaggaaagaactaactttttactgagtaccaaacgaggatcacgtcttgtactgagtgcttcaaatacattaactcacttaattcatacaacaaccctttaaaaatagaatcattatcccctttttataaattaggaattggaggataaaaaagattagcaagatgactttctgaagattatatagccagtcagtgtcatagccaatattcgactccagctaagcctttcaaacccctgctcctagcagctacttcctgagctaaaggtgaagagaacaggaacccaggtgggaagtggtggtaaaggagaggagggtcagaactaagtaatattatatagggactgtccactgagcatccatctgcaggaaatgaaaagcctgttctggtctctataaactaagatcttttgaaagaagcaaaagacaaagaaataagaaaaacctgactctggcaaaggaaaacagtctttctagaaagggaacagttattagccaggtgtggtggtgggcacctgtagtcccagctactcaggaggctgaggcaggagaatggcatgaacccaggaggcagagcttgcagtgagcagagatcgcaccactgcactccagcctgggcgacagagcgagactccatctcaaaaaataaataaataaataaataaataaataaataaataaataaataaacaaataaatagaaagggaagagtttaaggcctctaggaggcaggccattaaaaattgctgtcattgcagccattttacatgtcattacattacaagtggtgtacattatacccaacaggtagtttttctaccttcactcccctccctcccccattctgagtctccagtgtccattataccactctatatgcttttgcatacccatagcttaggccgcacttgtaagtgagaacatgtagtatttggttttccattcctgagttacttcacttagaatgatagcctccagttctatccaagttgctgtaaaagacattttccattttttctacaggtgattagtattccatggtatacacacacacacacacacacacacacacacacacacacacacacacacacaccacattttagattgattccatatatttgcaacggtgaattgtgctgtaataaacatacacatgtagttatgtttttgatatagtgacttcttttcctttgggtagatacccagtagtggaatttctggatcaaatggtagatctacttttagttctttgagaaatctccatactgttttcatagaggctgtactaatttacactcccaccgggagtgtataagtgttccttttttaccacatccactccaacatctattgctttttgactttttaataatggccattctggccagggtaacgtggtacctcgttgttgttttaatttgcattttcctaatgatcagtgatgttgagcattgcttcatatgtttgttggccatttttatatgttcttttgagaactatctattaaggtcatttacccactttttatggggttattttattcatgctgatttgtttgagttcctcatagatactggatattagtcttttgtcagatgcatagtttgccaacattttctcccattatgtaggtcatctgtttactttgatgactatttattttgctgtgctgaagttttttagttcaattaggtcccattaatttgttctgtttttgtcgcatttgctttaggggtcttaattttttgaatcattttatggatttgtccaacaatacaaaatatatgtaagagttgctgaaatgggtcaggtcaggaggtacatagacttcttccatctcactagtagttcaacctgctctctctcccccatttccctctgtttacttttattatcttttaccctccgaaactaaaaagggaatttctcatctcttctcaggcataatatgttacacccttgcagcttcagacttcatctcagaaagattatcatatatttttcaaacacatacagagctttcaatgaataagatttttttctacctttgtaattattattattattacaggaatgataacatcactatttattgagtacatatcttatgccaagtactttataaatattgttctatttaatactcacaaaagtcctaggacaaagatattttatctctacattacctattagaaaattgtgggtccaaaaggttaggtaaatgacttgcccaaggtcacaaagctgtggagttttaaagcctcattgtacttcaggatgtactggtggtgctttctacatcaggatatactgcttctcagtcttagggagagagtcaaatggtaagagaataaacaaggacaaaggaagtgctaaaattctaccaaaggagcgggtaggttgaatttctaggcaggacaagttttctaaaaatcttttttgttgaattcttaggtcagcatgatttatctctgctgtgacagtttcctaaattgcatgtcacccagtcaaaatgtatagtttgatgggtccacagaaaaggggatggtggggagaggaggagaaaagccattcaaagaagcacaacatttaattaaggaaaacattagatcaattaagactaaatggtggtataaaatattaaggtaaaacatgtattagtttgacatttacatttttatgaagtatgaatcacaaagaaataatacatgcagctaaatttcagttaactcccttttaaaagtcttgttgccatggcaatgccaagaatgagttttcacaggatgtaagtgatggatttttttattttttaaaagcagtttaaataaaaactaccaacatcatggcctcttttcatttctcttatatgaccaagggccactgaaaataagaaccacctagacagctattccaaaaattatacagaaagcgaaatactaaaagataaactggatttccctgttgtgtttataattcttttttagtctctgttatatttttaataggatcattcaaaaaactatgcctaggaaaacattctaattgtgagggaaataaaggagactattgtcttcttggcattctctataattctacctctgctgattcaattagggaatttttcaataacagctactctttttgagctcagttaagattccactataaacactataaaggctatctttgacacaagcagctaaatagttcgccttctgaattccagatctaagaaaagttgccctagtctctaatgagtaataggggattgaggtttctaggctacaaaaatcctgttgtggcaaaaaaggcagaaatctaactccaaaatcaataccatattactctctccacaggcgagagctgctgggtcaggggaatcatgaaaaattcatagcagaggtggtcaagtcatccataagatagagaaaatgatgctatatctaaagatcccctgagcaatcgaaagcactttatagatttcactgtggataagtgttcgtgtgtttcatctgggtgccttaatgctgctgcgatcttatttttgacagtcaatgagaatgtttgatctatatttacaggatcctatttacgttagtgcttagcctctttaaagtactcagagtggtcacagaaatatggcctgaagctgtttcagtcttgaagactccccttaactggacctgtcctgattcattctttgttcccatactttgagtgttacattctttacaaatccatttatttctcataacagcccagcaaattaagctttattgttattattattcccattttatacatcaggaaacaaagatcagaaaggtgaggtgatatatccaagatgacacaggaagtaagaatatgaatcaggattccagcctaggtatttctgaatccaaacaaccccaaaacttgcttgtctcaaagggctttaatttcctttctacatcccttcatttaagatttgactacatctagtcaatctaccacattcatggcatcacaggaggcaagggtctgtggaggcctgggctatggtatctggcccttccatttcattttactgtctcttatctctgtttcccattaactacctatatgttaaacacaaaatttctcagcttgacctcctcctatccatacttcaaaattcagttcaaatgatattttctttgtggtattcatataataaaaggtttgtggtattcataaaataaaaggttaagattataaacattccctaatttgccaacactcccatacccataagaaccaccatgcctttgagagaggctgaagaattgcaatgttcctgtcatctggctgccccaacttctcccaaacaatctgacacctaggatccagctttatttggctaaactgctagtttatttctcaatgactgctatttaggtaaatccaaaactctttagcctgaattcaagcctcagtcttcctttacatttttattttctattttctgctgctttcttaaatgattcatttgatccagatagttagttcagcacagagtcctcaaaatgagccctgcatattcatcaatattcctttgcatacaccattctctttatctggagttttctgcccttggccacctgagcatcctttacagttttattggaggtttgcctcttctaggaggcattatctggactttgtggctctggtaatcacttcagcaagtttatcatatttctttcaatccttaattacagtctgcctttaatacactctaattttcagtgtgtctttagtctatacagcaagactacggtctccttaaagtcaagatcagctgggtctcactgatctctaaggttatagaagttccaggcacagtgtcagatctgttcatattcagatcttatttagtttgacttctccaacccacatcatatttctcctttatagctcatagactcccttggaactttgggaatgtagcatgattatgtatttgtgtcttgtacaaaacccaaatttaatcagcaatctccagaacagtgtttaagggaatcagtagacaatgtggttgaataataggggagaagtgagactatcttcaaatatttggggtagatttattcacttgtcaaatgtcttttatgtgccagactcagtgttactggggcaggtacaaagatgagaaaaatagccctgcctcttaaggggctcacagtctaatgacaaagcttcaaaagaaatattgatgtaggttcttaaaagagcagtaggagttcactaggtagagaaagaaaggaagaaaggggaaggaatcaacatgagtgaaggtctggagcttgggagggcattatctgttctaatgcactgctcatattaaatacaaatattttttaaaaaaattcttctctcagtacctattttcccatcttattctgaattttttgttttacttctataagagaaatgaattagaaagtcattggcaccagaaatttttcatccatgacaagcctttcagcatgtaatgccctctgtaatgagggcccaaagagcctaaagagtttgttaggtaaatttcaacctccactggagaaagactgccttattaccagtcccatccaggccttagcctgctgtggtacacaaaggattaatcctacaaattgccttaaaatatccagtcattggcaccaccaaagaggaaggcattatgaatcatagaaggagcaaagcagaaaaaacaaaagagattcttcatatttggcatttataagatcctgtaccttttgacatctgttttgcaatggcctggccaaactccaaatacagttattatcctattcctcagtaaatgcatctcctagcctgaaaaagaactaaaaaaaagagggttcttctgtggctcttctaacgataataatagtaagcataacaatagaaactacgatttattgaaaatctacagtgtgatatattctttatagatactataatgtataattgtatcacaagaactatgcatggtaggtgtcctcactaccatcacccctcccccaccacagccattttacaaatgagaaatctgaattttaaaaaccaagtttaatttgcccaaagtcacaaagttagtaaattgtacacacaggatttgaacccagacctggctgccattgatgctactgtcatttctgctacattacattgtctttcattaagtgtttctgtattgcctaacatcagaaaaggtccgcattgtaaccacaaggcgatatatgcaaggacaacagccaagcacaggactgaagaaggaacaaaagttatttcctagtactagaattcaagtccagatccatagggacatatgctagcttcctgtgtttttcacttatgataattattgtttttatcattagggcctctggagaaaagtatttgatgagaaggaataaaaatcaccaacaaataattaagagagattagacaagaagaaaaataagaaccagttcatcaaaaagaaagctgaggaagaaaaaaagatagagatggcttatcagtctcttaaaataatatgaattcagtaaatgtgaatcaaagggtaaaaaggcactcaagaagaaaaacaaggtcattatggtacaacagaaaaagaaggggattaaaatctgacaacctaagattgagtcatgttttcctagactatttagccctatgatcttaagtaatttttttaacttttattttagtttcaggggtacatgtacaggttggttctacagataaatttcatgtccctgggagtcgacatacatattatttcattacccaggtaataagcatagtacccaataggtagctgttcgatccccaccacataccctcaagtaggccctggtgtctattgtttgctttgtgtccatatgtatttgatgtttagctctctgggacttggttatttcatttgtgaaatgagagaaataatatattcttcctttgcatagttgtaagaattaaacataatgctaaagttttttttataaattctaaaaatatatacacaactttcagttgtttttagtatttatctatgacccattggcctaagaaattcagagtagattttaaaaggcaaggcatttagagtgaaacaactaggaaacagattcaaagtaacatgtaagcaaatgcaggcaatagaaaataaaaaataaaaataagataaagttagtaatactgggcatatagtgaagtgtgcccagtacttcacaacatgcccagtaagccattcctcatgtgaaggaggaaaagaaaaacagaaattctatttagtgtcaggaattttcaaagacataatcttatttaataaccctaacaactttgcatgggagtgttattttccctatttttacagagaagaaaactaaagttcaaaaatatgaagaaattgcccccaagccacacagctagggagtgttggagtttaactcaaacgtagacttttcagactccaaaatccatttttcagaggaagtaactcttgagctgtgtcctgaagaaagagaaagattggcacagtgctgcatggaaaacaaagccacaccaaactgctataatctgaatatttgtgtccctctgaaattcatgtattgaaatttaatccttgaatgtgatggtattaagagatggagacactggaaggtgattagatcatgtgagctctattctcatgaagggactagtgcccttataaaggaggcttgacggagctatttggcccttctcccctgtgaggatacagcaacaacacctcatctatgaggaagaggtccttaccagacactgaacctactggaaccttgagcttggatttcacagcctccagaactgtgagcgataaatatctcttaataaatgacccagtctaagatattttgttatagtagcaggaattgactaagatacaaaccaaaaccatacccaaacctagtctagcatatcactcggggtctggctggaaatagatggcaaattcaaataaaataataaacaaaaagaatttaataaatggactatttacaaaggtgtgaacagaattggaaaaccaaccagggataaggaagtactgtagctctagcaacagatgaaagctgttatctttctccaatggaggttgaggctcacctaaggctctataagcatgaagtgccatggggagagagtagttaccaaaacctggagaatgtaaatgtcgctttaagagaaaagaaataaaaatctcaaactcattcttttcccaccctgttatctcctcctagtgcctctcattggcactcaactgtaagccagaatataagagaatttgctgattaagtccataaaagtcagcgtcatggggcactaagcaaggtggaaaagagagaagaatggatctagagggacaaatggaaaatatctaaaacacggtgaatagcccagtggatatttaggtatcaaccatattcttttttttttttttttttttgagatggagtcgcactctgttgcccaggctggagtgcagtggcgcaatctcaactcactgcaactctgcctcctgggttcaagccattctcctgcctcagcctcccaagtagctgggactacaggcgtccgccaccatgcccagctaattttttttgtatttttagtagagacagggtttcaccatgttatccaggatggtctcgatctcctgacctcgtgatccgcctgcctcggcctcccaaagtactgggattacaggcgtgagccaccgcgcccggccagtatcaaccatattcttagaggtagactcttgctattaccaaacactaagacaatggaatggcatactttatactgaaggtcaatgaatctgaataaggagtagatgtaaaatctcaagtaggaagaaaatacattgttcaggttctaaagcctagaatttgaccttgttattgtcctaatttctcaggaaatatttttaaaaatacaatacactagaccatcttaaagtgttgaatatcatgatcattttagcaattactttccaatatattttatacataatttttccttactactgcatggagaaagatgccagaaaaaaatatgtgtctgagaaagttaaaagccttatatagttaaagtgctatgcaaaatgagattttataggttaacaaacttacttcaatcatcccaactcctttggaaatcttccaaatctatgataaatgtgcctttttattttttctatgtgtgtattgcagatggtgacctaatcctttaatttaacacttggtggatgcttgtttgaaagcccctatgcagagtaatagtgaggcaaaaatatttaaaacacagtcattgcaggaagctcacagtcaagcaaagctgctgttattcttgttgttttatctcgtttatataagtaattaattggattttaaaagccagaaatttatttttattactattttcacaatatttacaatttaaagaaaatagtatcacacagtaggcgtcaacttttgttatgaatgaaaaatgaaaaaaatgaatattaaatctgacaaagattttaatattcaggatagattctaatatccagaaacgatatggaacttaagcaaatcaaacaagcaaacactaataatccaattaaaaagtgggcaaaggacatgaacagatacttttcgaaagaatacatacaagtggcccacaaacatgaaaaaatgctcaacatcactaaacattagagaaatgcaaatcaaaaccacaataagataccatctcacacctgtcagaatggctatgtattaaaaagtcataaaataacagatgctgccaaggttgtggagaaaagggaaaacatacactgctggtgggaatgtaaattaaattagttcaaccactttggaaagcagtttgaaggtttctcaaaggacctaaaatacaactgccatttgacctagcaatcccattgctgggtatagacccaaaggaaaatgaatccttctaccaaaaatacacatgcacctttatgggcatttgcaacactattcacaatagcaaaaacatggaatcaacttagatgcccatcagtggtggactggataaagaaaatgtacatatacatcatggaatactacacaatcataaaaaagaatgaaatcatgtattctgcagcaacatggatgcagctggaggtcattttcctaagtgaattaactcagtaacaaaaaaccaaatactgcatgctgtcacttataagtgtgaggtaaacactaggtacacatggacacaaagatgggaacaacagacactggagactactagatgggggaggaaaagagtggggtaagggctgaaaactacctattgggtaccacactcagtaccaggtgacaggatcattcataccccaaacctcagcatcacacaatataccaatgtaccaaacctgcacatgtatcacctaaaccagggtttctcaacctccaggccatggaccggtaccaggccattccctgttaggaaccaggccacacagcaggaggtgagcggcaggcaagcgagtgaagcttcatctgtatttacagctactcactatcactcacattactgcctgagctttgcctcctgtcagatcagtggcagcattagattctcataggagtacaaaccctattgtgagctgcatgtgcaggggatctaggttatgagaatctaatgccttatgagaatctactgcctgatgatctgtcactgtctcccatcacccccagatgggaccatatagttgcaagaaaacaagtacagggcttccactgattcaatattatggtgagctgcataattatttcattatgtattacaacataataataataaagtgtgcaataaatgtaatgtgcttgaatcatcccaaaaccatccccccatcccagtccatagaaaaactgtctttcacaaaactggtccctggtgccaaaaagcttggggattgctgtcctaaacctaaaagttgaaatttaaaaaaagaatattagaatcacagcatgtgagaaatggaaaatatgttctttaatacttgctccctttgttcatgctctttttttctgtttagaacacacttgtttgctatgatcttgacaaacacatttggtaaaacttgtattaaaatacatcatatatgcataaaattgcacgaattacagatacatatcttgattttttaaagaaacccagcacacctgtatatgtacccctcatttcaagaaacagaatataaacagcactgcagaggcctctttttgggcactaccttcctgccaaggataaccactatcctgaattttaatactatagactagttttgttgtttctaactttatatgaatggaatcatatggtatatactctttttttctggcccccttctctcaatattgtttttgtgagattcttccatgttgttacatgtagttacttacagttcactcattctcaatgctgtatggtattccatggtatgaggtaacacaatgtgtcaattatatgatttatagccatttgaataatttccaaaatttgactatgaaaaaagtaccagtaaaaatattttacatatctttggagaatatttgtatacattaccgggactgaaaaactggcattatatacaagagcaaaaggcatatgtatgttccctctagtagtacttttatagtatttttccaaaagcagttgtaccaatttatactcccacccacagtgtataaaaagaattccagtccaactcatttttcaaaattcagtttaagattggttatgtccttttggaagcatttcctgatcactctagttcattagttaccattcacttgtgctactacactatactcccatctttgcatacctcttttatgtaactgttttatattacatttttttctgtatcaaccttaaggtgtacaagtgcctcaagggcagaaagtatattttattcatattagcactcctagtaaggtctggcacaaaacagacactgagaaaacatttgtataataaatgagtgatttacaccatttaatcacactcccttgttttttatataagaaaattgagatatagaacaatttagtaccttgagagaagccacccaacacatcagtaacacagtagcacttctggggttaacagtccaaatcttatacatcctaatctatagctcttttcactgcattatgatgcttcccataaaaatcttactctgacaataaacctacatagaagtttggctgtatttctgtcttccaaaggagagggcaaaggaggcagtataaatctcctgacagactgatgacaaggtcatggaacttgtctatatgctagaacagaaaactcagctagaaaagagaatatacttcaggacaaacaattatggaagggacaaaatggtttaaaagagcactgggaaatacatcttaaattcacagatccaaattttccaaaaggttggagagatgatctcaatttataaatcacataaaatgttctgaattattggatggtaaggtatctgattttaaaggattatatagaaatatgaagagatgagacagctgccagatatgccgacagtttgtagttaattcctgatgttagagaactctgccaaataatcttctcatacagagatttatgttgaatttcataaagcaccaaagcaaatatactgagaaaaaaaatggataaaagagtcatagccgaatgaacacagtatcaacacaattcaaaaggaaagggcacttggagcatttgggttctctctgggtcaatcagaatccttttgtagattatttaaattatttagatccaagtcatttaaatcaataaatcctcttaatactacctatgtgcaaagcactatggaggatacaaggaaatatggcacttttaatgacacttttcctgatctcaaatcttcaatggatctcccttagctagaaaagaaaagctcccactatttagctgggcacacaatgtattcactgtagcctattcctcatcttaccactcacatagtctattttctctccaaaattaaactgttatttctttacatacccttttatatcctatttcactgcctttgatcatgctctttctcgaggagaaaaggtggtgggaaggaggaatatatgtaaagtagtaccaccatgtgccaggcattgtgtcatatacttcatattctttatatcatttaatcttcacatcaattctcttagacgtaatcaagtcacaagctttagctcaccattctactgaaactgcttgtgtcaagatccccaacatcctccacatttctaaacctataatcaatccacatccctcaatttacttgacctaaaagcaggctttggcacagtagatcactctgttctccttgaaacattttcttcatttggttttactatattatactgttctggttttcctctggctttactggctgctctttctcaaaaatcttttgtaggattctttgatctctaaatatattctcctcagggctcagtccttgcacattttatcttctgaaaatacactcacttttctggtaagctcctcaaccagtcacatggctttgaataccataggtgtacattgatggcttccaatttataactcagctcaaatgtttccttgaactccagactcacttatccaactgcctattcaatatctttacttagatgtctaataagtatcccaaactagacatatccaaaacctaggctccttatctttcctctcaaacttgcttcttatgagtctttcctatttcattagcagcaatttcatgacaccagaggttcagataaaaaactttgatgccatccttgactcatttcattatctcacacccaaatccaatcaacgaatctattggttatactgccaaatattcccagaatctctactcatcacctccactggtactatccggttcaaaccaccataatctcttgtcaggattatttcaattgcttcctaactggctactctgtttctatttattcttctattgtacattttctacatagagggcaattcatgtaaatcagatggtgccactccaggattcacaactctccaatattttttccatttcagccattgtaagcgcttacattggcccagaagtcccaacatgatcttgactctattacctctttagcctcatcttccattaatatttccctcactcactctgtttcagctatactgccctccttgctttcctaaaatacgtatgtcagtcatgctatcactcaagacttttgcccctgtgtcttctgcttcatatgctctgccctcagatagccctgcaggtggttcatcttcagatatttgcacaagttccaccttctcagtgagatattccctgtatacactatttaaaaagtgtaatctccatccctataccctctagtcctcttactggactattattctccatagcactttttaccatcttacatgttttacttaattattaatatttgtatactgtcttctttccccactagaatgtaaactccatgagacaaaatacaggcttgtgtgattctaaagtttatgttcttacaacaacaaaaattgcctaaaatgttctgttatcctacttccatatctacatgtataacctgtaccttgactttaaagtccaggccaatagtgcccttatcatagtacctatcacatgatgtgcactcagaaaatatttgataaatgagtcatatttagtctttgtcttcattcactttataatgtagctacaggtacagataaaaacaacaggagataagaaagaaagatgttatcggtatacaatttttgctaaataatagacagtccagtttgacagaccaaggtttcggttttgttttgttttgttttgtttttcatattacactttaagctctggaatacatgtgcagaacatgcaggtttgttacataggtatacatgtgccatggcagtttgctgaacccatcaacccgtcttctacattcagaatttctcctaatgctatccctcccccagcctcccaacacccgacacgccctggtgtgtgatgttcccctccctgtgtccatgtgttctcgttgttcaactcccacttatgagtgagaacatgtggtgtttggttttctgttcttctgttagtttgctgagaattatggtttccagcttcatccatatccctgcaaagaacatgaactcatccttttttatggctggatagtattccacggtatacctgtgccacattttctttctccagtctatcattaatgggcatttgagttggttccaagtctttgctactgcaaacagtgctgcaataaacatgtgtggatgtgcctttacaggagaatgatgtataatcctttgggtatatgctcagtaatgggataaattcctggacacaaacaccctcccaagactaaaccaggaagaagtcgaatccctaaatagaccaataacaaattctgaaattgaggcagtaattaatagcctactaaccaaaaaagcccaggaccagacagattcacaggcaaattctaccagaggtacaaagaggaggtggtaccattccttctaaaactattccaaacaatagaaaaagagggattcctccctaattcattttatgaggccagcatcatcctgataccaaaagctggcagagacacaacaacaaaaaaagagtatttcaggccaatatacctgatgaacatcaatgcaaaaatcctcaataaaatactggcaaatcaaatccagcaacacatcaaaaagtttatccaccatgatcaagttggcttcatccctgggatgcaaggctggttcaacgtatgcaaatcaataaacgtaatacatcacataaacagaagcaatgacaaaaatacatgattatctcaatagatgcaaaaataccttcgataaaattcaacaccgcttcatgctaaaaattctcaataaactaggtattgatggaacatatctcaaaataataagagctatttatgaaaaacccacagccaatatcatactgaatgggcaaaacctggaagcattcccttcgaaaactggcaaaagacaaggaagccctctctcaccactcctattcaacatagaactggaagttctggtcagggcaatcaggcaagagaaagaaataaagggtattcaaataagaagagaggaagtcaaattgtctctgtttgcagatgacatgataatatatttagaaaactccatcgtctcagccaaaaatcttcttaagctgataagcaacttcagcaaagtctcaggatacaaaaccaatgtgcaaaaaccacaagcattcctatacaccaataataggcaaacagagagccaaatcatcagtgaactcccattcacaattgctacaaagagaataaaatacctaggaatccaacttacaagggatgtgaaggacctcttcaaggagaactacaaaccactgctcaaggaaataagagaggacacaatcaaatggaaaaacattccattctcattgataggaagaatcaatatcgtgaaaatggccatagtgcccaaagtaatttatagattcaatgctatctccatcaagctaccattgactttcttcacagaattagagaatactactttaaattacatatggaaccaaaaaagagtctgtatagcgaagacaatcctaagctaaaaaaaacaaagctggaggcatcacactacctgacttcaaactatattaaaagactacagtaacccaaacagcatggtactggtaccaaaacagatgtatagatcaatggaacagaacagaggcctcagaaataacaccacacatctacaaccatctgatctgcgacaaacctgacaaaaacaagcaatggggaaaggattccctatttaataaatggttttgggaaaactgactagccacatgcagaaaactgaaactggaccccttccctacatcttatacaaaaattaattcaagatgggttagagacttaaacctaagacctaaaaccataaaaaccctagaagaacacctaggcaataccattcaggacataagcatgggcaaagacttcattactaaaacaccaaaagcaatggcaacaaaagccaaaatagaaaaatgggatctaattaaactaaagagcttctacacagcaaaagaaactattactagagtgaacaggcaacctgcagaatgggagaaaaatcttgcaatctatccatctgacaaagggctaatatccagaatctacaaagaacttaaatttacaagaaaaaaacaaaccaccccatcaaaaatgggcaaaggatatgaacagacatttctcaaaagaagacattcatgtggccaacaaacatatgaaaaaaaagctcatcatcactggtcattacagaaatacatatcaaaagcacaatgagataccatctcatgccatttagaatggtgatcattaaaaagtcaggaaataacagatgctagaggggatgtggagaaacaggaatgcttttacactgttgctgggagtgtcaattagttcaaccactgcggaagacaatatggtgattcttcaaggacctagaaccaaaaataccatttgaccaaggttttgaattatattatgtatataaccttggaaaaggaaaagtttgctcaggttcacttttcacacctatatatgaggaaaatcgtaactacctatcacacagtgcaaggattaaacaaaataataaatataaatcacccagtcaagtgcctggtgaataacaggtcaatattaggtcccttctccctaaaatttaatagtagaaagtacacatgctaaggataatttaaatatttttacttttatgtaaccaaatcaaccttttttttttcaaaattacttgattaagttattttctgtatcagagttatagcattaagccaaaaccttgtaggtaattacaatgttatctagatacattgttaatagtttggacaacccattattttactgcctacaaagctagtgctctagcaccaaaatgacatgtttgcagtaacatttatatgaatgttgtctattcccaaagcaccccatgccacgccagaatgacaaaattttttcacttcttttatctaggtgttagaaatgcttgttcctttgtgccgtaaagaaatagtacttgaacataaatttaatttcctcaacaaggccatttttactttctgcagaaagggtacactcaccagcagtttggccatgagagtacacccaacaaaggagacagggtcatttataacttgatgcgtccacactactgctgtgtccggtttccattggctggaacgggaactcacattctgtatttgtcccgattggctatcaaactagaactttttaaaagaggcaaaggcagaggagaacaaaggaaggaggaagtaacttgtggaatgctgagaaaggtaaaaacaccttcaaataaggaagaggaacaggctatgacctaatgcttgcttggaccactataagcatgccaggccaaatatttaggctaaattgtgggagctaagaacataaagtacattgatttctttattacagctagcagataattaagaatattagcacaggtctttgaataaattttgcttctaagagaagttactatttattcctaattagatggggaggaaagtctttgaagaggaacctctactttactttttacataggcagttgcccccaggtttctaggggcaccacatttgcctttcctacatgtcagggcacattaaccactccaaggtatgatacaatctgtgtgtggatttcacagtttcagtttgactgcacagaattccttctcctgtctctgttagtaattgactgccaagaggacagagatttggaaactaataaaaggcacattactgttctcttcagtcctttatactctttctccatctgtcacattctcatcaaactatctgtatcctgaatggaaaagactcaagaaatgccactaatgaatctagaagtattgctagatccaagtcccattgaacctctaggatgtgaaggatttattttacttactatgtggcttgctgaagcaatgtcaagtttgattctgtaagtcatattgttattctggtagtctttcctctggtagctatgtgatttttaagcattcttaacctaccactccacagtgtagccagacttaagtgtgcataatcaaaaaaacataggtttcagcatcaaaaagaccttggctatggagttattaggtgtaagaattttgatagttacttcatctttttatgcctcagttttctagtttgaaaaatgggaataataatgttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccaagatcccgccactgcactccagcctgggcgacagagcgagactccgtctcaaaaaaaaaaaaaaaaaaaaaaaaaagaaaaatgggaataataatgcctaccttgcagggtcattgtaaagatcaaattcgaaaatcattaaaaattacctaccaataatgccattcacatataaaacgctcagaaaatgcgagccatcatcatctttgttatgattatcttcaattgccatgatattttgtgcttcattccctttgcttatgctattccttttgttttgaattccattcctcttttcatcttatgaattcttttttatgctcctgatccagttcaaatgcaacccccttggtgatatcttttcagattcctatttctccccactcaattcctctgcagtatttcaggtcaaatacagattcgcaggaaaaaaccacacacacactctctctctcaaattagattatattactgatttaattactgaaggatacagaaacttagtttaagtgcagagaccatacagggaaagagaaatagatgcaacatatacttgtcagctcttccttggcctgtggtttcctaagaagttatgcagctgctggtgatcgctccacaaaggtttggaattgcccgaagtgagaaaacatacaaattattgctgctttgctgtctctgccctttttttatgcatggttttcattaccatgttggaagaatttaccttaaaaatgtaatcatttccattataaggaaatttttacaaacactgagattccttgattctaaaaccaaaatcagcttcagaaagcagtatttagattcagatatctccaaacaatatctatatcaagtctctcagatgcttcttctttcctggcattttaaccctttaatttaactacccttttatctgtttgctcactgagtctagcaggttgattaaattttaaacattaatagtactaatgcctcaaatttacaaggtccttttacccggatggttctgctactaaatttggtccaaagaccaagactataaatccatttcccctgaacattccagttaaattctgtggtctcattacaatctgacaaaccaaaaatacagtgttgtgaaatgagaatgcaattgtttatatgacatagattatgtaagtgtcaattagctggattgtgagctcctcaaggtcaaggactaggactaccacttttaaacaccatatcccttgtgcagggcctaaagtacagcataatggttaaaagaaagagctttgccatgagataggcttaatgatagtcttggctctgccgctgactagctgtggacttttgggcaagttactcacacggttggggtcccatttttctcatctgtagaatgagaataaaacttttacttcatatagttttgatgagagagagtgtgtgtgtgtgtgtgtgtgtgtgtgtgtacacatgtgatgtgaggtgtgcatagaattaaaagcccttagcacagtaacaactatactataagcattcaataaatgtgagacattttaaattattattatcatcatcataattaccatcatcaccatcatttttaacactcagtaagtatatgctgaatattccttctttgaaggaaaacaacacccctttataaggtaattgtggttactgtattaaattaaaacccttcaaagcatttagcaccatgcctggcacataataaatgcttaaatgtgttagctcatattatttcttaatcataaaattagaaggctgacagggatcttaagaagcaaactaatgtctgctgcaagagagatttctaattgcctattgaatgtcttctcttcttctttagtaacacagcactgattctgttgagggtagcttgtgtacagctaaaatatgaaacaactctatttcccaaatagtggtagccaatcaaatgtaagaggaagtcacttggtaaaatttctaggtaaaatatctttaaacgcagctgactcaattggaaggtgtgcccttcacctttcttctttcctttctccttcctgctacctgacattggaacagaatagctggagctgctacatccacctttaagctatgaaatgacccttgaggatagagccaagagctatggatggtagatcagaaaaacagaaggagcctaaatctttgatgacttcatgaagggacacacgtctagaaatacacgcatctagacctttctccatgtgagaaaataattccttatattttttaaagcaactattgttttggttttctttaatgtatacataagcccaatcttaactaatatacttgccttcagtcatgacatagcagagatgagattttttttccctattagtttttaacccacataaagaaactcattatgactttggtgttgtgatctggtctcctgtgctcacataggagggtctcataaattttcctaggcacaaatatttttcctttaaggttcagtcccttacagccagtttcaataacatctgacactaaatacaatctctttccacttccccagttgttccctaaactactatggcctttaccatctaagccacatcatttaagatttattttaaaacactttatattattcccctactactcccttatgtatatcttagcttaaattaatcataatgccacttatcaaggcatatgtggaagttaaattagataatatggtgactggcacagagtaagcacttattaaatgttaccattttttccttctctgtcaccccttctcttccattttctgttgagtccaaaacttcagaaaataaagtaatcccctgaaaggtatctccatgtgtctgttcctctttccttgacaattaagactaaagacataactcctcttagcaagtactgaaagtaaagcagttgttagcagatgttcatctccttgttggcttatcaaagaagcacactgcaggaggcctggggaggctcccataggaacttgctgaaattttctgaacatattcaggcattagatttctgttactgaaccccaaggagcacaaatcatatcttcttcaaagacttaggaagccaatagttcattataaacatggctccagagagctgagctttcagaaaaaagagaatctatgtcttcttttctgttgcctgaagactaccacattattagtagaatcttggaaggatggcccaataacaccctaccactaaagtgcctgcttggcaggggtaatatacaattccattatcaacaaaggggaatttaagggccatgtagaggtatttataagaaacagtgcctgagaatgatcagcaaggatatgaatgtcaggagagaataggaagcagcaaaatcagggaattcaaacatccttctctactcaatgtgttcatctagaggataacagaaaacactatctagctgatagtgatgtgttaaaactactggtaggttattgagagtgttaatgtgtggcatcactcctacttctaaccttgtggttcctggatccatatattctttctatgtagaatgcagtccatataaaggcctcttatgtattgtacataccacatcctaaaggatgataccccattctttcagtgttgcctccaaactgactcttcagctgtgcctttagaaagctgttacagtgctcctgaagctagcttcttctggctggaatggcatataatacaatcagcagatccagtagtgacaagaccccatccttacatctggattgctgtgtagtgggtcccctcatgaaatgctttttttctatttcatacctgtaaagcaggcattacataagaaccttaatagtggtactatgggtaagaaaggcaaactcatatctagaatagatatctaaagaatgaattgctgactcttcctggatgaaaagagctcaatgtgctttggtaagtaggagtctatgctgttgagaaaatattcagtgccttgtgcctactccattcatgtggtcatcattatagttccagggtgtgttgattcatccctaagtagccagttggtctactctgagaatagtgccatgttggtgactcagcattattctgtatttctcacaggttggccaatcagaggaagcagtagctaggtcagctttggtaagtgggagtctgtgctgttgagaaaatatatagtgccttgtggctactccattcatgtgctcatcattatagttccagggtgtgtgataataaagcctggggatatcaactagctaaagaatttttgcctactgggttatttagtgcctcttccatggtagttgtttcctggagggcactaacatagatttacaaatctttttctaagatagatttactaaaacaaacattaccaggaggtactacaatgctacatcctctgatgaagctgtggtattattcaatagcatctgctgttgctcatggaccacagtcagaaattgccaatgttggaaacagcaaccactagggttagggctacaagtcaaaaagctattctttgatggtcttgctcatggccacttctgaagcctgttgatgtctagaatatttgtgaataaagatttcctcaaaaagatgggaaatgctattgaataagaccatagtgtcatcagcaggtgtggtattgtagtacctcctggtaataagtttgttcttataaatctatcttaaagaaaatatttttaaatctatattaatgccctccaggaagcatctaccatggaagaggcactaaatagtgcagtaggcaaaaatgacaagatgagacatcaatatgtctcagtaaaacattctgagtgtgcctactcccatttatccaatcacatgcacctttaccccagacctctttgtttctaatctttcccctttcaggctcctgatgaattgtcctggccattggtcaccgcctgggaatctatgtacattcttacctcaggctatgttttatttcatacaaagtagatatagccaggcataccacttatagtccctggctgataggatgatttcttttctctcatttttttgttaaccaccctgcatatggctataatgcaggtaccatatattttttgctttcagcaacatactgaactgacctatccataaaccaagcccagggctattgctcctccttcacctggtcatataggataagatcataaggcaataggtgaaagctagattaggggagctgatgcaactgtgttggattaaacagaacttcagtttacctgctgaggcagttacttatgacctctgatccactttaactcaatcccagatataccatttccataaggcagttacttatgacctctgatccgctttaactcaatcccagatatccaatcgcagataagctggtgctgggcctgtccaattttatgactttgtaggtctaacaaaacccagctcataattaagagttccagatgcatggtcacttgatacctgtttgcatagcgttccatctttatcagggtccagtgacatgccaggagctgtttctcaaaaggcacataattctctactgtgaatggtatattcttggtctaaaatctctgtggcctatgtagtgattctccttttgcagctcaccgtaaactccacattatatcttttcccaaaactacacctccaataacatagagtcttccaaattacatagcacaagggacagaggaacttttcacacaacctggacctgccacaggtcccaataaaagctggaaatcttatgtataaccaagcatatatgccagagcatatatgtatggaatggaatgtgttacctccagaactgaatgaggcctgccagatcttatgctttcttctttgtaataaaaaagatgcagctatttgtcttttactttgaagggcatgcctctgaccactgcacctctaaagtctacatgaagaggatggggttcctaaatcttcaaaaggtttatctcctaccctgtggtgtactgtgtcttataaaggcctccaggatgagcaatcgactccttcctatcctatccaatcagcatgatgtcactgaagtaatggatcaatatcatgttctgttcaatgtattccagatgtctttggactatattgtgacagaaggcaggagacttaacatagtcttgggttgaaaccaaaagtaaatatgcatactgttttctatccaatgtaaaagcaaattgttactgaccctcttctctcaaatataaatagaaaagaatatgtgtgacaaagaaatggctgcctgctatgttcccgaggccttcttaatcttctctaacaatgataccctgttagactcagcagctgcatttggaaaaatgattttattgagtttgtcatagtttttaattttatggattcatctggtttattcaagggccaaattggagaataaaatggcaatatggtagagaccaccaccctgcatccttttaaaaaggggtcatcaaaatacaacctgcaagtcaaatccaacaagctgcctgattttataaatcaagcattattggaacacagccatttccattcatttacatattgtctataggaactttcaaaatacaatggcagagttgaatagctgtgacggagatagcatggccacaggcctaaaatatttactatctggtcctttacagaaaaagttttgtgacttctgctttagaaatttagtggtgtcactaacctaaaccattcccccaacatggcaggatatgattttattttttatttaaactggcttgggaaatggccccattgaagagctccacttggtcttccttcctcactatgatagctcttacgccttgggccaaggacttaatgtaaaggttacttcaatagccaagtatattgatctcaattatacacttgaggactgggtaaatggccactgggttgttcatggacccagcagacacactgtgagccagactccatttattattggcccccagaaacctccgctctaacagaggctccacgatgatatttcgggtcattgaatataatctcaattttgatgctttgtcaatagtacttgaactgtctcattattccctgttcctcagtgtacagtcatccaaatacatggtcatcagtccctttggaagaggactaggggaatcattaacaaatgtatctgctatagtattacggggtcctccctccaagaaacatggccacctcttctattaatggttttcagaaaactgactcaggtccaggaactgagaaaagatagtgacttttggggggaaatcaaccattctccattcttgcctctttcttattgtggatttaatcagcacccttatttgcatccatctggtttgtcgatagggacattgcactctattagacatctccacaagtccctgaaagtcaagccccctttgatggtcctcagaccttgcctacaattaaaataactatggccttctggctcctggttgttaaacacctccagctggtctatattacttcagagcatcattatcataaacagtattgagtccagctctttcactacctctcctatcacctgtggtctgcaaaggtgatcaataattaaactctcagtgatatgggcactccatggccatcaggaatacacagtgtatgggaccgtcttggtctacaatctctgtggcctgtgtagtgatcatgaatacattttatatttctgatagccttggagtatagcatgttctgtgtgccctcttgtggcacatagtcttctggtaagtcttctggtgtcacttaatgtgtcctgtccaacaggcctattttcctcagccttgttattcttcctttatcgtgtgtcagggtactcaggcatttcactcagcatgagatatcactttcttcaggcttttaagagctaccctagcagtacttggtgtgattgcctaggtgtgaaaatcctgtatcataagaaagtacacccaagtaaattaattcttgcatatccagtcttactttctagcctgtttaatcaatcaccctcgaaacccaatctcctggctcctggcagataggctaattaattgttatagcacctttagtatataacctctgtgcttccttatcaaacatccaattctagctaggtgcccttttgaagagctactccagtagctccttagaagtttaatgatggatcacctttgcaggccacagatgatgataggagaggtagtcaaagagttggactcagtattatttgtagtagtagtattttaatcgttaaatagctaaccatttaaacctagttataacctggtagagggacaagaggtgagagtagcaatagttttagcctggtggctggacaagagttgagagagtagctcctcaaaggggcacctgttgccttgcagagaaacagcctctgcagtatattccagcaccaaggtagtgccagttcttacaagagatgggtggactaactcccaaagctgtgcatgttcagagggatctgcagagcccaaaactctaaggtgtccatccaaatgtccctgtcccatatttaggatactgggttttctcatgaggtctctgatcttagtgtaatagacctactttgtacgggcatttaaacatttctaaacctgtgcctttctaacaagtcctgaatctgcttctcctctgaatccactcttctactgcaggagaatggacctctttgtaaactaccaaagtgtctcactggatctcacacttctcccttaattgctttttgattgacctcagtttctcattattcttctgaagggcatcaacagaatttagcaataattagctaactccacagtccttgtagacatgtttttctcctatctttaaaatgcccaaatcattgtacctacaagacaatcctctccacttgcacattttctcagtttcatcattgatgaaatcctcatttgtgtggccaccttgtgccaggaaatatttgtgtcccacataaaacccaggatgatatcattactgtgactgaaccatttccagaacccaaaacccattctcactacctgttgggagaaatgcctgtgaaagactaagggaaaggaagcagggatgaccttcagaccacaaagcaccatatctgaaaatggatggaggaagaaagaagaactgaatgtgaagaatctcatactgcaacatggttctaagagagttacatcaaatcaataggaagtcctgtagccaaagttggccatcagaaaagtccttgcaagcagactcctagtactcctactatgcctagtcattggctggaagcaacctacaggatgtatggcctcaggacgaatgtggtagtggatccaggggagcagaattctggctattagtcaactatgctccccacagtcatgaaaatatatctgagtgacacatttttatggctgccacatatgtgcagcacttagaactctgagatgttctgacatgattcacaacatcaaggaactaagagtgtagtagagaaaatgaacctaaatagaaaacaagggacaaacttaaatttagggttgagagagtttgctgggtcatattaagatttaatattccagagggagtctgggaatatggtgacataaaaacatggaaacccttttattctaatttccttgctatgttaacccaattattatgggaagggggaacctttctcaccactacctctgaaaaatagagggatttcacatgtatacctcaggttttggaattctaccaagattttacaagtgaaaaggaatgaaaactagttaacaagaccagtattatccagaggaataattatatgtcaacagattccctctggtccatgtggaaaaattttgtcttagaagctcatctgtcctcctatgagaagattctgtatttggaagctcatctgccttttcacatggtctggggaaacccttagctgcccacagaatcactcagacatcatctttagctctccctacacaaaggagatactcctatttccttcattttgctagtaaaaccattcaatcaggctgcatgcacacaggctgtctggcttctgccactggtccacataaacacagaattgcctttgtcatagtaagaaaaaacactcaccattacatcctctatgggtgagcaaacaggaagcacttccctttctaggccactaatatttgctcatcattggccacactagaacagtgtgcctaggcgggctgatcacgagatcaagagatagagaccatcctggccaacatagtaaaaccccgtctctactaaaaatataaaaattagccaggcatggtggcgcgtgcctgtagtcccagctactcgggaggctgaggcaggagaattgcttgaacctgggaggcagaggttgcagtgagctgagattgcaccactgcactccagcctggtgacagagcaagactccatctcaaaaaataaataagtaaataaaaataaaaataaaaaaataaaaaatccagaaatgaaataccaaaaacagatctacactagcccagagagaaaatacattagccaacaccattgataaacctagatcagtgactcttaaggtacagaccctgggccatcagcatcagatacattttggaacttattttatattcatacatgatttttaaattgatatccacatccttcattagcctgcaaaagccaacaaagcaggacttatgtctatttaacaatttagcacagactgacatattggaggggctcaaggaagatttgttaaaatatgaatactagaataacaacagcaaaactttccagaaagactcaaattagatatataacaaagatataatacagtaaagaaataataagaggtaagtagagaaatgataaactaatcattaaatgtgtgtgcctgtaagtaatcccaagtatttgggaagctgaggttggaggattacttgaacccagaagtttgaggctgcagagagctatgatggcaccactgtaatctagcctgggggacagagtgagactgtctcaaaaaattaaataaacaaataaataaagcagataaaatgttgccttttagaaatagttatttcttcatgatcacactataaattaaaatcaaagacaaatattactttaaatacatgtatatttaaatatttcatagcataagtaaattaaaaattatatagtagtatatattacaaaatacatattatataatatagttacatatagttaaataatttatgaaatatattattgtaatatataatatatgtaaatattacatattttatatatattttaataaaattattaaaataattttttttcataatattttaagtcaatttattcaaaatattatttcaacatactatcaataatttaaaattatttttgagatatttacattattttcttaaaatctagtgtgcatttttaaaaattatactttaagatccaggatacatgtgcagaacctgcaggtttgttacataggtatacaggcgccatggtggtttgctgcacctatcaaaccatcatctacattagatatttctcctaatgctatctctccactagccccccaaccctgaggggccccagtgtgtgatgttcccctccctgtgtccatgtgttctcactgttcaactcccacttaaaagtgagaacatgcagtgtttgcttttctgttactgtgttagtttgctgagaatgatggtttccagcttcatccatgtccctgcaaaggaaatgaacccatccttttttatggctgcatagtattccatagtctatatatgccacatcttctttatccagtctatcatggatgggcatttgggttgattccaagtctttgctactgtgaacagtgtcgcaataaacatatgtgtgcatgtgtctttatggtagaatgatttataatcctttgggtatatacccagtaatgggattgctgggtcaaatggtatttctggttctagatccttgaggaattgccacactgtcttccacaatggttgaactaatttacactcccaacaacagtgtaaaagtgttcctatttctccacatcctctctagcatctgttgtttcctgactttttaatgattgccattctaaccggcatgagatggcaaatttctatctccaagtggttctagtaagataaatttctatatccatgtggttctagtaagttaaggcagtccaatgttcctactgcgaaaaaatgagaagaggctacttaaattacatagacaatactgttgaggcatcagagagatgcaaacgtagagagaatttgatggtctaaaattccaaagaggcaactttctcaggtgaactgatgattgccaatcttttttcttcctttgagggtatcttatgattctggattcaggctaaagatcaggcttagcccaagaagaaggcccctgaaagaaaatcagcaaagctttgagcagtaatcaaaggcttgaatgacaaaatggaaaactgaaaggcctcaaacacaaagctcattttccctacgtggcatttgctgagttctaaagctgcatgtctctcttttaattcatacttcatatcatacacaaaagttaattccagatagacttcagatataaatatgaaagataaaatgagagatcttttagagaaaaacaaaggcaagcattctcatgagcttagagtaaacatatatcttttaaaccggacctaaaaagagctaactgtcaaggtaaaataactcattaattgtaatatattagaattaaggaaatatatatgtcaaaagacaccatttaaagaataaaaaacaagccacaatgtagaataaaatatttccaattcatgcaaatgacttgcatctggaatacattaagaactctccaaatccgtaagaaaatggcagactacttaatttttaaaaatcagcaaagatttgaacagatacttcaaagaaaagggtatcaaaatgaccaatatactacataaaagctgctaaattgttttaaatcattaggaaaatgctacataaaaccacagtgagaaacttcttcatacccatcagaaattctgaaataaaaatgaggaaacaagtcaagagttggaggaagggagagaactctcatactgctagaggaagtataaattggtacaactacttagaaaaaccatttggctatttaagctaaacaagtgtatattccatgacccagcaattttgaagtatgtatgcaacagatatgcttaaatatatgtttaccaaaatatatgttaattgcagcactatttacagcaactaaaaattagatacctccaaaatgataaaatggaaacttgtaaggcctcaaacatgaagctcattttccccacaggacatttgctgggttctagggctgcactctagggctgtatctctgttaattcagacctcttatcatacacgaaaattaattacagatagattataaatgtaaatatggaaggaaaaccagagagtagaatggataaactgagtgttataacaaaatataacagagtggcttaaacaacaaactcttatttctcacagttctgggcattggtaagtccaagatgaaggtgccagcagatctggcatttgctgactgaccacttcctgatttgcaactaaccatctttttgctgtgttcttacatggtatattgctgagagaaagaagtaagctctcttgtgtctcttcttatacaggcactaatctcattcatgaaggctccactttcatgcccaaattacctctgaaagaccccacctccaaatatcctcactttagggattaggcttcaacatacgaactttggagaaacataagcattcagtccatagtagtgaaatagtcacacaatggatatatggaaatgagaatgaacaaacatctactacattaaataatgaatatcaacaatataattttgagtaaaagaaactagacataaaaatgtacatatgtatgtatgattacatttatatgaattcaggaaatagaaaaataggtaataaaaatctatgctgttacaaatcaggacagtggttactgacttgaaaggctcacaagaatggtggggaggagtcttcaggatactagtgatgttttatttgatttattgatctgcatgatccaatgagtaaatcaaacagatgcaacagttaatactgagtgtcaacttgattggattgaaagatgaaaaatattgatcctgggtgtgtctgtgaaggtattgccaaaggagattaacatttgagtcagtgggctgggaaaggcagacccacccgtaatctgggtgggcaccatttaaccagctgccagtgcggctagaatataaagcagacagaaaaatgtgaaaagactagactggcctagcctcccagcctacatctttctcccatgctggatgcttcctgcccttgaacactggactccaagttcttcagttttgggactgggactggctctccttgctcctcagcttgcagacagcctattgtgggatgttgttattgtgtgagttaatacttaataaactctcctttaaatatatatgtcttattagttctgttcctttaaagaaccctgactaatacagcagataaactacatacttcttttattcttttatttttatttttattttttttgagatggagtcttgctctgtcacccaggctggagtgcagtgggatgatctcggctcgctgcaacctccacctcccaggttcaagcaattctcctgcctcagcctcctgagtagctgggattacaggagcctgccaccacgcccagctaatttttttgtatttttagtagagacagggtttcaccatgtgggccaggctggttttgaactactgacctcaggcgatctgcatgccttggcctcccaaagtgataggattacaggcatgagccaacacgcccagccagctacgtacttctgaaatattcccttttttatatgttgaagtatgttatatttaaattaaaaaattaaaaagtagtagcagctcattatgaatatttatctgttacacagactgaaaaaatctttctaaacctaatagcaacaaattaaaaaataaaaaaaaattatctgtagacttgactacataaaagcttgaggaaccaatatataaaaacaaccacaattttagtttgccatagaatgcaaagaaaaatggttaacaccagtaatacataatgatataaatgggcataaaacacttaagaaagaaataatggccaataagcacatgaaaaaaatatatttctaaactaataatcaaagatactcaaagtaaaacaataggatgaaattttccaagtatccaaattagcatttcttctaatgataataataaggcaagacaggcactttcatgcactgttgttcttagtttaaattggttattgaaccaaaaatcactttaaaaagcagagtatggactcaggattccctgaacgctatctatgatcccaacatcccaacagcccattttcttgtaatctactccttattccttagttactcttttacctcagtgatgctgatactgaatttgtcctttgtttagaaataaataaacactaaaataatatatatttcataatatgtaggcaaaatttagaagaatatgctccaatctgttgatagtggttctgagacataaaagtgtaagagaagctcacattctatatcatatatctgtaatgaaaagttatgcataattttctattacttttacaagaaaaatagtaatatatttggtctaatcttcattcatttcctaatccattcaagaagtacggatatagtttcgctgtgtcctcacccaaatctcttcttgaattgtagctctcataatccccatgtgtcatgggatggatctggtgagaggtaattgaatcatgggttccagttttcccatgctgttctcctgatagagaataagtcttacaagatctgatggtttcataaagggcagttcctttgcacatgctttcttgcctgctgccatgtaagacatgcctttgctcctcctttgctgtatgctgtgattgtgaggccttcccagccatgtggaaccatgagtccactaaacctctgttttttggaaattacccagtcttaggtattttcttcatagcagtatgaaaattgaccaatacaagtactcgccaagaagatactactaacacgccaatccctgtgcaaggcaggacaaggcaggtggttagggaccaaagtgaagggcacttgaggtctagctaagacctggagtgtaaggtcgagtaagttctatgactcttgttaaggtttgtgaccaacacaaagtgccctaatagacacagtaaggatcccaatacaaacccagtcatgcaggatcatcagggggtagcagcagtgtgcatctattcagctaggattcagaatggaaacacatccctgtgaagatacctcggcacctagaaatctgccagaataaaatctggaaactaaaaacctccaggcataacaccaataacatagatctagtcgcagtgaagcagtcgtggtaatccattctaacacacaccctgctatcaaaattggaagacaatataaacttggaaaggtaggacagtaatttagaaaataataatgatactaaacacttattatgtgtgtggcactattatacacacttgatacatattaaatcctcataacaacttgataagggaaatagaaagtgagcttctctcacacttttatgtctcagaaccactatcaacagtctggagcatattcttcttatcctatttacaaataaggaacacagaatttaaggttttgcccaaggccatatagttaataagtggtagagcctggatccaaatcaaggaatccttgttcttgctacaagaagtcctatttgttcatttattcaacagacattattgggagtcttccaaatcccaggcatttggataggtgttttgcatacaaacaaaaataagaaagcctctgcattcacagtgtagtagaataagagaacaggggagcaaatatgtaaaacacatggtaaatgctaaaacagaggaactggccaaatactgcttagtaatatgagcaattttgccggatgaaatcaagaaagtttttaacaatataatttgaattgggctttaaaaaataaacagaatgaaggcatccaaaaagggtgggaaagggtatttcagatagtaagttaaatatgagcaaagatatggaagtacttacgtatgaaacacagtatgaaaagatgtcagttttctatgactgaagaatgaagtccatgagggaaactggcagaagaaggaaggagacaggaggccaatatttctcctgcaacatcagtggggccatcctcactgaaaccactaccctgaggagctgtatcttcccaaggtttctcagaagcacacataaaaatttagtcatttgtttcaacctccaacaaaattacatttttagcaaaagagcataaatgaagctttactcattagacaacttactttgagatagctttgttaagattcaggtgttatacttgtaatagaacattgttgccaaggtgatggggatttaaacaatgaaataaatataactgcaataaacatgttttgagaagacagcaccaactgtaatttccctctgtaaaaggaactcagggcctttgaaacagctaaatctctttaaggtaagcaagtgctctcacaccacagcatagagggtgtgagatcttcagatctttttccctcagagtgttgcttatcttgagagcactacttagtttagtatgcagatcttgctggctgtacttcctgtcctgcttactataacatcttttttatgtagcagaaacttaaaacaattgaaattctaaagatggaaaagccgtctgcgctagcaaaggataatacaatatcatgttctaccatacggtctccttccaagaatttactccagggatttgcctagaccccaaaggagatctccatagaaggccttggagagatgcatttttatactgggaaaggaaatgagaacatttacttatactttatacatgacttcttttttgaaaggaagatgtgtaatctggtgcataatctttgtgtataatctagtgcataacaccagaactgccttgtatttgtacagtgatttagattttaccaagctcttttacatgcactgtttgtgtgagaattaaattgtatagcatgacataaagctcttagaacaatccttgcgatgggactcaataaatcggtgctcactacctgggtgatgaaatcatttgtacatcaaaccccagtgacatacaatttccccacataataaacctgcaaatgcaccccgtgagcctaaaagttggaaaaaatgacattacttttacttattccattttgtggttgttgttattgctgttgttatgcaaataacttccttctttctcttagtaaaagaaaacaacttcaaagctgggtagtaaaggagaaccaaagtgggactacaaagtgagatatgtttaggtcaaaataactgattaattaagagttaatgttttctcttttgtttttcactattaaaatgtcattttctacagaccactgtaatagccttggatcaccatgtatcaatatagctaaataattcaggggtttgtacagtcattctcaagctttatcatcacaaaatgaaataatcttatctgtaaatgtgaggatgccaaaattagaaagtgaaaccttatcacatgagactgcaacatttcgttccacaatgtttcccatagatgaattttaaatgataaacaaggctagcaaaattatcttatcttgcttcttttatcttagaggcatttattatttaacagtggttatatggtcagacgagtaatggttcaactggatttttgttctccattttctgaaaaacttttaaagagagtctcttttttcctattttataatttattttctcttatcttgccactgcctaataagcacatgacatttaacttttcagtgatatcaactattgctgttgctgatgatgctattattgctgctgtacttattgttaccatttttgattacatgctatgtgctagtctttttaaaagcattatttaatttaacactaacaagcaccttgcacaatgaatatggttgtagcttgagaagtaacttctaagccacattgctattgtgatggcatgttgaacccaaaactctttatttccaaatttcaggattttactgtatatttatatgctttcaagtaaattattaaatttcatgtcatatttacatgctttcaggtaaattattaagaattttacgaatagaaaactagggagcaattagagtaatattttccttgtaatatggttctcaaagatggtattaagcttattagcaataatatataaatacttcttaaaggaaaaaaaggttttaaaattcaagagtgaggaagacatcttccagtgaagataaaacaatgggcctggatttttaccttcctgcatgaaacaaatttttaaaatatttataaaacaatggttttaaagacattggaaggtaggcaacaaaggatgataatcctaagagattagaaacaaatcatttgagccctatgattgtcccaccctattgtctgaagtttccaagcacagcacaagggagaagaaacccaggaagatccttgctgtctccttaagttgagaagaagctggaagctcaagagaaccaggatagctagttcaaaaggcacactacttgaggggaaagaactacagaaaaagaactctggaggtctggaggtttctcttgacttttcacctttactgataaacacatgcatgtgtggaaactaccctcagaaagaagcaccaaaaaggattaaaaggaacaaaccttcgtgctcacactagatgaaaaaccgttcctgtcctcagctaaagcagaaaagctcataattcacagggtgtttgacaaactactcagataaagtactcagaacagttttgcatcaataaggggaaaagagcccaagattaaatgctgctgataacatttaacagtttataagaaagatctgaaaggattaactgtttgtttctgggaaacttgactgcatcttggaatgaagctcaaaaatacatatataaatgcaaaaatattcagcactcaataaagtgaaattcaccatgtgtggcatctaataaaaaattaccattaaaatactacccacagtgagggaaaaaacaactgaacaaaattgacttagaaatgatgcagatgatcaaattagtaaatatgaatattaaaccagttaactcttcctcatatgcgcaagaagctaaaaaaaggttgtacatggtaatagactacatgaaagatatattttaaaaatagataaatcagatggctagagataaaaattacaatgcctgagataaaaaatacaccaaacgggactaaaggcagattatacgctgcatgggaataaagccatattaaacactgctattggaaagattagcgatcttaaaaaacaccaaaagaagttactcagagtaatagaggggaaaaaaagacaataaaaaaggaacagagtatcaatgaactgtgggaaaacatcaagtggcctaatatacagttaaatagagttcacaaaggaaatggaagagagatagaagaaacattttaaagaacaatagctgaaaattatacaaatttgataaaaataataaatttaaaagtttaagaagttcaacaaattccaaccacaaaaaaaacagaaaaaaacaccaaaatatatcataaattgcttaaaaacaatgatttaaaaatcttcagaagtaactacagaaaaagagaggcattatgcacatggtaacaaatttaagaatgaaagcaaactgctggttgaaaacaatgcaagctgaaaccaagtgcaacagtatctttaaaatactgaaagagaacattttcaacctagaattctatatccagtaaaaatatgttactaaatatctttgtaaaagactttacctagtatatatgtaatgaaataattcaacatcaacagacctgggcaacaaaaaatgtaaaaagaagttattcaggaagaaagaaaactgtaacatataaaagtccgaatctaaacaaaacaatgaagagcactgaaaatggaaaattcactgataaatataaaagactttttccttattggttagatttccttaaaagattatcaattatttaaacaaaaactcataacaaagcattgcagagcctataacacagaaagacagaatatatgacaaaaatagcacaaaggatggagtgagagggggaaatggaagtatattcttgtgaggttgttataatacacaataagtggcataatattacttgaagacagactgtgataaattgaagatgtatactataaatcctaaagcaaccactaaaataatacaacaaagaattacagctagtaacaatggagacaagatggaatcaacaaaaatgctctacttaccaaaagtaggcacaaaaagaggcaacattgaacacagaatagacaaataattataaaaaaatgcaaacattccaaacactctaactaaaaggaagaagttgtcaaactgggttcaaaagtaagattcaactaggtactatttattagaatcccatttaaaatgcaactacacagaaaggttaaagtataaagatgggaaaagatttaccattctaacacttactaaaagaaagcaggaatgtctatattaatatcaaagtcaaattttaaaggaaagaatatcacaaggtataaagataatcatttcataatgattaagaaaacatgacaatgataacagagttttgaaaatcctgaagtgaaactggtaaaagcttctaggagaaatagaaaaatccacaattatactcatatatttaaacacacatctctaaattattgatggaacaactagatagaaaatcaggaaggatgcagaagacttgaataatactatctaccaacttgactcaattgacatttatagagcacttgactcaaaaacagtagggttcaaatccttttaaagggcacatgaaacatttaccaaggtaaactatatactactggaccataaaagaaattctcaatataggatttacatcaaggattcaaatcaagaaacatgttctttaattacagtggaattaaatgagaaatccctaatagaaaaatataagtaaaatgtctaaatatttggaatttaggtatttgtacatatactcaaatgacccatagggcaaagaataattcataaataaaattagtattttgaactaaacagaaataaaaaatagagaatttacgttattaaaaacgtgtagcactcagtacctatattagaaataaggcctcaacttaatgaccttagcttgcatggtaagaggtagaaagaggagaacattacactcaatgtaagtagaaagatcacagatgaatagatgaaatagaaaacagcaaaagtaatatggaaaattgattaaacacaatcctaattctttgcaaaattatacacagaataatcagtataaaaagagaatacataaattatgaatattgggtatgagaaagatgacaacactatagcctataattatcaaaaaaaattattatgacaatttcatgccaataaattttaaaatttttaggaaataaacagattttctgaacaatacaaactatgaaactcacaaaagaagaaacagataacctgaatagttttatattcttagaagactgaattcgtcattaaaaatccctctcacaaagaaaactccaggcccacatgccttcattagtgaagtctttcaaatatttaagaaaaaagttagtatcaaatttataaaatctctttttaaaaatggtcttaccaaaagattctgaatacaatgttatcctaacaccaaaaccagagaaagatatttgaaaacacactcatataccccaatacccctcaggaacatagatgcaaaaaaaaaaaaaaagaatgtttatcaaatcaaatccaataatatattaaaaggatattaaataatggctaagtatggaatgcaaagttagtttaacattagaaaaatagttaagctaattcaccattttaacaaactaaaaaagaaaaaaaaacccatatgattacctaaacaaatgcagaaaaagcatttgcccatatccaacatcagttcctcattacaactctccgtaaactactaatagaagcaaaattcctcagccatataaagggcatcttccaaagacacataactaacatcatatttttgacaaaagacagaaggctttccctctaatatcaggatcaagtcaaggatatctgatgttattacttctattcaacactgaacagttggttctactcagtgaaataggcaaaacaagtaaataaaaggcatggagattgaaagaaaagaataaaataaattaaaaagttaaagtgcctctattttcagctgacatgaatgtctatacagaaaattctatggaatctatgtgaaaagctacaagtactaataagtgagctcagcaagattgcaggatacaagatcaatatgcagaactcaactgtatttctatgcacaagcaattaataattgaaagctgaaatttaaaaaatgcctattacaatagcattaaaatacaaaataacttagaaataaatctgacaaaatatgtataagacctataaatttaaaactgcaaaacacctcttggaaaaattttaagtcctaaatagagaaatacattgtgttcaccaaaaggaagactcagtattattaaaatgttattttctggctaaactgatctgtagattcagtgcaatcccaataatatctcaacaaggttttttatagaaatatatgagctgattataaaattcatataaaaatgcacagaatccagaatagccaaaacatcttagaaaatgtaggacaaagaggacttacactagctggtttcaagatttacagtcctacaatattcaaagcagtgtggtatttgtatcatgacagacaaaatacataaatgaaacagaatagaaaatccagaaataggaccacatgtaaatggccttcaacaaaagtgcaaagtcaattcaatgaaaaagaatagtctttcctacagattgtgctaaaacagtatggtatccatagaccaaaaaaaaaaaatcaaaaaatacaaacttcttttgatattggcatcatatacaaaagttaactcaaaatagaacatatacctaaatgtaaaacctgaaattataaagactttagaaaacacagaaaatctattctaccttgggctagacaaaaatttcttagctatggtaacaaaaatcatcatccataaaaacaaaattaataaatgagacatcatcaaaattaagaatgaaatgacaaaccaaggcttcccatttccagcctagcaggtaagaagcttggaaattgctattccattctaacaagtaaaaagctaaataaattgaaaaaaactacaacttttagattcataagagaaatgagatcataaggcaaactactgccctcaaagctgaagaaacagaagacagaaacaacagagaagcagcctacaagcaaaaacctccacaggaaccagtgccagtgcaggaaaacctgaactcttaattgatgaattgctggagaattggtttggacaactctggcattaaaaattacagggggactcagtcattatggggcacccacagttttgtgaattttacatccagtagctctaccaggtcttcttggtgaatactggagaaagatcctccatgatccaggcagggggagggtgaaataaccatttaaaaatactccagatcattctcttctacttaacaaggtcttctctcaggagaaactatgtaatcagagcctaacctacagggatttggtcagaacttaactgacttgagagaaggggaatacccacctccagcccactctagaccttcttcctgacccacctacgagggaaagagaagcctatgagaagttcacaatccagaggtatggactgacccaaaaaaaaaaaaaaaaacctgaggactaattgtagaactacagaagatgtcctctctttccatatcttaccaccacattactaaaggcctatttataggatttccttctgcccagtacatcatgtccagctaactaaaaacatagttgaggagataaagcaagcatcaaaaccagactcagaaatggcagggatggtgaaattattacaccagcaatttattaaaactataattaatatgttaagaatgctaatgggtgaagtagacaacatgcagggacagatgggcaatacaggcagagataaaaactttaagaaagaacaacaaagaaattctagggatttaaacactataacataaatgaagaatacttttaatgggcttaatataggctggacacagctgagaaaagagcttctgatcttcagaatatctcaatagatacctcaaaaatggaaaagcaaaggaaaaaatgacaggaaaaaaaaaaaccaagaacagaatatccaaaacctgtaatacgactacaaaatgtgcaacatacacataaagggaatactagaaaaaagacagaatggaacagaagaaatatttgcaaacatgatgactaagagttctcccaaagttaatgtcagacacaaaaccacaaatccaggaggctcacagaacaccaagcaggataaatgccagaaaattaaacataagcttatcattttaaaacgaaagaaaatcaaggataaagaaaaatccaaaaagaatacagaggaaataacaccttatctaggggtaagtaaaaataagaattacaaccaacttctctccagaaactatgcaagcaaaaagacaacggagtaaaatattgaaagtgtggagaaaaaaaactacaattcttttactctacgaaattatccttcaaaaatggaggaaaaatactttctcaaataaaaaaaaaaggaatctgtagccagtagacctgtcttgaaagaaatgttaaaagaaattatttcaagagaagaaaaattatatacctaagaaattcagaacataaagagcatcagagaataaataagtgaaggtaaaatgaaagcatatttttctcattcttcattgacctaattgaaataatactagcaaaaatatatataactatgcatgcatatcaaattacacacacttatgtatgcttatgcatatgtgaaatgaatgacaacaatcatacagtggacaggagggacaaatacagcagatattaatccaactgtatcaatgattacattgagtgccaagcactataaatggacctactaaaagatagagatggtaacaacggatagtaaaacaagatccaactatatgtcatctataataaaccaactttaaatataaagatacatatagattaaaagtaaatggatggaaaaagatatataaaaatttaatgccaatttctaaaaataagaatagctatattaatttcagacagagccaactttagagcaaggaaagttatcaggaataaatggagtgatatacaatgattcaggtcacttcttcaagaaaacataacaacccttaatgtgtatgtatctaacaagagagcatcaaactacatgagacagaaatttctagaactgcaagtagaaacagattgatccactattatggttggaaacttcaacgcccctttatcagaaatggacagatccagcaggcagaaaatcaatacggatatagtttttagctcaacaatcaatataatggaccataaatcattataatcaccatcaatataatggacatctataaactacttcatccaacaacagaagaatatacattcttctcaagctctagtaggaaattaaccaagatagacctcatttggagccataaaacatatctaaactaatttaaaagaatggaattcatataatgtttactctctggccacaacggaatgaaactaaaaataagtaacaaaaagttacccagaaaatccccaaatacttgcagattaaacaacacacttataaataacatataggtaaaaaatatcaagagaatataagaaatattttgaacttaataaaaatgaaaggacaactcatcaaaatttgtgggatgtatcaaaagcaggagttggaaggaaaattacagtattgaaggcatatattgctaaataagaatactctgaaatcaatcatctatgttttccttttagtaaaatatttgaatccaaagtaagcagaagagtttccttgttctttttttccccaagatggctgaatagagacatcagatgccaattctcctgagaaagaaattcaaagttacaggtaaatggtcatgatctgagtggaaagctgaaggaagtgagccaaggtctgtgagagcccataggaaaaaagctgggggcacagaaaaggaaggcagcaagaatatggcaaaggctgacccctgaggaacttgaagtcccacagaaagggtaagtgagagtgtttctttgctcccctcaccgctgtgacaaactgctgacgactaaattgctggggaatgcctctgcccttgcaaccctaggaaatgcggtcagtagcaactcagaaacttcctagggacagagcactgagtggccagctcatggaggtgcattcacactcccctcaggcctaaactgacatagcaggtgccacactggttgtgcacctgttgtgggccattgctcttcctggggatcctcagccattgtgtcaccatatcaccagatcccctgcaaatataccacagactcttctctgactttggcaactacagggaaccagtgggaccttggaaaattgcaggatcccttcaacatgggctgcccctaggagatggaggagcacagctcacctaagtgcaccttgatacaaaggaaatgtgaacgcagtccctatctgtgaagcgggtggtactagtggccagaaacagatacggaggagtaaaccccactccccctattcactattgtggatgtagcagaggctttctctgctgggggctgacatgagtgcccttggaaacagcatttccagcactattcatggtagctgcaccccactgaaagggtacctgtaccacctgggcttgcagacagggcatgggccatctgccctccgtacacagagcagtagcgtcctagcaacacagcacagacaagccacagaattgtctgctctggaatgggggaagaggatctgccctgcaaccacttttgtggtagcagccagagaggtttatttcaagaatctcagttgcactgtggctgggagataaagcacaagtctattaattgaagatcataaaccttgcaacaagggcatgatagggaaaaggattgtgttcctgcctgcccaggacaaggaactggtgcagcgccccctacccctctccccaagacctcagcacatcccaacacaaatttcccctgccaaccccatcaaagagggtcctttcattagttatcaggctgtgaaagaaggagctagtgcctactcttaaacaccacctactggactgaagacttaactgccccaccatgtaagaaatctgctatcagaagggcatagagctaatgtaagacagacgcttcctgagacctccgcatttccaatcttgcagaagattgtgtgtttggctcatatgccaaacacattactacaacaagcagcatttgagaaagccaccacacaaaagctacccataacaccaaggaacttattcagagccttggcccctgaaagcatccagaaacaaagccaaagaaacatacacaagatacactgcagtcacattctcaaggtacaaattaaaaaaaaagaaatcccactcaaacaacagcaaattcaaaataagaagtgacagcttcttgagacgagaaggaattagtgcaagaactctggcagtacaaaaagacaaagtttttgacaccaccaaaggattgcactagctctctacaatggatcctgaccaaaattaaaattctaaaatgatgattaagaattcaaaatatatattgtaagaaagctcaatgagtgccaagagaaagttaaaaatcaacacaaagaaactagaaaaaaacaattcaggatgtgaaagacaagatataataaaaaagaatttctggaaatgaaaaattcactgaattaattccaaaatatagttgagagcttcagcaataggctagaccaagcataaggaagaatttcagagcttgaaggccagtctttctaattagcccaatcagtcaaaaacaaagcaaaaaaaatttatttaatgaacaaagccttcaagaaacataagattatggaaaattaccaaacctaatgatgtacaggcatttcagagacagaaggaaaaaagagtagacaacttggcaaacatatttgaggaaataattcaagaaaatttccatgctcttgctgtagaggtagacatccaaatacaagaaatatagagaacacctgaaagctattatacaagaaggacatcatcttgcttttcccacagatccttgcaacccacaaataaggaagtccctcatgaccccaagcacatagctgtgcagactcacagggactgctcgggtaggtggctgctcgagcaggcactgagacacaggagtttttgcattgtctggttctggaaactccagtgaggcacagcaggctggagactgcctaagaagactgagtactggcaatgggtagggatggccaccatcactagggctccagttggttgttttcccctgctgccagtgccagcaagactgggcaatttggacaaggagcaattccccacagcgcagcacagcagctgggacagttcaaggccagacagcgggacccagatccactcctaaccaggaagaacccctctgtgagaatttcagcatccccaaccaggggtttataaacagaactctgatatccctgagagaagctcctaggaagaggggcggctgcagtattgtcaatcagtggtcttagtcttttctaactgctggctctcaggagtcagggtagcccgaggattctgcccaactgcagcacacccgctttgccaaggggaagccagaccccttatttaagtgggtccctgatcccactccgcctgactgggtgagacctcccaacaggagtctccagaaacctcatgcaggagcattccagccagcatcaggtcagtgaccctctgagacagagctcctacagtaaggaacaggctgacatctttgctattctgcagcctccactggtgataactccaggggcaggagggacccaagtgaatagggtctggagtggaccccaagcaaaacgcagcaaccctaaggaagaggggtctgattgctaaaagaaaaacaagtgcaaagaaacaacaacaacataaatgaaaaacaccccacaaaaccacatccaaggtcagcatctcaaagatcaaaagtagataaacccatgaagatgagaaagaatcaacataaaaatgctgaaaactcaaaaagccagagtgcctcttctcctccaaatgatcacaacacgtctccagcaagggcacagaactgcgctaaggctgaaatggatgaattggaagaagtaggcttcagaagatgggtaataacaaactttactagctaaaggattatgttctaactcattgcaaagaaatgaagaagcatgacaaaacattacaggaactgttaactagaaaataaaacagtttagagatgaatataactgacctgacggagctgaaaaacacaacatgagaagttcacaatgcaaacacaagtatcaacagccaaatagaccaagcagaagaaaggatataagagcttgaagactgtcttgctgaattatggaaggtagatgagattagagaaaaaagaatgaaaagtaacaaacaaaacctccgagaactatgggattatataaaaagactgaacgtacgactgatagaggtatctgaaagagaccgggagaatggaaccaagttcaaaaacacacttcaggatatcatctaggagaacttccccaacctagcaagatagtccaatgtacaaattcaggaaatacagacaaccccagtaaagtactccatgagaagaccaaccccaagacacataatcatcagattctccaagatcgaaacgaaagaaaacattttaagggcagccagagagaaaggccaggtcacctataaaaggaaatccaacagactaacagcagacctcttagtggaaaccctacaagccagaagagattgggggccaatattcaacattcttaaagaaaaaaatgtccaggagcaggttgttcaatttccatgtagttcagcggttttgactgagtttcttaatcctgagttctagtttgattgcactgtggtctgagagacagtttgttataatttctgttcttttacatttgctgaggagtgctttatttacaactatgtggtcaattttggaataggtgagctgtggttttgagaagaatgtatattctgttgatttggggtggagagttctgtagatgtctattaggtctgcttggtgcagagctgaattcaattcctggatatccttgttagctttctgtctcgttgatctgtctaatgttgacagtgggggttaaactctcccattattattgtgtgggagtctaagtctctttgtaggtctctaaggacttgctttatgaatctgggtgctcctgcattggcagcatatatatttgggatagttagctcttcttgttgaattgatcgctttatcattatataatggccttctttgtctctcttgatctttgttggtttaaagtctgttttatcagagactaggattgcaacccctgcctttttttgctttccatttgcttggtagatcttcctccatccctttattttgagcctatgtgtgtctccgcacgtgagatcggtttcctgaatacagaacactgatgatcttgactctttatccaatttgccagtctgtgtcttttaactggagcatttagcccagttacatttaaggttcatattgttatgtgtgaatttgatcctgtcatgatgatgttagctggttattttgcttgttagctgatgcaatttcttcctagcatcaatggtctttataatttggcatgtttttgcagatgctcataccggttatgctggtaccagttcctttccatgtttagtgcttccttcagaagctcttgttgggcaggcctggtggtgacaaaatctctcagcatttgcttgtctctaaaggattttatttccccttcacttttatgaagcttagtttggctggatatgaaattatgggttgaaaatttttttctttaagaatgttgaatattagcccccactctcttctggcttgtagagtttctgccaagagatcagctgttagtctgatgggcttccctttgcgggtaacccaacctttctctctggctgcccttaacattttttccttcatttcagctttggtgaatctgacaattaagtgtcttggagttgctcttctcgagtagtatctttgtggcattctctgtatttcctgaatttgaaggcagaaataaagatgttctttgaaaccaatgagaacaaagacacaacataccagaatctctgggacacacttaaagcagtgtgtagagggaaatttatagcactaaatgcctacaagagaaagcaggacagatctaaaattgacaccctcacatcacaattaaaagaattagaaaagcaagagcaaacacattcaacagctagcagaaggcaagaaataactaagatcagagcagaactgaaggagatagagatacaaaatctcttcaaaaaatcaatgaatccaggagctggttttttgaaaagatcaacaaaattgatagactgctagcaagactcataaagaaaagagagaatattcaaatagatgcaataaaaaatcataaagggggtgctgggcgtggtggctagtgcctataatcccagcactttgggaggccgaggtgggcagatcatgaggtcagcagttcaagaccagcctgaccaacctggtgaaaccccgtctctattaaaaatacaaaaattagctgggcatggtggcatgtgcctttaatcccagttactggggaggctgaggcaggagaatagcttgaacctgggaggcggaggttgcagtgagccaagatcgtgccactgcactccagcctgggcgacagagtgagactccgtctcaaaaaaaaaaaaaatgataaaggggatcccaccaccaatcccacagaaatatgaactaccatcagagaataccataaacacctctacgcaaataaactagaaaatctagaagaaatggataaattcctcgacacatacaccctcccaagactaaaccaggaagaagttgaatctcttaaaagaccaataacaggctctgaaattgaggcaataattaatagcttaccaaccaaaaaaactccaggaccagacagattcacagccgaattctaccacaggtacaaggaggagctggtaccattccttctgaaactattccaatcaatagaaaaagagggaatactccctaactcattttatgaggccagcatcatcctgataccaaagccgggcagaggcacaacaaaaaaagagaattttagaccaatatccctgatgaacgttgatgcaaaaatcctcaataaaatactggcaaaccgaatccagcagcacatcaaaaagcttatccaccatgatcaagtgggcttcatccctgggatgcaaggctggttcatcatacgcaaatcaataaacataatccagcatataaacagaaccaaagacaaaaaccacacgattatctcaacagatgcagaaaaggccttcgacaaaattcaacaacttttcatgctaaaaactctcaataaattcggcattgatgggacatatctcaaaataataagagctacttatgacaaacccacagccaatatcatactgaatgggcaaaaactggaagcattccctttgaaaactggtacaaaacagggatgccctctttcgccactcctattcaacatagtgttggaagttctggccagagcaatcagacaggagaaagaaataaagggtattcaattaggaaaagaggaagtcaaattgtccctctttgcagatgacatgattgtatatctagaaaaccccatcgtctcagaccaaaatctccttaagatgataagcagcttcagcaaagtctcaggatacaaaatcaatgtgcaaaaatcacaaacattcttatacaccaataacagacaaacagagagccaaatcatgagtgaactcccattcacaattgcttcagagagaataaaatacctaggaatccaacttacaagggatgtgaaggacctcttcaaggagaactacaaaccactgctcaaggaaataagagaggacacaaacaaatggaagaacattccatgctcacggataggaagaatcaatatcgtgaaaatggccatactgcccaaggtaatttatagattcaatgccatccccatcaagctaccaatgactttcttcacagaattggaaaaaactgctttaaagttcatagggaaccaaaaaagaacccacattgccaagacaatcctaaaccaaaagaacaaagctggaagcatcatgctacctgacttcaaactatactacaaggccacagtaaccaaaacagcatggtactggtaccaaaacagagatatagaccaatggaacagaacagagtcctcagaaataataccacacatctacaactatctgatctttgacaaacctgacaaagacaagcaatggggaaaggattccctatttaataaatggtgctgggaaaactggctagccatatgtagaaagctgaaactggatcccttccttataccttatacaaaaattaattcaagatggattaaagactacacattagacctcaaaccatgaaaaccctagaaaaaaacctaggcaatcccattcaggatataggcatgggcaaggacttcatgtctaaaacaccaaaagcaatggcaaccaaagacaaaattgacaaatgggatctaattaaactaaagagcttctgcacagcaaaagaaactaccatcagagtgaataggcaacctacagaatgggagaaaatttttgcaatctactcatctgacaaacggctaatctccagaatctacaatgaactcaaacaaatttacaagaaaaaaacaaacaaccccatcaaaaagtgggtgaaggatatgaacagacacttctcaaaagaagacatttatgcagccaacagacacatgaaaaaatgctcatcatcactggccatcagagaaatgcaaatcaaaaccacaatgagatatcatctcacacaagttagaagggtgatcattaaaaagtcaggaaacaacaggtgctggagaggatgtggagaaataggaacacttttacactgttggtgggactgtaaactcgttcaaccattgtggaattcagtgtggcgattcctcagggatctagaactagaaataccatttgacccagccatcccattactgggtatatacccaaaggaatataaatcatgctgctataaagacacatgcacacatatgtttattgtggcactactcacaatagcaaagacttggaaccaacccaaatgtccatcaatgatagactggattaagaaaatgtggcacatatacaccatggaatactatgcagccatgaaaaatgatgagttcatgtcctttgtagggacatggatgaagctggaaatcatcattctcagcaaactatcgcaaggacaaaaaaccaaacaccgcatgttctcactcacaggtgggaattgaacagtgagaccacttggacacaggaaggggaacatcacacaccggggcctgttgtggggtgggggaatggggggagggatagcattaggagatatacctaatgtaaatgacgagttaatgggttcagcacaccaacatggcacatgtatacatatgtaacaaacctgcatgctgtgtacatgtaccctagaacttaaagtataataaaaaaataaaaagaaaaaaaattttcaacctaaaattgtatatccaacaaaactagcttcataaacaaaggagaaataaaatctttttcagataagcaaatgctgagggaatttgtcaccactaggcctgccttgcaagagctcctgaaggaagcattaaatatggaaaggaaataccattatcagccactaaaaaaacacattgaagtacacagaccaatgacatcatgaagaaactacataaacaagtctacaagataaccagttagcatcatgctaacaggatcaatttcacacataataatattaaccttaaatgtaaatgggttaaatgccccaattaaaagacacagaatggcaagctggatagagtcaagacctattggtgtgctgtatgcaagagacccatttcacatgcaggctcaaaataaagggatggaggaaaatttatcaagcaaatgtaaaacagaaaaaagcagaagttgcagtccactttcagacaaaacagactttaaaccaacaaacatcaaaaaatacaaagaagggcattacataatggtaaagggttcaattcaacaagaagtgctaaccatcctaagtatacacacacccagattcacaaaacaacttcttagagacctacaaagagacttagactcacgcacaacaatgcacccagtgtcaatattagacagatcattgagacagaaaattaacaaagacattcaagacttgaactcagctctggaccaagtggacctgatagatatatacagaacttgccaccccaaaacaagagaatatctttttctcagtgttacatggcacttactctaaaatcaatcacatatttggaagtaaatcactcctcagcaaatgcaaggctacagtaaccgaaacagcaccagtacctttacttacaccttatacaacaattaactcaagacggataaaagacttcgatgtaaaacccagaactataaaaacccaagaagaaaatccaggcaataccattcagggaataggcataagcaaagatttcatgacaaaatcacaaaaagcaattgcaacaaaagcaaaaaaatgatgaataggagctaattaaactaaagtgcttctgcacagcaaaagaaactatatcatcagactgaacaggcaactacaaagtaggagaaaattttttcaatctatccttctgacaaagatctgatatctagaatctacaaggaactcaaacaaatttacaagaaaaaagaaacaaccctattaaaaagtgggcaaaggacatgaacagacgcttctccaaagaatatatttatgcagccaacaaacatgaaaaaaagcttaacatcactgatcattagagaaacgcaaatcaaaaccacaatgagatactatcttgcaccagtcagaatggctattgttaaaaagtcaagaaataatagatgttggcgaggttgtggagaaatagaaatgcttttacactgttggtaggaatggaaattagttcaacaattgtggaagacagtgtggtaattcatcaagtatctagaaccagaaataccatttgacccagcaatcccattactgggtatatacccaaaggaatataaattgttctattacaaagatatatgcacatgtatgttcactgcagcactattcacaataacaaagatgtgcaatcaagtcaaatgcccatcaatgatagattggataaagaaaatgtggtgcatatacaccatggaatactatggagtcataaaaaagattgagatcatgtcctttccagggacatggatggagctggaagctattatcatcagcaaactaacacaggaacagaaaaacaaataccacatgttctcacttgtaagtgggagctgaacaatgggaacacatgaacaaagggaggagaacaacacacactgtggcctgttggggggtcatgcagggggagggagagcattaggaaaaatagctaatgcatgctgggctaaatacctaggtgatgggttgataagtgcagcaaatcaccatggcacacatttacctatgtaacaaacctgcatatcctgcacatgtaccccaaaacttaaaaataaaaatttgcaaaatatttgaaattgacacttcaccaagaaagatatacctatggcaaataaccacataaaagaaaattcaacataactagtcattaggaaaatgcagattaaaaccccagagagataccactacacacctatcaaactatctcaaactaaaaagaatagtcctgtggtttggatgttttgttccctccaagtctcatgttgaaatgtgacttccaatgttggaattgggcttagtgggaggcgtttgggtcatgggaacagctccctcatgaatggctttgtgctatccttgtggtaatgagtgagatctcactttgtgtgttcaagcaagatctggttattaagaatctggaacttcccttctctcgctcttgcaccctctctgaccatctgatacactgattacccctttgccttctgccatgtaagcttcctgaagcctcatcagaagcaaatgctggcactatgcttcttgtaaagcctacagaatcatgagccaaataaacatatttctttataaattacccagtctaaagtattcctttatagcaatgcaaaagagacacgcacatctatcaagtgttggccagccgttgtacactgttggtgggaatgtaaaatggtacaactactttggaaagctctttggatattttccaaaaagttataaatatatctatcatgtaacccagccatcctaattataggcatttacccaagagaaacaaagtcttgtatagaaatgtccataccagccttctttgtaatgacccaaaactggaaacaacccaaatgtctatcaacaggtgaatggataaacaaatggtgctataaccatgcaattacattagctggcaataaaaataatttattattgatacatgtaacaacaaaaataaatctcaagtaatcatgctgagtaaaataagccagacaaaaagaaataataatatattatttcttttaaataaaaatctataacatgggtggaggaggctgggatttacaaagaagaatgaggaaacttttgggctaatgaatattttcattatcttgattgtcatcacagtctcacagaatatatatatatgtatatatataacacatacatacattatatatgtgtaatatatatacatatataaacttaccaaattatacactttaaatatgtgtagaaatggaaagtgaaatatttggatttaaaacattagccatataatagtcttccactcagccttttccaatttccctcaaaaatagtttaaaagacaaaaaagaaggcgaagggaaacatcttttaacacaatgacaagtaaatttgacagccaacatattgacagaatttaggagaactttccactcattaaaaagacatatacagtggaaaatgaaatggtaagtgatggccaacatgctgtgccacctgaaatagcacaaaattgcaggtgagagaggcagagagttacgttatgcctcaacttttatttgtttttggcctagaaatctgaagtttttgatatccaaacactaggaagagatacaatgcattttacatcaaattctatatagattcaagtactttcaatcctggcaattacaatgacacactctatcctaagttctaacacttcataagcattgatggaaataggaaaactcctgtgcattctctacatttggagaatgaaagaatcaggcagttaaggttctcagcttcatccagaaaagcacataagatcaaaatgaaatcaagaaaagaaccgtgcacatcagcttctcaactgcaaatctgtgtagaagcttctacatataaatggacagtaagcaggatcaaaaacataccacaaatgatgcttcttggcacatactgggtttagataagtctctctttgttccaagtgaaatagagaaaactgtcaacttaaggcttgtgaaagaaagtggcaaaaaatgaaaaagagaaaatcactcttaaaacacactggaggagtttaactctgaaaagttatttactaaagcatgaagacaaatttagaaaatgtttagcaccatcaatggaatataagaagacatagaagggcagagacaacttgctgtccaccaaaattttgtttccttcccatagcacagagtttttgctgcacagctagggctaaatttcccagtacctcctatactgacatgttgctgtgcaactaattcttgccaatgggaatgtgaatagatgtgatgtgtgctacttctaaactagaacttttaaaaagtgggtcggatttttcaactttttatttacctctgaatataaacacagatggatacagaaggctttgcaatatgagactatgaagtcacaaaaatgaaagcatttgggtctctgaattcacatgtggaggataaccaccagccaaccaggaatctgcattgaattattatatgagtgattaatagaactctattgtgctcagccactgaaatactgagtcactttgtaacaacaattagtggtaccataattaacacatgtggcctctgcaatacataaatgagaagccactacaatagaatgaacagatagaaaatgataacagaataagatatgacagtagaaatgaaaaaaataatttggtaccaaaagagtataaggaaacaaaaaatacaaacaatagggttaaaatatccattgggaataggagtgaaagagaagaaatatcatttaaatataaccaataaaatggatatgaaaagtaagaatggtcttcctgaatgcaaaagaaaagagaaaaagtacagtttgaagcaacagagaggatatgatattgagaaccagaaaacagaacaggagttataagtcattccaagaaaaaagagtaaaatcattcaaacaagagtagtaataaagacataattgaagaaaacttagagaggagtagaaaggcccaagtatgaaaattattttttatagaattcaggggataagtcctaaataaaaacatgttctggtgacatgcttgagttacagcaatgaaagaagaaagcttgtagcatctaggaaaaaagcacaacacattatctacaaatgaataaatacaattaaagttttatatttctcctctttaagatgaaatgtcagaagacaatggagtaaaaatgatgagtattgtcataaaaagttgtgtctcaagaaaccatcctgttttcttctctataccatgttaacttattttaaaatatagcaattacagcataggtatatattcttgaatagaacacatatacataatttttaatgtagtcttataaagctagtacatattttcaaaaaatgcttttcctttgttaataattttctaattgcagaaatgctagaataccaagatatttctttacctggttaatatttcaagaacatagctaatctattattactagtaataaagcatcagcaaaagtcaagatgacattgcttctttctgatcaattcaagggaatatggtaatgatgaaatttcaacggtgcataataacacttttattccaaatttctttctgagattggtatctttggctcatattcagtgtatcccacatttctgacagctttctgtagaaacataatattgcttttagttaagaattttagccatggatatatattaacaagattctcactgtaaatttgatgccaatataatacaaacagtattcagtatgttagactacttaaagaaattaaggaagatcataaacaaatttacagttaggtgctatatgctaaatctaatgaagatataaattcagaagcatctccttcatgccacggtaaatatttcagtgaactaataatacaaaacttgtgtaatgcagaagtgatttggaaaccttagtaactatattactttggtagagttactcttaaatgaatattaagaaatttttagaaatcacaacctattgtttgaaatattttgtctatttccagagtgttagaaaacagtatagtaccatatgtaagattctttatcagaattaaccacttacaaccccaatcatatccagcagttacccttacttcctatagtaccctacagctccaacaatcctaatagactttgaatacagtgaagcaagactaaagtttaaagctgagatccaaatggcctgttttttttgtttttgtttttgtttttatttttggtatccaattccaacacaggatctggcaacagacagtcctgggcttgaagcccagttctacaaactgtattaggctaggcaagttatttctcctctgtaagactgagttccttcatctgttaaatagaaataatattacttaattcatagtatttgtgaggctttatattatctataaggcacctagtacaatgtgtggcatatggtaagcacttactaaatttatagatatcattataatcaacaacacaaatattataattgccaagattctctattcttaatttttctaaaaagagaccaagaaaatctgtctccatgcaaaaaaagttctcaattaaccatcaaaccatgaattttgtttgtatctctcatttttgttataggatttctaaaagggacattctccatacatgaacaactctttaagtgaaataatttttcacttaatgaaaatgaaaacccaatgacagtttttacatctgcttttaaaattttgctttttggtttttaacaaattaaattaacacatacatcaaacagacccttctaaagtcaggtgcctacagtagtcaataaaattggtcttcttgttcatctgtgtcttaagttttttttttttaacaaagaagtacacactaaatcttttttaaatttttaaaaatattttaatatttttaaaatttttaaaaaattttttttcttgctatgttgcccaggctgaactcgaacacctggcatcaagcaatcctcctacctcaacagtagctgggactacaggcacataccaccacacctagctttaagttttcttcttagtaatagccccttgagagcagcaacccttatcttgtatacccctctgctctctatgtctagcaactaccaggctcataggaggcattcaacaaatgttcattgaattaatgaattcagagtttatttagtttaaatggctttacaggccaggcacagtggcccatgcatgtaagcctagcactttggaaggcccaagcgggtggatcatttgaggtcaggtgttgcgagaccagcctggccaacatggtgaaaccctgtctctactaaaaatacacaaattagccaggggtggtggcaagcacctgtaatcccagctactcaggaggctgaggcaggagaatggcttgcacctgggaggtggaggttgcagtgagcagagattgcaccactgtactacaacctggaagacagagtgagactctgtctcaaaataaataaataaataaatatataaataaaaattaaaattaaaaaatggctttacaaatggtttatatccttacataattaccacttaaaatactgaaccaatgcacaaaaatagatgagagctaaaatttattgagtgcttactatgtattaatcactatgctaagcattttacatgtattatttaatactcacaagaactctattaaataggtaccattaccatccttattttatagtgaggagtcagatttaccaagaggttaaataattggctcaagggcatacagctggagccaaaatttgaacttaagatgcctaaatcaagagcctgttggagtaagcactttactataattgtctccaaagcttggttttggtatagaaagcacttcatacttggaataagaagacctggattattgacctctgccactaatatgcttcgtgacctcagacaagcctctctaagcttcagttacctataactatcaaaacaagaagatagttgtgagaaacaaataatataatacatgttaaagcactttccaactgtatatttacacagtatatgtaactacatatattgtctacatatattaatatgtaggccaggcatggtagctcatgcctgtaatcccagcactttggaaggccaaggcaggtagatcacttgagcccaggagttcaagaccagcctgggcaacatgacaaagccctgtgtcaacaaaattacaaaaattagccagccatggtggcacgtgcctatagttactgctatttgggaggctgaggtgggaggatcacctgagccggggaggtcaaggcttcaacgagctgtgattgcacacctgcactctagcctggccaacaaaatgagaccctgtctcaaaaataaaaataaaaaagcatgtagatttatctttaaaatatttgaaaatagaaggaaaaaaataagcataaatattataaggaaataacagtatagaatataattttgtaggcctagtaggaataaaagtactactcaggaaaggtccaagaataaacttttaaatatctgcacaaggcttcaaaaaaatctgagtttctctactcaacatcaatagaaaacaaccccatactaattttatgataccaagttgaactagaagcaaaaataacaatgtcttaactttgtatatgtaaaagctcttttaaatctattgctgcaactgcaagatggagttttaatatcagtgagattaaacaaaagaagaggaatgaagaaaagaacagagacatgaaagaccaacagatagggatttttgtcctgctcttccttttactctctatgtggccttgagtaaattacttaacctttctgatcatcagtttctttatgtgtaaaatgggaaaaaatattggtaattaatgtgttgtgaagatgcaataacataatttatagcaagcgtatcgtagggcaaagcccagtttagggattcaataaatggtagtgtggttattatctattagtttatacagctgagtgaattaaagacacaggtagtcatatcttgctgaaggtcacccaattattataggaaggaaacaaggctagaacttaacatcctttagttcttactccagcaatttttaaatttcgtaagaaataatgtagctttgtagtatttctttaccagagaggactataaaatattcattcccacttaagaaatgattgaatttttgctcctatgagataatgttaattcacacaggctgttatttactgaaagatgtccaagcacattgattttatattggaatattcatctcagaaaaaaaagcagtggaagtagaaataattgtcaagtcaatctctggtttgcttattattacggaaataaattaaactttgctctagatttttgacatgtaattctgatactaataggttcacatacatttgtctttcctctacctgctaataggaagcagtctgtaatggtgtgtcagaaatctaccagtaactgcctaatgtttcccttaaacagaaagcgactgtctacaattgcatcagcaattgtcaagtttactgtaacgaaggaaagagcaccaaaatggctctgctatgaaaatcagatgctttcacctggaatcccactcctgaattgattagaagcacagttatcagtccctgttttaaagaaatccaaaattgaacctcaatcttgctaaaccatcaactaagacatacattgtttccctcattcccctaacaggcaaggaggaaaacagcgtttcttttgttagacacagatatttttagattattgtcaaaacccagagctatactggggtggttggtgctaccatataatctttcatctttttatcagagagggccaggctgtttcttcatttgtgcaggaaatctatgatcaaggcaatggaaatacaaatattaaagtagataatgtttctgtcctcaagaagctctcaggctaatggaagagacacatatgcaatgatctttacaacatagtgtgcagaaaacgtgggcacgtagatggaaaatgaaaagaaaatgaccaagtgatgagaatagaaccctcaaatacatacagaaggaactatatgagcaaatacaactgaaaaatgaaatagcctggcatagtcaggaaataagggagttatggaaaaacctagtggaaggagggacaactgagggtagaaagacacagagagcccaactcatgaaggatcctgtatgttattttgaaaagctgggactttactttgaggactaattagaagctggtaagagacatggtcaaatatatattcaaaagttttcacctcagctgatgaagatggcaaaaaaagttcaaatgccagtgtgtgggctaacccacatgaccattgtcccacaacccaaaaatataaagcatattattgtatttctatattaacattcactggataggaaccagctttttttgttcatttgaccattttaataacagtgttctgtgaactataaatggcatcttgcagaatctaatgtgtatcagaaactgcaatgatagaaagggaaagaagggaagaatagagaaaacagtgattgaccagttatctaccatgtaccagatactttgtgttaggtgctctgaatatgtttaatcttcccaataaggcaaatcttatcacatcaactttacaggtatgtaaacagagtttcaaaaaaattaagtttccagtgtatacatatattgctcagatctatacctagagctgtcagtcttcaaagtgtttaatcttttcactacaccactctatctccttgaaaaaaaggaaagaatgaagagcacaagataaagaaaaagttggataggcactctaaaatacatgaaaacatgggtacctgtgctgctagcaagtattagcatttaaatgctactacaaagagatttcagaatatgacatcctgaagtggtcaatgaatcctatcaacacaagtataaatttgaaaaaaaaatttaaaaatcacaacaatctcaggcctctggaaataaagcaaaggcagacaacagattgagaagcacctattctttaaaaatcatcagagcttttggtacaaacagaagaagtttgagattttcttgcttgaagctactcccatcccactccccagctccacagttgagaacaatagctttgccaatgtggtgctaaccaaaaaacaaaacaaaatgaaacaaaaaaacagcaactttgctaccagaggcagacttgatttgggacacaaagacaatagcccatgattctgtaagctttttaagtttacaaagtggtaaactttgtagaaaacaaataggcaaagcctacagctttgctgatctgaagttgcagctccaattggggctatgacagaacagaaatttaaagggatcctagaaatgatgagtcataggagggctgaaacatgcttgccacatatccctggctataggtataggttatgagacctgagagaaactacagcaaaaagtaaaagccaagacagacttgagtaatagctacaattctgaataggctctccaaattgcacactggtccattggcaagagggtagaaatcttatgggcctgaggtatttgagcacaagtgctacttaaatcactggctaaatactaagcaatgcagacacaaaagaagtgacttacaggaagccagactaaaaaataaaaataaaatgtgatgcagccaaaacaattgttaaggtgaaacttatagcttcaaatgctttattagaaacaaataaatctatcatcaataatcaacacttctacttcaagaagctaaagcaatttacagattcaatgctatttctatcaaactaccaatggcattcttcacagaactagaaaaacatattttaaattctatatggaaccaaaaaagagtttgaatagccaaagcaattataagcaaaagaacaaagctggaggaatcatgttatctgaatttaaactatactacaaagctacagtagccaaaaaagcatggtactggtacaaaaacacagacacataggcctatggaacagaatagagagcccggaaataaagcctcacatgaccatctgatgtttgacaaagctatccaaaaaaatcaatggggaaaagatttcctattcaataaatagtgctgggataactggcaagccacatgcagaagattgaagctagaccccttccttacactgtatacaaaaatcaacttgagatgcattaaagacttagatgtaaaaccccaaagtataaaaaccctggaagacaacctaggcagtatcatcctggacgtgggaacgggcaaagatttcatgacaaagacatcaaaagcgataacaacaaaagcaaaaattgacaaatgagaactaattaaatgtaagagcttctgtacagcaaaagaagctatcaacagaataaacagacaacctacagaatgggagtaaatatttgcaaactatgcatctgacaaaggtctaaaatccagcatctaaaaagaacttaaacaaatttacaagagaaaataaaacaaccccattaaaaagtgggcaaggacatgaacagacacttctcaaaagaagacatacatgcagccaacaagcatatgaaaaaaatctcaaaatcactgatcattagagaaatgcaaatcaaaaccacaatgagataccatctcataccagtcaaaatggctactaattaaaagtcaaaaaaataacagatattggtgaggttgcagagaaaatggaacccttatacactgttgatgggagtgtaaagtagttcaactatggtagaaagcagtatggcaattcctcaaagagctaacagcagaactaccatttgacccagaaatcccattactgggtacacacccagaggaatataaagcatgctaccacaaagacatatgcatgtaaatgttcactgtagcactgttcacaatagcacagacatagaatcaacctaaatgcccatcaatgacagactggataataaaatgtggtacatatataccatggaatattatgcagccacaaaaaagaataagatcatgtcttctgcaagaacatggatggagtgggaggctatcatccttagtaaactaacacaagaacagaaaaccaaatacttcatgttctcacttataagtgagagctaaatgataagaacatataaacacaaagaaggaacaggaaacaacagacactggggtctacttgaggggggagggtgggaggaggaagaggagcagaaataataactcttgtgtaataagattaatacctgggtgatgtaataatatgtatgacaaacccatgtgacatgtgtctatttatgtaataaaccttcacatatacctccaaacctaaaacaaaaattaaaaaaaagaataacaaatcaaacccaaagtaattacaaggaaagaaataataaaaatcagagtggaaatcaataatatacaaaacaaaaaattaaaaattgatgaaaccaaaatgtggctctttgaaaagatagagaagccaggcatggtggctcatgcctgtaatcccagcactttgggaggctgaggcagatggatcgcctgaggtcaggagttcaagaccagcccggccaacatagtgaaaccccgtctcaactaaaaataccaaaaattatctgggcgtggtggcgggcacctgtaatcccagctactagggggctggggcatgaaaatcgcttgaacccaggaggtggaggttgcagtgagctgagatcgtgccattgcactccagcctgggcaacaagagcaaaactccatctcaaaaaaaaaaaaaaaaaaaagaaaagaaaagatagagaaatttgataacctttagcccaaaactaacaaagaaaaagaaaagacatacacttccaaaatcagtaatgaaagctaggactctacagaatatgaaaagaaagtaagaaagtaagttgaccccacacatgaaactaataattcatgttattagtttcacatctataggattttgatggtctctgcctttgaaagagttgcagtaagtcattacttaagtattactgtaatttctatttctctttcacatttaaaaggacttttttcaaaaatcaataaatttcttattctttccaaatcttaattattgtaaacagtgcttgcagcacaaacatgggagtgcagacatcccttcgatttactgatttcctttcttttggttatataccagcagtggaactgcaggatcataaggtagctcaatttttgatagcacaatagggtgactatagtcaacaacaacttaattgtatattttaaaataatttaaagtgtataattgcattgtttgtaactcaaaggacaaatgcatgactgtaaggataccccattcttcgtgatgtgcttattttacattgcatacctatatcaaaacatctcatgtactgcataaatatataaacctactatgtacctataaactttttttaaatattaaaaaagaaaattccccaagtgaaattttcattggaaaaaaatcaacaaactttaatgtttattcggtgaatatttacagagcacttagtttgtctaggtattctgttgactgctgcagacattgtaacaaataaaatggcctccacctgtaaaataaagctcacagatcagtgagaaagacataagtataaacaaataatcacaatctagtgtgctgagttgtgaaatgctatggggatgctggagaagaagtgcctaattcttcctaaatgaaagaggaaagtgcatagagggctaggaacagggggttggaggttatatcttgaagctggtgcttgaatgatgactgactgaagatcgcctgaatgaccacctgatgacgaaggaatggaaaagagtttcagaaaaggtacaatcccatgcagaaaagaatcatgagtgtgtgtacccaagactatttccatcaatagtcacagaatttaataggtcggaaaaaaaggcaagctcactagtgatctataagcacccacgaaaattgagaaacagctttttcttttttagaactctatttgaaatcttagaacaccaccagccttggaaggtcctgagatgtcttctcatccaactcttttgcttttaggtgggtaaaatgaggctagaaacattaggaacactcaattaccttgcatttattggtcatatcctatgttgaaaaacctctactttaaagggcccagcatgtattcttcatgacacctcctctacaagagtgagtcaaatacaaaatcagatcttcatcttaacttgcccaattgcccagcccatgcttgctatttctactctacacaaaacttggcccagaggagaataaaaaagatataaatatataattatatttatatataaatttatatatttttattaaagagaataaaagaatatatataagaataaaatacacacacacacacacacacacacacacatatgtttaaccacacgtagtttcacatttcttcaggctaatgagacagaagaaaaaaatctattacctggtaacagcctaactatctacctagatctgcagctaactgttttccaaaaaaaagaacgaaatcaccattaagtggtagaattacagtctttgagagatagagaggtatcactgcaagatttgattaatcacaacttgatacaatgaaagtatgtcaagcagtaacgaaacaatgtcaaatcacaaaatagtgcttgcacatgcagttaataccatgatcttccccactcaatactgattttgtttatgacatttgtaatgagcttttgacatttgagtgatagctacactgagataagaaattagaatgcctggggattagcttttcttaagcaataggtactgtctaaactggaattacaaagtattgacaactaaaattgttttaaatgtcttgaagattctaagtttcaggcctgagatgtggaagatggaagtccctatggatcatctaatctagtgattgtcattctgttttccaaccaagggataagacactgtcatgcaggccatccctagaagggtgtgggctggaacctagacaagataattagactttaaaaaaaggccacattgttggaatctttcatgggccccttgccataatcattaaagagattttgatattaaatgttaataatttcataacagaaacaaaaaaatactgtatattctcatttataaattggagttaaacaacagatacacatgaacatacagagggaaataatagacactggggactccaaaagtgaggagggtgggagggaggtaagccgggaaaaattacctgttgggtacaatattactatttgggtaacccaaaccccagcattacacaatacactcatgtaacaaatctacacatgtaccccttgaatccataaaaataaaaaataaaaataaaatcatgctaatgattcagaaaacagtaataaatcagccccatgagtctataccttactccaaacaaaaggctcagaaaagccatcttagttgccttgtccaagggatgggtttgtcagtaggttaactgtagtattcttaatattgtatctgtatctactaagggagacagtatatcaaactctccacagggagaaagagcatatatgatttaaagcctcctccaggggggatccactttccagatgagaatcactaattttgtgaatcacttaattttacagatctgaatctgaaggaaggcagtgatttgcacaaagttctactgcaaattagtgacagaggtagctaaggacccatttcttgactgcaagttatgtgagagtagtgccgataaaaataaacccctcacaattatagctttggctggtttacagagcagttctatgtccatcatttcaactgatgtacataataatcctaaggggtaaggatgctaaggattattattcttattttgcagatgagaaaacaaacacccagagaggtaaaatggtttacctgaggtcacatgagcaatttggtaaaagtaaacctaaattccaatatttctgaccctgtatccattgttgttagcaaaccactccattaattcatctggaaatcaatgtttccattaagatagtgttattttcattctcaagacactaagtcccagtctaggactcagtctgtattcatcaccttttataagatgatccaggcattgcagcacaaggtaatttcatgagggaatatatggtctaaaatttgcccaggtcttcaatttagtcttcaacaaaatctaaatacaacccaagtattgatctggggtaatatcatttggcattgaaaaggcttccaaaggaaagataattttattctttctctacttaggttgtcatacactttgctcatattccttctaaaaatgaaaacatacagccagtctgtgtgttacactgttgcttgttcttagtaaattcttattttaactgactaccattaagaattcacaaacattttgaaaacatttatcagataaatacattattatgtgtcatgtacatacaatatgtcaaagatagagaatggtattcatatgtcctattacctttatgacatgttcacatcaatcctacatacaggtattattagtcacattttgtacatagaggggcgatataaatgtaataaagctgaattttaagtcaggcctggctaaccatagatagtgcctatgctctttccattatgtaacattgcttcttaataataacagcaaaggatgtataagccaagagattaagggaatcatttaagaatgcctagtatattgagtgatatgccatggtttttactgctgtgtctttcactattccatctgccaggaatattcttttttttctttgtttaaagaatatctattatttatccttttagaccaagttcaatagtaacagtttaggaaacattacctggcacctcccaaaagaggctattgctctcttctcctgacatacgcacattgtattctacttacttagtctctctctctctcttgcaactaacctgaatgccttaaggagaagaactacatctttattcttatatctttataatctctgtaaccccaatgtctagtccaatctctaacctatgcaggaaaaatttttggaaaatttattatgaataggtgttgaattttgccaatactttttctgcatcaactgatatgatcatgtgatttttttcatctttagcatatttatgtgatggattacaatccttgatttatgaatactgaaccagctttgtaccactggaaaaaaccccacttagtcttggtatataattctttttatatattgataaattctctttacaaatattttgttcacaaattttgcatccatattggtctgtagttttatctttttaacttgcactctctttgttctcattttggtgttggagcaatactgagctcataaaataaggtggaaagtgttttgttctctattttctggaaaagacagtgccatgaactgaattgtgacccccaaaattagtattttgaagacctctcaatgtgatgacatttggagatggggagttagggaggtgattagctttagatgaggtcataaaggtggggtcctcatgttgggatcagtacccttataagaagagacaccagagagcttgcttgctttctccacagtgtgaacacacagcaagaaggtaaccaggaagtgactccttatcagaacttaactatgctggcaccctgatcttagacttccattctccagaagtgtaagaaaacaaatttctgctgcttaagcaacccagtctatgatattttgttacggcacctaaagctgacttggataaacagtgcagagctggtgctaattcttctttatatatttggtagaatcctctagtgaaacaattaaggcttggacacatcctttttgaaaacgtttttatttttctaaactacaaattcaatgtccttaatagttatagagctattcaaattatatatttcatgttttgtaacttgtagtgtttgtacttctcaaggaattgtctcatttcatctaacttgccaaatttatgtgtgtagggctattcatattactcctttgttattttattgacatcttcagagtctatggtggtatctcctatttcattcctaatattaataatgtgtgtctttttgtgttttcatcagccatactgcaggtttttcttttatcatttcttttgatcttttcaaagaacccacttttgctagattgattttctctactgcttttcattttcaatctcagtgattactccgattattatttcttgccctcagtttgcattgggttaatttttatcttctttatatgatttctttgaaggaaggagcttagattgctgattttagactttcttcttttctaatgtaagtatttagaactatacattgccctctcagtactggtttagctaccggccacaaattttggtaagttgtattttcattttcattcacttcactgtgttttttaaatttcattgggactaacttttaaaaccataaattacttataagtgcattgtttagtttacaaatgtttgaagatttatttttatttttctgttatttgcttttagttccattcactgtgatcaaaaaacccactctgtatcatttcaattatttggaatttcctaaaattttttaaggtgtatttaatgtcccaggatatggtatatcctctatatatgggatatatagattgaaatttcccaaaatttgttaatgtgtgcttaatgtcccaggatatggtatatcttctattgaatgccatggtcatttgaaaaaattgtttattctcatattgggtggagtgttctataaatgttgattgatgcctgtgggttgatggtactcttaagttttaagtcgttgatgattttacatctagatgtgttaccagttgttgagagaggggtgttgaagtctttagctattctgaatttatgtatttcctcaatcagttttattagtttttgcttcaaatacttttcagctttgttgtttgatacatacacattcagaagaagatgccttcttggtgaattgacatttttgtcattacatgaagtgcttctctgtctctgataattttctttgttctacttatttgatatgcatatatatacttctggtttattataaccaaggtgtgtgtgtgcttgtgtgtgtatgtttgcatgtgtgtgtgtgtgaatctccatcattttactttcaatctatctatataataacatttgaaatacatttattgtagaaagtatatagttgcatctctctcttttatttagtcatgctgccaatttctgctttttaattgctgtaaataaggccacttacatttaatggaattatgcatatgttagggcttgattctataattttgtttaattttctatttgttctctctgtattcatgtctccatttactttttctgggctttctgtaggttaactgaacttttcttctttttagaattctgtttttgaattattcatagtgtttttcaatatatctttttcatcagcacatagtggttgctctaggtagcataccatatatacataacttatcatagtctactttgtcaacatttaccagtttgagtgaagtatgcagaaattttacatctcttttaatcacttaatgctctaccatttataacacaattaccttaaatattttctctacatgcattgaactgcattagatgctgttctacttgtttcaactttcaaacataattaagaacagagtagaagaaacaatattttctgtttttttttaaattcattcatgatgttccaagattttcttcttcttcttcttcccttttttttttttttttttttgagatggagtcttgctttgtcaccaggctggagtgcagtggtgcgctcttggctcactgtaacctctgcctcccaggttcaagagattctcctgcctcagtctcccgagtagctgggactacaggcatgcaccaccacacccagctattttttgtattattagtagagatggggtttcaccatgttgtccgggatggtctcgatctcttgaccttgtgatccgcctacctctgcctcccaaggtgctgggattacaggtgtgagccatcgtgcccagccagattctttcttttatcattttcctttccttttaagaacttcttttagtcattcttgctgtatggcaacaattttattagttttccttcattcatctgagagtgccttgattttctcttcattcctgaaacatattttcactggatatagaattctaagtagataggtattttctataccacttgaaaatgttacagcactttattgtgggttccatgatctcttattataaagcctctatctttcaaatttttttctctataagtaagcatttctttcctctgttttctttcaaaaattttttttaatttggtttttgaaatttggctatgatatgtcttgccatggttttatttgggtttatcctgctttgaggttcacccaatctataggtttatgtatttgctatgatttagaaattttcagccattatttgtatgaatgattttcagctccagtctctttctcctttgcttctggaacttcaataacatgaatttagatcattctgttgaattccctgatgttcctgatgctctgttgtttttccttttttttttttaaactattgtcctcctgttgcttggaatggataattgttacattctacattaacgttcactgacactttcctttgtcctccccattctattgagcacattcactgagtttttctttcatttattgtattttccagttctaaaatttccacgtggttgttctttgtatcttctatttcattactgaaactgtgttttgcatttgttttaaatgtgtaatagtttgtaaaagaatttttatgatggctgctttaaaaacctcagcagatacttctaactgtgtcatcttaatgttggtgtctgttggttatcttttgtgtttcaagttgagatttccccagttcttgctatgacagattacttttaactaaaatctaaatatttttatattatcttatgaaatcctggattttatatcaatcttgtgttttagcagtgttcttttaacattgttctagaagaaaaggggaggttacctcattacttccaggtatggatagaagtccagattctccacttgccttatattgatatcagaaggatgaagggaccatgttactgtgaggtggaggttatcattcagtctccccactatgcttccagtgttagcactctagcgtcacattattttgcaagtcctcaagtccctagatggtctgccttctttactccacctttcatagtcttcttatgttttatataaaatgttcagggttttagttgcatttactaggaaaactagggaaaaatatgtctactacatctttctggagccacaattccagcctctctgatttcacagcagaaagtcataaaacagtgtttctacattgcaaattaaggaagctactctgtttctacaataatctatatacaaacttctgtgagagatcctttattccctttgccattataagtacttttgtattggtcattggcttagcaaagtaaaagagtaaatgccatgcctttttaatatggaagtttttctctacaattttctggaaatatgtgatggtgaaaagattgtgcctaccattaagctgcaattttatttaaatcaagaaagaaagtggctttctcctaccttggcctctgcctactaaaaaagtacagcaaactatttctttaaaaaaataaatctggaattaagaatttaatgtaattatctattaatttaagagtcaagattactttccttgattaaaaaacatataggtggggcacggtggctcatgcctgtaatcccagcactttgggaggccgaggagggaggatcacaaggtcaagagatcgagaccatcctggccaacatggtgaaaccccatctctattaaaaatacaaaaattatctgggtgtggtggcacacgcttgtagtcccaggtacaggaggctgaggcaggagaatctcttgaatctgggaggtggaggttgcagtgagccgagatcacgccactgcactccagcctggtgaaacagtgagactccgtccccccagaaaaaatatacataaataagacataaagttaataaattactgactctcattaatgattgtgtaagaaagttctatctactattgaaaaatattggcctctcacttttgatgcttattcaatgtaggtcattgttattgcccactcatcacagatttttcaatagcttacatgttagtaatctattcatttatctgtcaaacctactacttcataccagacgaaggccctagagcaggaccaacttcatgggtgtgtgacctgtgcagctgcacagggctccacaatgagtagggcccacatttgatttaatcttttgatgtcaccattttgaaattcttcatattatttaacaagggtttctgcattttcatttttcactgggcttcgcaaattatgtagatgaacctgtcctaggaagacaacatgaaaaagacaaattttaccctcatagtctcagagcagagacagaaaatttcatcatggtatattaagtgctatgattgaagaagatatgattgaagagacacaatgagagacctaacacagtcaaggggctcagagaaaggttctacttcacaacgtctatgctgagttctaaaagttatcccaggtcttagactgatgtttgctctggattatcacagactggccatcgtctttactgctaatttagaagttcaccagaagcataatttattagtttcaaggtcactaggtgcattttcaattaaaaaaaacatatttagcaggcctcttggttcaggtacaaattcaggcaaaaaaggcactggctagagaatcatatcagcctgggaagaaaatctcattacccctaaaaaagcggagtcttgatgtccaaaaggaggctataccagggtgtcattgcagagataaaggttaaactcacttgttttatcaacatatccattttttaaaggcagatattatattaagcactgcagaaaccaagataatagtaagtaataataatagtagctaacagccacaggcactcattatatctcagtgctagctatttcagtcctcacaagaagctctatttcatagaaatttaaataagaaattattaagtctcagtctctaatagaaggtagctaaaaatccatcagggaaaggaacacatgacacatcaagtgtaacatcatatgataaccatgctatgttagcatcagcaatggaagctgtgggagaatagcctggaagtaaggagaagcttcccaaaaggaaagagactttatccatatctaaaaggttttgtgagctagacaaagtgagaaatacagaaaggctttccaaatgaggaaacgacatgaataatgaatgaatcatcaagaatgaatcccaaatttttatctgagtaattaagtagacagcaaatggtacaataagttaaaaataggactgcaaaaagaggatacacacttgatgaaaatttgctgttcaatactgatgtggaagtgtttggtaggctgctggaaagatgaattacactgcagtgaaactaaagttcaagactgaggagtaatcagcatttagtttatcatcctgcagaatggcacaagaaagttagctaaaattcaaaggtgagcacaagagtaggtcaggctacaagtggattgaaccattctagattcataatggggcataataagagcctctgacagtttatctggttagactctaaagcttttcccatatatccagcaaaccaatgtctataaagtttcagtgccttttcctcttgattttattgtttttgttctgccaaagcaagacttagacaacccataaaattttacataaaatttaaatatcaatctctcatttctttggcagtagatcagccaaaaacccatagctttaagattcatctagcctaagatgttctgtttctggtacccagtttcatttgcataaagatctttttcactttctacatctgtgttttatttatattgcaacagcaatatttataagtttatgtcacaataagtttccagtctaaatttgggtcttttttaattgttcagcagttaaaaaaccacacactaagggtaaaagaaaatccagcatgaaattcctcagtgtgaagctcatattagttttcttcataaacaagtaaccatgtcatgtcacatcaatcaatgttgatgttaaagcacaataaaaggtgaaatataactaccccattctaaggccaactctataatcttaataaaaatgcaaagacatgctttgctttatataaattgacagcattatatgatttaattgtttttaccacttatttcatgattaaattgaagtttggctatcgtaacaggtttatgatatttatttgactaagatgagtttttcctatttaaggcagctttaaggactggatcaagtacagtgttctctttaaaacctacttttatctatttcctgacacccagcccaattaaaagtgataaactttcatttttattttttccttttaacttttattttaggttctgggggtacatgtgcaggtttgttacatgggtaaattgcatgtggctgggatttcatatacaaattatttcatcaggtaagtagtaatcatactactcaatgggtagttttttgaacctcaccctcctcccaccttccaccttcaagaaggccctggtgcctattgttcctttctttgtgtccacatgtattcaatatttagctcccaattataagtgagaacatgtggtatgttgttttctgtccccatgttaattcacttaggatatacccatgttgctgcaaaggacatgctttcattcttttatggctgcacagtagtcgtgtatacataccacattttcttcaatccacaatttttttcagttcaccgttgatgggcatctaggttgattccatgtctttgccattgtgaacagtattggaatgaacatatgtgtgcatgtgtctttatggtagaaggatttatattcctttgggtatgtaaccagtaatggaattgctgggtcaaatggtagctctgtttcaacttatttgagaaatcttcaacctgctttccacaatggctggactaacttacactctcaccagcagtgtataagcgttcccttttctccacaaacttgccagcatctgttatgttttgactttttaatagtagccattctgactggtgtgacatgatacctcatagtagtttcaatgtgcatttctgtaatgatcaaggatgttgagcattttttcataagcttgttggccctttgtatgtcttcttttgagaagtgtcctttcatctttgctcatattttcatcaggttgttttttgcttgttgatttgtttaagttccttatagattctggaatttagaccatcgtcaagtgcatagtttgcaaatattttcttccattttgtttgttgtctgtttacactgctgatggtgtattttgctatgcagaagttctttagtttaattaggtcccatttgtcaatttttgttttggttgcaattgcttttggagtatttgttaataaaatctttaccatggtctatatccagaatggtatttcctaggttttcatctaggatttttatagtcttaggttgtatatttaagtgtttaatctattttgagttgatttttatatatggtgaaaagaaggggtacagtttcagtcttctgcagatggctagacagttatcccaacaccatttattgaacagggagtactatccccagtggttgttattgtcatctttgttgaagatcagatggttatagatatgtggctttatttctgggttctctaataaggacccccgccacggccccactgaagttcttttgccagcaccctccatgggaatgttgttgccagtggatggggaacacctcggctcctccagcacagtaagtgcttaatcttgacaagccagagaacaatgccattggcctagttccagcccctcagggctaaagcatgcagcccaggagtgctgacctcagccttggccccctgaaatcatcccatgaaacaaagtcagtcataatcaaagccaattcataatcacaaaaactgaaaacatttatataatcccttaagtggataaacaaattgtggtaggatttgccacttctaaaaatactttgtttacttgctcctatctattgtctttattcacataatagaaaataagcttctccagaacagaagaaccttatctgtcttattcaatgctgattcctgaatgcctagagcagtatctggcacacacaataagtatttattgaatataaataataagaaagtaaaatttatggaaagctttctacatgttaggcaaaactgcaattgttttgtgtatattatctcaggtaggtaggaaactgaaacagagggagtataaaataatttgcccaggtgacacagtaaatagttgaagtagaataccaaccctggcagtctgactccaaagcttgagcttaatccaaatgaataaatgttagaatggcattacaggaaaaatacagtaaaattcatggaaatatgaaacaacatggtcgctgtagggaactacaagaaggccaataagtatgtaagtcaaaagcaaactggataagaactagatcatgaatggtaccacatgccaggctaagaagtttggactttaccctaaaggtaatagaggggtatttaaggcattttgcagtggagtggcaaggttaaatttgcactttacatataatgctccagcttcagtgtgaaggatgaacttaaattgcatgaaaccctggacaaaaccacagttggaagacaactgccatagtccaaacaatatatgtaaatagattaaacttgaatggctgtagcagagatagaaaggcacagataaatttaggaaatgactctaaaagtggtaaagtaaggaaacaaatttgattttgtcatttgtaatatgaacttaataataggaatagttactaggtttattatcagtccccagaaacttaaagttatctctgtaaaacaatagaagccgacttgaaagaataaaaatatgggcagagcacaacggttcatgtccgcaatcccagcactttaggaggccgagggggacggatcacttgagctcaggagttcaagaccagcctgggcaacacagtgaaacctcatctctacaaaaatacaaaaaagtagtccagcatggtggtgcactcctgtagtagtatcagctactcaggaggctgatgcaggaggattgcttgaacccaggaggcagaggttgcagtgagccaagatcatgccactgcactccagcctggatgacagagtaaaagcctatctaaaaaaaataaaaaaaaaattaaaaaaatacaagtatgttcatgtttgccacacttacactaaaattgaaataataaagtacatacgcaaattcattaagctaaccatatcctctacatattgaatacaacacttccctctgaatgttttctatttttaatttttatgggcacatagtgggtatatatgtttataaggtatatgagatattttgataaaggcatacaattgtaataatcacatcagggcaaatggggtatgcatccctcaagcatttatcctttgtcttataagcaatccaattatactatattagttgttttaaatgtacaattaaattattattgactatagccaatctgttgtgctagcaaatactaggtcttattcatactttctaactattattatacccacttccacaccctccccacaacaatcatgccactacaattcccagcctctggtaaccatccttctagtctccacctccatgagttaaattgttttaatttttagctaattttagctaccacaaaaagagagagcatgtaaagtctgtttttctgtgcagggcttgtttcacttaacataatggcctccagttccatccatgttgttgccaatgaaaggatctcgttcttttttatggctgaatagtactccattgtgtaggtgtaccatttttctttatccattcatctgttgacagacacttgagttacttccaaatcttgcctatggtgaatagtgctgcaatatacatgacattgcaaatatatcttcaatatactgatttcctttcttgggtatatacctagcagtgagatttttggatcatttggtagctctacagatttttgaaaaaggtccaaaactgttctccatagtggttgtgttaatttacatgcccactcacaatgtatgagggttcccttttctccatatcctcgccagcatttgttattgcctgtcttttggatataagctattttaactgagatgagatgatatctaattgtagttttgatttgcatttctctgattatcactgatgttgagcaccttttcatatgcctgtttaccatttgtatgtcttcttttgagaaatgtctgttcagaacttttgcccatttttaaatcatattatttgatttttttcctattacttgagttccttatattttctgattattaatcccttgtcaggtgggtagagtttgcaaatattttctcctattgtgtgagtcatctttcactttgttcattgctttctttgctgtgcagaagctttttaacttgatataatcccatttgtccatttttgctttggttgcctatgtttgtggagtattactcaaaaaatctttgcccacgccaatgccctggagagtttcctcaatgttttcttttagtagtttcatagtttgaggtctcagatttaaatcattaatctcttttaatttaactttgtagatagtgagaaacaggagcctagtttcattcttctgcatgtggatatccagttttcctagcagcatttatagaagtgactgtcctttccccaatgtatattcttggcacttttgtcaaaaaggagttcactgtagataatatggattcttttctgagttctctattctgttccttggtctatgtgtctgcttttatgccagtaccatgctgctttggttactatagctctgcagtataatttgaagtcaagtaatgtgattcctccagttttgttatttttgctcaggatagctttggttcttctgggtctattgtggctctatataaattttaggattttttctatttctgtgaagaatgtcattggtattttgatagagattacattcaatctacggactgctttgggtagtgtggacattttaataatgttgattcttctaatccatgaacatggaatatctttcctttttttctgtcctcttcaatttctttgatcaatattttatagtcttccataaacgagagctttcagtcctttggttaagttaattcctacgtgtttaattttatttttggctactgcaaatggggttacttttcatgatttgagaggactgactccaattttgaaagaagttctactgtgagtaaaatgctatcagagagcttcacctgctacagagaagtatttcatgagttaactgatgaagtcaactgatgtggtatacctcattgctgtcttattttaagaaattgccacagccaccccaaccttcagcaatagcaccctgatcagtcagcagccatgaacatcaaggcaagacccttcaccagccaaaaagattaagactcactgaagcctcagatgaacattaattttttttttgcaataaagtgtttctcaattaaggtatacacattgattttagacataatgctattgcacattttataatatagtgagcataagttttatatgtaccagggaaccaaaaaattcatgtgactcactttattgtgatattcatttcattgctatgatctcgaaccaaacccacaatatctctgaagtatgcctgtatgttaaaaggttcacagtcattccttttaggtaggaggattatgtgtttcagtttttttcttgcttgctttcaatagttagctatattttccaaatttactacagtgagcattcctacagtgactacctaggcacaaatcctgtataaaccacttactaattgtatgatcttcagcaagttattcatcctttctttgtctcagttcctttcagcttcttcaactgcaaaatgggggttaggatactaataatggtacttacttcaaagaatttctttgaggaataaatgaatgaattaatataaagggcttagaacactacttatgacattgaagtgttccgtaaattttagctattaatgtaataagttgaatgacagagcaaatgagaacctgtgttatatttcctattagtattagaagtatagtaatattaatagataacatttgctgcactgttcctatggaccaggcattaaatttagtgttttatttgcatcatcccatgtgtttcttccatcaacgctattaggtactattaaccccactgaataaatatagaaattaataatttaaatagacagttcaataactttctcaaggtcacagaggcagtaagtggaagagctaggcctggaatgtatgtctaacgaaaagtctgtattcttaactagtacattttgcttgatgatgatgatgatgatgatgagcatcaataacaggttttgaaagaaggtggaggaggaggtgaaggataaacaggagaaaaggaaggtcgaaaaggaataagggcaaaaaacctgttttagtagcagttttctagtagtaatctgttgtggtggtagtttttgttcttgctgctgttgttgctatagtttgaatgagaaggcaactttacttcatactgaggtctgggcagatgtccagtctcagaacttctgaaattgattcttgatggtggtggccttggtgacattgagcatgttgaagtgcactatcttcctcaagggctagcacttgtccaccatgatgatgttgctgacctggatgtccttgaaacagagggacaggtgtgcagacatgttcttggggtgcttcttgtaggattgtacttgtggatgtagtggagatagtcctggtggatgacaatggtgctctgcattctcatgttggccaccatgacagacaggatactgttggggtgttttaataaaaacaatagccatcaagtattgagtccctattgtctaccaaacactatggtagttgtgatggttaatactgagtatcaacctgattggattgaaggatacaaaatattaatcctgggtgtgtctgtgaggatgttgtcaaaggagattaacatttgagtcagttgggctgggaaaggcagacccacccttaatctgggtgggcacaatgtaatcagctgccagtgtggctagaatataagcaggcagaaaaatgtgaaaagagagactggactagtctcccagcttgcatctttctcccttgctggatacttcatgccctcgaacatcggactccaagttcttcagttttggaactcagactggctttccttgctcctcagcctgcagatggcctattgtgggaccttgtgatcatgtgagttaatacttaataaactccccatatataatcatcagatctcatgagacttagtcactatcatgagaacaacacaggaaagacctgcccccatgattgtttttcgccaggtccctcccacaacacatgggaatcaagatgagctttgggtggggacacagccaaaccatattagtagtctctttacttaacattgtcttgtttaattttcacaagacccctatgaattagtattattactttcattttacagatgagaaaactgaggtaccaagagattatttaaactgatcacaggtaaaacggctcataagtaagagtcagaaatataaaccaaaattggtttaaatccattgtctgtgctaattccactgtgatatgctgcctttgtggactgctgattttgaccatggccaggatgaaatttcagagcctgaattctccagaatggagactaaagaagcagcaaactggccagacacagtggctcacgcctgtaatcccagcactttgggaggctgaggcgggtggatcacgaggtcaggagatcgagaccatcctggctagcacggtgaaaccccgactctactaaaaatacaaaaaattagctgggcatggtggcaggtgcctgtggtcagagctgctcaggaggatgaggcaggagaatggcgtgaaactgggaggcggagcttgcagtgagccaagatcgcgccactgcactccagcctagacgacagaaaaagactctgtctcaaaaaaaaaaaaaaagagcagcaaactttctcagaatcttaaagggaaatttaaacacatctatgtaaaagtgtgtatgtgtgcatgtgtatgtttaaactacattatttcttatagtaatccaagaaatactatattgttaaacacttctttttttaaaatctcctattacatacatcagacgacaatctattggcaatcccaggtaaaacaggattgatgaattgagaaaaggagtcaaaataataactctatctgttttgatgtctcatgttattgctggaatgcaattaatttatgactagaggcctgagacattgcatcatatcccatttatctgtgtgaagtttcaaaacaagtgaggaaaaagtaacaatttattatggatttctgaacactggagtttataaaacaaagcaagaaattcaaataaaggaatcttattcactgctgataggacagtaaaatagtataaactttctggcatcaatttagatatatgtgtaaagagtctttaaaatgttcatatccctttgcctatcatttcctctcataggaatttatcctaaggaagcaaaataaaatttgggtaacatttcctgcatcaagatgttcactacattgttacttataacaacaacaaatggaaaataatctttatgaccaagaataaagagctattaatattttatagccatatttatcaaacttttgataacagaaaattgtctgtgataatatttaggttctttagaagcaaaacatgaaaatgtatatacagtacaaatttaattatgctccacgatagaaaataaataagtttagaaataaatatgccaaaaaaattaacagtatttgcttccagttagtaaaattgtaatttttgtgtgtgtgggggggtgctttttctctgcttcaaataattatatttcccaaatttactatattgcacattgactatttttacaataaaaatgggaaaaataacttcaaaaagataaaaaaatacaaaaaagaaatagagcttaatcaatccaagcatatcattttattttctcttattggctgaacttttagcatatttaaataagaagatctgctttcatatcacacaagtgctctcagctgcattaatacatttccactaagaatatttaatatcagttttttagagagaaaatcacctttccataaaggaatctggacatttagttttcattgattcttgcaaatgcactattgagcaactacttttacgggttaatatatcagtcctgggatacaacaccatatgctgcgagcttttattatttcctagaaacatcaagaaatacaacgcaaaagctagacctgtttatacaatatatttgatgctgcaatttttaaaatttatttaatggagtcagcctgcaatgactaatacatacatgtttttttgcctgctagtagtaccaagacctaaataacgttcttgactagattacacttatgcaggtctcattttaacggaaatttgagagatgaaaaaaagattatagaaagagatgctataaaaacagacctcacaagtcaaacttcatagtaaaactattttctttaacgtagactaccatgaaaacaaacatcctgtgagctagagatatatattgtatctttcctgcagatctttatgccttcttgcgacagatttccataatgtgattacagttgatgaggcaatggcccacagaaagaggctgataaaagcatcaggctccaggaaaccagataaacatgttcatgatttctaattggaacaaggataggatagcactctatatgcagacagaacccagagacagggaaaatattggtcccttcaactttaataaatatgcatccacaaaacagacccaactctcttgtaagagtaaccctttaaaaaacattcatgttacttgcacagttaattgatagataagattgcaaaagaggctgtatagcttcgacatgtaataagtaagttataacactctggcagagacattttgaacaacaaaaagaacatcctcgtaaacaaactagaagagcaaagaacattgtgtgagaaacttgtccaaaaggctatctcaagtagtttaactgaaggaacacatttttcctaactctcttatcatctcacccctctacccctccttgtataagctgtataaagataatctttatagacacttaagtgaaagaaaaactgggccaggaatttaatgtgacccaaagttaaagaaacagtataatttcagagcttctgctaaatctctatttagcaaagaacacaatgaggatagatgattctcttgtttgaaaagtaattggccccacttcttaggagttagtgggttcctggatccagcaggcaagctgagggatgtgctatgaaaaaaaaagaggaaaagaataattccctttatgaatttagaaatcatggcagattatactgcttctaagaaaatgttttccttccttcatatgaattgactacactgcttcagaattattgtttgttttccagaggtatgtgtttgtgacaaccataagttgctgatatgagacaggaacattaacaaaagaatgaaagaggtaatgaagaaaatctcataggggtcccaaatttgaagtgaaagactcagtctagtacatgtgactaaagccgcctatcgtggattatattctctagattcagtaacacagactttggaaaatatactttaaggattattgattgtcttagtggaacaagtaggacaatcctagaatcaggtgaacccctgtaggtaaagagagggttttcctaagatcaggggaaagagaatgcctactgttactgtgaaaaactgaaaagggaactctgccataggagagtaaataaaaccaaaaagcaaagctaggaactaaagtttgtccttaagaggctctctgtgtgtggtgtaactttttctcccttgtcctaaaattctgagacaagtcagatttagcaaataatgttcaggactcttccctagatttgattccttcctgttggcccctaaactttagtaaatattgcatacactcagtcttgtgtccatggtgttgtacaaaattaaagtatcaaagcaaagtggctgtatttgcaccccctttttgctgaagctagcatgccaggaataatattgtatagaagaaggctcagagtccctaaattcaagacactggccactgtctgacacacaagtcaagttgcagttgagataaaatgatgagaagcaagcaatcaagggatagagcaagcagaatagattgactcaggagaagctaaactccctaggagaagctaaactccctactttttcccaaatatactagcaaaagacaacataaagtaagaaggtagatgttggattgcaggactatgctttcatctgcttaaaacaatcataatctcactatgtgtacaaagcttgtacagagtcttccatgatcagttgtctcaatataacggaatagtaactgatatcttacgatttgagttttattaatgtttattcaagcatacgtttttagttccctttattttcatcaatactgtctctcatgaaaaataggattcgaaagtattataaaaacgtgcactattaaaaaaatgtagctgaagaaattatggttaaaagcagattaatacgttcaaaatacaagttgagaatccctcatctggaaatcgaaaatctaaaatgctccaaaatccaaaactttttgagcactgaaatgatgccacaaatggaaaataatagtttttcatggacaaaattattcaaagtattgtataaaattacttccaggctatgtatacaagatgtatatgaaatataaatgaatttcatgttcagacttgggtaccctccccaacatatttcagtatgtattatatatgcaaatatttcaaaatctgaaaaaaaaactgaaacacttctggtcccacgcgtttaagataagctatactcaacttgtaaaagcaaagtcagtacacagaagcacaagcaaaaatattttccagaatcactagagagggctgtaaatatggttccgagtttcccagcagccaaagcaaagggaaaataggatcagttacaagaatcatattgtcttaaagatataaacactctgttgtacagaagaaaagcttctcttttgaaactgagacttgtgagaaatgtttctcacagatctttataaagaagagacaatagagaacaataccctttgtaaacataatagcaagtctcttccagtgtttccttatagtgtccctcaaggaatcctaacatatcatgctaatgcttcaatcagtaaggaacactttattctcagatgaaatatttgtattatttaataaccatcagataacaaaagtcaacatattgtatctatttctctgcatctcttgaaccaaaactgtatcattgctgtggataaacaagaatatattcttaatatagtcattattttgatatttctaaaagaagacaaaagcatattattcttaccaaaaccactctgaaggtatccactatttccctcacctgtgattctttcacattttcaacagtaaagttgaaccagactcggaagcgtggattacaggtgtccggcctaatgaacagatcatactcaaactcagagacctggtccacccggcccaggttacctggtaataaaaattaagagaattggattttaatagaagttcatgcagctcaatggtacacacatttaaatattatgctctctgatagtggcatttgtcaacattcagtacttgaaggttcagtgttcacaatccaaagggctgccaagtctgaatgcagcccagagtaagaaaagctttcatctaggccaggctgtggtgcaagcttctctgcctggcccttctgacccagatccttttatgctacaagtatctttgacagaccaggatattatataaagcctgtggtaagcccctataaaccaagagaagaatggcaaactttggtttcttacatagaaaagtgaggatgataataccttatgtattttgtattaagcttcattgtatacaaactacctgtaatacattggatcttgtttaatttttacaacaggcatatatggtttgtactgagcttcttatatcctaaacttctatcagaatatgttaaagaatatgtacagtaaggttttaaacaaaaattagaagtaattgctacataagaataacacaatcatgaaacctaatttccattttctccaacaacagaactaacagttatataaaaaatgtgtaaacttaggtgttatctccattttccatattgtctctcctttttctcactgatattctaatgagcagtgaattgttagagaggcaagatatttgttacacaatggtactgaatttggagtcagaagaactagtttagttttagttctggaactaactaagcaactttagacaattcacttaacctcttccaacatctgtttcctcaactataaagttagaatcatattaatagaaacatgaaaatttatttctatgccaactactacgaacactagttgaaattaacgtacacaatgtatatgaatattaagttttgatagaaaattaaagttttctgagcatttctacaggccacatactgtcctaaatgctaaatgaactaaactatttgatcctctcaacaactcctatgaggtagagaccattactatccccattttacatctgagaaaaccaaggtacagagaacttacccaaagttatacagcaagtaaacaagtaaaagtcacatttgggatttgaattcaaggaacctggctctaaccactagacaatatagctgtctacctaacagagctggtaggaataataaacaaataacataaattgaaagcacattttaagtggtaaggcttaataaaattactattcttaaaataacaagaagttgaaaaggtacttttttccctctaaaagttcatgatataaaaattaaatattaatattcacttcaatattcaaagaaatgcagattttcattttgttcttcatactaaaaaagtataaatgggttttgataaacaatatcttaaaattactgtggcatatagtgtccaataataatccaccatatgtgtctacaaatttgtagtttcaaaatgatttgacatcttttatattattaaatcctcaccatgacccagtgataggtaaattgaaacccagaaatgtttagtgcttgcttaagttcatgttttaaagcaccagggtgagaccataaattaaacacttctgatttcattgtgtttttctttcagaatctaccatagctacaaccaattcatttattaagccatttaatcagtaattcattcaaaaggcactatgctttgtgttataaaagaaactagatagtatcaaacatatactttctttgtgctcactaagcttatagtctgaaagaatagtgaacatctggtctttggccttctgcaactactctgttgaccttcttcatcattcttgtgatgagcattctctgtatgtgtgtgtgtgtacataaaaaatactttccttatacacaattaagtgccagtttatggccttctggaaataactatttcagaataagttaataatgcctccatatcacctggttctctttcattaaatgaaacacaaggaaagaaaacaaacacaatctaaaatacataggtaggacaaatataacacagaacataagctgtagattttatacccaaatatatcactaaatgtgttatatgtaaatggattaaaattataattaagacaaactggatgaacctggagtacattatgctaagttaaataagccagacgcaaaaagaaaaatattgcatgacttgacttatatgtagaatctgaaagaaaaaaagccaaacacacagaaacagaaaataaaatggtggttaccaggggcagatggtggtggacaaaatgagatatgtaggtcaaagagtagaaaatcacagttatgtatgatgactaaacctagagatcatgtacagcatgaggattatagttaataatattatatatcatactggaaatgtgcttagaaagtagattgtagttgcttttaccatgcatacatataccaaaaaagttaactatatgagataatgaatatgctaatttgcttgactttggtagtcattgcattatgtatatcaaaacataatgttctacatcttatatatataaaataaaataattttttaaatacaagacaaaattttattttggatataatatcaactatatgttgcttataaatgcaagctttccttttaggagcacaaaaagattgaaaataaaatgacaaaaagttttaacagaaaagcactattaataagaaagcaaatgtaactatacttatatcagacaacatagactataaatcaagtaacattactagaaatgaataggggtatttcattttgaaaaagggtaattccaccaagaacatataaaaacattaaatagatagatagatagatagatagatagatagatagatagatagacagatagatctttaaagtatgtaagtaaaatttgacaaaattaaaacatagattaatctagaatcaaaatgagaaatttaacacaccaatatcccttactgtaaaaaataccaaaagaaatattcagcaaaggattgagataatttgaaaacatgattttaaaaatacctagttttaattatgaaacacattacatttatagaactaaataatatacattcttttcaaatgtacatgatgttcttctcaaaactgatcatatgctcgtccataaagcaagtcccaactaatttcaaaggagtgatatcatactgcatgtgttctctcatttaagtaataatattttaaactaaattgtgttcaatatgtgagaatcaaaatgtgtaaaatatagctaaatccactctaagatgtaaatttataaccatacatgcacatacatatacatatatagttacagatgattaatttttcaatgatttacacatgtggataaagatcaatgatccatgcttctgttttaaagaggtaaaaaaagatggtattttcaaaacaaaaagcagaggcaagcaaaaagaacagaaaatgttaaaaaaaattatctgaatgtaccctaaaaattttaaatgtgaaagtttgatactttgaaatagacttttaatattaaaaaactcttaacaaagctcaccaagaagaaataaaccacatattattaatatcaaaataataaaaagagattgaattcatcaggatggtaaaataggtggttttagctctaatatccccagataaatactggtttaataaccattcatggtggtgcctgtaatcccaggtacatgggaggcttaggcagcagaatcacttgcacctaggaggtggaggatgtagtaagccaagatggcgccactgcactccagcctgggtaacagagtgagactctgtctcaaaaaaaaaaaatgtaatgtatacacattaagatttgctaagagagtagatcttatgttaagtatttttatcacaaaaatagtaataatatataaagaaagcagaaggaaacttttggaggtaatggatatatttatggataagcctgtggtaatggtttcacagatgtatagttatatagttatctccaaactcatcaaattgtatacaacaaatatgtgcagctttttgtgtgtcaatcatacctcaaaaaaagtgatttaaagaaaaaataatacttgggggaaaaggaaaaaagagcaaaataaacccaaagaaagcagaataaagataataataaagacaagagtagaaataaatgacatagagaatagaaaacattactgaaagccaataaacacaaaattcttcctttgaagtgatcaacaaaagtgacaactttaaattgattggctaacaaaaaagagaaaggactctaatttgtaaaatcagaaattaaacagaggacatactataaccaactgtacgtcaaaaaattaaataacctaaatgaaatggcatttgtcgttttaacagaaaagcactatcaataagaagcaaatgtaactatacttatatcagacaacatagactataaatcaagtaacattactagaaatgaatagcggtatttcatgatgaaaaagggtaattccaccaagaacatataaaaacattaaatagatagataaagtatgttgtctggaaagacaacaaacaaagttgactaaaaataaatatggatatctgaatagatctaaaacaagtagtattaaattaataatcaaaaaacttcccaccaggaaaattctatgtccaaatgttttcacagataaattctgtaaaattaaaacttgttaaaaaattaacaccaattcttgactgggtgtggtggctcacacctgtaatcccagcactttgggaggccaaggcaggcagattacaaggtcaagagatggagaccatcctggccaacatggtgaaaactcgtctctactaaaaatacaaaaattagctgggcatagtggtgcatgcctgtagtcccagctactcgggaggctgaggaaggagaatcacttgatcccgggaggcagaggttgcagtgagccaagatcgtgccactgcactccagcctagtgatagagcgaggctccgtcccaaaaaaataaaataaaataacaccaattcttcacaaactcttgccaaaaaaaattgaagaaaagataacactttcaaactcattctatgaaaccaggattacctggatcctaaaatcagatggagagatcatgatgacaaaaacaaaaacaataacaaataaaaaatacagaacaacatccctataaatataaactcaaaaatcttcaaagaaatactaacaaactgaatctagcaacataaaaaatgattatacaccatgacaggtgagatttatcccagaaattcaaagttggtacaacacacgaaaatcaactaatgcaatataacacattattaaaataaagaccaaaaacacaaggatcatctaatagatgcataaaaaaaatctgacaaaatcttacacatttcatgataagaatactcaagatgaacacaagggaccttcctcaaactcataaagagtatatttgaaaaacacacagctaacagcccacttaatggtgaaagactgaacattatccctctaagatcagggagaagataagcatctttgcttttgccatttctattcaaaattgttgtggagattccaggaaggacaagtatgccagaaaaaaaagcattcatattgaaaaggaagaaataaaattatttctatttgcagatgacataatttttatgcagaaaaacctaaggaatccacataccaaaaaaaaaaaactatttgagctaaaaaacaatttcagtaaagtttcagaataaaatccatatacaaaatcaattgtatctctatatgccagcaatgaacattcttaaaataaaataattccatttacaatagcatcaaaataatacttagtataagttaacaaaagaaatgccaatagatttaatccaagaaggcaagtttcttttaacacttaaaaagcaagcaacataattcaccatatggacaaaataaaggagaataaccttaagattatttcagtagatgctgaaaaaacatttgacaaattccacacgcattcatgattaaaaaaaaaaaacacttccatcaaacttcaactagtaggaaacttcctgatactgacaaagggcatgaaatgaaaacaaaaatgtagcactaatatcatacttaatggtacaatatttaattatttatccgagatcaagcatgtagggtgtccttctattcaacatttttataaagacccaagctattgcaatacagcaagaaaaacaaataaaagacataaagattaggaaagaggaaataatactagaactttccttacttacagatgagagtgttatttacatagatttttctatgtaaagaatagaaaattgacaacataactacttgagccaataaataaatttagcaaagtcacgaagtgaatatatgaaaataactgcagtagcaacaagcaatggcactaccagcaaaaaattaaaaataaaattttaaggatcccatccatggttgaaacaaaaaaccacaagatacctagaaataaatctaaccaaagatatccaagtcttttgcactaaaaactacaaaatattatcgagagaatttgaagaataccttaaaatggtatttctccccaatgtatgtatacagattcagaggaaccacaatcaaattctggaagcctttttgtagaaattgattatctcattctacattgtacgcaaaaatgtaatataatatcataaaagcaattttagtgaaaactgttataaatttagtaatcaagacagtttggtatttcaaaatgatagacctttacatgtatgaaacagaatggagagtacagaaataggcccacatatttatgagcaatttactttaacaaagatgacaaggaaatttaataaagaggtaagtattttaatgagtaatgttcaatataaataattaacccttactgaaaatcttatacaaaaattacctcaaaatggatcatagacacaaatataaaacccaaaattataacatgtgtagaagaaaatataaaagaatgatactgcctaggttttcttctagggtttttattgttctaggtcttacctttaaatttttaatacatcttgagctaatttttgtataaggtgtaaaaaaggggtacagtttcagttttctgcatatggctagccagttttcccaacaccatttattaaatagggaatcctttccccattgcttgtttttgtcaggtttgtcaaagatcagatggttgtagatgtgtggtgttatttctgaggcctctgttctgttccattggtctatatatctgtgttggtaccagtaccatgctgttggggttactgtagctttgtagcataatttgaagtcaggtactgtgatgcctccagctttgttcttttgcttaggattgttttgaatatacaggatctttcttggttccataagaaatttaaagtagttttctaattctgtgaagaatgtcaatggtaacttgatgggaatagcactgtatctataaattactttgggcagtatggccattttcacaatattgattcttcctatctatgagcatggaatgtttttccactcgtttgtgtcctctcttatttccttgagcagtggtttgtagttctacttaaagaggtccttcacatcccttgtaagttgtattcctaggtattttattctctttttaacaactgtgaatagtagttaactcatgatttggctttctgtttgtctgttgttggtgtgtaggaatgcctgtgagttttgcacattgattttgtatcctgtgactttgctgaagttatcaggttaagaatattttgagctgagatgaggggattttctaaatatacagccatgtcatctgcaaacagagacaatttgacttcctctcttcctatttgaatacgctttatttctttctcttgcctgatagccctagccagatgaggggattttctaaatatacagccatgtcatctgcaaacagagacaatttgacttcctctcttcctatttgaataccctttttatttctttctcttgcctgatagccctagccagaactttcaatactatgttgaacaggagtggtgagagaaggcatccttgtattgtgccagttttcaaagataacgtttccagcttttggtcattcagtatgatattggctgtgggtttgtcataaattgctcttattattttcagatacattccatcattacctagtttattgagtgttttttttttaccatgaaagggtgttgaattttatcgaaggccttttgcatctattgatataatcatgtggtttttgtcattggttctgtttatgtgatggattatgttcattgatttgcgtatgttgaaccagccttgtatcccagggatgaagccaacttgatcgtggcagataggcttttcaatgtgctgctggattcagtttgccagtattttattgaggattttcccatctatgttaatcagggatattggcctgaaattttctttttgtttttttgtcgtgtctgccaggttttggtatcaagatgaggctggactcataaaatgaattgcagaggagtccctgtttttctattgtttgaaatagttttagaaggaatggtaccagttcctctttgtacttctggtggaattcggctgtgaatctgtctagtcctggacttttgttggttggtaggctcttaattactgcctcaacttcagaacattttattggtctaattcagggatctgacttcttcctggtttagtcttgggagggtgttgtgtccaggaattcatccatttcttctagattttctagtttatctgcatagaggtgtttaaattattctctgatggtagtttgtatttctgtggggtcagtggtgatatcccctttatcattttttattgtgttttttgtattcttctctcttttcttctttattagtctggccagcggtctatctattttgttaatcttttcaaaaaaccagctactacattcattgattttttgaagggtttttcatctctatctccttcagttctgccctgatattagttatttcttgtcttatgctagcttttgaatttctttcctcttgcttctctagttcttttcattgtgatgttagggtgtcgatttcagatctttcctactttctcatgagggcatttagtgctataaatttccctctaaacactgctttagctgtgtcccagagatgctggtacgttgtctctttgttctcattggtttcaaagaacttctttatttctgccctaattttatttacccagtagtcactcaggagcaggttgttcagtttccatgtagttgtatggttttgagtgagtatcttaatcttgaactctaatttgattgcactgtggtctgaaagactgtttcttatgatttctgttcttttgcatttgctgaggagtgttttacttccaattaagtgggcaattctagaataactgttatgtggtgctgagaagaatgtatattctgttgatttggggtggagagttctgtacatgtctattaggtctgcttggtccacagctgagttcaagtcttgaatatccttattaattttctgtctcgttgatctgtctaatattgacagtggggtgttaaagtctcccactattactgtgtgggagtctgtctctttgtaggtctctaagaacttgctttaagaattgggtgctactgtattggatgcatatatatttaggatagttaactcccttgttgcgttgatccctttacccttatgtaatgcatttctttatcttttttatctttgttgacttaaagtctgttttatcagagactaggattgcaacccctgctttttttttttttttttttttgcttatcatttggttggtacatattcctaaatccctttattttgagcctatgtgtgtctttgcacatgagttgggtctcatgaatataacacaaagatggatcttgaccctttatctaatttgccaatctgtgtcttttaactggggcatttagcccatttacatttgaggttagtattgtaatatgtgattttgatcttgtcattatgatcctagctggttattttgactactggtggatgccgtttcttcatagtgtcgatggtctctacattttggtatggttttccagtggcaggtaccggtttttccttcccatatttagtgcttccttcaggagctcttgtatggcaggcctggtggtgacaaaattcctcagcatttgattgtccataaaggattttatttctccttcacttataaagcttagtttggccaatatgaaattctgagttgaaaattcttttctttaagaatgttgagtattggcccccactatcttctggcttgtagggtttctgcagagacatcccctgttagtctgatgggcttccttgtgtaggtaacctaatctttctttctggctgcccttaacattttttccttcatttcaaccttgatgaatctgacgattatgtgtcttggggttgctcttcttgagaagtatctttgtggtgttctctgtatttccagaatttgaatgttgacctgtttcactaggttggggacgttctcctggataatatcctgaagagtgttttccaacttggttccattctccccctcattttcaggtacaccaatcaaatgtaagtttggttgtttcacacagtcccatatttcttgaaggctttattcattccttttcattctttttactctaatcttgtcttcacattttatttcattaagttgagcttcaatatctgatatactttcttctgcttgatcaatttggctattgatatttgtataagcttcacacagttctcgtcctgtgtttttcatctccatcagttcatttatgttcttctctaaactggttattctagttagcagctcctgtaaccttttatcaaggttcttaacttccttgcattggttagaacatgctcctttagctcagaagagtttgttattacctaccttctgaagcctacttctgtcaattcatcaaactcattctccatccagttttgttcccttgctggcgaggagttgtgatcctttggaggagaggagacattcagttttttgaattttcagcctttttgcactggtttttcctcatcttcatggatttatctacatttactctttcatgttggtgacctttggatgggatttttgcatgggcatcctttatgctgatgttgatgctattgctctctgtttgtagttttccttttaacagtcaggcccctattctgaagctctgcttgagtatactggaggtccactctagacgctgtttgcctgggtatcaccagaggagcctgcagaacagcaaagattgctgcctgctccttcctctagaaccttcctctcccagagcgacacctgccaaatgccagccagagctctactgtatgaggtgtctatcgacccctgctgtgaggtgtctctcatgcaggaggcacggtggtcagggacccaaatgaggaggcactctgtctcttagcagagctcaagtgctgtgctgggagatctgctgctctcttcagagctggcaggcaggaaggtttatatctgctgaagctgtggccatagctgccccttcctccaggacctctgtcccagaaagatgggagttttatctataagcccccgactggggctgctgcctttctttcagagatgccctgcccagagaggaggaatctagagaggcagtctggctacagcagctttgtagcactgcggtgggctctgcccagtctgaacttcccggaggctgtgtttatactgtgagggaaaaaccacctacacaagcctcagcatggtggacggccctttccccaccaagctcaagtgtcccaggacaacttcagattgctctgttggcagcgagaatttcaagccagagaatctaggaaataccattcaggacatagacatgggcaaagacttcatgactaaaacaccaaaagcaatggcaacaaaagcaatggcaaacaccaaaagcaatggcaacaaaagccaaaattgataaatgggatctaattaaaccaaagagcttctgtacggcaaaagaaactaccatcagagtgaataaaatgggagaaaatgtttgcaatctatccatctgacaaaaagctaatatccagaatctacaaggaacttaaacaaatttacaagaaaaaaacaaagaaccccatcaaaaagtggccgaaggatatgaacagatacttctcaaaagaagacatttatgcagcaaacaaacatatgaaaaaaagctcatcatcaatgggcattagacaatgaatatcaaaaccaaaatagataccatctcatgccagttagaatggcaatcattaaaaagtcaggaaataacagatgctggagaggatgtggagaaataggaacgctttacactgttggtgggagtgtaaattagttcaaccattgtggaagacagtgtggcaattcctcaaggatctggaaccagaaataccatttgacccagtaatcccattactggatatataccaaaaggattataaataattctactataaagacacatgcacacatatgtttattgaggcactgttcacaatagcaaagacttggaaccaacccaaatgcccatcaatggtagactggataaagaaaatgtggcacatatacaccatggaatactatgcagccataaaaaggatgagttcatgtcctttgaagggacatgtatgaagctggaaaccattattctcagcaaactaacacaggaacagaaaaccaaacaccgcaagttttcactcataagtgggagtttaaaaatgagaccatatgggtacagggaagggaacattacacactgggcctgttggaggttgtggggcaaggggagggatagcattaggagaaatacctaatgtagatgacaggttgatgggtgcagcaaaccaccatggcccatatatacctatgtaataaacctgcacgttctgcacatgtatcccagaatttaaagtataataataaaacaaaaatgaataaataatttaaaatttttaaaaaatatatataatagaaaattctttgtgacctttgagtaggcaaagatttcttagaaagaacataaaaagcataaactatattttaaaaaactaataaactgaacttcataaacagataccaaaaatcactttacctctttagttctctgaaaggcagtattaagaaatgaaaaacaaagacacagactaacagaagatacttgttacacagaaaaagaacgtgtatcttgaatatacaaagaactcttatgaagcaaaaaattaaattaaaattaaaaaataagcaaaagatctaaacactcagaaaaagaaaacaagatttatgagttgccaggaagcatataaaatgttactacacatcacttattatcagaaaaatgcatattaaaaccacaaaggaatactactgcacacccatagaatagctaaaaaataaaaacataataaacaatagaaaatttggccccaccaagcgataacaaggatgtgaagcaactagaagtttcatacgtttccagtgaaaatgtaaaaggacgatcactttgcaaaaccatttgataatttctcataaaggtaaatgtacaccaattatatgacctagctggtcatagatatctaaccaagaaaaaaattaaaaattgtgtttacactaagacttgtaaataaatgttcatagaaactttatttgtaatagctgaaaactggaaacaacctaaatgcctttcagtaggttgaatggataaacacatatttgtacaatgaaatagtgctaagcaagaaaaagaaatgaattatcaatacatacaacatggatcaatctcaaatcattatgtcaaaataaaaaggtcacacaaaacaaggtacataatgaattccatttattcacgaaaatgcaaattcacatttatggatagaaagcaatgatcagtgtttatctgggtagaaagggggatatattatgaaggagcctgagaaatcttgcaggcgctggatatatttgctctcttgattgtggcgacagtttcctaagtgtatgcatatgtcaaaatacatcaaattttacactttaaatatgttcagtttaatgttgttcagttacacagtactttaataattttaaaaaatacttatacctctccactatctcattttcccttggaatgtcccagaaataacagctatcttaaatttagtgtttcccttttacatgcattttttgaaataagtattacgcacagtataatggttacatacagggactgtaaagccagacaacatgagctgtaaatctgtctctatcacttaatagctttgtttctttggaaaaattaattcatttttatgtgcctcaatttactgactataatgggatgatagtacttttttcacagggttattgtgagtattaagtgactgaatttatataaatagctagaagagtatttgtcaaatagtaaattatagttatgccatataatataaaaccaggtagatattaaattgaacatgaaataattgttaataatatggtacaatattaaggcaaaatatgataaggatggttaggaatatgggctctggttcatccatgttgttccaaagggtaagatctcctttttaaaggctgaataatattccattgaataataccccataattttgttaactattcatctatcaacagacaccttggttaagtaaaataagttagacacaaaaagaaaaatactgcatgatctcacttatatatggaatcgtctttttaaaagttgaatatatagaaacaaagagtagaatggcagttaccagagatgggggtgggggcagggaatgaagaatggggagataaagatcaaaaatataaaaagttgcagttatgtaggatgaataagtctagagatgtaatgtataacatgaggactatagttaataatattgcatattgaaaatttgctgagagtagattttagtagctcttaccaccaaaaaaagtaactgtgagataacagatatgacaattttcatgattatagaaaccatttcactaatgtatgtatatgaaaaaagaaagctgtacatcttaaatgtgtacaatttttttaaaaagaagaatatgggctttgggttagaccacttggattgaatctcagctctaccacttagtatctgggttatcttgagtatgtttcttgtttcttactttctttgtgctttagttttttcatctttaaaagatgaataatgacagcaccttcttcttagggttgaattaaacaacttgacctaaaagcatgtggagtagtgtcctaagcacagaacaaacattcaataacattaactattagtagtagcatacattcagaagtaatatatagttgcctccaacaattcagtgttatgtcttcaagtaaaagtaacgtatattaaatgtaaattaatggtttgtatttttttatgtattcaggctcataggagaaacattttttatctttgcaaaaagatattgtaaattcactggacataagcctactcttcattgctatttgtcacctatttctctgttcttttattcattcctaacatgttttcatcaatttagataactcagtgagaatatcctatggatttcattttaaaagactgcacttaacaataactgatgtgccttttgtaaactccaagcttacaggggctgaaaagtttatttttgctattaatttccacggcaccttttctcatgttaacaccttgtcttatttagcaattcattaacatagatagttctatacaattcattgacagattcatttttgatcattttatttttaatgttttataagtatcaaaaatagtaatatatccacattatttgatcagttacatactaatagtagctgtaataaactaatccaagcaaattgttttattcagtagcttttatgtattaagaaaaaattctttgaatatttatatataccatatacatatatatacacacacatacataaacagattttgttgtgaaaaagcataatatgttgatcaataaaagactttcaagcaaaaaagaaatactgtatttttaggataattctttgcagaaactaaaaaggaaattatgagtcttgtacaaaggaggaacaatgtaaaatttctgcttagaaaagtctcctcatttttttttaagagatagggtatttgtatattgctcaggctagacacaaactcctgagttcaagggatctcctacctcagcctacagagtagctgggaatacaggcatgtgccactgtgcctggctttacttctaaatggattttaaccacgaataactacatagtttttaccatatgccaaacactcctaactgcactctctaaacactcttctaattgccaaattaacttaatatatttaaatatcatgactatgccaagacgtagactgtgttagtcatttcattttagtacgtggaaactgaaatactgagagattaaataatttacttaaggtcataaagctaaggaagtaattcacagaaactgaatacgaatccaggtactcctgcttgattgcctgatattttaaaatagattttagggtgcaagagcagttttgtaacatggatatattgcatagggatgaagtctggattttcagtgtagccatcacctaaataatgtagattgtactgattaagtaatttattttctctcgtccccctccaaagcatccactcttataattctccaatatctattatcctatacattggagaatgtccatgtatacacattatttagctcctacttataaatgaaaacaagaggtgtttgactttatgtttctgagttatttcacttaagataatggtctccagttccatctatgctgctacaaaagacatgactttactgtttgttatagttgagtagtatttacatatatatatatatatatatatatacacacacacacatatatatatatctatacatatacacacacaaatatttacacatcacattttctttgtccaatcatccattcatggactcttggattgattccattatctttgctattgtaaataatgctgcaataaacatacaactacaggtttatttttgatgaaattatttcttttcatttgggtagatactcaggaatgggattactagattcagtggtagctctatttttaattctttgagaaatctccatactgttttccatagagattgcactaatttactttttcaccaacagtgtataaccattctcttttctatgcatcctcactagcatctattattttttgactttttatttaatttttaaaaattttttcaattatactttaagttctgggatacatgtgcagaatgtgcaggtttgttacataggtatacacatgccatagtggtttgccgcacccatcaacccgtcatctacattaggtatttctcctaatgctatccctcccctagccccccagccccaacaggctctggtgtgtgatgttcccctccctgtgtccatgtgttctcattgttcagctcccacttatgagtgagaacatgtggtgtttggttttctgttcctgtgttagtttgctgagaatgatggtttccagcttcatgcatgtcccctcaaaggacatgtactcatccttttttatggctgcatagtattctatggtgtatatatgccacattttctttatccagtctatcattgatgggcatttgggttgattccaagtctttgctattgtgaacagtgccacaataaacataaacgtgcatgtgtcttaatagtagaatgatttataatcctttgggtatgtacccagttatgggattgctgggtcaaatggtattctggttccagatccttgaggaattgccacactgtcttccacaatggttgaactaatttacactcccaccaacagtgtaaagcgttcctatctctccacatcctctccagcgtctgttgtttccttttaatgatcaccattctaactggcatgagatggtatctcattgtggttttgatttgtatttctctaatgaccagtgatgatgagccttttttcatatatttgttagccacacaaatgtcttctgagaagtatctgttaatatccttcacccactttttgatgaagttgtttgttttttctcataaatttaagttccttgtagattctggattttggccctatgtcatatggatagattgcaaacattttctcccattttgtaggttgcctgttcactctgatgatagttgattttgctgtgcagaagctctttagtttaattagatcccatttgtctattttggcttttgttgccattgtttttggtgttttagtcatgaagtcgttgcccatgcctatctcttgaaaggtattgcctaggttttctcctagggtttttatggttttaggtcttatgttgaagtctttaatccatcttaagttaatttttgtataaggtgtaaggaaggggtccagtttcagttttctgcatatggctagctagttttcccaacatcacttattaaatagggaatcctttccccattgcttgtttttgtcaggtttgtcaaagatcagatggttgtagatgtgtggagttatttctgaagcctctgttctgttccattggtctatatatctgttttggtaccagtaccatgctgttttggtaactgtagccttgtagtatagtttgaagtcaggtagcgtggtgcctccagctttcttctttttccttaggattgtgttggctatgcaggctcctttttggttccgtatgaaatttaaactagtttttttctaattgtgtgaagaaagccaatagtagcttgatggagataaccaggcgaaaataaaatactggaaaaccaaatccacaagcacatcaaaaagcttatccatcacaatcaagttggcttcatccctggcatgcaacgctggttcaacatacgcaaatcaataaacataatccattacataaacagaaccaatgacaaaaaccacatgattatctcaatagatgcagaaatggcattcaacaaaattcaacagtgcttcatgctaaaaactctcagtaaactaggtattgatggaacatatctcaaaataataagagctatttatgacaaacccacagccaatatcatactgaatgggcaaaaactggaagcattccctttgaaaacaggcacaagacaaggatgccctctctcaccactcctattcaacatagtgttggaagttctctccagggcaatcaggcaagagaaagaaataaaggtattcaattaggaaaagaggaagtcaaattgtccctgtttgcagatgacatgatcatagatttagaaaaccccatcgtctcagcccaaaatctccttaagctgataagcaacctcagcaaaatctcatgatacaaaatcaacgtgcaaaaatcacaagcattcctatacaccattaatagacaaacagagagctaaatcatgagttaattcccattcacaactgcaccactgctcaaggaaataagaaaggacacatacaaatggaaaaatgttccatgcttatggataggaagaatcaatatcgtgaaaatggccatatatccccaagtaatttgtagattcaatgctatccccatcaagctaccactgactttttaatagtagccattctggcttttgtgagatggtatctcattgtggcttagcattttattcagagtaaatatcaaagttttaaaatattctatatgagctgccctcttcatgtgtctgacctcatctcctattattatcactttacttggcttccttcaagtaactgctcaaatttcacttcctcaataaggccaactttaccaccatattaaataatgccaaataccctttcctacatcctgattcctctcacctgccctagttttcccacagcactcactacatcgaagtatattattaaaattacttatttactatgactattgtttatttctatcccctctagtaagaatgtacgttctttgaggaaaagaatctttcttgttttgtttattgttatatcggcagcacctgtagtagtgtctggcctaactagatattcaataaatctctgttgagcaaatgtatacataaaagctaacctcaaaagttgttaagtaaaataagttacagagtcattgaggtaatatattaaagctctatttcaggccagacttagttcagggaaccagaatacaaatgcgaatatatcagtccttgctatcatgaagctaacgatcaagctggagcaatagtcacaaaagtagataacttcaatccaaaacatcaagtgctattgggatggatgaagaaatgatggaaggatgcccagagtaaaccataagatgctatgtaaaagtgggtgatatggttcggatgtttatcccctccaaatctcatgttgaaatgtgattcccaatgttagaggtggggagaggtaggaggtgatgggtcataagggaggatctttcatgaatggtttagcattatccccttggtgagaagtgagttctcacacagttagttcacacaaggtcttactgcttaaaagagtgtagcatctcaccatttctctctctttggctcctactctcaccatatgatgtgctggcttcccctttaccttctgccatgattgctgcagaaaccctcaccagaagcagatgctggtaccttacttcctgtatagcctacagaactatgagccaagataaaactcttttcttcataaattgcccaatctcatatatttatttgcagcaatgtaagaacagactaatacaacaaattattattatatctacactaaaagaaacataaacgggtcaaaatgaaaagccataagaatcttcaataatggatctttaattgtgaaaattaatttttctgttcatccattgacagttattttgagatttcagtaaacttaaactgcatatgtaaaaattcttgtcatttaaatgttggcttattttctattaaacttatattataagttgattttcagaataatgagggtatctgcttttcttctttattttgtctgtattttcttctttattccaagaatataaagaagatcctgtaaaaaacatttccctctacaaaaaatttgtaagctttctattttcagaaagaaaaactacataaaataatttatttttctttctctattctaaaagtgtctgtttgatgcatttctttctccagatgccttacacagaagagtcttatctgaaaactatcttaagttatccaggagtgagacaaagaacaacatgtaactaaaaatgttaattgaaatgcccattagaataggtacattgggtcaggtggtccttgcaagtggccctctgcagcctctttcaattatgtgattctataaaagaaggaaacccaaatcctataagtaatcatacaagtggctatcactggaataggaaataaagatgaagagcccctggaaataaaggagaaaaataagaatcttactatgctagaaaattagcaaatgtcatatgactttcccatcctactcagtctattcatttccaaaatctcatcttctaaaacaattcccacaataactggacttgctgggtagagaagatcctcttagaaaacaaagtgttcacctacgtgagagaaatcacttctttttagaaatcatttagagccctggataaggcaatttaccaaatggtgcctgcctccccaaaggagttaatctctctttccatagtaaatctgcctcttcctgataacatgtttgtgatcgtggctcaccataaaagctgtgcatttgcttgatcaaaagactaggaagacgaaaaataaatttagtcaccttgcgtcactgtattgtggtctgtatgtttaaataataacaagcaatgcagaactgtcattagcccttcctccataaaagactgaaagtaagataaaacttgaaaaagccttttatgtgatttggctgtgtccccacccaaatcttatcttgaattgtagttcctataattcccacatgctatgggagggatctggtgggaggtaatttaaccatggagatgtttatcctcatgctattcttgtgatgtgagcgagttcacatgagatctgacggtttcataaggggctttcccccttttgctcagcatttctccttgctgctgccatgtgaagaaggatgtgtttgcttccccttccaccatgactgtaagtttctcgaggcctctccagccatggtaaactgtgagtcaattaaacctctttcctttataaattacccagtcttgggtatgtctttattagcagcataagaatggactaatacagacatgttatttcatgaatatcctaaaaaatatacactctctaagactaaaactgaaaggaaaactgatcccagcaataagtatctccaaataacagcattataggttgagcatcccaaatataaaaatgcaaaatccaaaatccaaaatccaaaaaatgctcacaaatccaaaactcttctgagaaccaacatgatactcaaagcaaatgctcattagagcattttggttttcagattttcagatttggggtgctcaacagtaagtataatgcaaatgtttcaaaatctttttaaaaatctaaaatctgaaacacttcaggtctcaaacatttgagataaaatatattcaatctgtactatattttggctactagaagaagttttaaaaagtcctgtgtccttggttccatctccaaatgttcattgagcacttgctacatagcagctattctgctatttactagcgattccaatttgtttgtacagaatagtgattaaaagcatatactttggaataatactgcctgggttcacatcacatctccaaccctttttagctgtgtagtcttgaatttgacactccatctcagtgtttctacttgcaaattcatagagttgttgtaaggatcaaatgacgtgatacgtgcagaggtgtgagaacagttgctgctgcatagaagtgaataggcataaaagaagctattaatcaattgagggaaactaataaattagtcaagatatgtaaaaagtgttatagggacataaaattaaaagactaacatatccggggttgcaagacttgcaaagagttaacagaagtgacaagttacacttgaaggatgagtagttttccatatgtcaaacgaaagaaggcagaaagatcatcatgtgacagaacacagagtaataatgagaggcgaagccagctggacttcctgggtaaagtggggacttggagaacttttgtctgacgagaggattataaaatgcaccaatcagcactctgtagctagcaaggggattgtaaaatgcttcaatcagcactctgtaaaaacgcaccaatcagtgctctgtaaaatgcaccaatcagaaagatcctcaaagtagccaatggcagggaggattgaaaaaaaggcactctgataagacaaaaacagaacatgggcagggacaaataagggaataaaagctggacaacccagccaacagtggcaatccgctcgggtccccttcgacactgtggaagctttgttgtttcactcttcacaataaatcttgctgctgctcactctttgggtccgtgccacctttaaaagctgtaacactcactgtgaaggtcgaaggcttcattcttgaagtcagtgagaccacaaacccaccggcaggaaccaactccagacacaataagacaggatggccaggccagggaattgctagtatggccagagtccaataatgcaagggatattaggacaagttgctggagaggtagatcagggtaagaaaataaggagccattggaggcttttaagtgaaagagtgacattttgaattttattattaaaaggtttctctagtggcagtataaatataaaatgagacttgtaaaaagcttgaaataggagccagtaataatacttagcactatattgcaaaaggccaagcaagaattgatggagactcacatgaagcaatgaaaggaaggagtggattacaaagatagaatcttcaggtgtttgttaagggataaactcttcttaccacttgataattttatataaatacttaattggctttcataggaaagaagggacaaaccagtaatatttatgaaaaacagtaatacagaaatttcccctcatcaaagaacaatgagattatctgagatatgagttaatgatcaatacagaacttgaagagaaagttggacaattatttggcaggtttggattagataagcaaaggttacaaccagaggtgaatttattaaaagaagcaaatgaaatttaagctttaaggttcctcagttacaagggcccttgtgagggttgaggactgcctagagctatgagcaggaagggaaagcaagcctgtacttcttcaaagcacttctagtaaatagcctaaagagacttcagcagaaaggaacttgaatccccaaggtgccagtaacgtattgtgatctcctttctttttctgaagatataattttatattcatattttgtacaattcttcatatagaggactctcagaaattatataaacttcaggccacataaaacctggaactgcccttgcttccagccttcaggcttctttagcattaacaaatggagagaacttagtctaactcctggagttgaatatttttatcttgatgtacaggaattaattctccaagtaaacaaataaggtgatttctttaaaacatattaagagctattaaccagcaattaaacattaaatgcatgatgaataattaatgttttatatgtcatcatacaatgatgaataacaatagggatttgaaggttgagggacattttcaaaatcattcttcttcaaagattaaaaatgctttctgatacatgtttttaagtggatgtactattgattttacattgattgaatggcagtcaaaagatctgatttagctctatgtttatcattgattacctttgtgaccttgggcctatgacaggtaacttttctattctaactctgaaaagatttttacattaacttctctccgtttccaatgaatcttctctcactcagtctgtagtaactgagaaagaaaaaattttttatttgaggaatgtgagccccttttaaattatcaggcccagagaggtactgaaatgtggcagtagtcacatctcactcctcaacttgagctaagtaatcattttgaagctgcctactatatgaactctacactgagtgtcgccaccaacagtttataaattaacctaataccatatgctgggcacataactcttatcctttttttcaacaacgtgcagccaatcactaatcaatgttatttccagaaatcaatgacaatccctgaaaaacaacttttctaatcactcccattcctaatttgtcctttctttctttaaaatcttgagcctctcctttgttttcccagagcactcaacagtgttagccaggccgtagtccttaaccttggctcaaataagctctctatattaattttgcctcagtttatttatttaggtcagaaaaacaaactcctgaaaggtcttcatgcctcttgcttctaacgccagcaagcctcccattctcttatcatctaatttccattgagcctatactcccttttctgccacctagagaataaaatgcaaaatcagcctgccgcataaagcctctacaatttgacctctagatatctgtacaactttatctaccacttgatctcctatttctttatacagttttatttactgtttccacaaagatatacaatcttggcacatttcctcaagctattccacagttatgagccctctcacaagctatgtctggtcatcaaagccttcagggccttactcaaattgccagtttttccaagattattttccagaagaattaatctttccccatcatcttttcttatcactttctttattatttataatatccatcacatggcaaagtgattgaaaacactagcgatgagtcagaaagtcatagttttaaagctgtgctctaacactcaccaacccatgtaactttgggcaagttacttaacctccatgaaattcagctttcatttactgaatgaattatgtgcatatgatatcttctatatgcatggaaaccagaagaaattcagtgaagaggaagcagaataagccatcaggattccaggcctaagcttcttattcaatcatgcttaccagagaagtccaatagtttatgtcagtcagtagagtaagggtagaataggaatgattagggataaaagatctcttatttgcttacccaaccagtaataaggcattatttagttttccacttttctttgagattttggaactctcagcaagtagcccaagaaaaggggtattggatgatatacttcaagaacaaaatcccactctggaccccaaacagtgtagggcactctcatttgttcttacatctaatggaaatgttcaagaagcactttctgaaagtagtaaaacttatatatgaaacctcttaatgctgttgtttggaaagtaaattaatcaaaccctatattttataaaatacttgctccacaagtatttattgactacaaactgtaggtcaacatataattattgttgtggctataacagcaaacatgacagacatagtccctttccttaggttttatgctctcatagagaagactgacattaattgaatcacttcaagtgtgatgagtgttataaaggagatgtatgtctctattatcatagaagcaaacaatagagaacttaatccggtttatggataaaagtattccattcttattaactgctgtcaaggactgtatgtttgtatcccctcaaaattcatatgttgaaactctaacccccaatttgtctgtacttggagatagtacctgtaaggaggtgattaaagttaaatgaggttataagggtggggctctgatccaacaggattagtgttcttataagaagagacaccagaaagatatatatatatatctgtcccccaaggaaaaatcatgcgaggacgtggcaagaagaaggtcaggaaggtagctctcacaagaaactgagcactgccagaattttgatcttggactctgcagcctccagaaatgtgagaaaataaatttctgttgtataagcatgcagtccatggtattttgttatgacagcccaagtggatggaaagaagaaatgaagaaatgaggaaaggagaaaaaagaagggaagaaaagggaagggatgggggaggggagggaagagcaggagggaagaaaaagggaataaaagcacttgtttttattattttcctactaaaatgacattttcctctcctgtcagaatataatggacttcatcatgtgaaactcctgcatatgtgaggctctaggaaaatgtttaccttacaagaaagatgcatctatgttaatatatgtatctctctgaattactctttcctattcccataacatttggtggagcactgtaagcttagcaagtgctattaagggcttgctgagttcatgtcaaaacttttctggctacaaattgtttcaaatctataaaatgaatatgtatctgcaagctaacagcgaaataatgctgtgtttgagcctaccagaaatctccgtggcttacaacagtaagtatttattctcaagctcataggtttgcaggttgtggtttcgctgatctatgctgggctgtccagctctgctttaggctgtaggtaggctgtggttggctctaggatgaggctgaaacaaggtatattcaacatgtctctcatatacctgttcttatggcaaatcaccagcatgctaaagccaaattactcaaaaagcacatttaaggcctctgttgaagtcatatccattaatgttcttttcctttgtgggtttttttttttttttttttttgagatgggtcttgctctgtctccgaggctggagtgcagaggcgcgatcttggctcactgcaacctccatctcctgggctcaagcaggcattcaactgaccaaagaaaatcatgtgacaaagcccaaaatcaaaggagtaagaatatatatccttactacagtgagaaactgaaaagaataaatatttgctgaataataagccacatattttatacaggttcagaaaagatgatctctaagtgaaaaaggaaactaaataaatactggatgctggaaacaaaaaggtgatttagagtttcagatcttaagtggcttatagtctgagggctggtgggggttgagggagagacaaataagagaaacactataaatatagtgaagcaagtataatgacaatgacggtagaattattctgtgtggaggacatttgagttttaaagggtagtagaagtttatcagatcaaggtggttgggattcagagaagatagaattctaggcaaagggaaaaaatgtgtgcaaaatcacagatatgttaactagaatggcataatttaaaagtggcatttttaaggtgtggcttaagcataaaatatatagaaaaatggtgagaaatgataaaggagatgcaagagtcaaatcttaacacaagtcaggtctaaaaatttggtctgcagtgccattaaagaatattaaataggaaaataatgtgctaaaatgtttagaattatggctcaatagagtggaagaatgactggcaggatgagtttaaggaatggcagagagtatgagacaatagaaaccctaaccaaagcagtggcagtgtgaatgatgagaaggaaatattaacaaatttatgaaatattattgcatatctttttaatgactgcaaaggtcaggactttctgagttgtaagtgacttaaactcaactcacataagcttaagcaaaaactggcagctctcagaaataaaaaataaataaataaaaataaaacaaactacaggaaccagcacaactctaaggaccttggggatggcacagataatttaaatgttgcttatattttctccccatccttcatcaatgtttattcacttaattctctcccactgtagaaaagcttactacacatggaggaggaatatggccacagaaagctccaaatcacattattctaactaaaggcaagaaaagacctctctatttgcaattttttttaaacaaaaactcttgagtaagcctcttttgacccaactcaggtcatatgcccaccctacaatacagtggccaaaataccatgagttacccaagttatctcttgatcctcttagagaaaagtaatctgttatcagtagaggaagtggataaattattatccagccaaccacatcaatctgtatcaaccactgtgagagtaaaagactagttgagggtgacaagttgagacttctagcttagcaactagaatattaatgacatattaatgataatacgtgctacaggaagaaaacaatgtatgaagtaaaatttttagaaatgtcaagtttgaccttaaacttagattattcaagccatgaattattcaaatggcaatattcaataaccactaaatttttctttccacaagactgggatatatatatagagagaaaaagtgcataacaatagcaattaatgatttagaagaataaagacagaaatttcatttctgtatttgacataaaagcattacatccagggaatatctctttccatatgagaaagaacactcgaaaataatgtattaagagtctctgaggctattttaacagaaatttgaaccaattaaaacgtttgaaaatatctattgaaatgcatatgattgacattatttttatgaaagggaaaaataatgcagcttaggtggaaacaatataacgtatctaccaaatacaagaactgctgccttcattgacattgctgattcagtcagagactaataagcctgtgaagctttctgctttctcagaaagtagagggctgctcattaacagaaaatttggttgagtccatcttagaagccaatagtccctatcttctggaaaaatttgcaggtatcccataaaaactccaagtatttgacactatagaggtttactaagtggattaaaacattatgacttattattattattatacccatattccccaaggtgaaataatgttttctgaaaactctccattttgaggttcaatgagatattcccagcaacacacatgaaaaaagagtattgaaaaggggttttgcatagccactcaaatcaaagctgacaattaccttgatggaagaataaatgataaaacttaagggttttattagccccaaagtagttttcaagttgcacaaaatgttccttttcttcctatatattaaagtactcctgccctatatatttagctttcataaaatattcaaaatattgcttcccacgttgttaaaaaagtatctgttaccggaagaaggaaaatccattttgcaaaataacagggagattacccagcataactacaattacatttttaaaggtacagaaagataatagagagctgtcatacaatttaaagatcttcttaaactacacactgtgtttctctacagaggatttttaagatgagaaatagaccttgagggtcttagataggcctgaggcaatattaaaaaggtcaaacattcttctaaaaagcacctctgtcttcagaacaacttagcagccagcttgcagtgccttcttatttacagctattgttcccagaggaagtgcacttgagtgtgggccactattagtttgtaatgagcttgccagaaatgatacaggaaacaagtttgtaatgatgtgccatacccagctcagaaatgcgatgacacactcttttggtgaggtaaacaggaatatggggctgagaaggcatgtggggagagaagagggaagaaaaacaggaagagaaaaggagcctagcaatagagagccatcttcctgttctgctcctagtaagaagccaactagaatggaactgaggaataactgagttgccagcatagtttggaagactcaggaattattcagctcaactgtccattcccagttcaggagtcttcaaagggcaggcttgtactctcaaatgaaaccgttctaaaacaaaacaaaacaaaaaaagaaaagaaacagccctgaacctgtcaaagattagtaacaaaatgtcaaatgcttcgcctatacacctagggtgcctccatattgtatgttcacttatgttttcctaatgtacctctctccatacagaaaagtgcacacaatcatgaaccggggagggcagagaattaaaccttatctaagagctgtcaataaatctattgttagagatacatgtgaataaaagtaacagaggcaatctttgtcttttaaagaggtagtttttcaaaaagagaattacacaaagtgctcctctgtttttgtcaatatgctgccaggttttgaaatgctatttttcatccaaacaataaaaatcttgacaagtaagcagcagaaaatcactaaatacactcgcagctgcatttcaatctatacaaattctttaaacaaaaacaagcaaagaacagcctggcctagcaaaattatttcaccatttgagcctcaagtccaagataattaagaaaccgaattttatatttccactgaaatattccaaaaaaagttcaaataaaaaatgaaaatacagatgagaagatgtagtaaagctctacatgtgaatttcaagagcataaaatcaaggaggcaattttttcaactttacaattgagattaacccccccaaaatcctcaattattttctttcttaaaaatgtaagtgaactcaaaacaatagggttagtgggagggaaggtggacatacggaagaaactgatgtcggaagacccaggttaaacatctagcataactagcagcaatatatatttgagggaagtctgaaaaaagaaacagactgtttccatcatataatcaagagattataaagatccgaattaataagtctgtggtagtaggaattttaaaaaatgagatatattgatagcagcaagagacagacagcagcgacccatccctgtcctaggcagacaggggagggtccctggtgaaacccaaccttcaaacaaaagacaatttaaagcctgaaaatgagctgagctgccagtcccagatagagtccatgacccgagtgagaacttctatttctgtttcccactctttcctcattggttctttctggataatggtttttaaccaatcaaacgctgcctctttcaaggttacctacagctggggcctcctgattccaaacctgtaaaaaccctggactcagccacacagatggcttctcacttctgggcctcctctcacacagtgggctacccacttcaggtcccctcttgttgtcgagagctttcctgtcactcaataaaattattttctgccttgctcattctccagtgtctgcatgccctattcttcttggtcacgggacaagaacccagaacccaccaaagagcaggagctaaaaagggcagtaacacactccaggccagctcaccgagctgcggatggtgtgaataaaaagagctgttacatgctcccattcaccagactatgggagtgaagagctgcaacccttctgggggcccagacctcgggactccccaagccagaactatgacatgcccccattcacccagctgccagtcgggaatgagagacagaactatggcattccctgggggctcagaccttgggactccccaaggagtgacagaagctgtgacaaccccttggggctctgcagttgctggtatctctgagttttcaggtgctgccatgtccacctcatctagatgctggcacccaagatggaagccagttgcagcatgcttgatccagccctgggcgaagcacagagccacagcaggctcaagatttgggctggtagcataagccaactacagcctgccagatcaagtgaggagagcaaacccggtaggctccagcaaagcccaggcagaggcatcatccaccccgtggagatttctggctggcgaagtggcacagaacaaatcctgtgtcaatacgtgatagccaattttgtggacagaattaataatatttattaatgaatgaaggtaagtatactgaatatcttccatttgtccctccagagccattctctgcattctactccctgctttgtgttgcaggaggctgacttctatggactacatcaatgggctcccttattctccagcttctggttgggtttggttaatggaaagcatcagacacagatgaaagacagaaagtgtgaggacaaagtacttattcccttggctccctctctgcctagttacaagttgttggctcttctactgaagaccaaagctcctatcaggtgtccttctttacatttagtcttccccatgactcctataatcacttcctctcatttctccatcaaccccagtatggcaaatagttctgtattattagcagcctaagaattactaaaacatgccatcttaattgccctaaaccccctcatgcccttgtgaacagtcccagaatcctgactgatatagtgagattgttttgtaaaacataaagcactgtacaaaggcttatttatttatgttgttagtttaaaaaattatgccagatatacacagcagacgaataataaatacgtgctgaatcaaataatacagattacatacagttaagattttgggtcagcttctgttttaaatacgttaaatctcaaggaaaaaataaagagtcatgaaacatatcaattaggcatcaagggcttataaaagtataagcaacaaaagaaagcaatcatttctagaaactctttggtaattatttaaaatatctattattccaggaagtactctaaatatatgtaccttttcataaaggtgaagggaaaaaaaatagcaaccttcaaaattaataccttgaaaagtataaatatgaaactggaagtaatacctacggccaattgaagagataggcaaattctcccccaaaaagcaattgtaaacgtgaatatacatgataaaaagaatagtttcttaaaggtatacaaaaatcagagaaggatttgaatttgaaaactacttaactaacagtaagaatagagggaaactgacattctagactggagctgctcccatacttgcccccaggaatatttggcctgaaaaatctgctatgtaaggcaggccataaggacctacagtaatttttctgccatggttgaagaggtcttactcaatttggaaaagtgatgaccacttccaggggtattgtcagcagaaattacttaccaaaaactggctagcaagaaagggtaaagggtgcaactctaccagcttgaagtacagccctgactgggacaagcatagtcttggctaagactgtgtacatccacagtggaggcagagagacccaagttatttcaagactcttggtttatcctaaggctgcccacatgaacataggaaaataaaaaaggtctagcagaaactgaaacccagagaataattgaaaagaacctaaactacaaaaattatacaaaacttttaattctcaacaaaaatttaaaagacaagcaaagaaacaaaaatgtaactaaatcagataaaacttaggcaataaaatctatgagtgtctcagacctgtatttaacaggcaaagacttcaaagcatctgtaagaaaactatgtttatgaaataaattatgataaatactaatgaacaattagagagtcccaaaaaggatacagaaattataaaataaccaaatggaaattctagtgtggaagaatacaataactagaataaaaattcagtagaaaggataaacagtagatttgaggtgacagaagaaaaatcagtatacatgaaagacagaaaatatcaaatctaaagaatgaaaaacacttttgaagaaaaatgaactaagcctcaaagatctccagtgcagcaagtttaccaacatgtgtgtaatagtatttaccccaaagagaggagagagaatgaaatgggaagaaaggatttaacagctcaaagcttctaaaatctagtaaaaaacatgaatctacagatccaggattcttaataaacttcatataacacaaaaataaagagacataaacctagacacatcatgagcccaactgctgacaccaaacataaaggaaaatattaaaaacagggaaatattaaaaaggaaaaaaattaaaaaggggaaataacttatcacatacaaagaaccccaataagattaacaactgactttcatcagagccaaaggaggccagaaggcagtaggatgacatagtcagaatgctgaaggaaaactactttcaacaaaaaattctataaccacccaactatccttttaaaaaagaaggaaaagtagagactttccaagattaagactgagacaagtcgttgttagcaggcatgacatgcaagaaataataagaaagtctttcaagtgaaagaacatggtaccaagaggtaaattcaatttacagtaagaaacgaagaacaacagaaatggtaaacatgtgggtaaagatgtttttctcatttctacttttctctaaaaggcacaatatcgtataagaaatttgacatcttagctgacattgctgactgggctgtttataacaaattatcacaggctgggtggcttgaacaacgaacattatttctgtacttctggaggctaggaagtccaagatgaaggagccagtgaatccagtgtatggtgagagcctgagttgtagtcttgttgtatccccccaaattcacatgttggaaactgaatccccattgcaacagtgatgggaggtggggccttcagagaggtgtttaggtcatgaggactctgccttcattaatagattaatgccactatttttaaaaagcctgtagaagtatagtctcactgttctgcttttctgccatgtggggacaaagatttcacctttttactctacaaccaaagccaggcaatggccccacaagaaaactaataactaatatgcctcataataatagactgcaaaatttttatccaaaaaattagcaaatagactaaatcctttaaaatattgaaaggattatacactatgactaagtagaattcatcccaaggatgcaacattggtttcatatccaaaaatcaactaatataacacaccatactactatagaagagtattaaaataataagaccatttcaacaaatggagaaaaagcacagcactacacaaattcaacactcattcataatatagttcttgatatactatgagtagaaggcaatttcctcaaactgtatatgtgggctacagctaacatcatacattaaggggaaaaaaataatctgcccccaaagatcaggaacaaaacaagaatgttgactcttgctattaatattagaatggaggttataactagtgccatggagaggggagaggggagagagagagagacagagagacagagagagagaaagggggaaatgtaaattggaaagaaaaaagtaaaaatgttcctattcacagatgatgtgatcctatatttggaagacctcaggaatctacagaaaaagtacggagactaataagcaagtttataaaggacatagaatctaagagcaatatatgaaattctattgtagtcctgtatattagcaataaaacattgggaattaaaatgaagaaaaattcaattcataacagtatccaaaaaattaaaaataaagttaatttaaaaagtacaagacttgtacaatgcaagctataaaaaaaatggctttggagaaattaagatccaaataaacaggactgaagaaccagtatagtctcaatatcaattttcccctaagttcatgtgtaactttaattcaatccctatcaaaatgccaacagggtttttataggaattgacaagttgatattaaactttatatatattaaaataatctataatagcaaatagcaaaaaattttaaaaataataataatcatgggaaacttatattattttatttcaaaacttagtataaagccacagtaaccaaatatttcagtgatgatacaaggataggcatatagatcaatagaacatatctgagagttgaaaaataaattctcatctatataatcaatttgtcttccacaaagatgtgaaatcagttaaaagaggaaagaatagtctttccaagaaatggtgccagacaactgtgcatcaagatgcaagacaataacaattattattatacccatattgtagtaggtagaataatcagccccacaaaagtccacgttctaatccctgaaactggtgaatatatcttacacaataccaaacgttttttgcaggtgtgattacagtaagaccataacatcaaaagattatcctggattatccaggtaagctcattgcaatcacaaatgtccttaaaacaaagaggtagaggtgtgtgggtgtgtgtgtgtgtgtgtgtgtgtgtgtgtgtgtgtgtagagagagagagacagattttaagatgctattcttgtgcctttgaagagaaaagacccatgagtcaaagaatgcagtcggcctctagatgatggaaaaaggcaagaaaatgtattctcccattgatcctccagaagaaatgtgatcctataattttatattatcattgtaatacccatttcaaactcttatatcaaaaaatataagataaaaaaatgcatgttgttttaaagcactatgtgatatgtaatataccagcaacaggaaatgaatacatttacaagatacagaaaaattaactaaaatggactacacacctaacataagagctacacaatattaaaaaggaaatacacaggagactatcattgtgatactaccttgggcaaagtgttttagctgtggcaccaaaaagaatccgtaaaaaaagtaataactggatttcaccaaagcttaagacatctcttcaaaagacagtactatgaggagatagaagtataaagacagagtattttttaaataacctaataaaaataatggaattaaaaagaacaacttaattgaaaaacaaaaatcactggaaagtatcaacagcaagccaggcaaaagaaagccacagcaaatttaaagatgggtcaactgaaatctccaatctagcaacagagaaaaaaaatgaaaaaaatttaatagagccacagaaatctttgggaaaccatcaagcacatcaacatgcacatactggcaatctcagaaggagaggaaataaagaaaaaagggaaaagaatatttaacgaaatactgcctgaaaacttcccaaatttgatgaaaacattagtatacacatcaaagaaattcaaagcccagtagaataaacttagagatccttagacacattataatcaaacacttgaaagacaaagacaaagaaaggctcttgaaaaaaagcaagagaagagtgactcgtcattaacaagaaatcctcagcaagagtaacctctaatttcttttcttttttgtcttaaaaaatttaagaagattggaattacatcaagtattttttacaaccacaatgatacaaaattataaatcaataacaaaagaaatttcagaaaattcaaaaatccatggaaattaaaaaacctgccctatataacaaatggatcaattgaaaaactaaaagggaaatttcaaaacatgtttagacaaacaaaaattaaaacacagcatactaaacctttgggatgcagcaaaagtagtgtcgacatcaaccttgacaatgaatttttggctaagtccccaaaaggaactgcaactaaaactaaaagagacaagtgggacctaattaaactaaagagtttctgcacagcaaaataaactatcaacagagcaaacagacaacctatagaatgggagaagatacttgcaaactatgcatctgacaatggtgtaacttcccaaatctataggaatcttacatcaacaagggaaaaaaaaaaacttcattaagaaatgggcaaaggacatgaacagacagttctcaagagaacacataaaaatggccaaccaacataggtaaaaattaacaacataactactcatcaaagaaatgcaaatcaaaaccactatgagataccatctgacaccagtcagacaatttgacattttaacaatggctattaaaaagtttaaaaaaaaaacatgatggcaaagcaaagctgcagagaaaagggatagcttatatgctgttggtgaaaatgtaaattagtccagccactatggaaaccagtctggagatttctcaaagaatttaaaaaagagctaccattcaatatatcaatttcattcctgggtatatactcaaaacgaaataaatcattctaccaaaaagaaacatgcacttatatgcttgttgctgcactattcaaatagcaaagatatggaatccacccagatgcccatcaatgctagattggataaagaaaatgcggtacatatataccatgaaacactactcagaaataaaaaaaataaaatcatgtcctttgcagcaacatggatgcagctggaggccattatcctaagtgaactaacacagaaacagaaaccaaaaacagtatttttcacttataagtggtagctaaacattgggtacgcatggacataaagatgggaaaatagatactggagactactagaggtgggagagagagacaggggcaagagctgaaaaactaagaaccaggttctgtggtcattggtgatgggtgatgggatccaaacttcaaacttcagcaccatacaatattcccagataacaaatctgtatgtgtactcctgcatataaaataaaagttgatatttgtaacaaaatcctagtaattccttatcggaaatcatgaaaaccagaaggcagtaggatgacatattcagagtgctgaaagaaaagactttcaactcagaattccattagcaaaacttaccatcaaaacttttttataaaaaaagatagtcttagatggccgaataggaatagctccactctatagctcccagcatgagcaacacagaagacgaatgatttctgcatttccaactgaggtaccgggttcatctcactagggactgttggtcagtgggtgcaggacagtgggtgcagtgcaccgagcgtgagcatttccaactgaggtaccaggttcatttcactagggactgttggtcagtgtgtgcaggacagtgggtgcagcgcaccaagtatgagccgaagcagggcgaggaatcccctcacccgggaagagaaagggattagggaattccctttcctagccaaggacagcggtgactgaaggcacctggaaaattgggtcactcccaccctaacactgagcttttccaacagtcttactaaatggcacacaaggagattgtatcccgtgcctggatcgggggtcctacgcccacggagccccgctcattgctagcacagcagtctgagatcaaactgcaagtcagcagcaaggctgggggaggggcgctcaccattgcccaggcttgagcaggtaaacaaaatggccaggaagctcaaactgggtggagcccaccgcagctcaaggaggcctccctgcctctgtagactacacctctgggggcagggcatagccaaacaaaaggcagcagaaacctctgcagacttaaatgtccctgtctgacagctttgaagagcgtagctattctcccagcatgcagctagagatgtgagaaaggacagactgcctcctcaagtgggtccttgacccccaagtagcctaactgggaggcaccccccagtaggggcagactgacacctcacacggccgggtactcctctgagacaaaacttccagaggaacgatcaggcagcaacatttgctgttcaccaatatctgctgttctgcagcctctgctgctcatacccaggcaaacagggtctggagtggacctctggcaaattccaacagacttgcagctgagggtcctgactgttagaaggaaaactaacaaacagaaaggacatcgataccaaaacctcatctgtacgtcaccatcatcaaagaccaaaggtagataaaaccacaaagatggggaaaaaacagagcagaaaaactaaaaagtctgaaaatcagagcgcctctcctcctccaaaggaacgcagttcctcaccaacaatggaacaaagctggatggagaatgactttgacgagttgagagaagaaggcttcagacgatcaaactactctgagctaaaggaggaagttcaaacccatggcaaagaagttaaaaaccttgaaaaacgatgagaagaatggctaactagaataagcaatacagagaagtccttaaaggacctgatggagctgaaaaccatggcacgagaactacatgaggaatgcacaagcctcagtagctgattcgatcaactggaagaaatggtatcagtgatggaagatcaaatgaatgaaatgaagagagaagagaagtttagagaaaaaagaataaaaagaaatgaacaaagcctccaagaaatatggcactatgtgaaaagaccaaatctacgtctgattggtgtacctgaaagtgacggggagaatggaaacaagttggaaaacactctgcaggatattatccaggagaacttccccaatctagcaaggcaggccaacattcagattcaggaaatactgagaacgccacaaagatactcctcaagaagagcaactccaagacacatacttgtcagattcaccaaagttgaaatggaaaaaatgttaagggcagccagagagaaaggttgggttacccacatagggaagcccatcagactaacagcggatctctcggcagaaactctacaagccagaagagagtgggggccaatattcaacattcttaaagaaaagaattttcaacccagaatttcataaccagccaaactaagcttcataagtgaagtaaaaataaaatccttcacagacaagcaaatgctgagagattttgtcaccaccaggcctgccctacaagagctcctgaaggaagcactaaacatggaaaggaacaaccagtaccggccaccgcaaaaacatgtcgaattctaaagaccattgaggctaggaagaaactgcatcaactaacaagcaaaataaccagctaacatcatcatgacaggatcaaattacataacaatattaaccttaaatataaatgggctaaatgctccaattaaaagacacagactggcaaattggataaagaggcaagatccatcagtgtgctgtattcaggaaacccatctcacgtgcagagacacacataggcttaaaataaagggatggaggaagatctaccaagcaaatggaaaacaaaaaaaggcaggggttgcaatcctagtctctgataaaacagactttaaaccaacaaagatcaaaagagacaaagaaggccagtacataatggaaaagggaacaattcaacaggaagagctaactatcctaaatatataggcgcccaatataggagcacccagattcataaagcaagtccttagagacctacaaagagacgtagactcccacacaataataatgggagactttaacaccccactgtcaatattagacagatcaacgagacaaaaagttaacaaggatatccaggaattgaattcagctctgcaccaagcagacctaatagacacctacagaactctccaccccaaatcaacagaatatacattcttttcagcaccacaccacacctattccaaaattgaccatatagtaggaaataaagcactcctcagcaaatgtaaaataacagaaattataacaaactgtctctcagaccacagtgcaatcaaactagaactcaggattaagaaactcactcagaaccactcaactacatggaaactgaacaaactgctcctgaacgactactgggtacataacgaaatgaaggcagaaataaagatgttctttgaaaccaatgagaacaaacacacaacataccagaatctctgggacacattcaaagcagtgggtagagagaaatttatagcactaaatgcccaggagagaagcaagactgatctaaaattgacaccctaacatcacaattaaaataactagagaagcaagagaaaacacattcaaaagctagcagaaggcaagaaataactacgatcagagcagaactgaagtagatagagacataaaaaaacccttcaaaaaatcaatgaacccaggagatggtttttcgaaaggatcaacaaaattgatagaccgctagcaagactaataaagaagaaaagagagaagaatcaaatagatgcaataaaaaatgataaaggggctatcatcaccaatcccacagaaatacaaactaccatcagagaatactataaacacctctacgaaaatgaactagaaaatctagaagaaatggataaattcctcaacacatacaccctcccaagactaaaccatgaagaagttgaatctctgaatagaccaataacaggctctgaaattgaggcaatgattaatagcttaccaaccaaaaaaaggccaacagcaaatggattcacagctgaattctatcagaggtacaagaggagatggtaccattccttctgaaactattccaatcaatagaaaaggagggaatcctccctaactcatatgatgaggccagcatcatcctgataccaaagcctggctgagacacaacaaaaaaagagaatcatagaccaatatccctgatgaacatcgatgcaaaaatcctcaataaaatactggcaaactgaatccagcagcatatcaaaaatcttatccatcatgatcaagggggcttcatccctgggatgcaaggctgattcaacatacgaaaatcaataaatgtagtccagcatataaacagaaccaaagacaaaaaccatatgattatctcaatagatgcagaaaaggcctttgacaaaattcaacaacacttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcgccactcctgttcaacatagtgttggaagttctggccagggcaattaggcaggagaaggaaataaaaggcattcaattaggaagagaggaagtcaaattatccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaaatacaaaccactgctcaacgaaataaaagagaatacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaagcatcacgctacctgacttcaaactatactacaaggctacagtaaccaaaacagcatggtactggtaccaaaacagagatacagaccaatggaacagaacagagccctcggaaataatgccacatatctacaacaatctgatctttgacaaacctgacaaaaacaagaaatggggaaaggattccctatttaataaatggtgctgggaaaactggctagccatatttagaaagctgaaaccggatccctctcttacactttatacaaaaattaattcaagatgattaaagacttaaatgttagacctaaaaccataaaaaccctagaaaaaaacctacgcaataccattcaggacataggcatgggcaaggacttcatgtctaaaacaccaaaagcaatgacaacaaaagacaaaattgacaaatgggatctaattaaactaaagagcttctgcacagcaaaagaaactaccttcagactgaacagtcaaacctacagaatgggagaagatttttgcaatctactcatctgacaaagggctaacatccggaatctacaattaactcaaacacatttacaagaaaaaaacaaacaaccccaacaaaaactgggcaaaggatatgaacagacacttctcaaaagaagacatttatgcagccaacagacacatgaaaaaatgctcatcatcactagccatcagagaaatgcaaatcaaaaccacaatgagataccatctcacaccagttagaatggccatcattaaaaagtcaggaaacaacaggtgctggagaggatgtggagaaataggaacacttttacactgttggtgggactgtaaactagttcaaccattgtggaagttagtgtggcgattcctcagggatctagaactagaaataccatttgacccagacatcccattactgggtatatacccaaaggattataaatcatgccgctataaagacacatgcgcacgtatgtttattgtggcactattcacaatagcaaagacttggaaccaacccaaatgtccaacaatgatagactggattaagaaaatgtggcacatatacaccatggaatactatgaagccataaaaaattatgagttcacgtccttcgtagggccatggatgaagctggaaaccatcattctcagcgaactatcgcaaggacaaaaaaaccaaacaccgcatgttctcactcataggtaggaactgaacaatgagaacacatggacacaggaaggggaacatcacacaccaggacctattgtggggtggggggaggggggagggatagcattaggagatatacctaatgttaaatgacgagttagtgggtgcagcacaccagcatggcacatgtatacatatgtaacaaatctgcacgttgtgcacatgtaccctaaaacttaaagtataataaaaaaaaaagatagtcttagataaaaacactaacataatttctcactagctgataacatttggctctgtatcaccaccaaactcctaaatgttagaggtggcatgtggattggaggtggttggatcatgagagcagtttctcataaatggtttagcaccatctccttgatgttgttctcatgatagtgagtgaattcccatgagatctagttgttgaaaattgtatatcatctccaccctctctctctctctcttgctcctgctcccaccatgtgagatgccttgctccccatttgccttttgccatgattggaaactttctgattcctctccagaaggagaagccgctatgcttcctgtactgcttgcataactgtaaaccaattagacctcttttctttgtaaattaaacagtctcaagtatttctttatagcaatgcaacaatagaccaatacactagcaaatcaaacctacaaaaaatactaaagggattccttccttcacagtgaaatgaaaggaccctatatattaatagtaacttgaatgccgaagaagaaatacagagcatcagcaaaaagaatgatataatatgaaaaaagtataaacctatttttgtttgtaacttttttcttctgatttaaaagataactacaaaaagcagtaagtataaatttacatttatgagcatacaatgcattaagatataattatataacaataagaagccaaataaggcagagaagaaagctatatagaaacaaatttttgtatactgttaaaacttaagttgctattaatttgaactgtattttatctgttaaggttaatcctcagagctaacagaagaaaataactcaaaaatagtaaaataaattttaaaaataatttaaatggtacactagactgtttctaatagtatgatagtagtgaagaaatagagaaacaaaagacataagatatacagaacacaaataataaaatgacgagatataaattctacttcatcattcattaaattaaatgtaaatggattaagcactccaattaaaaggcataaatggaaaaatggattaaaaacatgacccaacacttcagattcaaagacagaagcagagctcaagtaaaaaatgcaaagagaatatatcacacaaacacccaaaagagactataatgggtatacagtagttctcctttatctgattgtttcacgttccatagtttacctatggtcaaccatggtccaaaaaaagatgagaacagtacactaagctattttgagacagagagagataccacaatcacacaacttttattatattattacaattattctattttattattagttattgttcttaatctcttactgtgacaaatgtaagggttaaattttcttgtaagtctatatgtataagagaaaaacatagtatatatagtgttcagaattatccaaggttggaggcatccactgaaggtcttcaaacatatccccaacagataagagaagaccactctattaatatcagacaaaacagactttaagacaaaatatattactagaaaaaaaggacatttatgatgtcaatccatcaggaaaatacaataaatattataaatggtcaatccatcaggaaaatacaataaataaaaatatatgcccatatcaagaaagtcccaaaatatatcacacaaaaactgtcagaactgaaaagatagaaaatttaacaataattgagacttcaatatgttgcctataataattgacagaagcaaaaaaaatcaaaagaaaaatagaagacagaaacaacaaaaaaacccaactagacttaacagaaaactacagaacactgtaccccaaaacaggagaacacacaatcagttcagatgaacacaaaacattctccaggacagaccagaaattatgcataattaaatcttagtaaatttcaaagttttgaaataatacacctcagacatagtcatccagtatcacccaagaagctattaatttgttcattcaattaattatttaattttattagacacacagtttattcatcagtatagcctcagcgtctctgcttgtatgccatcaacacttccagaagaatgcattcctgaacactgtgctcattagacaagtattattttacattatttaattacgttgaactgaattttgcctctacacattggcatgaattacgctttctgaattcattacagataaagtagaaagattttactactgcttccacatgataaaactctaaatatttaatgataaccatcatattcatatctccaactccttcaactactcaacaaatgttttgttctcatacatcctcttctgcataagtggtctactttatcaatgtctggtgccaaaaactacacttattgtagatctgaacaacatagtatcctgatccttggtttacaaaggtttccatgaatggctttttacatccctatgtgataggtcttttatttttatatttagaattcacttcaatctcccaagtagcaccatgacattgtgtgggaaggcaggtaaaagaatcagatctttgatgatgtgctaagacgaattttgaatattttgaactgtaacttgtctaggtaagccaatggctaatacaatccttatatatcttatagataaaagaaaatcaattcttactagatcctttggactagaaacatacttgattctaaaccaagccagttataaggaagtgatatatttccaaagactctcctagctccaacaattaattgtctgtagctgagattgtaaaagttgtgtaatatattgatgataaaccaaaggatatgttagagaaacattatctatgagtttatcatgcccataagatacttacaagtaggagcaagcacaatcccctgataaaagataacaagaaaacatttctaaagtgaaaaaatactctgctcacatatctcacaaatgtagaaaacaggtcagctattgacatggctgacgcaaaaacctagcatctttgagttagtcaaacccactttatgcacacccttgacagaattattcaaggccttgatgattcaggaataaattaatatgatattttattttcaccttcatatcaaggacttttgctttattccttttccacaaactcctctaaataaaagtacatcagaactgagttctatgactgtcctttgctcattgttgactcagctttgcaagtagcatacctaaatctccaggacttattacagccctacctccacgaaattttctcagcaacatagcgtagtgaaaatagaagcaaaatttcctgacattacctattaatgttttatgactgtgggataaatataacataagaaattctgatgaacaaagagataatagtgcctaatcccacaagagcaattgtgagaatcttctgagattacaggttaaaactatttaataatgttgacttttttcctttcttaagtttttcctaacccaaaatgatcaactgtatttaatagcatttgatctctaaactaatatttgtcaactaatcagagatcttctaaaatttttcatctctttgtccttagattattttgctctaattttattacttaatttttttacaagatgaagtcttgtcttcccaactaaattggaaacttactgaggatggagatatcgactgatctatcgacatatctttcacagttcctagaaggcaggcaaatgtttactatcatttgatgcaaatacatttcaaaaactattcaatttgacacaataaatttattttttatctacaaaatgtttaataacaaactgtatttgacagggttatccaaagaaacagaaccaataaaaggagtgtgtgtgtttgtgtgtgtgtgtgtgtgtgtgtgtgtgtgcatgcagacaaagaaagatttatttactttttacttttttaattatactttaagttttgggatacatgtgcggaatgtgcagaacgtgcaagtttgttacataggtatacatgtcccaccgtggtttgctgcacccatcaaaccgtcatctacattaggtatttctcctaatgctatccctccccttgcgccccaccccctgacaggctccggtgtgtgatgttcccctccctgtgcccatatgttctcgttgttcacctcccacttatgagtgagaacatgtggtgtttggttttctgttcctgtgttagtttgctgagaataatggtttccagcttcatccatgtcccttcaaaggacatgaactcattcttttttatggctgcatagtattccatgatgtatatgtgccacattttctttatccagtcatcattgatgggcattttggttggttccaaaccttagctattgtgaataccactacaataaacatgcatgtgcatgtggctttattatagaatgatttataatactttgggtatatacccagtaatgggatggctgggtcaaatggtatttctggttccagatccttgaggaatcgccacacagtcttccacaatggttgaactaatttacactcccaatagtgtaaaagcattcctacttctccacatcctctccagcatctgttgtttcctgactttttaatgatcaccattatgactggtgtgagatggtatttcattgtggttttaatttacatttctctaataccatcgatgatgagctttttttcacatgtttgttggctgcataaatgtcttcttttgagaagtgtccgttcatatccttcacccacattttgatggggctgtttgtttttttcttgtaaatgtgtttaggttccttgtagattctggatattagccctttgtcagatggatagattgcaaaaattttctcccattctataggttgtctgttcgttctaatgatagtttcttttgctgtgcagaagctctttagtttaattagatcccatttatcaattttggcttttgttgcaattgtttttgatgttttagtaatgaagtctttgcccatgcctatgtcctgaatggtattgcctaggttttcttctagggtttttatggttttaggtcttacgtttaagtcttttaatctatctggagttaatttttgtataacatgtaaggaaggggtccagtttcgttttctgcatatggctagccagtttttgcaacacagttttaaatagggaatcctttccccattgcttgttttcgtcaggtttgtcaaagatcagatggttgtagatgtgtggtgttatttctgaggcctctgttctgtcccattggtctacatatctgttttggtaccagtactgttgcaatagaagaaaaacaaataaaaggcataaagattaggaaagaggaaataatactaaaactttccttattaacagattatagtgctatttacatagatttttctatgtaaagaatagtaaattgacaaattaactacttgagccaacaaataaatttagcaaagtcacagatacaaagtgaatatatgaaaataactgcagtagcaacaagcaatggcactatcatcaaaaaattagaaataagattttaagaattccattcacggttatatcaaaaaaacacaggatacctagaaataaatctaacaagagatgtccaagtcttctacattaaaaactacaaaatgttgagagaatttgaagaatactttaaaatggtagttctccccaatgtgtgtatgtagagtcaatggaaacacaatcaaattctggaagccttttcgtagacattgattatctcattctacatcgtatatgaaaatgtaatagaatgtcatcaaagcaattttagtgaaaactgttataaatgtagtaatcaagacagtttggtatttcaaaatgacagacctatacatgtatgtatgaaacagaataaagagtacagaaatggacccacatcaatttaacaaagatgacaaggcaattcaatgagaaaataagtctttttaataagtaatgctcaaaataaacattaatccttactgaaaaccatatacaaaaattacctcaagatggatcatatacccaaatgtaaaatccaaaatcataacatgtgtagaagaaaatatacaagagcggtattacctaggttttcttctaggctttttatggttttaggtcttaaatttaaatctttaatcatcttgagttaatttttgtataaggtgtagggaagggggtccagtttcagttttctgcatatggctagccagttttcccaaaaccatttattaaataatcatttctccattgcttgattttgtcaggtttgtcaaagatcagatggttttagatgtgtggtgttatttctgaggcttctgttctgtcccattggtctatatatctgttttggtacctgtaccacgctgtttgggttactgtagtcttgcagtatagtctgaagtcaggtagtgtgatgcctccagcattgttctattttcttagtatcttcttggctatacaggcttcttttggttccatatgaaatttaaagtagttttctaattctgtgaagaaagtcaatggtaacttgatgggaatggcattgaatctataaattactttgggcagtacggccattttcacaatattgattcttcctatccatgagcatggaatgtttttccatttgtttgtgtcctctcttagttccttgaggagtggtttgtagttctacttgaacaagttcttcatatcccttgaagttttattcctaggtattttattctctttgtagtaattgtgattgagagttcactcatgagttggctctctgtttgtctattatttgtgtatacaaatgatgcgatttttgcacattgattttgtatccttagactttgctgaagttgcttatcagcttaaggagtttttgggctgagatgatggagttttctaaatatacaatcatgtcatctgcaaacagagataatttgacttcctctcttcctatttgaataacctttatttctttcacttgtgtgattgctctggccagaaattccaatactatgtcgaataggaatggtgagagagggcatccttgtactggtgttcaaagataatgcttccagaatttgcccattcagtatgatattggctgtgggtttgtcataaatagctcttattattttgagatacattccatcaatacctagtttattgggtgtttttagtatgaaggggtgttgaattttatcaaaggacttttctgcatctattgatataattgtggtttttgacattggttctgtttatgtcatgaattacgtttactgatttaagtatgttgaaccagccttgcatcccagggatgaagccgacttgatcgtggtggataagctttttaatgtgctgctggatttggtttgccagaattttattgaggattttcgcatagagattcatcaggaatattggtctgaaattttcttttgtgttggatctctaccaggttttagtatcagaatgatgctggcctcaaaaaatgaattagggaggagtacctcttgttctgttgcttagaatagttttagaaggaatggcacccgctcctctttgtacctctggtagaattcggctgtgaatccgtctggtcctaggcttttcttggttggtaggctattaattactgcctcaatttcagaaattattggtctattcagggtttcaaatgattcctggtttagtcttaggtgatgtatgtgtccaggaatttatccatttcttctagattttctggtttattttgcatagagatttttagagtattctctgatggtagcttgtatttcagtgggatcagtggtgatatcccctttatcactttttggcatttatttgattcttctctcttttcttttttttttttagtctggcttgtggtctattttattaatcttttcaaaaaaccagctcctggattcactgattttttgaagggtttttcgtgtctctatccccttcagttctgctctgatctcagttatttcttgtcttatgctagcttttgaatttgtttgctcttgattctctagttcttttaattgtgatgttagcgtgtcaattttagatctttcctgctttctcatgagggcatttagtgctataaatttccctcttaacactgctttagctgtgtcccagagattctggtacattgtctctttgttcttactggtttcaaataacttacttatttctgccttaatttcgttatttacccagtaggcattcaggagcaggttgttcagtttccatgtagttgtgcggttttgagtgagtttcttaatcctgagttccaatttgattgcactgtggtctgagagactgtttcttatgatttcttttgcatatactgaggagtctgttactcctagttatgtgaacagttctagaataagtgctatgtggtcctgagaagaatgtatattctgttgacttggggtggagagttctgtagacgtctattgggtccacctggttcagagctgagttcaagtcttgaatatccttgttaattttctgtccccatctgtctgatattgacagtggggtgttaaagtctctcactattattgtgtggtagtctaagtctctctgtaggtctcaaaaaacttgctttaagaatctgggtcctcctctattctgtgcatatatatatttaggatagttagcccttcttgttgcattgatccctttaccattatgtaatgcccttctttgtctcttttgatctttgttggcttaaagtctgttttatctgagactaggattgcaacccctgcttttctggctttccatttgcttggtaaatcttcccacatccctttattttgagcctatgtgtgtctttgcacatgagatgggtctcctcaatacagcataccaatgggtcttgaccctttatccaatttgccagtctgtgtctgttaattggggcatttagcccatttacatttaagattaatatagttatgtgtgaattggatcctgtcatatgatgctagctggttactttgcccattacttgatgcagtttcttcatagtgtcaatgatctttacattttggtatggttttgcactggctggtactggtttatgctttccatatttagtgcttccttcaggagctcttgcacgggcaaggctgatggtgacaaaatccttcagcatttgcttgtctgtgaaggattttatttctcctttgcctatgaagcttagattggctaaatgtgaaattctgggttgaaaattcttttctttgagaatgttgaatattggaccccactcttttctgacttacagggtttctgcagaggatcccctgttagtctgatgggcttccctttgcgggtaatctgacctttccctctggctgcccttaacattttttccttcatttcaaccttggtggatctgacaattatgtgtcttggggttgctattctcaaggaatatctctgtggtgttgtctgtattcccagaatttgaatgttggcctgttttgctaggttggggaatttctcctggataatatcctgaacagtgtttcccaacttggttccattctgcccctcactttcaggtatgccaatcaaatgtaggtctggtcttttcacatagttccatatttcttggaggccttgttcattccttttcattcttttttctctaatcttgtcttcacgctttatttcattaagttgatcttcagtctctgatatcctttcttccacttcatcgattcagctattgatactcatgtatgcttcatgaagctatcgtcctgtgtttttcagctccatcaggtcatttatgttcttctctaaactggttattctagttagcagttcctgtaacattttatcaagattcttagcttccttgcattgggttagaacatgctcctttagctcagaggattttgttattacccacattctgaagcctacttctgtcaattcatcaaacttaccctctgtacggttttgttctcttgctggcgaggagttgtgatcctttggaggagaagaggcattctgttttttggaattttcagcctttttacacgggtttttcctcatcttcatgatttatctacctttggtctttgatgttggtgaccttcggatggggtttttgcatgggtgttcttttttttttttatttttttatttttaatgttttttttttattattatactctaagttttagggtacatgtgcacattgtgcaggttagttacatatgtatacatgtgcatgggtgttctttttgttaatgttgatgccattgctttctgtttgttagttttccttctaatagtagggcctttcttctgcaagtctgctggattttgctgtaagtccactccaggccctgtttgcctggatgtcaccagtgcagcctgtgcaacagcaaagattgctgcctgctccttcctctggaaactttgtcccagaggggcacccaacagatgccagctggagctctcctgtatgaagtgtctgtcaacccctgctgggaggtgtctctcattcagaaggtacaggggtcaggaacccacttgaggaagcagcctgtcccttagcagagctcaagcactgtgctgggaaatccactgctctcttcagagccattagcaggaacatttaagtctgctgaagcttgcccatggatttattttaagaaatcggttaaaacaatcatggaggacagcaaatccaaaatctgcaggttgggctgtcagactgaagatccagggaagagttaatgttgccccttgaatctgaaggatgaccacaggcagaatttcctcttctttggggaagtcaatctttttgcttttatgatgtttaactatttgaataagccccacaccatactgtagatggtaatctgctttactccaagcctaataattttaatgtgaattttacctaaaaataccatcacagtagcatctagactaaggtttaaacaaatgcctgggtaccagggcctagccaagttgagacataaaattaaccatcacatcaacccttaagatcagtgttatctcctctaatggtcatattattgccatcagccaagataacagaagagtagtctgtttttcattttttaaattattcctcataccatgcactcctaattaagaatatgatctggtaagaattagaaggaaccttaaggtttattccactttaaagaaaaaaaaatcaataatgcccaaatgagaagtgacttgctccaagctatactgtgttaagccagagttggagtcagttctagttctttgactttaatccttcagctgccacacacaaacatgagcctctgtttatgctccaaccttatttgaatgttggcattaatcttacaaaatactaaactaactctaatggattcatattaaaacttcctgatctcttagtttttcttaaataatcattatttccccaaacatagctattcttgagcacacacacacaaaaaatctccatctctcaatgtaggaaaatcctcctggaatccatcatattgtgaaatttaacaaggaatcttagaggcagcagcatgaattaacccaatgataattttatctaactagtcaaaaataaaagaaaacctgtatcactctccagccctgccacgctgcttttaggcaacacttcatcacttatcacctaattgttgccaccaatctatcacccatatttgtgccagagtgatctttctaaaatgcaaacttaactatgtcactcacctcttcaaatccttattcaatggctcagttagaatatgacccaatgtccctgttatctggctcctttatttctagctttgtctcccacaatacattcaatatttccccatgttccagactcacgccaaaatttacttacgtccaaacattttatactagtgtttctcaatcttttatactcagtactcttcaaatttatttgaaattataaattaaaaaaatttttttgaaatatcaatataattgcctgttatatggcttttaaataagatattttgacttctgatgtacacaggtcagcaccctcataatttacatgtcccctccaaatatatagtaattatagatataaccacgcagatataccaggttttagaggacagatgagcatctctgtgaaccaaaagttaaaagagaaaaaaaagtcaagaataagtagaaaaaaaaagccctgagcctagtgggctccagattgaaaatcaggccacagtaaccaggagttttgctcttaaaggaaaaaagtactaaaattgctccacaatagatttgagactaaagtcaggcctctggttgaagacagattctaagatgccttttaataacatgaaagaatgctaaataaaatgactgatacttactactataggtagcagtagaagacttatacagtttggctatatccccacccaaatcccatcttgaattgtagttcccataatccccacatgttgtgggatggaccaggtgggcggtaattgaatcatggagggagtttacccccatgctgctgttctcacgatagtgagtaagttctcacaaaatctgatggttttataaggggcttttctctctttgcttggcacttctccttcttgccatcatgtgaagaaggatatgtttgcttccccttccaccatgattgtaagtttcctgaggcctccccagccatgcagaattgtaaatcaattaaacctctttcctttataaattacccagtcttgggcagttctttatagcagctgagaacaaacaaatacggtaaagtgggacatgagatttggtaggggccagggacagaatgatatggattggctgtgttcccacccaaagcctaatcttgaattgtaatctgaatgataatccccaagtgttggtgaaggaacctcatgggaggtgattagatcatgggggcagttccctcatgctgttctcatgatagtgagtgagctctcatgagatctgatggttttataaaaggcttttctccccttcactctcacttctctctcctgctatcatgtgaagaagaatgtgtttgcttccccttctgccatgattgtatattttttgaggcttcccagccatgcaaaactgagagtcaattaaacctgtttcctttataaattacccagcctcatgtatgtcagtatagcagtgtaaaaatgaactaatacagtaaattggtactgcagagagtggggtactgctataattgaaatgtgcatgtgactttagaattgggttacaggcagacattggaacagtttggagggctcaaaagaagacagaaaagcgtgggaaagtttggatcttcctagagacttgtagggctcagaagacagtaagaagtgggaaagtttggaacttcctagagacttgttgaatggtttcaaccaaaaggctgatagtgatatggacaatgaagtccaggttgaggtggtctcagatgcagatgaggaccttcttgagaaatggagcaaaggtgactcttactatgctttagcaaagacactgggagcattttgcccttgtcctagagatctgtggaactttgaactcaactgagttgatttagggtgtctggcagaagaaatttctaagcagcaaagtattcaagaggaagaagagcatgaaagtttggaaaatttgcagactgacaatgcaatagaaaagaaaaatccattttctggggaaaaattcaagcagtctgcagaaatctgtataagtaaagaggagctgaatgttaattgataagactatggggaaaacgtctccagggcatgtcagagaccttcacagcatcccctccctgtaggcctgggaggaaaaaatggtttcattggccaggcccagggcaatccccagctctgtacagcctcaggacatggtgccctgcatcccagctgcttcagttccagctgtggctaaaaggggccaaggtacagctctggctatggcttcaaaaggtgcaagccccaagccttggcaacttccacatgatgttagtcctgcgggtgcacagaagtcaagaactgagcattggaacctcttcctaggtttcagaggatgtatggaaacacctggatgtccaggcagaacttttgctgtgggtagggagagctctcatggagaacctcttgctagggcaatgcagaaggtaaatgtgggtttggagcacccacacagggtcctcactgggggtgctacctagtgtagatataagaagatggccaccatcctctagaccccagaatggtagatccaccaagagcttataccgtatgcttggaaaacctgcaggcactcaatgccagcctatgaaggaactgcccagggtcatgggaggccacctcttgcaacagcatgcctcacatgtgacatacagagtcaaaggatatcatttgggagctttaagatttaatgactgccctgctggatttcagacttgcatggggcctgtaacccccttgttttggctaatttctcccatttggaatgagaacatttacccaatgcccataacccaatcatatcttagctgtaactagctttttttttttttaacaggctcatagatggaaggggcttctctcagataaaactttggccttggacttttgagttaatgctggaatgacttaggactttaggggactgttgggaaggcaaaattttgttttgaaatgtgagggcatgagattttggaggggccagaggcacaatgatatggttggttctgtgtccccacccaaatctcatctggaattgtaatctgaactgtaatccccaggtgtcaagggagggtcctggtgagaggtgattggatcatgggggcagttttccccaagctgatcttgtaatagtgattgaattctcaggagatctaatggttttataaatagcagtttccccttttctctctcttgcctgcctccatgtaagacatgcctgcttccccttctgctatgactgatcccaagccaggcagatctgtgagtctacctcttttctttataaattacccagtctcaggcaattcttcacagtagtgtgaaaacagactaaatacactctgatatgtgataaaaaatggctctttacctctctgtagttttcttcactaaaaccagtagcccctgtataatcacaggaaaacatctgaaaagtccaaagtaagagacattctaaaatatacctagacagcactcctcaaaattattaaggtcatcaaaaataaaagtctgagaaattctcagtctagaactgcctaaggggaaacaatgacaaaacagaacctggtatcctgcataagaccctgagacagaaaatgtccattacaaaaaactaagcatatctgggtaatgtatggacttcagctagttgataattaagtatcaatattggttcattatttacagcaaatgtacaatagtatgtaaaacattaactataggagaaattgggagtaggtatacataaaatttatgtagtatctttgcagtttctccgtgaatataaaactattctatggtggaaacaacccaaatgtccattaacagatgaacggataaacaaaatgaggtatatccaaacaatggacgatgattcagccataaacacaaagtgagatactgatacatgctacaacataaataaatctcaaaacagtcaggctgagtgaaagaagccaggtataaaattctcatattgtattccatttatgtgagatatcaaggctagataaatccataatgacaggaaggaaatcaagtgattgccaaaggctggggtaaataagacatggaaagtgacttcttaatgagtacaggagttttatgggggttgtgaaaatattttggaactagatagagatgatggtaatataacattgccaatgtacaaaatgccaccaaatcatctgctttaaaatggttaatttttttgaaaattgttcgtatcctttgccactttttgatggggttgttttttccttgtaaatttgtttaagttccttgtaaattctggatattagacctttatcagatgggtagattgcaaaaatttcgtcccattctttaggttgcctgttcactctgatgatagtttcttttgctgtgcataagatctttagtttaattagatgccatttgtaaattctggcatttgttgtaattgctcttggcatttttgtcatgaagtctttgcccatgcctatgtcctgaatggtattatgcggccaacacatgtatgaaaaaaagctcaacattactgatcatcagagaaatgcaaatcaaaaccacaatgagataccatctcaacaccagtcataatggcaattattaaaaagtcaggaaacaatagatgctggcaagcctatggagaaataggaacactcttacattgttggtggaaatgtaaattagttcaaccactgtggaagacagtgtggcaattccttaaggatctagaaccagaaataccacttgacccaggaatcccattactgggtatatacccaaagaaacataaatcattctaccataaagacacatacacaagtatgtttattgcagcactatttacaatagaaaagacatagaaccaacccaaatgcccatcattgatagaatggataaagaaaatgtgatacatacacaccatcaaatactatgcaaccataaaaaggatgagatcatgtcctttgcagagacatggatgaagctggaagacatcatcctcagcaaatcaacacagaaacagaaaaccaaatatcacatgttttccctcataagtgggacttgaacaatgagaacacatggactcagagaggggaacaacatgcaccagggcctgttggggggtgggggtaatgggagggaacttagaggatgggtcaataggtgcagcaaaccaccatggcaaacgtatacctatgtaacaaacctgcatgttctgcacatgcatcccgttttttttttttttaagaaaaaattctaaaaaatggttaattttctgttactgaattttactttaattaaaaaatgtatgaacaaaagaatctgaaattgttttcaagagtttattttaaaaagaaggctatcatactttcttatctattgtaaaaataaatataaatattactttattgtaaaactcttaatctattataagagattcaatcttaaaaatcacagaatatatacaaagctatcatggtagcaaaaggtcaatgtagtcagagcatcggaaaaggactctgtgaaatgagctctaatccaacacattaaggaactgtattacatacagccctggctctggccaccacctagctttgagaccttcgttagtctcttccctttttggcatcccaaattcttcttctttacctctttttgttcctttcttaaattgacacattgtaattgtagatatttatgcaatacaaatcaatgttctgataaatatatgttgcataatgttcaaatcggggttatttagtatatccatcaccaaacatctatgatttctttgtgataagagcattcaaaaaacctctcttatagctttttaaaaatatataatgctttactgttaaccatcatcaccttactatattgtgaaatactagagcttattcctcctacttaattgcaactttgtgcctgttgaccaatgtctccccattctccccttctctcaccctttcccagtctctggtgcccattgttctactctctatttctataatagttttttaaggctaaatagtattctattgtgtatatataccatattttatttatccactcatctattattgcatacttgggtcaatcccacaccttggttattgtaaatactgctacaataatcacatgactgcaaatgttgctttgacataccaatttcatctcctttggatatgaacccagtagtgggattcctgggtcatatggcatttctatttttaattttttgagaaatttccatgcagatttacatagtggctgtattaatttccaatcccatgaatagtgtgtaagtgttcccttttctccacatcctcactagcacttgttttgtctttttgatgacagtctttctaactggagtaaggtggtacctcagtataattttgatttgcattttcctaatgattagtgatgctgaatattttttcatgtacctgttggccatttgtatgtctgttttagagaaatgtctattaaggttttcttctcaattttcttcttttttttttttttttgagacggagtcttgctctgtcgcccaggctggagtgcagtgccgcgatcttggctcactgaaagctccgtcttccgggttcactccattctcctgcctcagcctcctgagtagctgggactacaggcgcctgccaccatgcccagctaattttttgtatttttagtagagacggcgtttcaccatgttggccaggatggtctcaatctcctgacctcgtgctctgcccgccttggcctcccaaagtgttgggattacaggcgtgagccactgcacccggccgtgttgctcaattttcttatccagttatttgtttttcattgttgagttgtttaaattctttatatagtctgtttattaaatccttctcccatgcaaatgttttctcccattctgtaagttatcttttcactttgttaactgcttccctctctgagcaagcttttcagttagatataatccccatttgtctatttttgcttttgttttctgtactttcgaggccttatttaaaaaatccttgcccagcccagcgtcataaagtatttctcctgttttcttctagtactttcatattatagtttcaagttttatatttaagtttttaatccattttgatttgatgttttgtatatgatgagagttaggagtctactcacattcttctgcatatagttatctaattttccctgctccatagattgtcttttcccaatgtgtgttcctggcacctttgtcaaaaatcagttggttataggagtgtgtaatttatttctagactcttgcttctgttccactggttgatgtcagattttatgccagtcccatgctgtgttagttactacagccttgcagtgtattttaaagtcaggtagtgtgattcccccagctttgttctctctgctcaggactacttcactgtccaaggtactgtgcctttccatataaattttaagattatttttttcacttgttccagtctaagatggctgagaagcagctagtgtgtgcatctctcacgtagaggaaacaaaacggtgagcaaatactagttcttcaagatgatggtctaagagattacattgggattcactaagaaagtgatggaacacatggaaaacagagaagagtgaagctgggcagccacccacctgggactagcatggagccaggggaagctccataatgtaaggcaacagtgagtaagtgaaagtccctagataatccacacttctgcaatgaatctttgcaattctgggcacaggataacctccctgactcccccagggcctccagatggacacagagctgcctggtgtctttctagggacaccactcaattccacacggaacccgtcaggccatggatacctgagcagactagcatcagttgctgtagccccaacaagggaggacaggctcttttgcacatccctaggatagaggccacagcagcagtcctgaggagtggccagactataccacatgagacccccatgcccctgctacttcttgtcatgcaaggcttgctggcttgggctcccagtgcagcagccctgttcccacctggccagcgcaggcagtcacagttctgtgttcctctggaaagcagccatacttcacgctgcgcaaccccctacatctgctgctcctcacagcacaaggcttgggctcccagcacagcagccccacacctacctgaacactgtggtaagtcacaacacgcattcctctggagcaaaattcccagaggcaacagacaaggctgggcacctttacatgcccacaacagcaaaatccagcatcgcctgggtgggagggaagtgtaagcatgccatgtaccccacagccaccagtctccactgccccagttgcccctagccctcccgaatgaaaggttcacagcacagccacaccgcttatgcctaaacacagaggccttctgaaaaccaaacccccacaggcctatgatagtcccttgggttccaatcacataaacattctgcttgctctcacctgagagatctgccagtgagcatagaacaaggccaccctcctgatcacagccagcacctcaactttgggctggcctgaccacagtccagtcctttaggattcatatatgctgtccatcaggacgtctaggggcctgggaactggaggactgtctaccctattccaactcttctagcacctgaccatttcctcaagggcttgtggtcaggccaacctaactagtcgacactaccaacaccaacatctactcacacaggcctaaaaatgaaactactctctttatgagaaacagcaatattgccacatcagagaacagaggatccataaagttatctaattcaggctgagtgttgaggttatgcccttaaaccactcccatggagagtcgcaaaaataggtgtttcctgtggctctcaactacactgtggtccagagacagactaatgcagtacgtatctgaactaggagtcagagccatggaacagaggtgtgataggaaaacagatcaagtttgagcctatataggatgcagagcaagtgcagcccacacattcccctacaaatacctcaacacacttcagcaggagctcctcccagtcgcccttctcaggactagtgcctgtgctcaccatcagggtatttgtgggtaacccagaggctccagcattgcccagctgtgtccctccaccccccatggaacaggaagctcagagctccagccattccaaggctcggcccttcacctgaaacaacagagtacactccacagtaaacaaagatcagtacaaacccccctgcttgttccacagatggctctttcccacaagtgccatctactggcatgtaggtcaaaccacatggctcaatacaaaacctgccaacagaagttcacagggctatacaagcaaagccaaaagaccctactcaacatactctacggtcacactcctagggaggaggaaaagaaaaagaaaaatatatatacacatatgcagaaagtgaaaaaatcctattcacaaaaaaataattacaataattagaattgctaacctctccagttaaggaaccaccataagaattctagcaccatgaaaaatctcaatgctgtgacaccaccaaaagatgacactagctctccagaaatggtctctaaccaaaatgcaaactaataaatgacatataaagaattcaaaacatggattacaaagaagctaagcaagatccaaaacaatgctgaaaacacaaaaaagctttgaaagcaatccagaaaatgaaggaagagaaaaatatcttgaaaaatcaatcagaacaatggaaattgaaaaactcacttcaagaatttcaaaatacaattgaaagctttatcaatagatgagatcaagcagaagaaagaatttcaaaaattgaagcccagtcttttaaaccaacccagagaaaaataatgaaaaaaaatgttttaaatgaaaagaatctttgagaaatatggaattatgtaaagtgatgaaatctatgaattattggcattcctgagggagaaggagaaaaattaaacaacttggaaaacatatttcagagaataattcaagaaaatgtccctaatcttgctacagaggtagccggataaaaactaatccagagtacatctgccaaatgctttacaaaatgaacactgtcaaagaatattttcaccagactgactgtcccaaggtcaacactaaagcaaaaatcttaaaggcagctatgcaaaaaggtgagaacacatataaaagaaaccccttcagctaacagtggacatctcatcagaaaccttacaagccagaagagattaggggcctattttcagcatttttaagagaagaaattccaactaagaatttcatatcctgccaaactaagcttataagtgaaggagaaataaaaatttttatagatgagaaatcactaagggaattcattaccactagacaagccttacaagagaacctaaagggagttctaaacctggaaagaaaacatctgctaacacaaaatcatgcttaagtacatagctaacaacccctataaagcaactactcaatacaaacaaaacaaccagctaacaacttcacaataggatcaaaacctcacatgtcaatattaccttgaatgaaaatggtctgaatgcccccacttaaaaggcacagagtggcaagctggattaaaaaaaaaaaaggacccttccatccactatcttcaagaaacctagctcacacataacaacacacataggctctaagtaaatgactggagaaagctatatcatgcaaatagaaaacataaaagaacagaggtcaggtcaatgttcttatatcaaataaaatagactttaaactaaaaatagtaaaacaaatcaaaacaaaaaaggacaaaaaaggcactatgtaatttaaaagggttcaattcaacaagaagactgaactatcctaaatttagaatgtacacaatattatagcacccagattcataaaacaagtacttctagatctctgaaaagtattagacagccaaaccagaacagtgggaaacttcaacaccccactgagagtactaaaatgcagatgatcaaagaagaaaactagcaaagacattctgcacataaatttaacacttcaccaactggacatagtagacaactacacaacattctgccaatcaaccaaagaatatacatccttcttatctgaacactgaatatactctaagatcaaccacatacttgggcataaaacaagtctcaataaattaaaaaaaaataaaagtcatatcaaccatacttttgggccacagtggaataaaaatagaaatcaataccaagacgatctctcagaaccacataattacatgaaaattaaacaacttgatcctgaaagaccttagggcgaacaatgaaattaaggcagaaataaaaaaaattatgtgaaatagatgaaaagagagaaagaacatataaaatttctgaaatgtggtgaaagcagtgttaagaggaatatttatagcaataaacacctacatcaagaagttagataagtcacaaatgaacaatctaacattgcatctagagtataaaatgaaaagaagaaacaaccacaacataagcggaaaaaaaaagaagtaaaatcacagcagagttgaatttcattaagaccccaaaatctatacaaatgatcaacaaaaccaaaagctgtttctttgaaatgataaatgaaatcaatagaacactagctagactaacaaagaaagaagacaaaaagagcacaatcagaaatgacaaaggtgacattacaactgatcccaaagaaattaaaaaaagaccctcagatactattataaacatctctatgcaaacaaacaagacaatcatctataagaaattgatgaattcctgggagcacacaatctccaaagactgaatcacgaagaaattgaaaccctgaaaagacaaatatcaagttcgaaaattgaatcagttgcatgtgtaccctagaacttaaagtataatttaaaaaaaaaaaaggatctcaaagaaaaaaaacaaaacaaaacaaaaaaaccctgtcaaccaaaatgagccctagacctgatggattcacagccgaattttaccagatgtccaaagaagagctggtaccaatcctcctgaaattattccaaaaaattgaggaggagggtctcatctctatctcattctacaaagccaggattactgtgacaccaaaatctgtcaaagacacaatgaaaacaagaaaactgcaggttaatatgcatgatgaacatagacacaaaaatcctcaaaaaaaaattaacaaactgaatccagctgcacatcaaaatgttaattgaccatgttcaagtaggctttattcctgggatgcagggttggatcaacatatccaaatcaataaatgtgattcgccacataaacagaattaaaaacaaaaatcatgtgatcatctcaactgacacagaaaatgcttttgatagaaacccatatctttttatgttaaaaatactcaacaaactagacatcaaaagagcacacatccaaatgataagagccatctatgacaaacccatagccagtatcatagtgaacaaggaaaatctggaacaattccccttgagaaccagaatgcgacaaggatgaccactctcaacactcctattcaacatattaccggaagtcctagccagagcaatcaggcaagagaaagaaacaaaggcattcaaatagaaaaaaaagtcaaaatatttctcttcactgctaatgtaattctatgcctagaaaaccctagattccaccaaaaggcttctagaacttaaaaggaatatcagtagttttaggatataaaataaatatacaaaaatcaggacttttttttttttgagatggagtctcactctgtcgccaggctggagtgcagtggcgcgatcttggctcactgcaacctccgcctcctgggttcaagcgattatcttgcctcagcctcccaagtagctgggattacaggcatatgccaccacatccagctaatctttgtatttttagtagagacagggtttcaccatgttggccaggatggtctcgatcttgtgacctcgtgatctgcccacctcggcctcccaaagtggtgggattacaggcatgagccaccacacccagccaaaaatcaggaccatttctatatgttcaagccaagagccaaataaataacacaatctcatttgtaatagccacacacacacacacacacacatacacaaacaaacacctaggaatacatttaaccaagatggtgaaatatctctgaacactgctgaaataaatcatagatgacacaaacaaatggaactatattccatgctcaggtattgtaagaatcaaaatctctaaaatggccataatgcccaaagcaaattaaaaatccaatgctattcttatcaaactaccaatgttatttgtcacaaaattagaaaaaagtactctaaaattcatatggatccaaaaaagcgcctgaatagccaagcaattctaagcagaaaaagaaagagccagggcagaacattacctgacttcaaactacactacagggctgcagtaaccaaaatagcatggtaatggtagaaacacagacacatagaccaatggaacagaatagagaacccagaaataaagctgcacacctacaatcatctaatctttgaaaaagccaacaaaaacgatggggacaggactccctattcaataaatggtggtgggataactggctatccatatgcagatgaatgaaactgatccctacctatcaagttatacaaaaattaactcaatatggattaaagatttaaacgtaagacctcaaactataaaaattctaatagaagaaaacctaagaaataccattcagaacattggtcttggcaaagaattcatgactaattcatcaaaagcaattgcaacaaaaaacaaaaattgacaagtgggacctaattaaactaaagagcttatgcacaccagaaaaataaaactatcaacagagtaaacagacaatctacaggatgaaagaaaatatttcggctgggcgcggtgactcacgcctgtaatcccagcactttaggaggctggggcggatcacgaggtcaggagatcaagaccatcctggctaacatggtgaaaccccatctgtatggccgttatcgtgatgaggtacataccttctatacctaatttgttgagagttttgattatgaagcgatgtagaattttctcaaatgctttttctgaatctattgaaataatgatatgattttatctttattttgttgatgtggtatatcacatttattgatttgcatatgttgaaccatcttgtatcccagggatgattcccactttattgtagcagatgatgttttttaatttgctgttgaattcagtttgccggtgtctttttgataatttttgcatccatgttcatcaggagtattggcttgtagtgttctttttgttgttgtgcctttgcctttggtcagggtaacgctgaccttttaaaaagagtttgaaagtattccctcctctttaatttctggaaaagtttgagaataattggtattagttcttcttcaaatattgctagaattcagcagtgaagctatcaagacctggacttttttttcatcaagatgttttattactgattcaatttactcacttattgttctgttcagattttctattttttcataatttaaacgtgctatgttgtatgtattcaggaatttattcatttcgtctaagttctcaaatttgctggcatactgctgttcataggaatctcttatgatcctttgtatttctgtgatatcaattgtaatgtctcccttctcatctctgattttatttatttgggtctttcctctttttctcttagttaatctaacattttgttgattctgtttatcttttcaaaaaccaactcttcatttcattgatttttaaattttttttagtctctttcatttatttctctgtgagctttattatttccttcctactaccaattttgggttgattgttcttgtttttctagttccttgagaagcatgattaggttattcattagacatccttccctttcttgttgtacgtgcttattgctgtgaacttccctattagaactgcttttgttttgttccataggttttggtattatatatttccattcttgtttgtctcaagtaatttttaatttacattttaatttattcattggcccattggttatttggaggcacgttgtttaatttccatgtatttgaaaggttttcaatggttttcttgttgatttctagttttataacattgtggtacaaaatgatacatgatatggcatctattttcttaaatttcattagacttgttgtgggatctaacatattatttatcctggagaatgctccatgagtggttgagaaaaatgtgtattctgcaactgttggattgttctgtaaatgtctattaggtccatttggtttctggtgtagttttaagtctaataactatttattaatcttctgttatgatgctctttccattgttaaaagcgggttattaaagtaccttacaattattgtattgcagactatcttttcctttagatctaataatctttgctttatgcatttttgtactcctatgttcagtgcatatatatttacaattgttacacattattgaattgctccctttatcataatataatgacttttttctctctttacaatttttgatataaagtcgactttatctgatataagtatggctactcttgcctgcttttggtttctatttttccatcccttcattttcagccctgtattgtctttaatggtgagatgagtcttttatagcaacatatagttggatcttgcttttttatccatttagccactttatgtcttttcactggagaatttattcaatttatattcaaggttatcattgataggtaaggatgtactcctgccattatattaatcattttttcattgttttgtagatcccttcttcctttcttcctctctagttatttacttttgtggttttgtggttgtctgtggtactcagatttgtttccattgttctacttctttgtgtatctaccataaattcttttttgtggttaccacgggcctaacataaagagtcttgcagttataacagactattttaagctgatactgccttaactttggtcacataaaaatactttagacttttttctcccctcatactatttgtattttggttaatttatatctttatattttgtgtgttccttaagcactaactgtagctattgatgtattgatgtttttgacctttgtagctttaaaccttcattagaggtttgaaggatttacatagcaccattacaacacttagggtattctgagtagcacttacctatactagtgcatttactacttttcacatgctttcatgatattaattactgttttttgttttgcgtagccctactttaagtatttcttgtaaggccagtctattgatgagagatactcagttgttacttgtctgggaaggtctttagttctcttttattcctgacgtatggatatagtattctttgctcatgattttcttctttcagcactttgaatatatcatgctattctctgctggctagcaaggtttctgctgagaactctgctgacaatctaatgaggattctcttatatgtgacttcacattcttctcttttagattctgtctctgtctttgacttagacattatgattaaaatgtgccttaaagaggatttttttattgattcttactagggacctttgagcctcctgtatctgaatgtccatatctctcaaaagacatgagaagattccactattattttgttaaataggtcttctgtatctctctccatttcttctttttctgacactctatagtgtaaatgtttgatcacttaatagcgtctcataagttctgtaggccttcttcattcttttttaatcattcttttttatcctctcactatttcaaaatcacgtcttcaagttcaggatttctttcttctgtttcggctagtacattgttgacggtctccattgtattttttattccattctttgaaatagtaagctctcatatttgtttggctcttttttatgatacctctttgtttgaatttctcattcagatcatgaattgttttcctgattttactgacttgtttgtccttatcgtcttgttaggatgtttataaatatccttttctttaggacctgttactggaaacttattgtattcctttgggaatgtcatgtttccttgctttttcaagtttcttgtgactctacatatctgcacatcgagtggaagtgttgcttttttccattttatggagtagctttggtagcttttcctgtagatggaccctagggtgtcaaccggaaacactgtgtggcttcagctctgggtggactcagtagaactggtctctgtaacagattcttcagctgtaatcctcatctgcaacacctgtgatatctcagtggcccaggctgcatttgtggtgggttggttttgctggggcagggttccctgttggccaggcacatgggggtgcagtaggctagaaggttgtgtgtctgactctggaatggcaaggccactgccagactcactatcaggccaggggtgatcatgagcagatcaggcagctgtgtgtaaccctctccaacggagtggtgctacttctggtccagttctcaagccaagaatgggtgcacacaggcccagcagctgcaaggagcctctccactgtgcatgcttgcctgtttccctgggtgacaggatgcctcatctgttcagacatcagagtcccagtcattcctttgggcctaggttctagacagctggagtattggtgctgtaggcacctatgtgaatttagtgaaatgactgtggcacgtaagcggtagaatggtttagtggctactggcctcaaagcaggacacactccagatgtaggtccagtttcaagatgatgccatgccatagaaatgtatgtctcatgagcaagggtgtcaaggaaatttctcttccggggaatgcacctgtgtgtattcctggcaattgtccaaattggactcaaggtctgtgaggattggaggaccaccctgtagcaataactgctggcgtctgcaacagtgatagggaccactaaaagtctccagcttaccttttccccataagtagaagtatccccagttctgatctgctcctggcaggggaaatagtgtggcagaggcaggatgatttgctccacactctttggaggtatcctggcttccatgctccacaggggttttgcaattcccctggtgctctccagaacacttactctgtccaccctgttgaaatatagttgtttattcaatgttttggttcctttatatggggcaggtggagggggatgagagccaggccactgtagtctgctgtcttgctaatgtcactgcctaaaaatctttatctttaaaaattaagagatatgcctagatatccagttttaaaatttgtgattctatcttaattgaaaagatatcttttcttctctcattttgacttagttttctatcatgactgaagaaattctgcaataatagttatgtgaattgcctattcatttgattacaagtgaagacaggttatgcaaaatccagtataaaggtatgaagaaatcgaaattctcattaactgttgttaagagtataaactgatactctttccagagactcatatgacaaagtataaaaatatacataccctttgactcagcaacaccacttttaggaacataacttaaggagacaagtgcacaaggataaatacacaaaaagttaatttaaatatcttttataatagtaataaattagaaataacctaaatgtccttgattaggaaacaatgatagttaagtaatttatgagatacacaggcaatgtaataaagatgcagccattaaaaatgaaacctatgattgatatagaaatggaaatatttacaagatattgaatgagagaaaaacagcttcaaaataaagtaaaagggcaatatcatataatgtttaagagcacgtgatctggaattatacagtcccaagttttaatccataatcttccacttaacgttaggtaaatcacttaactatcccagtgctcagtgccctcatccataaaatggggataatgatggtatctaccttgcaacattgctgtgtatattaaataaaacaatataagcatgtcagatttctaagtgtctgttattcaataagtactaatttaaattttatcaattgttcaaaatgttagtttttaatgagtaatgggatccaaaatagttatataaatgtgcaaatagatttttttcaagtatgtacaattaaatattatctgagtatgggtatgggggctgtttcttattctatttattttgacatttttaaaaagataaatttttccccaaaccaaagttttttctaacaggtcaagctataacaatattaaccagtttattttgccttaaattataattaccatgtgtctacatttcccacctaaatatgtgctccttgagggcaaggactatgtaattcatcaatatattatagacttttactttatcagtgtcttatacatcatagaaattcaataaaagtttgctgaatgaatgtgtgaacaaatgaataaagacttcaatcttataataacctataataatatacagaatattaccagagtatattatgaggggaaaagtaaaagatttattattatagtggtaaaattgtgagctttagagtcagtgagatctgggttcaaatcacaattctgactcttaatagtgaattggctttgggaagtatgcatatattgagcaagtattgtatattacagtactgggtgtacaaagaagaacaagataaggtccattctctgaaggagttcagagtaaattgagagaaatagatacaaaaacaaccaatgacaatgctgagtaatagagtatacgtattgtagctacaaagtggtgtgatcaggaatctggtggaagcttagaaaaaatggtggtcagttatgcctagggagaatcagcaatatttgacttagatctgaaagaatgaaagagtttagaaaaataatttctctccatctttgttgtccacaggctacctttcatctggtatcatgcaatgcttcctaactagttcctccaattctagtcttaaaaattcttccaatatcttttctagcagtagccagaaataacttctcaaaatgtaaataggatatatctccatcctctgtagaacactctagtgatttccttcttaagataaaatccaaaataatccagaatctttaacactgttcagaggcccttatatgatgagagtcctaaataccactctggcttcatcttagtctactgttcccttagggtattacctgctaacctcaaaatcagcaggttctctccatttcagagctttttttatgtttttccctctgcatgaactactcttcatcactgctcttcacataactaactaccactttgctttcaaacttcattttaaatgtcatttcatcaaaggaggtcttttctgacctccctaatatatcctgttagtgctgatcccacaacatcatacttttcatacatagcacttttatcatgattttgtaaccacatatttatatatttgattatgtgtttaatgtctgcctcccaaacatgaccataagtaacatgaagctcagatcatgtcttgccctcactgtatttgcagcatttaacacaaatacacttaacactgtatttggcacagaatatgagttcacaaataataaataactgaagagggaaaatagcattctagcacatggaacagtgcttactacaaaagaggtattcaataaatatttattaaatgaattatttgttgaacaagaaaggaccatacggtatgaaaagtgtttgaaaatagcatgagatttaaaatgctggagcttagagattgtagggtgaaagctgagaaataagtcataaaatgtaagtttcctttcccaagtatcacaaaatcaggcacataacaattacttcatagaaactggtgaattaattgtattaatcagatttgaaaataataatcatttagacccataaaagtattaaaatttagctttataacactgtttaaattccttgcaaacagtacttttgtagaaatgcagcattcatttttttaaatcccagaatcaaaattgattcatgttttgtaatcatgtataatttaagtaatagtttaaatttagcatatcaaaagtatagaaatcattaaaatatatttagaatttaatgcacaaactttttacagcacttcttttgctcaagtcagtatcatgtcagtggcatacaactaaaaaatacaacttaaaaataagagaagagcagtttttaattatgtaggacacatctgaaaagcccagcctagcactccaaagtttatgcataccatcttgaagtcttctgtacctagtcaaaaacaaaacaaaacaaaaaacagaaaatggtcttgcactagctattgggtcatttgcaattccctgctttcattaccctataaagctttgataaaaatcctttgtagggaagaggaaggattccgggaatggtggtatgtggatattagtagacactctccccagtgaaacagtaatttaactggtaaaaaaataaaatcaaaagaaaccttttaaagtatctataatttctcctaaggcatacagcaaatggagaaacatttagtcacaaagatcattaaatcatgctaagaacagcaaaagcctgtagtatttgactcacaagctgctcccattatcccacaccactgtctctctccccagctctcatctagtttcaccctggcaggggaagatcatcagcatttctcattttccccaaagcttcatactaaaggagttctaatccaggcaagtacatctgagataattgggctcccatcctccatccatcctccactcacagcatggaagttctactcaaggcagagaatgctgagtgggcttgcattactcttgccccagctaccttatagggtggaagttctatgccaacatgggcaatccaagaagactaggtgctgccatctccaactaccaccccactcatagaacagaggtgtcacacaggccactctcctcacccgcagccctgatgcagtagcacacagattctacccagggagaaaatcaggccatcagaacaacagctgcaactatgagtaaggctggcccaggatacctgagtccctgaaactccttcccaaaactaatgttatttggaagaaagcatggagaatttcatccctaataacattatcaaaacaatggcaaacttggtggtgagcaataaagagggagttaagagctccagggtactagaagaaatacgtggaatgcaagaccaggaagtgttttataagagtaaatctagcaaagagacaggtaaaagagccctcctggataagggaaagcctcaaagattgacaatgccttgcctctgcaatggggagttggtctttaattggaataaacaatttataccaaatacaacatgttctcataagtgggagctaaacaatgggtgcacatgaacataaaaatggaaactgtacacactgggaactccaaaaggggggaagttgggagggaggcaagggttgaaaactaacacgtataatatttactatttgggttatggttatactataagcccaatctccaccagtatgcaatatattcatgtaacaaacatgcacatgtatcccctgaatctaaaattaaattaaatttaaaagatgctgccagcatggaaaaaaatttatactcagagcactaccaaaacatacaacaatcagatagcaattattggtggctaagaacagaaaattatatcaatagaagcagaccagagaaagggataataagaaagagctgagctgaaatcaaggtgctcaaaacaattaatgctataaaatagcactccttattcctggtggtcaaggagactatgtgcacacctaagttgaaacaagattacaaagtatttgaagaaatgctagctgaaaacttcctaaatgtgatcctaaatgtcaaaatggttaatgaataccatgagcaaactgaaagtaacaatcaaggctttattcacctactgcaacagtgcaaggaagaaggaaaataaaatggtgccagctctccagtgttttcctactggagaacaccaacggtaaggtggtaacatgtagtacaggcagggggatgtgtttcattgctgaggagcccttaacaaaaggttcctgcctttctgtagaggaaaggagaggctgggagaggaagaggggaaagaaatggaaaagcactgagtaagagtgggaaaaccaccgcagctgaggtcccccaataaggaggtctctggatgaaggtgcctgggctaagaattcacacatacacacgagtatggctggcatgggagatctgagtccctgaaactccttccccaaaacgtaaattagctgtgcatcaagtctgatgtagggaatgcagttttccccatgaagcttgccaggaaaatccttataattgcctgtagttgggccataaaggctacacagagaattttggcctggaccctgactcctcactaacttccagaagcttaaggaatggcaagtaagataaatgcaaagacctccaaactcagacacacaataggcaaaacgttgaaagaaaaagacaatgagaaaatatcaaaagcagaaaaaaaaaattcaactcatcaaatacaagggaactcaatatgattgataattgacttatcatcagaaacaatggagggcacttttgcctctttcaaaaatccaggcaaaataaagacattcccagataaaaatggagtgaatttggtgccagaagaacttacttacaaggaatactaaaggaagttatttaacttcctttaacaagttacaccagacaataatctgaatccacatgaaaaaacaaacagcactaacagaggtaattataaaagacataacaatagtatatctatactcatttcttctgttaaatgatttttaaagcaatttttaaaaacgtgtaattgtactgtcatgcttataatacatacaaaggtaatataattgataataagagcccaaaagaggtgggcaagaacaaagctgtactggaaaagaaaatgatgtttgatgataactcaaatccacaaaaataattaaaagaactagaaataataaataagattcatataataaactctataaatatatactttatttactttctcttctcagcttctttaaaatacatagaattacataaaataataattacaaaaatgaattgttgggtttgtaatgcctgtgagatatactatgattttaaaatagcacaaaagggggaagaaagggggagctctacaggtataaattttcaatatcattggaattaggttagtataaatatgaactaaattctgataagtaaacatggacattgtaagtgtaagagcaaccactaagaaaataaccagaaaaaaagtcatttaaaaaattaaaatattacactgggaaatattcacttaattcaattgatggcaatgaaggaggaacagtgactaaagaggcataaagaaaacaaaaagtgaaatgaaagacataaattcctatcaataataacattaaatatgaatggattaaataatccaatcaaaaggcagacattataactccggggaaaaacaacaacatccaactaactatattctctctacaggaaacatctcccttcagattcaaagatacaaattgatgataagtaaataggtggaaaaaggtataccacacaaaaagaaggctggagttgctatactaatatcagacaaaatatataattcaaaatgttataagaggccaagagtgatggcgcacacctaaaatcccagcactctgaggggccaaagcgggaggactgattgaggccagaagtttgagaccagcctgggcaactcagcaagatcctatctctacaaaaataaaaacaaaaacttagccaggtgtagtggtgtacacctataatcctagctattcaggaggctgaggcggaaggattgcttgagcctaggagcttgaggttgcagtaagctatgatcataccactgtactctccagcctgagcaacagagcaagaccctgtctcttaaaaaaacaatattattagagataaagagggaaaatataccaattatatataatatatgcacatatacaccccttacaagagaactccaaaatatatgaagcaaaacatgacagaattaaaaaggagaaagggacaattcaacaatcatatttagggactgcaatacgccattttcaatgaggggtaggaaaattgaaaagaacaaggacagagaaaacataacactataaagcaagtagacctaaaaggcatttctagcatactccacccaacagcagcagagtatacaatttcacgaagtacacacagaacattctctaggttaaggcacattttaggtcataatataaaagtatcaataaatttttgaagtttgacatcctctgaaatatactttctagacacaatgaaactaaattacaagttaacacacaggagaattttaggaatgtataaatatgtgaaaactaaacaatacattcctaaataattaatgggtcaaaaaagagattacaagggaaattagaaaatactttgatttcaacgaacatgtagggtacagctaaagcagtgcttagagagaaatttataactttaagctcttatatttttaaataagaatatctcaaaatcaatgacataagcatcaccttatgaaactagaaaaagtagagcaaactaatctaaagcaagcagaagaaagaaaataatgaagattggagtataaatgaatgaagcagaggctagaaaaacaagaaagaaagtcaataaaaccaaaagttagttcattgaaaagatcaacaaaaaccaaaaactttagctagaatgaccaagaaagaacaaagacacaaactattaaaattaagaataaaaagatgaggcatcactaacaaccttaaataaaaagaattataagatcatactatgaacaactgtctgccaaaatattaaataactgagataaaataaagaagtttctagcaatacacaaactatcaaaacagactcaagaaggagtataaaatatgaatgcatctatagatgataaaaagattaagattgtctgaacatttctgtccctcccaaaattcaggttaaaatccgaatcctccatgtgatgtactaggaggtagcatctttaagaagtaagtagaagttctcatgagtgagattagtgtctgctatggtttaaatgtgttcccccaaaaagcacgtgttggaaacttaatagccaatgcacagtgttggtaagtggggtctaatgagaggtaattaggccaagagtgtgaagtgaatgggttaatgtcattatcatgggtgtgggtgcattactgcagaagcagttccttatgaaaggacaagttcagttcttttttgtctccttgttcttttctcttgcactctctttgcccttctgccatgagatgatgcagcaagaagtcccttgccagatgctcgcccctcaatcttggactttccagcttccagagccataaaccaataaatttctgtttattgcaaattattcagtcagtgatattctgttatataatagcagcacaaaacagactaagacagtgcccttatataagaggccccagaaacctgttttttttttttccataatgtcagtacatagcaagaaggcaccacatatgggcccttgccagacactgaatttgctcatgcctggtcttgtactcctcaaccttcaaaactatgagaaataagtatgtgatgtttatgagcaacccagtctatggtattttattatagcagcctgaactggttaagataaagaatgaattagtattttcaaacttctcataaaaatatcaccagaaaagaaaactaaagatcaatatcttttatcaatcattaacaaaacactagcaaacaaaatctagcaaaatataaaaaggattgatatcattaccaaattgaatttattccaggcatgcaaggttgtttgaaaataaattaatataccacagtaatagggtaaaggacaaaaaaaatcaaatggtcattgcaatagatgcataaaaagtatccgtcaaaatcaaaccccctcaacaaactaggaatgtaaaggtactctctcaacctgataaagagcttctactaaaaagcccacaactaatatcatacttaatagtgaaagacggctacttttcccttaatatcacaaacaagataaggatgtcagttcttaccacttgaattcaacattgtactgaaggttctaaccagggcaaataggcaagaataaagaaataaaaggcattcacagtagaaaggagaaaatgaaatgatctctatttgcaaataacatgatactatatatagaaaatcctaaagaatccaataaaaaaagtatttgagctaaaaaatggattcagcaaagttgtaggatatatcaacacaccaaaaaaatttattgtatttctatacactagaatgaataatttaaaattgaaaataagaaaacaattacattggcaagagcatcacaaatacttaggaataaatttaacaaaataaatgtaagggtttgtacactgaaaactacaaaatattgtgaaaagtaaacaaagaaaatgtaaataaatgtaaagatatctcatggtcatagatcaaaagtcttaatattaagatggcagtactcctgagattgatcaatcccaaacacaattacagctgctattcttgcagaaattggcaattttgttcaaaactttatatagaaatgcaagggactcagaacagtcagaataaccttgcaaaagaagaacaaagttgcatgttgcacccttccctatttcaaaacttgtttcaaagctacagtaatcaatacaatatggtactgacataagaatagacatctatatcaatggaatagaactgagagtccagaaataaatccttacatttatggtcaattgatttttgacacaggtgccaagaccatttgatagagaaaacaagtctcttcaatgaactatactgaaaaactggatatctactcacaaaattatgcagttggaacccttcctcaaaccacaaatgatggagttagacccctttctcaaaccacacactaaaatgaactcaaaacagatcaaacatctaaatgtaagagctaaaactaataagaaaacataggtgcaagtcttcatgatctcggatcaggcaataatttttcaatgtcacaccaatagcacaagtaacaaaatttaaaaacgataaatttgacttcatccaaattctgtgcaacaagtgatactatgaagaaaatgaaaacacaagccacagaataggaaaataattttaaagacttatatccagcacatataaagaactcttacagttaataataaaaagataaatgacccaataaaaaataaaaaatatatacaaatggaaaacaaatacattaaaagatattcaacacaattagtgattaatgaaatgcaaatcaaaaccacaatgagatacttcttcacacccaataggataaccacaaatccttgctctgccaagcaaataatagcattataacctcagtttacttactcataaaacaaagataattaaacctaacatgcagagtaatttataggttttgaaaaatatctgtaaagtattcatctgaaagcaaagtggcaacttaataaaccaaagcatttatattttttactttttataggtgactctaaaagactagaatttatagaagtagatagtagaatggtggctaccagtagctggggatgagtgggaaggtgagagatagacagaacctgaccaaagagtacaaagcttctatctgaccaaagagaaataagtttcaatatctatcccacagcaaggtgacattagaaatgataatgtatgttacaaaattactaaaagaatgtatgttaaaatgttctctctacaaaaaaatgacaaatatgtgaggtgatggatatgttaattagtttgacataatcattccacaatgtatatacatatatctaagtgttttaccccataagtatatattactatttgacaattacaaataaaaattttaatttagaaattttttaaatcatttattactattgttacaattagaaatttgctgaataccactaataccactccacaactatggtattaatatcctatttcagggtggcaatgataacaatgatgttctgaaaacatatacaatgggatttttaatcttattgcaaattctgtggcccaaattgaatttcaactaacaactgttgaaaactatttccaatggttttccttttaatcccatatgccacctactcacaaaatttagccctctctgtatcttcccaataggaagaacaacaacaacctaggctagaaaaaagtgttacaaaaatgagcgttgtcattacatacctctcagaatcaccaaaaatcaatatgcacaatttcagagtacatgagaaatcccaggaaaaaaaaaatatatatatatatatatatatatttcctgaggctagacccacctacgttatgggaaaaggtatcaggaagaaaaaaggactgtcttctcattagcgtcagtgacattgtcaaatatgaaagcagaacattacctaaaccgttatccatcccattgatgcttttacaaaatattccagaaaacaaagggaaatgttttctggattacaagaatagcaaaatacaaataaatacatgaaaaaataaataccccaaattccatgatgcagagagaatcctcgctaccatctgaagctaaccttttcatatctttttctacaaatactcatattttacatggctgagatcaaactatgtatatagtgtcacagcatttttctacttaacattttatcttacggttatgagctatctattgctgcataatacaattatctcacaatttagcaccttaaagtaagaaatatttattatcccacagtttctatgggtctctgggacaaacacttttctaccttgaatttctgctgagtaacaatatctctgagcttcttaacaagcttccattgtttcattgagaacacttattttaaaggttaagtatacctttaaaatatttagatgatttttattcaacttagtactctgaagcaccacctttcatctttctgaggtctcaaccagggattttacaatcacatcctcagtttcatctccagacaaagtttttctagagtgccctgaattgtatctttacctaagatgataaattttagaaacatttgtcatctataaatactggacattttttaaaccataaagccctggatcctttatatttaacagtgcttgctttagtttatctcccttttctcaaattttactataggtatcaagaaaaaaaacaggcagtgtttccaacattctgcttagaaatttcctcagctacatcactcagttcactcagtgcactttctactttctacattactgcagtggcagtgttggtaaattttccatcactacataacaagaaccctctttcatcaagtttccaacaaggtttttctcattttcctttatgccttcacctaaagccttctcaaaggtagttttgtttctatagttccttcaatactgtacaagattccactgacacgctccctaagtcccccctgtaacagtgaaacaggggatgaagcccagcctgcatatagcgacattttaaacatttcgctaacacccttggaaaccagctgagaaaagagaagggcggacatatcacgtgataaactacaactcaatctagacgcaccctaacaaagattggccgggcgcagtggctcacgcctataatcccagcactttgggaggcggaggcaggtggatcacgaggtcaggaaatcaagaccatcctggctaacacggtaaaaccccgtctccactaaaaatacagaaaaattagccgggcgtggtggcggacgcctgtagtcccagctactagggaggctgaggcaggagaatggcgtgaacctgggaggcggagcttgcagcgagccgagatcaagccactgcactccagcctgggcgacagagcgagactctgtctcaaaaaaaaaaaaaaaaaattgaaaccaaccccagacaaaaacgtgaggaaagacagagtttgtaggttgagtactatgtcgggagtttccaagatcactctcaggtttgataggtcactagaaagactcagaggactcagaataagttatgctcaattacagtttgttacagtgaaaggacacaaagcaaagtcagcaaaggggaaaaccacacggggtgaagtctggagaaaaccaggcaggagcttctaaaagcactttcccagtgaagtcacacaggacacacctaattcctccaacaatgaactgtgacaacacatgagaattgttgcctaccagctcgcctgcacatagaaacccaggggccttttttgcggggaagggggtgtcagtcactgaacttccaaacccccagaaaaaaaaaagcagatgtccaccataaattatattttttacataaactatctaaacaagcaagtacaatatttccaaaaaccaagcatgcagaacattcctatcaggacattcaaggagccaggcaaaggccggtcacacaaaaaggatcttcttgagaatatgcaaagttctaagagcattctgggagctaggcaaaggtcagtcacacacaaaggacttttcttggggatatgcaaactttgagaaactcataaatgctgagttaattcttttctgcacaagccccaagttacagacacttggaaaaccgcttagacattccacagatctgcctttacaaagcacataactaagtctatataatgtcaaggtgatcagccaaaaactgaactgcacactagaacaaaaacagaggataaaaaaagaaccaagaatttctacaaaaaacatctacaatgtccaatttataacaaaatatttctagatatacaaagaaaaatgaaaagaaaaaaactccatcaatacagatggacaccgagatggcccagatttgggcttttggaaacaaagagcatattataaatatcttcaaataactaaaaaaatttcaaagaataaaagaatgaacaaatagagaatcttatacagaaaactcaaatctataaaaagaaacaaatggaaattatagacctaaaacttacaatgatggaaatttaaaaattcatgaaatgggctgaaaaacagattagaaacatcagaataaaaagaaactattacaaaatatctgctctgaataacacagagaaattaagttgaagaaaagttaacaaagcttcgtggacgcatgggaaaataacaagcatgtaataagagttccaaacaaaaaagagacaatgtggtaaaaagaatattttacgaaataatgcctgattgccctagccagaacttccaataatatgttgaataagagtggtgagagagggcatccttgtcttgtgctggttttcaaagagaatgcttccggcatttgcccattcagtatgatattggctgtgggtctgtcataaatagcccttattattttgagatacattccatcaatacctagtttattgagagttttgagcatgaagcggtgttgaattttatcaaaggccttttctgcatctattgagatactctgtggtttttgtcattggttctgtttatgtgatggattacatttattgatttgagtatgttgaaccagccttgcatcccagggatgaagctgacttgatcgtgctggataagctttttaatgtgctgctggattcgatgtgccagtattttattgaggatttttgcatcaatgttcatcagggatattggactgaagttttctttttttgttgtgtctctgccaggttatggtataaaaatgatgctggaaacaaatgaagtgtattcaaataggaagagaggaagtcaaattgtctctgtttgcagatgacatgattgtatgtttagaaaaccccatcatctcagcccaaaaagtccttaagctgataagcaacttcagcaaagtctcaagatacaaaattgatgtgcaaaaatcacaagcattcctatacaccaataatagataaacagagagccaattcatgagtgaactcccattcatgattgctacaaagataataaaatacctaggaatacaacttacaagggatgtgaaggacctcttcaaggagaactacaaaccactgctcaaggaaataagagaggacacaaatgagaaaacattccacgctcatggataggaacaatcagtatcatgaaaatggccatacagaacaaagtaatttatagattcaatgctatcctcttcaggctaccattgactttcttcacagaattagaaaatactactttacatgtcataaggaaccaaaaaagagcccgtatagccaagacaatcctaagcaaaaagaacaaagctggaggcatcatgctacctgacttcaaactatactacaaggctacagtaaccaaacagcatggtactggtaccaaaaacagatatatagaccaatggaacagaagagaggcttgagaaataacgccacacatctacaaccatctgatctttgacaaacctgacaaaaaaagcaatggggaaaggattccctatttaaggccaggcacggtggctcacgcctgtaatcccagcactttgggaggccaaggcgggtggatcacaaggtcaagagttcaagaccagcctgccctcaccccctactaaaaatacaaaaattagccaggagtgatggtgcgagcctgtagtgtcaactactcgggaggctgaggcagaagaatcgcttgaacccaggaggtggaggttgcagtgagctgagatcgcatgactgcattccagcctgggtgacagagtgagattctatctcaaaaaaaaaaaaaaaaaaagaagctcagtaaaccccaagcaaggcaagataaataccaaaaacaagttcaatctatgcagatcatacttgaagtacttaaaaccaaagataaaggtaaaaatcttaaaagcacagggaaaacagatatactgcctgcaaaggggatgagtgataataaataacagttgaattaaaaaaattatcaattgagtttatacagcaattgaataatgctagtagtgttaaaagaaaaattaaccaaaaaatcatttcaatccagaattctatatcaagtgaaaatatcctttaaaacaagagtgaaatgaagacaattttatataagcaaaaacagaggggattcagtgccagaagatgcatatctgcacaataagaaatgtgtaagatgttttccaggttgatagaaactcaaatctaaaggaaagccaggtgaaaacctgtatctacaagaaagagtaacaacagaaatggcagataatcgactatattttaaagatgtttttaatgtgtaattgtcttaatagccaattgactgatagaagctaaaatattgacattgtagtgagctttataatgtacaaaatataaaacatataataacaatatccaaagaatggggcaggacaggaaaatggaattagactgttataaggtttttacagttttgaagtatgaaatgggaagtgtgaagtatgaagtatcaagtgtgaaataggaagtagaaagtgtgatataagaagtgtgaaatgtaaagtgatataatattggctctagactttcataagtgaagcatgcatattgttagccctagagcaactgcgataaatgaatgaatgaatgtatggatagattagtatattaatataaatagaggtatagctaagaagccaatatagaaaataaaatggaatactaaatatatgcatatccatgtctacatggatatatgtatgttatatacatatatatgttagacacctactgtaaaattttctgccttagtgtagttcaattctaatagcccattacaatttctaccaaaatttccaccttccatatagtattgtcttccccaaaatcaggtcatttcagtttcctgcctatatctcttcaatggtttcccaatacacatcaaatgaaccacaaaccctttactatggtctatgagacactacataatctaatccttgtctatctttatagtttcatcttttgccactccctcacctaatgaacctcttttcagttcctaaaacaaacatatcctacatcaagaccattctctgtgctgtctccatccctgccttctcacagatccctactatcttttaggtctcagtttaaagcttatctcatgatagaagactctcttaactaacctaaaagtttctttgatatctttattactaaattctttccctctttcataacatttctcacaacatgaaattatatgtgtgttcattaatttcatattgcatttctgccaccagatattagctctttaagggtaggaaccacatttttttcacttatgtacaccctacgcctagcattatgtctgaaatatagaatgtactcaataaatttgtattaaataaatgacatatgtaaatacctacaacataaaattaccccagtaaattttctatttataaaattactacaagaaatgctgacaaaatttgcatgcccagcagcatcacggacatattctcctgggtaactttcatcacttgtcttcctttttataatatggtggtattacatcacaaagtaacaagagtatagtttgagagaattcccactagcttcgggggagccatgtttatggatcagcaacttatagatttattagaattttaaaacttctcattttatatttattataaaaaggaaccaatttagcatagcttcctgatagagaatatattaaaaaaacagcagctacacaagattaacagtccacaactcttggtaactggagaaataaagatgtactcacttaaaccaggagcaaattatagattatattataaaccagagcagaagtatatataaactttgaagtgtagtcaaatggcattttgtggagatgaaaagtaacagaatgattatggtctcctaaatattataaatcattttgtgattatggaaataaacagaaaactactgaaagccagaagatagctgggtgctttacacaggtccagtggcaaacaatgtatttgcctttatgtattttttggtaaataaatcaagtcctttctttcttacctcaggtttttattatatttcttatgaactgttaaaatgctcttgtcactggtctccaagatgcaacccttactcaatcacacatacccatccaacctccaaactgtctcaagggcaatggttctggcaaaaaggtaagaggaatatagtagaaattcagtaggtataggcgtaaaacagacttaagctttaagtcaagtaataggatatgaagatttgttagactcataaatgtgggtaaatctttctagactcaaatttcttatttgtttaatgagaataataatatgcatttcatatggttagactaaggagaaattattagtgcatacataaaagcttttaatgaaaacacaaaatcattatttgttgcataaatgactaccacctaaccaaacaatggaagtccattactctctatcctcttatttttattcaaagcactcttcatcacctgatatttaaatatttttatggactatctcccacacaaaaatatcagatctatgagaacaagaactttgtcagtttttggtgatagttgtagtcccagacctccaaacagtatctgacatatatctggtactcaaatttctgtttctaatttctttggataattcttatcaactacaaaattaagtttaaacagaatagcatagtgggtgctctatccgttgatactaaacggatttctagcttctctgaccatgttcctccatgtctcccagtctttgagcacaccagggtactcacttgcttccttaaacacaaaataatctgttggagtagaataataataatagaactgaagaaaagcatacagactgctgctctgaaggtaaatttagatggagtgaataccacaggtgagttaaaggaagaactggttgacatccatatttctggcttgagcatctgcgtaaatagtaggtctcaacataatgatggggaatgggttcaaaggaaaaaatctagaattctactttggatctcattttttttaatgtctatgataacacaagtgaagatgttaagcagacagctgaacatgcaaatctgaagttaagaggtctaggtaagaaatttaaatttaggaatagtaaattaaaaggatgataaaacagagaaaagagactagaactgtgatctgaggaaatctaactcttaggattttattagaagaggatccaataaaagagatcaatagggggtagcatgtatgactgaaggaaaatcagaagtgtgagttattgaagaatccaaaaaagaagactgattcaagaaagagagaagtctatgttgaaagctactgaaatcaattatcgtgaggatagaaatgtgctttaaatttagccacatgatgatcactgatgactttgaaaagaacattttcaggaaagtagtgagtaaaagtggaaaacagcttggcaaaattgaagaataagtgagaatcaaaagagtgaaaacaacatgactgtgtttgtcatattttgctccttcagaacacaggcactctgcaagttgaagagacggattctcaccactaaaataaaaaatattgtcattttttttgccgatacatagaaaaagcaatttaatgtacagaatactctcacttataagttctccccataacaaaaaattgaaaacggatttaagttaaattacccaagatcttctcacaaagaagacaagataattaattttgtataagatatgtacttcaatttacctatgcaattcatttaaaatcagatatgattatcttcattttaggtgagtaaatgattttcagagaggcagtaacttgtccaaagttacacaacagttggttttaaagagaacctaggattccaatcatgtctaagaaagtgctaacacttctactgaacaaaactataaattaactgccacaagtattgagaaatatttgatagaatttttacacatctctgttataatacattggatttcaattatttacttacaaatttttctctccccaacgccagtaaaagttttgatgataaaagattttcttctttatgtttatagactcatgttcctagcataatgcatgactcataataggaattcattaaataattggttaaatgaatgttgaatgaaagaatatttataagaacttcaattcaggatattttcaaatgtcccaggagcataagtattaattcactcatggctatttcgttttgaggtctagaaattggtgatgagaattcaatataatttacgaaatatctgctggacaattgtttgtgttaggcatagcactagatgttgaaaagtaaaggaaatgaattggaaaataatcagacaaaatctctgcccttgaggtcttcatataaagatagcaatacgaagatagggaaataaaaaagggaaaatatgataaattcattgagaagaagaagaaagtcactgggctaaagaaaaactgaaatgatattttaaatgaagagaaaatattaggtatagtcatataaactggcctaaacataagcattcagctgatatttaaaaaaaaaatagaagtaccattctaaagtatatgaggactttcatttaagtcttttataaaaaggaagacattaacaaatggcaagacatactatgtacccagataaaactatcacaaatttgccactgctttacaaattaatatatagtttcatataactcccatcaggaactaagtaaaggtatctcaatgatttttttaataaattcactgaaatatgtatctagcaagctgaataaatgagaaggatgtaaaatttctggaaagggaggaaaaatcactggtgtcctgtgtattcctgagacacatctgtagaattgttactgaagtattccagagttatggcccaggagtatgcattttcataagcacccaagatgattctaattagaagatctaagggcaaaatgttataaaccacagaccgtgtgtgtgtgtgtatgtgtgtgtgtgcatccatgtgtgtcagtaagatataataaagggaacatcccaaatcagtagtaaagagataaatttttcaataaataattgataaaaacagctattcagaaaaatttaagttagtacttcagtttacaacatataccaacataattttgatgaggattacagaattaaatatatggaataaaaccataaaaagactagaagaaaacttgagtaaatatttttctgatttggaaggattaaacataaaagcagtgagagaaaagatacaatgaataatcaatataattgactacataaaatgtaaattatcttatgtgaaaatcatgatcataaaattaaaatatatcaagctaagaaaatactggccacaatgataactaagacttaatattcttacaccataaagagctcaaatataccaccagaaaaacattaaaactctaatagaaaaactgggcaaaagatatgaacaggtaattcagaagcagaataacaaatattaacaaatacattaaaataagtttaactttaacaatggtatatagatgagtaagtaatgattttcctacagtgtttgtagaaacttaaattggtacaatcattctgtaaagtaattatcagcagagtttaagggcttaacaaaaagattcagatcctttgaaatcataattacacttctaagttcagtatcctccaaaaatgaggagaaatgaagacaaaaaaatgtatgaagataccaaatgcaacattattaaaaatagtaacactagtgattaaatgctcaacaatagggaaatcactaaataattccaaccgcttaataatattctgttacaaagactattaaatttataatttaaatttaaatttaaaatttaatttaaatttaaaattatctttttaaaatattagaagacttaaaaattcgttcatgtataataaagtgaaaagcacaaaaaaaattacactctataagtaatctcaaccattcagaaaagaactatgtttctgcttttttctataaattaaaaataaatatgcaggttattagaatttatttctaggtggtagaattatgatttctaaattacagattattttaatttgcttcattatgccttttctatcttttacacatttctaataatgagtacatattattatttcaatatttaaaagtgacttttcaatgggtataactttccagttatgcaagatgagtaagttctagagatctgctatacaactatacaacagttttcctatagttaacgaattgcagtgtacattgaaaatttgttaaaagactagatctcacatgaagcattcttgctataataaaatatctaaatatttaccttagcattgtgttatccttataagaaataggaggattatattgttctttctaaaattagaatgtactacatagtctaaatctgccatttaatctccagcaaattttttatcaactttctattcataaaataacgatattagtaaatcctgccaatttcacaaaaatattttaagaattaattaaatttcaatattctgagctttgggaaagaaattcctgaattagctttccattaaagttgcacaaatcagtgatgaaattgtgatgccttggcattcagtttgttctcttctgatattaaagtttctgaacctcaaaatataaatgtttatagaagacaagattgttactgtgcctaggataaataggtacattagttatcttatgagtcactatcaggaggtaaaatggtaagtctatatttaattttttgttttagagacagggtcttgctctgtcgcccaggctagagtggagtggcagaattatatagctcaactgtaacctcaaactcctggctcaagttatcctcccatgtcaatctcccaaggatctagggctacaggtatgccactgtgcatggctaagtttttaaaatttttttgtagggatgagaccttagggtctcgctatgttgcctatactggtcttgaaacactggcctcaagcaatcctgccaactaagcctcccaaagcactgggattacaggtgtgagtcactgcgcagcacagccttaattatcatttttcttttttttttcttttctttttttttgagacatagtctcactctgttgcccagactggagtgcaatggcgcggtcactgtaacttccgcctcccgcgttcaagcgattctcttgtctcagcctcctgaatagctgggactacaggcatgtgccaccacacccggctaattttgtatttttagtagagatggggtttcaccatgttggccaggctggtctcgaactacagacctcaggtgatacatccaaagtgctgggattacgggcatgagccaccttgcccggccaattatcatttttaaaagtatgtacctctcttctctgggagatattcttgaccaataaaatggcaaaaatgcatgtggccagagggggaagaatcgaatctgatggatgatcaaattaagtaattaagcaatggacaatgaaggtttggttatacttatgctatgaagtgaaaatgttattttactctttatttttaaaattaaagataacaaatctgcctcagagggctgtttctaatatccaataagttaagcagtgttaagaacttaaaacactgaagtgttcaataaatgtaagcagtgatggtgtcagttaacagtcatcctcatacttttcatagtaatatacaattattaattgccagaatatttcatttactccattaatgcatgcatttaaatttatccagtggtatacatctttaataaagtttaaaatcttcagcttatgagtttttaaagataaaacataaaatgccatttttatgattttattgtctagtttgattgttgaagaatataaccgcattccaaatgtttctctatgaggcatctattcatctactgactgacatatttaatgtttaagttccttttatttaagttcttattgctttctttatgtggtttggattgataatttaatattgacatttgcaatgcatccaaagaactttctatatgacaattgcagtgttatagtcaaaaagtctttgcattaaatgtttgttatttcattttccaaactctggaagtattttattttatttaaaatattttcagcatctttgtaaattaagtgttaatcaccatggaaaatgccagcatagttaagtgtttggttgcagataaaatcatattaattcttcaaaattatagctacttatcttttatttaatagctaagaaaataagaatgccaaaatacagtcagaaaatagagaaatctctagtataccatccactctccattagcctaaagtaaaataaaataataataatgttgctatgaaacaatggatttaaattctcaggaagagtataaaatgaattactatattagtagtgcaccatgtgcattgcaaacgtctcgctgaagttaattttcattaaaagcaccctttggccacacagagagctttaaaatatatgactttctctgtcactctaataattaggcctacttcactatgggaaaataacatgtgataataactttatatgtcaaggttgtaaatcaaattaaaaaaaatccacagactcagctctgggagattttccaaaatacgtaaatttcagaattgaagtccaacagttgagatcctctcacagaaattatctgtctctgaaataaacagtatctaactggtacacttattgtatcactatagtccagggttccatgaatatcctcattggaaagatctgagaaagttgtatgctagtaatgattaatgtctgggctgtagaagacttgtagagcttttaacagttgtttataggaagtgagggagggaagaaaggatagtagaaagagagagacagatacatagtagaaagaagatagattttagagtgaaaaaacaagggcaaaggtattaggaagtgaaagggcatcttgatggcatcatcaagacatagtgactaagccaaaaagatggtcacataccatatgacattataaaagaattctgaactgacaagacattctgagtctgcctcaggcgagtagttgtgatcaatatacattatctccttgagtttctagtacttataatgatgtccatatgtttgccaaacaactcagtgccacagtgacccagatggacacagaaaataaaattataccttccaccattagctttctttatgtatagataaatattgagaggtttgcaggaaaaagaagagggagggtaggagtagagaggaaaaaaagagatcaatcccttaactataagtaacataacagctgtcacttccatagtatctgcctctaaacagaactaatttcctttaattttctactgtctgcttagggtatgttacagacagtctcttaaggtagtctccatgatctttacctcttggtgtttacacctttatgtgatttccttcccttgagtgcaggtaggggctgtgacttgtttccaaccaaaagaatatagcaaaagtggtaatatgtatgtgattacaagtacatgatttcatgattatgttacaaatctcactttttgtcccttgctgctttgagaaagcaatcagccatgttggggaactccatttattttttttatttattattttttttctcattttctttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctataaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcctttgggtatatacccagtaatgggatggctgggtcaaatggtatttccagttctagaaccctgaggaatcgccacactgacttccacaatggttgaactagtttacagtcccaccaacagtgtaaaagtgttcctatttctccacatcctctccagcacctgttgtttcctgactttttaatgattgccattctaactggtgtgacatttatgcagccaaaaaacacatgaaaaaaatgctcatcatcactggccatcagagaaatgcaaatcaaaaccacaatgagataccatctcacaccagttagaatggggaactccatttaacaaaaaactttggatggtctctaagagctgagggcagattccagtcaactgctataaactgaaactctcagtcctacagccacatgagactgaattctgccaacaatctgagtaagttaggaagttgatccttccctgactcaaccctcagatgagattacagccctagccaacacctcaattgcaacttgacaacgctttaaacagaggacttgctaagccatgcccagactcctggtccacagaaactgtgataaaaaagtgttgtttcaagccactatgtttgtgattatattgttacacagcaatagataactaacacagggagaaacaagacaaatagatttgtaaaacctttgtctaaagtaagtcaataaccattgaatacatccctgaggatctcaaatataaaaaaaaagtgcataggctttacatgacattattctatacctacaggttcttcactgtttgcttttctgctctcacttgtgttcctaatgaatgctcaaagaagtaacccagttgagatattacaatatacattaccatactaagcaaagccagacatataattgtataaaacaggcaatttcttaaaaagcatcatttgaaagtcatcccagagtaatccttattcaaaaaatgtctcttcaagtggcctgcacagtgtttgaaatacgtctgttatggtgtcatccttctggagataaagctatgtgtttttagaagtgtcctgtaagaaagaaaatatctcagtgaagaataacatatcagagcattatcttctgtagggagaccccctgaaactattgctatggaataaaagataaaatgctcctgattattgtacatacaaagttgcctgcaggattgtgtaaagacaatgccaggttggactgccagaacgagccaacagtgcatgatgtgcttccccctgcagagagcctatgaatggacgtgcagtcagggagttttcacatcaccaagattcctatcccagaaaagcagatgttcatagctctgggaatggaatgtgacccatgtggagagcctataaacagacacatcggggggggtcgcctgtctatatggataagatagggctacaaacgccctcatcttgccacagctcttctaggcctctttagggttaaggcatactcccttctgagaatttctggtctaaccggttgtctagcttcatgtcctgtttctatggattgtttgtaaccagcttttgctgcaactgttactgctgattaatatcttgctaatcataggttatggaaaaactgtgtttctgtttttagtctctgttagaaattactgatgcacacactgtattataaattcttatctctgtatactgtacttctgcatacaaatgttatgttaaagaattacttcatccccatgtgaccatctcacctcataatcaaatgaccctaaatccctcactaacctacccccgccctcactaaacttaataataaatgctggtatatccagtgcattgttggcaccacgggaccagaaggcggtgacccccctggacccagctttcactatcttgtgtgtgtctattatttctcaacctgcctatccatccgcctgggaacaaagagagagccccattgcattgtgggctgctggccagatcccacaataatcttctaccaatatgtctgctgatttaatttatccaatagtcattgccctagcaaagcacataaaaataaacttttcatttgtaactgaatagatacatagcatttttatagtatctgctttacaatttcaaaagaaccttcataagttaaatttcattatatttaatgtatgaagttaaatatatgatatataagttatatatgtattatatatagcttatgaagttatatctaaattttatatattcataatttatttaattaaataaatcttatttaataaaactttatatgtaaagctcctaggagagtgcctgcctatgatttttactcaacaatgttcattcattctcttccttttaatcctaacaagatttgatccccactcctttaaatgaggagaccaagtagcagcaaataaataacttgctcaagatcattagcctagtcatataacagagttgagactttaacccaaatcctcagactatgaattttgctctctctacttttgtctctactgcttcagaaagcaccacatatccatcacttagaatatgaaaatcccatagacaaaatctaaatgacactctctattctgctttaaagatatttaactttaatttctgtgacatttaatgaatgcattgtttattgaaattaaatagaattttataaagatttggaatcctagtcccaattctgccactagccagctctgtgatcttgaaaaagtcactctacttctctgaactgcagttttctcatatccaaactggaggtaatactaatgatgattctgataacctgatatttgcctcaacgtgtcgctgacataatgagataatgaatctgatcaacctttgaaagtggtactatagtatttagcaaatatgtcattgccatcagtatcataattattattgaccaaaattctataattgtactatcttaataaacccagtttttctaatctgatgtcaatgaaaatatttggttattaacacttctgatttttttgtttgatgtttctttgaaatacaaaagatactactattagaaagaagttaaaacaaagtaacctatcctaagatgtgtggtttaaattcatgctagaaaattgtacatttggactgttctttaagtgtgctgctaattgctaaaaatacagtgttgatgaaccttacctggttggaatttttttaaattagtagttaaaatgtggctgttacagcttctcacaacagactccttaaaatcttaaaccataattcttttatattaaagtataactttaaaagcactcttctctcacaaaaaaactatcaatgtgttagtgtaagccagccgtgtccaaccctttgaatgcgaggaatgttttgcttacctgtgatggcagatattacaaaacttatgcacggacctttttttagctcattagctatcattagtcttagtgtattttgtgtgtggcccaagataattctttcaatgtgtcccagggaagccaaaaggttggacatctccagtgtaagccattctctaagtacagtatacaatggatgaggtcaaaaggaagggcaatgagtacattaaaattatttacttaagagtattcaacatttattatggagtataatttcacctatatgcaagtaattcacactatactggctcaggcttaggaaaaatcatgtattgaattcattacatttattacttttgaaaacactgatagttttgttatattactgaaggctgaatttattaagtgattcataaaactgggctccactttgttcattaattgtaggactaactagtgtaactctttataaataatttgcattttcatcaattaacaaacatttatatttgctggtgagatagaaacctattaatacattctgaaaataaacaatttgagaatcaggcttttcacacatttaaatttgctttcctggtgacgaagtcaatctttacattagagtatccctagatgcataacaaaccacaaaaaaactttgaggtttatagcaacattttcattatttcttcctgtttcttgggttgaatggtggcttatctgggctcacccctgacatatgactctaaagcacatcacggtgtagactatatttaaagtcaagtaattagatgagataaccaaagggaataattgtagatagtgaaaatgtacaagaactgagccctgaaacatttcagtttatagaagataaagaaatgaggcagaatcagcaaacataaagaagtggccaatgatggagaaggaaaacaagggagtttcgtatgtatttctaaagccaagtaaagaagtatatcaaagaagagggaacgagaatagttaactgggtcaaatcctgttgacagaactataagaacagaagataagaattcagatttagcaaactggaggttattaatgaacttgagaagagcagttttggagaaagggtatggctcatgaaaagcctgattgaatgggtttcagggaaaaagaaattacagccagacaactctataaatatttttcttctgtaaaggggagcagagaaaggaagtagtaacttatgaggttgtggggcaaagagaaagatttttaaagatagaagaaataacagcatatttgtatgccaatggaaataacatagagataaaaaatagcaataaacaagatacagagaagaactgctgaggtgatgtccttgagtagctgaaattaaatggtgtttgagattgtctgaatgcttgtttctcccaaaaattcatacattaaaacctaatcagcaatgtgatgctatttgtagactgagtctttggcaactgataaggttataagggtggatccttcatagataagataagtacccttataaaagtggcctcagagagctgccttactcctttcgctaagtgaggacacagcgagaaggcacatctatgaaacagaaactgggcctttaccagacaccaaatttgccaaatccttgatctgggtctccccagcctctggaactgtgagaaataaattttcattgtttaaaagcttcccagcttatggcattttttaaatagcagcccaaacagactaatgcaaatgtttgtactgataatcaggtactgctataacaaatacctaaaatgtaggagtggctttaaaactgtaatgggtaaaggatggaagtgcttggaggtgtgtgctagaaaaagcctacattcctataaacagactgttaagggtggctctgatgaaggcttagaaggacagcaggggagttatagagaaagcctcaatcttctcagagaatatgtaagtggtcatgatcagaatattggtagaaatatggatggcaaaggtcattctgatgagttcttagaaagaaataaagaacatattaatgcaaaatggagaaaggcaatcttagttataaaatggcaaagaacttggcttaattgtgtctgtgtcctagtattttgttgaagtatttctgtgtcctagtattttgttgaaggtagaacttgtgaatactgaaatacaacatttggctaaagaaagttttaagcaaagtgttgaaggtgcaacttggcttctaatgtaaaaaatagaaaaataatttaaagatggaattttaaataaaaaaatgaagcagaacttaaagatctgaaaaactctcagcctctccaaattgtaacaaatgagaaagcatgtttgggagagaatactaatggtgtaaccaagtgaacatttgataagattaatatgaatcagccaagttctattcatcaaaactatggaagaatgatcccaaaggcattttggagattaccagggatacccctcttattacaggcccagagtgccaggacctgggggacagaataatttcaaaaaggggccataggtgcccacaggacccacatactcgctggccagtaccaccccaaagctctgttcccagcattctggtgcagcagtctttgaccaccccaggttcagctccagtgggcccaggtgtggtacaggcagtagttgccacccctctagaggacacagacagtaaaccttgccaatatctgtgtggtgccacctctgccagttctcagactacacaagctgtggaaatgtggctacctccatctagattttggaggatggagcctcccagagttctaggcatgcaatccaggcagagtgctgggttgagctggctgagagtggggcaattgcagagagtctccactaggtcaatgtctaggctgtacctagtggggtacagccacccccacgatcccagaccagtagagccactggcatgtgaatccagcctaggaaagcaacagacaggtgactccaacccttgaaagctgcaaagcgattagggcagggttacccagagctttggggactcaatccctgccaagtaaagctgcagaaataggatctctcccctggaaggtctggagggcagagcctcaagtcaaataagatgattctatatccttaaggttttagacttgcaatctgctgcccctttctcctttcctatttctcccttttagaatgagagtatctatcctatgactgtctcaccactgtaatgtgaaagcacataacatgtgtgatttcataggtacatagctagagagtaatttgccttagaatgaatcataccttgagtctcatccatatctaattgagatgatagatgagactctggacttttgacttttgagttgatgctggaaatagtaaacacttttggggttactgggatggaatgaatgcattctgcttctgaaaaagacaagttttagtgggccagcagcacaattctatgatctaaatatatgtgttcctccaagattcaaatgttgagacctaatcactaatttgatgctgttcagaggtgaggaattttgggagataattatgtcatgagggcagagccccaatgaataggataagtgaccttacaaaagaagccccagagagctgccttgccccttccacccatgtgagggcacagtgagagggcatcatctattaaccaaaaagtggggcttcaccagatgtcaaatctgccaatgccttgacctaggactttccaacctccagaactgtgagaaataaagtacagttgtttaaaaggaacccagtttacggtactttgttatagcaacctaaacagactacagcaacatgtaatgtgcaaatggagagattaccctcagataagaacagaaacagttcctccagtaaaagatggaaagaaacagtaaagggcacagatgcaaggaagctggtgaatatggtgacagaaatttttggaaactctcttccaattgcttctattttctctatttattgattgtatattactcatcagccacagagccttgaagagattttaatttggatttcttgtttgagtgacggggtggatgaggatgtctatagattcacaaagggaagacaggaggaggctcaatgttgaaaagactacaaactttgatgcacactgactttggggtgcctctcagacaacttacttcataaatgcacagagctgaatttagttacaattacatgaagtcagttaataaatataataagattatatcccctcaagtttttctcaattactattaaaattataaaaattagtatatacatatacgtgtgacattctttttatatttctgttctgaacatgaggacttataatttaacgaatgaattatccgtttaagaatatcacttgtctagcataagacaacttactattcctaaatacttataaatattaggagaaaaagcacgttgaatatatcagaaaaatgccctgttcctaacatagtagaaactaatttatgtttctgacatcgtagtatatagataatttgcacatgggtatgattcaagttagcagtctatagaagattgctaggatatgaaatccccttgtatattatggtaatttaccttcacattatttcattgttatagattccgaggttctcactagcttctgaaaaaaacatgcagcgataatatatggtttgctccctatttgctttcagaaataaaaatactaaatcaaaattaacatggaaaaatctgaacctagtaggcggttaggcaattgaagaaaatcaatcagtgtaaatatggagttatgtgctaccaattgaataatactattaaatattacattttattgcaatcggttttcaactacacaggaaaattcttcccttgtagcatccaattacatttttttttattattttactttaagttctagggtacatgtgcacaacatgcaggtttgttacatatgtatacatgtgccatgttggtgtgctgcacccattaactcgtcatttacattaggtatttctcttaatgctatccctcccccctccccccacgacaggccctggtgtgtaatgatccccaccctgtgtccaagtgttctcattgttcaattcccactattcttaagaaccaaaaatggtgttctggacaacaccagtgctattggaatgcagtctctaataaagagttggtggaactattatagcagaactatgaacttacaggtctataaaccaaagtataaaaggagcattgcaacatattttctaacacctaactgctgtaaccaaatagtttattgtcaaaaccaaatgatatcctgctgtacaacattatatctatagctaataataccgtattgcacatttaaaaatgtgttacaagggtaagtctcatgttaattgttcttaccacaataaaaaataacttcatataaataatgcaaaattaataccagcttcaaactccccatgtgtgatacagagaaatttatataaagaaaggataacaaccagacaaaatgctgtaaacaatcaaggcttcaaccttatctatctcaagtactgctgctgggaagttataatgaaatctccgcctaaatttaaaaatactagaaaacttgctatataaatcctgtaatttttcaaacacctgtctatttagtggattagctatctccaataataccttcccaccccatattaattatttagtttcacagtggctactttcagttccattaaaaaatatctgcttctaaaacaatcataattatcattcaatataaacctattttgttccagatgctttacatatcatacaaaattgatctttaccactttcctccctataaggtaggtgaaggttttccttccagttgaggaaaatgaggctcagctaagtaccagacacaaagtcacacaaccagtaagtagcagagacagaatttgaactgaagtctgtgggactccagagtgcccttatatctataacttactactagatacaagaatctattccaaatccatcagggaagtaaaaagaggagtaagaaataatgtatgtcattaaagggcctattacattctaggaaaaagtaactatactagaaagtagaatattatattctaaaagaacagtttaaacaattgttttagtacagggagataccacacatctaattataaatttcaggaaagtttttatggataaaatggcatttgaaatagatcttaaataattaattattttatcataaggtgaagacttgatgttaatagggggtactggagaaggctatataaagaaggcatttctaaaacaaaagaataatgaagaaaaaacagcaaaaaacatgtttcatgtatagtgaatacttctgattgactggaatactgggtaaatatagcagactgaaacaaaggaagaatagaaagataggttaagttcaacctaaaggctcttaagtgacatgttgaggaagtttcaattcatttaaaaggcattgggaagttactggaagttttttagtagaaagtgatatgattaaatctatgcttcaggaaaatgacttgagcaaaaacatatacaacatattgaaaaggtagacacctgaggtagcaagctaaattaggaaattactgcaatagtcatggcagcctgaactaagacaatcacagtagtcacagaaagggtggcacagtatcaaatatataggcaattaaaccagcaggacttagttacttttctacttaaggtagtgaaaataagagtaaagagttaagtgggagaagagcttcaaggtctgggacctagatatctatccgaaacactgactttcacaaaattcaaactttcatcaggtaaaagagaggtaaataatcatgaggtaaaatgatgtgttttatcaccacttttatctaagaacttctatgttggaatggatcctgtggaaaatggtgttccaatgtgtgctctgcagacttcctgaatcagaatcatctggggttgcaggtcatgaggattccagtctgcatttcatccatttctgcatatctacaacacttgttatttatagcgcttaattgagaatttatacagctttatttaaagctgtatagtaaatacatagtaaaatttctatgaaagagaatggctttcttgggtacttacaaagttcattcttaatttttgttacttagactttataagtatcttagctacccaactattaatagaagacaaattccctaaggataaagactaataataataatgtctctaggtacttttacactaatcgaagcactttacagtttacctgtttggtactcaattattataatgatattcaccatattattaaaaatttttttagagatggggtgtcgctatgttgcccagattgatctcgaactcctgggctcaagcaatcctcctgcatcagcctcccaaagtgctgggattacaggcatgagccaccatgtccagccaatagtcaccatatattactagacaaattatatagcactttatctcatcctcaattttgtcagttttacaaattagagaaccaaggtccacaaaacgtaaatacttcatcaaaaaacagagttagcgaaagacaaaggtaaatcagaatccagagccatctaattccaaagtatattttcttctccctacgtcatgttgcctccacagtgttacatgccacagtgctagttacaaaagtactcattcaaacaaatttttgtttgttttctgttgtggttgttattaagtatttaagccttgtacataagcaatcattgcacataatgaatgatcaatgagtatctgtcaagtgaattaatgtagcctcaatgagaaaactaaaattcttaagaaaaaatagaaaattatagacacagacaaagcacgaatacattcactgtgctgcttacaaatataatcattccccctctggcttagtgctaaaattaaaacagtcatagcatttgttaaactccaattgtttgggtaaagcaatgcttccaaggtggaacgaaagggagaaatatccatagggatccctctgagcatgatttcctccaacacctacattctagggctgttaagaatgggagacacaaggctgtatacatggacttgtagatttggagacagatagatgttatactttgatgacatactcacatttacctatatacatcaaaaaagagccagttccatttatctacattcttccaacctaacaaacactgacataaaggtgcttggctaggagaaagggatgtaagttcattcatgggtttctccacataatctatgaatactgatgttagaggaaggaacactggactagctggtcattctagaaatgtagaccactaatgcccacagtgctgtgcaaaaccctgtcacaagtcaccctttctccttctcctgggtttccttgataaatgttaattttctaactttggtctcatcaattttctagtcatttattctgcaaacatttactgcagaactactatgtgccaggtactgtactaagtcacaccatgggaaagagaatctaagagaagtccttgtcccaacagttcaaagtctcactgaagagacctacatgtaactaaatcactgcagtgcaatgattgaagaagacatataaatatcccagatgaaagatatgggaaagaagccagagctataagatttaatgaactaaaaagcgcatcacctgcaagaaacttaaacaatacctgtagaagtgccaggctaagggagaatcacagaatcctagaatgttccgggttgaaggaaagcccaattaattgctactaaaaaagaatatcttactgacaaagcagcccataaccactgtgccaggttctgataatacacaaataaactctgagcccagcccacctcaagaaacccacaactcagtgaaagactcctcactataccactagtaggcagaggcattaaaaacaatatgatgatattaagaaaaacattaaaaattgtattaatatagaatgccacatcactaagatggaatttaaaagtagcccttgcttaagacactctcctgctataaactctgaaatattgtcatcaacctatgcctctgcaaagacgtattaattgcatgtgacaaaacagtctctactccaataccctctattctcagccctcgtctcctgacaccactctttatccctaggtaaacatggccactccctccttggtgactctataataccctatacagactctgctcattcattcttcatgcattcatttactcacttatgtaatcagtaagtattttttagcacccattatgtacaaaacactgtactaggtgctggggacataaagtactcaataaaacaaacacaatcctattctcagggaggttacattccagagggtgtagatttataatacgaaaataaatatataacaggtctggtgatggtaagtgctaagaacaaaaacaaagttggataacagagatacggaatatggaaagagagtacttgatatggtttggctgtgtccccacccaaatctcatcttgaattgtagctcccataatccttacatgttatgggaggcacccagtgggaggtaactgaatcatgcgggcaggtctttcccatgctattctcatgatagtgaatatgtctcatgagatctgatggttttataaagggcagttcccctgcacatgctttcttgcctgctgccatgtaagaaatgcctttgctcctttttcgccttctgccatgactgtgaggcctccccagccatgtggaaccatgagtccattataaattacccagttttgggtatgtccttattagcagcatgagagctgactaatacagtactgtattaattgtgtagccagcaaagacctccctgataagatgacatttcagcagagatgtgaatgacatgagaaatgtaccatataagtatctatgtatcatgtaggagtattccaggcagaagaagttcaaacactctgaagtgagaacatgagtagcgtatttaaggaacaggcagtggacagatgacagtgtcttgaacgctatcagcccctacagccttatagtgtacttacttgtatccactatcacactatgagctccctgagagaaaggatcctgtcttagttacctctgagttgccattgcctaggacagaatctgacccaggagacactatataaatatttgagtaataaattaatgagtgaggattcaacctttcttctctcccttgcttgattcactcccaggtattattgatgaatatgtgctgcatcttcaactaggtttccagcttttctgaaggcaaacactatgtcaagtatatcttttcctgttcctcccatctcacatgtacccctagggttcaatgcagtgttgtacaaatattatataagaccaacagatataaaatcattgaaggaatatctaggtctagtgctaccaagatacctggaataggaaataaatggcagaaatcacagatcaaaattctgcatagaaacaaatggtgtcaaaatatgaaaagtagccattaattttaatttttattttttgtgggaacatagtaggtgtatatatttatggggtatatcagatgttttgatagagacgtgcaatgcaatgtgtaaaaatcacatcacagaaaatggggtattcatcccctcaagcgtttatcccttgttacaaacaatccaattatactcttttagttattttaaaatgtacaacaaagttattattgactatactcaccctgttgcgctatcaagtactaggtcttactcattctttttaactatttttcatacccttaaccagcctcactgaccctaaccctccactacccttccctgcctcagctaaacattcttctactctctaacttcatgacttcaattactttgatttttagatcccacaaataaccgagtacatgagacgtttgtctttctgtgtctggtttatttcacttaacacattgacctttagttccatgttgttgcaaatgacaggatctcattctttttatgggtgaatagtactccatcatgtatacatgtcacattttctttatccattcatctgttgctggacacttacattgcttcaaaatcttggctattatgaacagtgctacaacaaatatgggagtgcagatatatttttgatatactgatttcctctctttggggtatatacctagcagtgggattgctggatcatatggtagctctattttcattaacttgggaacctccaaagtgttctccatagttgtactaacttacattctcatcaacagtatatgagggggtcccttttttccacattctcaccagcattttttattgcttgtcttttggttatgagccattttaactagcgtgagatgctatttcattatagttttgctttgcatttctctgatgatcaatgatattgaataccttttcatatgcctgtttgccatttgtatgtcttcttttgagaaatgtctattcaagtcttttgaaaactagctgtttcttaggtagggaaacactcacctaatttcaatcattaccatcttttttttcagtgggaggtcttactctgttgcccaggatggattgcaatgacaggatcatgactcactgcagcctcaagctcctaggctgaagcaatcctcccccatcagcctccccagtcactggggtttacaggcatatgccaccatgcctggctatgtatttttttaagagatggggtcttgctatgttgcccaggctggtctcaaagtcctggactcaagtggtccttctgcctcaggctcctgagtcattgagattacctgaggcagcatgctcagctcttatcattaccacccttaactctcactagtactactttacagatacaaccagaataataccatcataattagagtatgctttcaggattcagaactggatcagaagagagtggccccagcaagatagccagaaagtctgatgcacaatgtccaaaaagcataggatgctcagacatgatttaagctggaaaaggttccaaaaggtctaggtaatgggcatatacaataatgtagaccaagcatatttgccacttagtggtccaaggaaatatgtctattcatatctagattttatccagcgattggtaaaaatgaaaagtagatatgagtatagacatggtgaaaattaggcctcccagcccagattcatatctagagggcaagggttcaggcaataacctacgcttgaagagatactaattctaatattctaagctgagtgatgagtaagactttggcacagaaaagaaggtatcaagaaagaactcatttttacagacaataccaatgaaaataatgcaggaaatgtaacaacttacagactagtgaccagggtttgtctcttgtatattagataacaagactaattggcagcatctctaatactgctcatagacattatgctgtggtcaagaaatggctcagagatgaggcagactgggatagaagtcaaaacccatcagtagcagatttaactgctggaagccaggatgagaaaggtaaaggtctaaggtgagagctgctcacaaaatcagattggtcaaactggaggaaactttgcaaacctgaaacccaactatattagagatgtccattacttctcctccactcatagcctcttagagaatctctcctacccacatccctgaagaggcagccctatatacacaatgaccaccttctttggtttacagttgaccagacccaaactgagaaaatcatattttccttcttataattaggaattgaaatacaagactgagtttgttagagtatgttgaataggccagtcaaccctatggcaggcaagtgaacactcagcaagcttgaaacagaaactaaaaaccttaaaaagaaagttggcctgaagggcagggaatggaatataaagtatttaggaacaaggagattctagatcatgcagacccaggcatatacatggaagaagagattgcctaataagtttccagcttcctttatgcactatgagttaaaaatattgtctgtttattaatggttaagaattatgggataaaattttccttgaaaaatagtcatcttctttaagattttaggggtttttaataacacataattctcattcgcaatactgttatttataaccctgtgttaaatattcagactcaattatttattctattcctaagtaatattaagctatactttaaatattatcccatacttttggatacacaaatctgagagagaagaaaatatacaaacaaagaaaaagtgtatactcttcccatcagcaatgacagccaaattttacttataagattgctttccatattttaccctgtttagatatgtaaaaggctaacatctaatcccatttgtaatgctgatccagcaagaaagaaattaatttggcattagagtagtaacatcaatttcccatgtaactaaagtaatgcatttactggaaagagattaatatcaattccataaatcattcacatgctttttccgggtttgagacatccgagtaatgtcatatatgtgagctgatatcactttgtgcatgtgccattcattaatctgtgcctggggttacagagaagttgtcaggagaaaatataaaacttagaaaaaaatcaatctttctgttcttaattttttgtaacttgttttaagtaaggtaagccaaatgttgctagaaatgcaatgacattgatccacactagcagccagcattttcagaaaaaaaaaattaaacatttggtcacttagcttcctggtggtaacaactacttaatatccacataagacaatgtgtaaatgtcaatgcaaatattccattaaggagcctcaataaaatgatgactaaaagaagaactgagtctgagtctctcctttaaagaacagttcatctttgttgttgaatttcataatcatatgggttttttttagtttcttgctttctgtttgtttttgttttttttgtttttttttttttgagatgaggtcttgctctgtcacccaggctggagtgcagtggcaccatcatgactcactgcagcctcaaacttccaggctcaagaaatcttccaacctcagctcccaagtagctggaattataggtgcatgccatgatgccttgcaatattttttaaaatttttgtagagttggagtctccctatgtttcccaggctgctcttgaactcctgggctcaggtgatcctcctgccttggcatcccagagtgctgcgataatcacattactcaggatcccatagataaaaagaaccaatatgatatgtgtatatgtatatggtctgtgtgtgatatacatataaatcatccaatccccaaaacacagcaccaattacctgcatgatacagaatgggaagaacaaggcccagatgtaagagcgtggagcttgtaacactcctattatttattattacttttgacaaattgataatattaacctaaacttaaatcttccattccaagtcatctgtggctagcaaaactgcagggacaaggaaatgagtgacacagtggaaagagtccaggcctttgatttgactaaagtcaaatcccagctctatcatttactaacagttacttgtctttgagcttctaatatttcctcatctgaaatattagaaaaatagtgcctatttcatgggattcttaggagaattagagataaagtatataatgtttcctggaatataatagatgatcaatacttctctggccatatttattctgttcacttccagggcacagggtagaatttcaccttttgaccccctgaaaatagacgtggccatatgacacattttgtccaatgcgatataagtggaaattatttgtgacttttccaaaaaggtatttttattataatttggctatcatgacttaaaacatactgagacatttctctcttgcgatgcattcacaatatcagaactctttttattttatagtatattagcaacttacagaacagttacgctatcttctattaattgtgtgaaacagaaatattgtcaactaagcaggacaaggttcattattccattttagtgatgagatcacacattcagagaagtgaggtgatttttcccaagaccacatagataataagtgtcaggtcttctgattcctagataataccaatccgtgtataagaaaaaaataaatgccacactaacaatggactgttttataagataatttattgagatgctaatctgtgctggtaaatgatatcccacattctattttttccaacactgaacatttatttccctgcctcccacccacacaccatacgctctattctctaggctctttgagatctcttacctcaagggaggtttgcgtggcaataaaaaagaaaacattgcccccaacacttcttttcctgaccttagctaggattatgctagtagaaagagcagagttccattggaagcagagaagggaagaaaaacgtcctatactttgggaaagagaagtcaaagattccaggaatggtgggaggaagaggtgctccctggcaatcctcagtaataaatggcttcgcagggtacctacagaggaagaacgctaggcactaggtctctgaagctaggcaaaagctccaataaagaccctcatgtcctgcttgtgtgagacttcccacattcaaggagttgcatgagcttgaattatgagggtgtcatggtacccagacatttaaaaatcagaatgttttatctcctagcgtaagcatcacatacacctcttggagtcttatgtgacttttgagaaagaaagcctcagttaagatgtgaaaatgaatttcctctaatcccagtgagaaggaaatccagagtcagattaacttgatataaataaactaatttgaaatttcttactgagtgtataaacgaggacccacaccctagcccaaagtccttctgaaaacacacacttaactgccaatttcatttaattgtgtgaaacagttataaattgtatcccataatatgttcctgattattcctaaaggattgagttttccaaatccaaaaatgttaccctttctccatcaactgtgagatgatgtgaaatgaattatctccctccattacggaggaataagatatgctatgaatgcatgcaataagccctcacagatcagatactcaaaccctacacagggattgagccaaagttccccaaagtggtaacaagtacattcctatctactcaactcaaagggtctcaactagctagtctacaagctaatataggacatcagactggttattagcttgtacttcaacttggaaatgctctagttgctaataatgagccaggaaataaacatataaatgctgaataaccaaaagttaactaagatgtataagaacaggttttgaggtccggtaggcctgggctgaactccagattctgccacttattagttaagcgcacttagtcaagtcacaacttctctaaatcttaatttcttcaacttccttctctacaaacaggaataacatgcttaccctaatttttgtccaggatttatgagaggccacaatagatgtgaaaacactttgttaatcataaaatgcttacaaatattagcaattattacagttttattacttttcttgctgttgttattacttcccactagcccctgaggtctaccaaaggtagcacatggggagttcccctaaaaaataggctgattgtgcggtccagtatgcttttaaaaggaataggtaccatgaagcttctaaattatttattcattcattcattcatttaataaatgtgtattgagtgccccaagaattcttcaaatcattcaatattcaaaatgtatcctcatttacctctcacagtgaccattagaagctcttcctttgggtttagctgtgtgacatttggagagacatttaaactgaaaacctgtttcttcatctgtaaaattaagatggcatcacttatcccacaacatagggtcaaatgagatcaaggctatgaaaatgcaaagtcaccaatatggcactccaaatgttcaagagtgctactgatagacttaccttaactacctaaaagtcctaaggatgatgtgggaatttaagattatcttgaatgtataagcattgtactgagctactgctctctgtagaatgtgtttatgacagtagttatttccataaatactcataaagccaatggagtaaggaggcatcaaggaagtaaagacatttggtatgttttaactttcttttctagtcactaaatgtttatatttgtaagctgcattgctttactgtgattacgaaattgttgttgacttagttggaaatgttcctataaatgatagattttccatttatgaaaacttgattatctaaaattgagaaaacagaattcagctgtagattaatttcaggataaacttttaaaaatagaatacataaatgtgggtcaacatttacaagttatcaattctttttttaactaataaacatttcttttttcaatcccaaatacagaaagaaaatctcacttacattaattttgagttttcctagaaaaatatcacagaacatcagagttggaaacaactttgatggtgatctagccataaaagttggattggggaggatgagatttaaatcacatccatttaaaaatattttaacctatgaatgagaaaattctgtgtaatattttcttttccagaaaaaaaattgggggggttttattcacattgttcacaacataaagacagatgataagacaccgaatatgtttttaaaactataaaattaaaggtatatttccatccgggtcaacaacaaaactttaagtatttttcttttttgtatttttctttcttttctttttcttctttcttcgtgtgtgtgtgtgtgtgtgtgtgtgtgtgtttgtgtgagacggagtctcgctctgtcacccaggctggaatgtagtggcgtgatctaggctcactgcaacctccacctcctgggttcacgcaattctcctgccttagcctcctgagtagctaggattacaggtgctcacaacgcctggctaattttgtattttagtagagatggggttttgctatgtcagtcaggctggtcttgagctcctgacctcaggtgatccacataatttctaaataaaattatccaaattctcaaatgctcatctccagaaagcctttctgtcctccaatccacattgatatcttactccaaatttatacataagtatgatattcattatacaaactcatactgaagtatttacaattttattttgctgtataatagtttgtgtatgcttaattgtgcttctacaactagtctacaagcatatgacttgcaatgatggggactggagatgctgtggtggagactgttactgattgcaaaattcatttcttattctacctgggcacacaaatagacttcatttctcagtccatttgtgtccatatgactatttctcattaatggattataagttgaaagaatatgtaatatttccagtttaaggcttttaagaagtagatgcatctcctcttttaattgttctcctcacaccagttagatacagatgatgatgacagactttgggaacagtggagtcactgaaatggaagatggaagaagtctagaaccctgaatcatcatgtagaatgaatacttacctgtcttggactgttatatgaccaagaaataacttttgcttatatttgcaccattatatattttggaatttatttgttacagaagtcaagcctatgtaaaccaatgcagctatggttacttaaagttggattttctcttaacaaaatgctcaaacatgggtccacagcttagctataaggcagtgtgaaaattgacctagtgggctggaaaaattattatgtcataaagtaacaccatcaacattgagaacttggaagaatatcatgggcccaactgagctggtaactctagtagacatagtttaaaaatatatattaatacacgttggttgttccttgctggtaataattagatcagataataatagaccagttttcaaggaaaattgaatggaatagagcaaatgcaagaaattgaggcacagcaggtttgaaaaatcagctacctttggacctcaaattttggaagcaagaatgtcccaagctgctgaagacaaatgaattattctgtgaattgaggagagattttgaaatgggtagggaatcatccagaaacatggtaaagcagccatagagaactaaggagtgcttgatatccaattttaagtcatgttcacttctgcaatttttaaagaaatttctattcttccattaaggctgcataatgtgtgtgtgtgtgtgtgtgtgtgtgtgtgtacatacacacacagaaacacacagtactgtgtgggaatgtatacattttcttggcgatataaagaaaagttaagttccataacaggtatgacataaagcagaaataaaagaccaggtgaggccaggcacagtggctcaagcctgtaatcccagcactttgggaggtcgagttgggtggatcacctgaagttgggagttcgaggccagcctgaccaacatggagaaaccccgtctctactaaaaacaaaaattagccaggtgtggtggtgcatgcctgtaatcccagctacttgggaggctcagacgggagaatcgcttgaacccgggaggcagaagttgcagtgagccgagatcgcgcattgcactccagcctgggcaacaagagcaaaactccgtctcaaaaacaaaacaaaacagaaaaacaggtaagatgcatgggaaaccaaaatcctaacaaaggaggaactgagagtcaaaataaagatatacagagaagtacaggatatggttcttgggctgacacctgggttatacaagcaacctctgtccaaggtaaagattcctgcattacagttaacaagtgtttactaacaatgctaagctctgtgtttgagcctcacgatttgtcaaatgaatgagatatggcatttgaatcacaagggaaggcacatcaacaaagaaatgattgataatgaaaagcttagaagcaatagaagctattcacttaaaccaacctatggtttcagaagcaatgaagccattcacttaaactgaccttagggcttcagagaaggcttcctggttagacaactaagttatcttgaaggataaatgcaaataagccagagaaagaagggtaggaatggcttttaagacaaagataatcatataaactaaagcaaggaagcataaaattacaccacgcatgtggagaactaaaactgtgtaaacatagtctaaaactaaggcaaagagggctaagaaaaatgtctggaaaggttggtagtgggtaaagtcatggaaagtgctaaatgctatcataagatgcgtgggcttcatttcataaacaatgaggatgcactgaagattcttatctgattcattctcttctgaatctgagctattgctattttttggtttgcctctattgattttgactccatactactccatagattttttttctccactcataatagagcctctcttatttgctctgccagtaagtaaccaccctgataagtcacccaacctgttacagcttcctaagcaagacccagatagaatatagtgagcaactcaatatattgttttcaaaacactgaatggttctaactgactctatcttctttactgatacaaaaactgtcattttcttttgtttttctaaataatatgccctcttctgtgatgtattttaaagcatacatgaatattctgcatcatccactaaacaatcatgcatcttatttctattccatgaaaacaggaagaaggaataggacacaagaagaaggagtaggaaggggacaaaaaatttatgttgttgacatttaccaagtgcctactatgtaataggcatttgatacattaccttatgtaattttcacaaccattctacaagacagttcattattccacatattttaaaatgagaaaacagaagttcagaaaggctaaatgtgatgggtaattgtatgtgtcaatttggctgggtcaccgtgccaaaatatgtgatcaaatctttactccggatgtctctgtgatggtgtttttggatgagattaacatttaaattaacagattttgattaaagcagattgccctccataatgtgggtagacctcatccaatcagttgaagacttgaatagaacaaaagactgacctccttgagtaacaggaaattctgccagcagatggccttcagaccaactgcagaactggctcttccctggatctctaacctgctggcccactctgcagacttgccacctttcataaacatgtgagccaattccttaaaataaatcttcactcacacatacacacacacacacacacacctttttggttctgtttctctggagaaccctgacaaacatactaaagaactcaaacaaggccacccatatagtaaataataaaaaaaaacaaaacttacaaccagaactgtttgtttccaaagctaggattccactagctacacgattttccatataataactttaaacactattatattaaaaatgaaaactaatttacataatattttaaaactattttaatatttgtgtaaattgataagcttaaaaagttgtttttttcctgtgttggagcactcttcaggaaaaattataaaaattaataaaaaacaaaaaccctctgtaattgaagtttagtgcacagggaagttttttaaaaaaaacaagcaaaacatattgggaaggaattaactagtacatatgggtatgagcatttgcttctaaatgtggcaatgaaatctgccctatgagacattctttcaacacatttgttttaaacaagtatgttctgccatatttaagggacatttcaaatacaaaccttctgtgattgatatgtaaattatgaacagagtgacaaatcgaagactaagatgaaggcattgagtcaagttaacacatctacacttggctcctttaggatatctaatagctaaatataagaatgagttgatgacaaagcaaggaaccatatcaggttttcatgatctcctcttacataataactgtatccctgtatagacaaagaaggcagaaataggagaagacaagactacagaaaattgtttttactcatccatgaaagaagaaggctttagggtgagtataaacttgccaattattttaggacccaccattttatgtttaagcaattgtcatttattcatttatccatggatgttttgtgcacctattaagagctagccattgtaagaaaagaaatcatggttcctgccctcaagaagtttatgcttacaggcacagtgaaaagctatgttccacaaaagaaatattagtaaaactgaaattgtaaactggaagacggaaaagccatatacagctgcagatatcataggagaaagtaagtttgggtacagactttgaggatagatttcaataaaagttgaaaaagaacataccaaacaaagagagtatcataattaacgttaaagacaataaggatttgatattggttagcagaataaaaatgaaaatgcatacatgagaaggatcatacaggtagagtatgaattctcaatgggggtgctttcatttggagcaaaaacattttagactattacaatgatttgttgccctctgaaaatcacagtacctaaagagatatgcggtatatcagtagcaatgaaatttcagggagctgggggagtaggaaaaaatacccaaaaagtagagtaataataaaaaaatcagttaaaaacattaagatggagtaaaaggatttaataagaaattagatggggtgacaaagaaaagcaaaagctgactctagaatgactagaaagctattagaatttttgaaattaaaaaaaagttttaaggtcaaaagggctcttctgttttgaagttaaaacataagtttggtttggaaagctgtccattttaaaatatcaatacacatctagatacagacacaatcggatagtttaaaatatagaatcactaccttgaagagagttcaaggctgatgatactttccaaggcagtgttattcaaaatttggtccatagattgatgctggtctgcaatgtgtttgttgtacattgctaccaattaagtacagtatgatacttttacagtcatttgacatccaaacttatgattggtttacttatctagttcaatagggtgtaaataaatttaaatgttgacaaactcatgtggcaaattgcacctggcatgagcatcatacaagtcatgcacagtaggatcatatagagagccatgacagactggggagaaataaagttggttcttgaccacacatagttctgagaagcgttttaccagggcttaattatgtagagcttattacttaatgaaactgtattccatcatttctaagatagcagggacactagtaaaatgtctaacaaagagtaagtactcaataaatcaaacaagcttctaatttttagacaaaatgttataatatgtgcataattgcatttttattggaagggagttcatagctttcattagattcttatgaacagatgcctgttacctaacaaaggctaataaccaatgcagtaaaaaaaaaaacaactcattactactattatctttgtaccttcagtatctgcacataatttcattcatccatttaacaaataattattgaatgcctactctatgttaggctctggagatagagcaaatagacaaagtaactattcttattgtaagaaaggcagataaacaaataaaaaagcaagtagcatatgaaaacaaaatgctataaaagagaaactgggtagctgctttggatcatcacagaaggcctctctgaggaagcaatatttaagctgaaatctgaataccaagaagtaaagatggtgtgggggaggtgatcagaattccagaaaaaaaaatttggctgaatcaaacagcctaaaaacaaatatggcctgctctggaaacaggcagaaagtcactatggctacagcattattgggaagagtaagaatgtcatgaggtgaagtcagaaaagtagtcaagggccagaccaagtagtcactgatcactttgtagtcaggataagaagttcacattatattctaactctgatgggaagccaatgaaggtttaaaatagggaaagaatgagatgtgatttgaatatttaagaatatttctgggtactgtgtaaagaatagataatgggggagaagaaacttgagtgaaaggaagcaagaggccagccgcggtggctcacgcctgtaattccagtattttggaaggccgaggcgggcggatcacgaggtcaggagatcaagaccatcctggctaacacggtgaaacccgtctctactaaaaatacaaaaaattggccgggcgcggtggcagacacctgtagtcccagctactcgggaggctgaggcaggagaatggcgtgaacccgggaggcggagcttgcagtcagccaagatagcgccactgcagtccagcctggacgaaagagtgagactccgtctcaaaaaaaaaaaaagaaagaaagaaagaaaggaagcaagagcaacatatgttaactgcttgaataagggaggcagacagaaaataaattaatggattcaggatatttaagcacaataataattcttaatggacggatggatgaatggatggatggatggattatgaactattagatatgtactcaagatttataaagattaaagatacgtaagctgaaccttggaaaatgccttataggtcatgtgtggaggaaaacaagataggtcagtccgagacagggggagaatgaagatgttgtaatcacagctgccagggtaagacagtattggaaagtaagagtaatcattagaaatgtcatgttgcacaggaatcaaaaactaaaacaaaactatcaaattacatcagtatgcccctggcaacccttcaaagaacaatcttgctggagtggccaggatacaaatcagactataaaaaataaagatgtaatggtatatagtgacatttccatttttactggaaatctttccaaaatcatctcacacataattaaatcttattattattataatttaagttccggaaaacatgtgcggaacggtgcaggtttgttacacatttatacatgtgccacggtggtttgatgtacccatcaactcatcatgtatattaggtatttctcccaatgctatccctcccctaggcccacaccccctcaacaggccctggtgtgtgatgatccctccctgaggccatgtgttctcattgttcaactcccactaatgagtgaaaatatgcactgtttgcttttctcttcttgtgttagtttgctgagaatgatggtttccagcttcatccatgtccctgcaaaggacatgaattcaccattttttatgtctgcatagtattccatggtgtatatgtgcacattttctttatccagcctatcattagtgggcatttgggttagttccaagtctttgctattgtgaacagtgctgcaataaacatacatgtgcatgtgtctttacagcagaatgatttataatcctttgggtatataaccagtagtgggattgctgggtccaatggtatttctggttctagatccttgaggaatcaccacactgtcttccacaatggttgaactaatttacactcccaccaacagtgtaaaagtgttcctatttctccgcatcctctccagcatgttatctcctgactttttaatgatcaccattctaactgccatgatgtggtatctcattatggttttgatttgcatttctctaatgaccagtgacgatgagctttttttacatatattagttggctacacaaatgtctccttttaagaggtgtctcttcatatccttcactcacttgctcatggggttgttttttcttataaatttaagttctttgtagattctggatattagccctttatcagatggatagaacgcaaaatttttctccaattttgtgagttgcctgttcactctgatgatagtttcctttgctgtgcagaagctctttagtttaattagatcccatttgtcaattttggcttttgttgccattgcttttggtgtttcagtcatgaagtctttgcccatgcctatgtcctgaatggtattgcctaggttttcttctagggtttgtatggttttaggtcttacatttaagtctttaatccttcatgagttaatttttgtataaggtgtaaggaaggggtccagtttcagttttctgcatatggctagtcagttttcctaacaccatttattaaatagggaatcctttccccattgcttgtttttctcaggtttgtcaaagatcagatggttgtagatgtgtggtgttatttctgaggcctctgttctgttctattgctctatatatctgttttggtaccagtgccatgctgtttcggttattgtagctttgtaatatattttgaagtcaggtagcttgatgcttccagctttgttctttttgcttgggattgtcttggctatgcagacttttttttggttccaaatgaaatttaaagtagttttttctaattctgtgaagaaagtcaatggtagtttgatggggatagcactgaatctataaattactttgggcagtatggccattttcacaatactgattcttcctatccatgagcatggaatgtcttcccattcgtttgtgtcctctcttatttccttgagcagtggtttgtagttctccttgaagaggtccttcacatcccttgtaagttgtattcctaggtattttgttctctttgtagcaattgtgaatgggagttcacttatgatttggctctctgtttgtctattattggtgtataggaacacttgtgatttttgcatattgattttgtatcctgagactttgctgaagttgcttcagcaaactaaggagatttggggctgacacaatggggttttctaaatatacaatcatgtcaatatgcaaatagagacaattagacttcctctcttcatatttgaataccctttatttctttctcttgcctaattgccctggccagaacttccaataatatgttgaataggagtggtgagagaaggcatccttgtcctgtactggtttcaaagggaattcttccagcatttgcccattcagtatgatactggctgtgggtttgtcataaatagctcttactgttttgagatatgttccatcaatacctggtttattgagagtttttagcattaaggggtgttgaattttatcaaagaccttttctgcatctatggagataattgtggctgttgtcattggttctgtttatgtgatgaattacatttattaatttgcatatgttgaaccagccttgcatctcagggatgaagctgactagatcgtggtggataagctttttttttttaattttattttattattattatactttaacttttagggtacatgtgcacaatgtgcaggttagttacatatgtatacacgtgccatgctggtgtgctgcacccattaactcgtcatttagcattagatatatctcctaatgctatccctccccccttcccccaccccacagcagtccccagagtgtgatgctccccttcctgtgtccatgtgttctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttggcttggttccaagtctttgctattgtgaatagtgccacaataaacatacgtgtgcatgtgtctttatagcagcatgatttatagtcatttgggtatatacccagtaatgggatggctgggtcaaatggtatttctagttctagatccctgaggaatcgccacaccgacttccacaatggttgaactagtttacagtcccaccaagagtgtaaaagtgttcctatttctccacatcctctccagcacctgttgtttcctgactttttaatgattgccattctaactggtgtgagatggtatctcattgtggttttgatttgcatttctctgatagccaatgatggtgagcattttttcatgtgttttttggctgcataaatgtcttcttttgagaagtgtctgttcatgtcctttgcccactttttgatggggttgtttttttcttataaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccattgcttttggtgttttagacatgaagtccttgcccgtgcctatgtcctgaatggtaatgcctaggttttcttctagggtttttatggttttaggtctaaggtttaagtctttaatccatcttgaattaatttttgtataaggtgtaaggaagggatccaatttcagctttctacatatggctagccagttttccaagcaccatttatttaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcatgatgcctccagctttgttctttggcttaggattgacttggcgatgcgggctcttttttggtgccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttctttgtatcttctttaatttcattgagcagtggtttgtagttctccttgaagaggtccttcacgtccgttgtaagttggattcctaggtattttattctctttgaagcaattgtgaatgggagttcactcatgatttggctctctgtttgtctgttattggtgtataagaatgcttgtgatttttgtacattgattttgtatcctgagactctgctgaagttgcttatcagcttaaggagattttgggctgagacaatggggttttctagatatacaatcatgtcatctgcaaacagggacaatttgacttcctctttgtgcctctggattcagtttgctaggattttattgaggattttcgcatcgatgttcatcagggatattggcctgaaattttctttctttgttgtgtctctgccaggttttggtatcaggattatgatgacctgataaaatgagttaagaaggagtccttctttttctatcgtttggaatagtttcagaaggaatggtaccagctactctttgtacctctggtagaattcagcagtgaatctgtctgttcctaggtttttttggttggtacattattaattattgcctcaatttcagaacctcttattggtctattcagggattcaacttcctcctggtttagtcttgggagggtgtatgtgtccaggaatttatccatttcttctagatattctaatttatttgcgaagaagtgtttatggtattctcagatggtagtttgtatttctgtgggatctgtggtgatatcccctttatcatttattattgtgtctatttgattcgtcttgcttttcttctttattagtctggctagatgtctacctattctgttaatctttttaaaaaatcagttcatggattcattgaagggttttttgtgtcttgatctccttcagttctgctctgatcttagttatttcttgtcttctgttagcttttaaatgttttcttttgattctctagttcttttaattgttatgttaggtgtcaattttagatctttcccactttcttctgtgggcatttagtggtataaatttccctctaaacactgctttaactgtgtcttggagattctggtacattatctcttttttctcattggtttcaaagaacttatttatttctgccttaatttcattatttactcagtagtcattcaggagcaggttgttcagtttccatatagctgtgtggttttgagtgagtttcttaatcctgagttctaatttgattacactgtggtttgagagaatgtttgttataatttccattcttttgcatttgctgaggaatgttttacttccaattatgtggtcaattttataacaagtgtgatatggtgctgagaagaatgtatattctattgatttggggtggagagttctgtcgatgtctattaggtccacttggtcaagagctgagttcaagtcctgaatatccttgttaattttctgtctgttgatctgtctaatattgacagtgaggtgttgaaggctcccactattattgtgtgggaggctacatctctttgtaggtctctaagaacttgcttcatgaatctgggtgctcctatattgggtgcatatgtatttaggatagttagctcttcttgttgcattgatccctttaccattatgtattacccttctttgtcttttttgatctttgttggtttaaagtctgttttatctgagactgggattgcaacccctgcttttttttcctatccatttgcttggtaaatattcctccatccctttattttgagcctatgtgtgtctttgcatgtgagacgggtctcctgaatacagcacactgatgggtgttgactctttatccaacttgccagtctgtgtcttttaattgagacatttagcccatttgcatttaaggctaacattgctatgtgtgaggttgatcctgtcattatgatgctacctggttattttgcccattagttgatgcagtttcttcatagtgtcaatggtcttcacaatttggtatgtttttgcagtggctggtaccagtttttcctttccatatttagtgcttccttcatgagctcttgtaaggcaggcctggtggtgacaaaatctctcagcatttgcttatctgtagaggattttatttctccttcacttatgaagcttagtttgactggatatgaaattctgggttaaaaattcttttctttaagaatgttgaatattggcccccaccctcttctggttctggcttctaggatttctgcagagagatctgctgttagtttgatgggcttccctctgtgggtaacccaacctttctctctggctgcccttaacattttttcctttatttcaaccttagtaaatctgacgattatgtttcttggggttgctcttctcgaggggtatctttgtggtgttctctgtatttcctaatttgaatactggcctgtcttgctaggttgggaagttctcctggataatatcctgaagtgtgttttccaacttggttccattctccccatcactttcaggtataccaatcaaacataggtttggtcttttcacatagtcccatgtttcttggaggctttgttcattccttttcattctttttctctaatattgtcttcatggtttatttcattaagttgatcttcaatctctgatattctttttccgcttgatcaattcatctattgatacttgtgtatgcttcacaaagttctcgtcctgtgtttttcagctccatcaggtcatttatgttcttctctaaactgattattctacttagcaattcctctgtcctttttgcaagagtcttagcttccttgcattgggttagaacatgctcctttagctcagaggagtttattattacccaccttctgaagcctacttctgtcaattcatcaaactcattctctgtctagttttgttcccttgctggcgaggagttatgatcctttggaggagaagaggtgttctggtttttggaattttcagcctttttacactggtttttcctcatcttcgtgtatttatatacctttggtctttgacgttggtgaccttcggatggggttgttgtgtggatgtcctttttgttgatgttgatgctattcctttctgtttgttagttttccttttaacagtcaggcccctctgctataggtctgctagagtttgctgaaggtccattccagacccatttgcctgagtatcaccagcggaggctgcagaacagctaagattgctgcttgctctttcctcaggaagcttcgttccagagaggcacctgccagatgccaaacggagctctcctgtatgaggtgtctccccatcaggagtcatgggtgtcaggaacttacttgaggaggcagtctgccccttagcagagctcaagcactgtgctggaggatccactgctatcttcagagcctgcaagcaggaacgtttgagtctgttgaagctgcgcccacagccgccccttccccccaggtgctctgtccaagggagatgggagttttatctataagcccctgactgggacttcggcctttctttcagagatgccctgcccagagaggaggattctagagatgcagtctggctatagccactttgctgagctgcgactggctccaaccagttcaaacttcctggcagctttgtttatactgtgaggggaccagaaccctctttccaaaatctgtgtagcccttaagtctgtatacataaactccattttaaaatgttaaaaactggtcatgaacacaattcaccaaggtggtatgaaataattaagcatgacctagttcagtaaattgcaaggttggcaacacactgctccactagtgtcaactatgacaattaaaacagagcttctcctggccagatgcagtggctcacacctgtaatcccagcactttgggaggccaaggcgggtggatcacgaggtcaggagatcggaccatcctggctaacacagtgaaaccccgtctctactaaaaatacaaaaaattagccaagtgtggtggcaggcacctgtagttccagctactcgggaggctgaggcaggagaatggcgtgaacctgagaggcagagcttgcagtaagctgagatcgtgccactgcactccagcctgggcgacagagtaagactccatctcaaaacaaacaaacaaaaaaacagcttctcctaaggttcagcaaatcatgccaactactatagccctgagctattggaagcagaaggtggtgagtgaagatccaaccccaccatttatagtaaccccagggaatcaatgagaaaggtttcttgccctcaacattcaggaatgaatcaaaaatgggtcagtgaaagagctcgtgccaggtagttcaataaaaggaatttactatgggaaactagttgctcaactattgggaaagccaaaaggccaaatggggagagtgggaaaaaataacacagagattaacaacagtgagaagtgtctagtgtactcatagacaaaagggcaaagacaaaagctattgatatcctgagagctccggctatccaacaatgatgatatcacaagaaaggagttgtttggcaaaaccatgaatgtaggtgtagccactgctggagatgccacccaaaggagaaagaaaaagaaatacctaggcttcttccttcttcctgccctacagacacctgcaagaggttcctcttagctgaggtagctagaagccagttgacaacgaagcctgggaaatgcgattttcagaattttgtccctaacactacagagcaaaggtggaaaatggaattaattgcaaatagtcaaatgacctgcacaagatattcctaaaccttcagatgccaactcaatttgaaagctgtatgataacccataatttgtacagatttttcaatactgaagtatattataaaaatattattattttatggagcatgaagaataaaaacatagataacattctagtttgctagttaatatttcttcaagtgttatttacaaatgggaagaagcaataacagtaagtaaaaagtaaattttaactgaaaattatcatgttctggttatcactagaaaaattatgtcttagaatttacactaatacatacacatactataatcattctagtggtaccttaaattgttatttaaaaaaaactcaaccatatttaataagatgatgtgtctccttttgtgattattttactactaaagcataagagggtggtttatgtgcatcgtaagtccccttcaaagctgtttctcagattacttgaaaagagcagttgaagaggcatgcaaacaggtttcaatatgcccaattcatatttcttcaattgtgctttccaaggcctttaagtttagctgttactatagaaaataccatcattcttagaggaaaattatttgggaatgaaatatttcaattcctccttgttaagaaagcagagaaaataggaaagaaaaatatataccagtagatacataactgttatatcaaaatataattcagtaaggaggtcagtaatcttataaacaaattaaaactatattataatagaagttcagatttgtttcaattatgagtcagaaacaaggaacagaattaaatttttggtctacagttacagagttaccaatatttctccagcagaatttctagacatagtgaaactctcctttatatttaataaccatgcttttttcctcctaaatgtcctattttttctctaaatgagataatggccttataaggtggcatgttctggcataaagtaacagtattagtaaaaatgaaatttctatcagatctcatgttaaagaggtcatcaaatgaaagcatttggattttatcctgaaaacaatggggagccatgacagattttgaggaataatgtaatataatcagattatttgcattttaactttggttgcatagtggagcatggaccagagagaggtggagtagttagaaagctgttgtacaagtccaaggggacccatgttgaggaccttatataggatagaagctacagggttaaaacagttgtgagatattatcctcatacatttaggtgttgtgatatattacaatcatccatttaattacaaaaagagggaaacaagaatgcattgtacaatactttctcctattataattctatgagggaaattccacgagggacaagaagctaaacccactggtcaggacaaaaattttggggtagtaaaacaaacagggcagcaatacatataattcaggaggatccacaagacagagctgtgataaagggtgagattatagagaggaacccaacaaacagggagatacacacaagccagattcagagtgtggacataggtacatttggtagaatttggctataaatatgtctggtccagggtttttttttggttggtagtctttttattattgattcagtttcagaactcaatattggtctattcagaatttcaatctctttctgattcaatcttgggacatagtgtgcttccaggaatttaaccatttactctgcactttctaattggtttacataaagttgttcatagtagtctctggggatttttgtatttctgtgggaatagttgtaatgttgtatttgtcattcctgattgtacttaagtggatatttttttctttgtttatctagctagcagtctatcgatcttgtttactctttcaaaaaatgaacccatggtttcattgatggtttgtatagatttaataactagtatcaatcctagtgaaactattccaaaaaactgagaaggagggactcctccctaactcattctatgaagccactctcagcctagtaccaaaaactggcacagacatgacaaagaaaggaaacttcaggtcaatatcgccaatgaatgcagacacaaaaattctcaacaaaatactagaaaactgaatccaacagcccatcaaaaagctaattcaccacaatcaagcaggctttattcccaggatgaagtcaataagtgttatctaccacatgaacagaattaaaagcaaaaatcatatgaccatctcaatagagaaagaaaaagttttccataaaatccaatatcccttcatgataaaaaccctcaacaggcagacttgttatcaaacagacatacctcaacataataagagccgtctctggcaaacctatagccaacaccatactgaataggaataagccggaagcattcacattaagaaatggaacaagacaaggatgcccactctcaccactcttattttacatagtactagaagtcctagccaaagcagtcaggcaagagaaagcaataagaggcatccaaacaggaacagaagaaattaaactatgttttgtcacttgcaatatgactgtatacttagaaaaccctagagactccagcaaagggctcttaaacctgacaaactattttatcaaggtttcacaatatcaacatacaaaaatcagtagcatctctataaaccaataagcatccagaatgggaatcaaatccagaacacaattccatttattatacactagccacaaaaaaatgaaatacacaggactacagcttaaacaactggttaactgaggcaactacaaaacactgctgaaagaaatcagagatgacacaaataaatggaaagacataccatgctcattgattggaacaatcagtatcattaacatggccatactgtccaaaacaacttacaaattcaatgttatttcaaccaaattaccaacatcatttttcacagaattagaaaaaaatcataaaattcatatggaaccaaaaaagagtccaaatacccaaagtaatcctaagaaaaaagaacaaggctggagaaatcatactatctaacttcaaactatactctaaggctacagtaaccgaaacagtatggtgctggtactaaaacggacacagagatcaatggaacagaatagaaaatagaggcagaagaaatttctaagcggcaaagcatacaagaggtgacttgggtgctgttaaaggcattcagttttataagggaagcagagcataaaagttcagaaaatttgcagtctgacaatgtgataaaaaaaaaaaaaaatcccaccggcaccacggcctttgtctcacagtcaggcggagcaggggcagccattcctgccagaagccagggcatgacccctgggctgcctgtctccacagacccagtgagaatctcggcctcctcgagcgtgtcctccacctcgtacctggcctcgtccttgcacacagtctcctcctcacacccggcctcctctttgcacccagcccatattcacgtgcagcctcctccttgtgcccagcctctactcatgcctgccctctacctgcatgcccgacctcctgaagtccgcgccaagctccccaaccacagcctctgcctctgaaaggaccacccacactgcattggaggagcatgtgacctttgaggacatggtggtggacttcagccaggaggagtggaggcagctggagcctgcccagagggccctgtactatgatgtaatgctggacgccttcaggcttctggtctctgtaggacattggttaccaaagccaaacatcacctccctgctggagcaagaggcagagccatgggcggtggactctggagttccccaaggcatgtacccaggtgagatgggagcccttcagggctgagagaagcctgtccatgcttgctccctggtttctctgtctgcatgtgctctctaattcttcagagcaaatttactactcagtcttaattcttcacagcaaatttactactcagtcttagtgaagatttaccaagcacccattttgctgtgagtgacgacaccaagtcctcatctccactgaatttacattcttggtgagggagtgggggagacaaacaataaatcggtaaaataataataataataaaatgagttggatgattacagattgtgatgaatgctgagaaaatgaaaatgagtgatgaggtagactaggatgggggtgaggagactttagcagagagatgagggatagcctctctaaggaggtgacatgtgacttgaagcctgagccatgaggcagtctgagagaatactagcatttcaggcagaggaaacagcaggtgcaaaggcctgaagtgatgcatcagtcagttctcgcatagtaaaagcactctgacctcagtggcttaaaccaaataattgtttataattcatatgtctgtgggacaatggatccaggctgggccctgacatgtgcctgtagggtgattgataggtagcagagatatcccagcccactgacaggcaatttcccattggcatcaggtgggaagagtggcctgtcaccagagtccaggaggaatggccaatgtgggagagggtcacattagggtccctccacatcaataacagacggggtgttgctctcttgcccaggctagagtgcagtggtatgagcatggttcacagcaacctcgaccttctgggctcgggtgatcctcctgcctcggcctcctgagtagctgggactgcaggtgtgtgtcaccatgcctagctaattttgtgtgtgtgtgtgtgtgtgtgtgtggagatggggactcagcattttgcccaggcatgtcttgaactcccaggctcaggcagtcctcctgccatggctgcccaaagtgttaagattacaggcatgaggccctgtgcctggctaagaatccatttatttgcatttttcagcttctagaggcacccacattccttggctatggccttgtccatcttcacagtcagtaaggggtggtcaagtctcacatcttattcactctgactgtgacccttctgcctcttttccacatttaaggacacttgtgattacacaggtccactcagataatccagtataatttctctatcttaatgtcagctgattagcaatgttaattcctccctcccatgtaatgggaaacatacaggttctatggttaagatgtgggcatcttgggaagccactattctgccagtcacccctggcttaccttttttttaaaaattgaacttttcactgaagtataacaatatggggaaggtacccacatcacccctctaggccactgtggggtcagggtaggggcagcatgcacccaggtcatggctgtgcagagatggctgggtagcagggcaaaaagggagtcctgccaggaagcaggaggaaggagtgcatttgttcattcattaagcatgtatattgaggtcttgctatgggatagagatacagtggtgagcaaggtggacagaaactcctactctcagggggttcccatttagtgaaacagacaaaataaggcagatcaaagtactttaatacaccaagggtcatttatcttcctcctagtgatgcatgttgcagctattcctgtttgtgggaagcagataggctcctttacatctagagtgagatggcacaacagcatatgctgccaggaagaagctgggtgtcagcagactttccccatgcagcacctttttctctgttgccacctggcatcatggaggccactgtagctggggcctggctgccacattgctccttccaagtccagtgcatctgtgcatctgagtgctctctccctgggcatcccctctgcaccctcctctgtgctcccctcacagactctacccatattccttgtgccaactgtttttcccttcctctcctcttcctttccttattctgttctttcctcttcctttccttattccttattttcctcttccttattctgtttttccctctctctcttcctttcctggtttgcaaaactatatttttaaatagtcaaagccacttgcaccttgaacatttcaaaatcattagtttcatccttcctcttcccatctcaccacaaactcttttgccctggaacagagattaagggacatttccagtttttgcttctttcagacttggaaactagacccaaagtcaaactgtcagttctaaagcaacgtatctctgaagaaatatccaacaatgtcatcttggtagaaagattcctctgggatggtctgtggtactgcaggggtgaagacactgtgggccactgggaatggagttgtgagagcctagagagcctggcagtgctggcagccttgatgcctttgaagatgcctgttcaggagcagtgacagaggaatgggtttggggaaaacagaagtctgaaccctgatttcctacatcaaccaatgactcctgaacaacaaggcccccacacgtggggaacacgtggaaaaagggagaagccagacctaaatgctctacagaaaacctatgtaaaagagaaaccctacaaatgtcaggaatgcagaaaggcctttagtcacagctcagcacttacccaacatcaccgtacgcatacaggacagagaccttatgaatgtcacaaatgaggaaaagtcttccgaaacagctcggcacttaccaaacaccagagaatccacactggggagaaaccctataaatgcactcagtgtgaggggaccttcaaccaaattgccccactgatccagcaccagagaactcacacaggcgagaaaccctatgagtgcagtgtatgtgggaaatccttcagttttatgtcctcctttagccaacacaagtgaactcacacaaacaagaagccctatgagtgcaacaagtgtgggaaagccttccagcaaagcatccacctcacccagcacctgcgaatccacactggggagaaaccctatcagtgtggtgagtgtggcaaggccttgatccatagctagtccttgaccaaacaccagcaaatccacacaggggagaagccctacgagtgccatgagtgtggaaaagccttcacccagatcacaccactgattcagcaccagaggacccacacaggagaaaagccctgtgagtgcagtgagtctgggaaagccttcagccagagcacattcctgactgagcatcagaggatttacacgggagagaagccctatggatgcaacgagtgtgggaaaaccttcagccacggctcctcacttagccagcaggagcggatgcacacaggagagaagccgttcgactgcagtcagtgtgggaaggccttccttctggcagagcacaaacctcacacaccagcaaatccacacagggcagaagccctacaaatgcaatgactgcagcaaggcattcagccacagcttgtccctcaccaaacatcagcgaaaccacactgaggagaagccctacaaatgcaaccagtgtggcagagccttcagtcagcttgctcccctcattcagcatcagaggatccacacaggagagaaaccctatgaatgtaaccagtgtagccagagctcccttctcatcaaacaccagaggattcataccaaggaaaagccctatgggttcaataagtgtgggaaatccttcaaccacagctcctcactcagccagcacaaaaggacacacactggggaaaagccttatgagtgtcacgattgtggaaagtcctttaggcagagcacccacctcacacagcactggaggatccacacaggagagaagccatatgcatgcagggactatggaaagacctttacacacagcacctcccttaccaagcaccagagaactcacactggataaacccactccacatgtgctggggacataggaagaccttaagacatagctcatccctttctagatttgacccaatcatacacatgagaaacatatgtctttatcaacagggtggaaacagactaatacaaaagtgaagagacaatccactgaaggaaagaagtatctcatgtactccataaatatatacacctattaaatattttaatttcaatctttgtggttacatgataggtgtatgaccaagctgagaaacaactcaaggaggcaaccccatttacaacaactacaaaaaaataaaatatctaggaatacatgtaaccaaggagatgaaagatttctactagaaaaactgcaaaacacggatgaaaaaaatatagatgacataaacacatgaaaaaacatcccatactcatggagcagaagaattaatactgttaaagtgatcacactgcccaaagcaagctacagattcaatgcaatccctctcaaaatactgacattatttttaacagaactagataaagcaatcctaaaattcatattgtacccaaaggagcccaaatagccaaagcagttctaagcaaaaacaacaaagctggagatatcaaattatctggcatcaaattacacatactacaaggctttattaaccaaaacagcatggtactggtttaaaaatagacaattaacatcaattaaagaatagagaacccagaaataaagccacctatctccagccaactacacatacattgggaagaggacattgttttcaataagtggtactggtaatattggattgccacctgcagaagaatgaaactagactcctatctcttggcatacacaaaaatcaactcaagatggattaaagacttaaatgtaagacctaaaactataaaaatactataagaaaaactatggaaacctcttttggacattggtctaggcaaataattcatgactaaggcctcaaaagtataagcaacacaaacaaaaatagatctatgggacttaattaaactaaaaagcttccacacagcaaaagaaataatcaacacaatgaacagacaacatgcagaattgggagaaaatatctgcacactatacatcggacaggggactaatatccaaattttatccaatttttacaaaaatgtcacaaaaaagtagatatccaaatatccaaaatttataaggaactcaaacaacaaccacaacaaaatcaataaccccattaaaataagcaaaggacatgaataaatattttttaaaaaagaacattacaaatggcaaataaacttgttttttttttttttgagatggagtctcgctctgtcacccaggctggagggcagtggcgcgatctcggctcactgcaggctccacccgccaggttcatgccattctcctgcctcagtctcccgagtagctgggactataggcgcccgccacctcgcccgactaattttttgtatttttagtacagacggggtttcaccatgttagctaggatggtctcaatctcctgacctcgtgatccgcccgcctgggcctcccaaattgctgggattacaggcgtgagccaccatgcctggcccaaacatatttttaaaatgttcaacatcattaagcatcacagaaatgcaattaaaactacaatgagatatcttataccagtcagaatgactattattaaaaagcaaaaaaataatagatgttgttgaggatgcagagacaagagaatgcttatcaactgttggtgggaatgtaaattagcacaacctctatggaaaacagtatggagatttttctaagaactaaaaatagaactaccattcaataccattcaattcaaagatatttttctaagaactaaaaatagaactaccattcaatccagtaatcccactactgggtatctgctcaaagaaaaagaagtcattatgtaaaaaagttacttgcactccaatgtttattacaatactattcacaatagcaaagatgtggaatcagcctaaatgtcactcaatgcaggattgcataaagaacatgtgatatacaatggaatactattcatccataaaaagaattaaatcatatcttttgcagcaacatggatggaactggaggccattatgctaagtgaaacaactcaaaagcagaaagtcaatacacatgttctcatttataagtgagagctaaataatatgtatacatatagaacgtggaataatagccccttgagactcagaagggtaggaggggtcagggaatgagagatgagaaattatttagtcggtacaatgtatattatttgggtaatggttacactaaaagcccaaactttaccactacgcaatatatcaatgtatcaaaactgtgtttgtaccccttaaatttattcaaataaaaaactttaggtgctaatgatgttatatccaacagcagaaagtccatggcatgaaatgtttatagagatatgcaaaataactgcactagatattcctaatcaatcacttttaagaagcaaggatctatgtgactttgtgtatgatactatcaaacatttttgaaaatttaatgacattggctggctactcccaatgttactggacaacatggttaaaaaaaggtggggggatgagttcagggattcaaactcccagcataaacacctaataaataacctaagagcttctgtgtgtaccctgaaggagacctttactttctgtggctgcaaggctgaaattgctgaagatcaaatgtagaacctcatcctgtgacttaatgaattacaaggcaagttaaacaccagcctggcagagtgcatatgttaacatgagggcattgatttggaaacacgggattgtgaaactcaggatgtggatgtgtgggaaggccctccagggtcattgacactctaaattctgacgagtcttctttgccctaaataatatttaccctttctaagatgtcctcattcatctaatttattattattattattattattattattattattattatgtatattctggtaagaaagctcacatctttaaacaaagtatacatacacacacacacacacacacacacacacacatacatacattaagatggatagtaggtatcatccctcaataaaatgtaagaaaactggctcctttgtcaagccaagatttgaaccacagcctgaaccaatatctgtccacttaaccactctactgcaagtctcatgtattactagcatagatctaactgatacaaccaattattcataaattgttgggaaaatatgcattatttatttggtgattacatggtaagattgaacaatttcttttactgagtttttttgtaaaggatggaagaagactgcagtggggttaaagaaaagatgttatgagaaaggaatctgaattattgcaggctgtatgtaaatcaagacatttaatcttttaaatgaggataatctttattcccacagaggtgtaattattgtaaagggtccttatgtctttaacataagaaagaatcaaagatattatgtaggcatcaagtacatacaagacaaggcactagtacaagatttatagaaaataaaaagccattgttcttaattatgcggacagtattcaggtctggttggaagtacaatactacaatactgcgtaatgactgaatcatgtcctctcaaaattcctaagttgaagtcctagcatctttatagaggtaatcaagttaaaataaggtcattaaagtagttcccaatccattgtgactgacatttttgtaaaaagtggaaatttggatatagacatacagggagaacaccatgtacagatgaaggcagagattagagtgatgcttctgtaagccaaggaacaccaaagattgctaacaacctgtaggaagctagggggagaaacatggaacagattcttcctcataattcttagggggaaccaatcctgctaatctcagacttctaatctccaggactgtgagacaatacatttctgttttataatccactcagtttgtggtactttgtgacaaactgagtactgtgaaagtaagaaacaataaacatctgttgtttaacccacttcgtagtactttgttatatcagccttatcaaacctatacaatatgacataatcaaagagcaacaccctgcataaacaaattttcaattgtttggtataaacaaccaatgtttttaaggttcagaaaaaactattatataactgatattggtatgtcccttcagccacacatacacatacttatgcacacacatgcatacacattattcagaaccaatgaaaattaataattatttgtaaaataaaattatgtttacctttctcactaatattttcaacatattctgagtctctactgtgtgacaattagagcatgaggctcagaacatcaagggctaaagaagacctagtccctactggatgaaaatacacaatcaagtcctcatctccactatcagaacacccacagcatttgccaattacgaggaaattttacctctgctctttagtttgtattcaattaaatctgctatctaattgttttatagggaagcctcttctccccctaaaactaagttctactgtaagcatgtcatacagaactagatagatattattcaataaatcgtaattgataatacagtcaaacatgagggttttattccaaaaaaataatatcttggaaagtagtttctaaaatataagctactatgtaagcatttgttaatattaccatcaattatatttttaatcatttataacaacaaaaatttgatattcccaagttagttccttcaaaattttttcccataaaacttgtcccattattgtgaaatattaaatgagttgaattgcactgaatggtcacataaaattcaattctgaaaaaagaaatgccttaccagacaaacttaaaaggaaaagcctttaatatacttaccactttcaaagcaagcatcaaagataagatgtcctttcttgggctgtccacaatagccagttggaagcactatatatttgctcacattccctccaatggcatcatcatttcccatatcattgcctatttaaaaaaattgaaataaaagtcaaagtatattcggcaattgaagtctagtcagatttttactgttaattaccccttccctagtcaccaagtgttaacccaagcaaaaagaagttaacaccacattgtggtacagtgaaaaaaggctacattttgaaacaaaatgatatagggtcaaatttcaactcaaataactgctaattctctatgccccaaagcaatcaacctagtatctttacacttcagttcctctcatccataaaatgtgaacagtaaactcatcttccaaagttgtattagaattgtatataaactatatctactatcattatcaaaatccaagagatattcattaaattgcatcaaccatttaatatataaataattcacataatttgtcataaacatatattcaattgtttaaatttgaataaagcagtcattctataaatagcattatgacttccagatgctccaccagaaacaatttgagaaacactgaattagcatagaagttctatttcctaacaggaactttaatttttaaaagtttttgaagtttcactttcacctaagatgtagaaaaatggaaagagcatcccttctaccctaacaacaacaaatatctcaattaagtacaaaattataactttcccaaatctatcagagagctgagtttgaagagcagctaaataatccaatatcgaaggaaagtcaagcctcaccaaaaagagtatgggaagcaagcagtgactccttcatggcagagcacaagaagaagtaatgctgggtcccatacaaatgagtaagaaagctaagctaatttttaaatattattaaacatcaaataaggaaatatgagagtgtggaactactgagtcatagacacacagggaattcacgtccatttgaagactctgctgtacaggtctctaccaggtattcagaaggaagattacaggcaagtaggtagaccagaaaatgttttcctctgtggtacaggcctagagaaggggagagacttctgtaataggaaaggcatgaagtctcttatgggaaaaacagccttacacgactaggggagaaataacgaacttatcacctgagtgcaaaagtgagaggaagaggaacaataaaagaaaaatcctctacacctgaaggagcagcaggaaacattcccagagaatactataaatattattcatcactataaatggatatacctctttccaggtcatttgtgtaggggcttgtgtcaacctagtctggaaataaactaggtttgagtttcactgttgctatggtcatcttaaatactcaatcaccccagccagccccttccctcaaaaataaaatagcactagaataatttgaagctaattggaaactgaagataaccatagcaacaaagaaactcaaacacacctgaactccaagctaggttgacacaagcccccacccaaatgaggtggaaagagatatccatttatagtaacaaataatatttgtaagtactgtaaatactataaaacagtagtattctctactcttctggtattcaataaaaaattgtgagacatagccaaaatatcaagaaaaaacaacctactgtctagggataaaatgatacgcaggaccagacacagaaatgaccagatactggaattatcagacaatgatttttaaataaagcttaatatgttaaaggctgtagtggaaaatgagaacaaaattcatgaagaaatgggaaatttcatcagtaagacagaaaccacagtaataatacaaaaggaaatgataaaaccaaaaatcacagtaatagagatgaagaatgcctttaatgcattcatcagtacacttgggacagctgaaaaataaatcagtaaactttagatcaataaaaatattctaaacataaatgcaaagggaaataggaaaggcaaaagggaaaaaacagcagagcatccaagagctgtggaacaatatcaaccaatctaaaatatatgtataattgggattcccaaggatatgagagtaagaatgaagcagaaagatacctgaagatataacacctgagaattttccaaaattaatgaaagatattgaggtacaaatccaaacagtaactaggagaataaatatattattaaaaattatgttatatttaaagagataaatcacatacaaatgacctaagataaaaatacatatttctctttgaaatatataaactgtgcaaaccaaaagtcaaggtaatgatatattgaaattactgggaaaaagtcaacgtaaaattttataccaactgaaaatatctttcaaagatgaagtacaaactaaaggtattttaagaaaaataaaagctgagataatttattatcaacagtcctgtgttgtaagaaacgccaacaatagttcttcaggcagaagggaaataataccagatataaactaagatccacacaaagaaattaagagctccagaaatgatataaataaaggtaaatataaattttcttattttcaatcactctaaaagataaatcactatagaaaaaatagcaatgtattgtctgtttatgccatatggaaaagtaaaatatattacaaaaattgcacaaaagatagaagaagatggatgactataggtgcctgacacttgccctcattcacaaggaaggggcaagtgtcaggcccctctaaaacaagtagacaaccacacatcaaataaagtgcctaagtgagaacattggaattcagcagggaagtgacagggaccatctgaggcatgaaaggagagagaagtgaagcaactggcccatccatgattgtctcagatccaaaagaagttccccactgcaaaggaaaggtaagtaaaagatccccagtgctgcacattcccatcacagatgcctgcaatagccacaggagactctagcatagaaagtcatatggagtccattgcaattgcattgttctacagaggaaactcacactctgttctactcacccccctgaagcctaagcaggtgcaacatggcaccattttgagaactaatcccccatcagactacctcttaccctggggcccagctgctcctgcacctccacatccctggagccccaaggacatcctcccacatccaaccagagggctgcagcattatgatgcctgctggacccagcaatacatctggacccccagcactgtagccatatagtgccctaaatcccctaaaatagacagtatagcacaccagggaggctacccacaggacaaaggaagccaaaatgcacagttcccagagcctgaaaaccatcttccctgggacactgccataaacagaaacaacactcctccagttgaagggccactgcaaacctgaatgcaccatcagagagcttgagaacaagcctgcctatgtatgtcatccagttttatagatggttggcatttccccaactggcactcattttctctcctgctgcactgtgaagaggtgctttttgccataattgtaagtttcctaaggcctccccagccatgtggaacagtgagtcaattaaacctcttttctttagaaatcacccagtctggggtatttcttcctagcagcatgagaatgaactaacacaaatacaaacaaaaaggttattatgtaatgataaagagatcaattcagtaagatgatataacaaatatatatatatgcccccaacaccagaacatccagatatataaagcaaatattattaaagctaaagagagaaataaaccccaatacaatcatagtgggaaacttcaaaacccccacattcagcattggacacatcatatagaaagcaaatcaacaaattatctgcacgatagaccaaatggacataacagacatttacagaacatttcatccaaaagctgcagaatacacattcttcttatcagcacatggaacagtttcatggacagatcatatgttcggtcacaaaacaagtctcaagaaatttcaaaaaatcaaaatcatatcaaatatcttgtcagaccacaatgggataaaactggaaatgaataacaagaggatctctgcagactgtaaaaatagacagcaattaaacaacatgctcctgtattaccattggatcaatgaaaaaaattaagaagaaaaatttaaaaatttattgaagcaaatgaaaaagcaaacacaacatacaaaaacctacgtgataaagcaaaagcagtgctaaggatatttcacaacaataaattactacatcaataaagcagaaagattttaacaatgtaatgctgcacatcaagaaagtagaaaagcacaaataaaccaaatgcaaaataagtagaagaaaataaataataaagatcaaagcagaactaagcaaaatagaatctaaaaaaatacaaaggataagcagaattaaaaggtggttttttgaaaagataaaatcgataaactgctagctagctaaacgatacaaagagagaagactcaaataaataaaatcagaaataaaaaaaagacattacaactgataccatagaaatacaaaggaccactagagactattatgaacaaccatgtgctatcaaattggaaaaccaagagaaaaatgtataaatttgtgaatatatataacctataaagactgaaccagaaataaatagaaaacctgaacagattaataatgagtagtaagattgaatgagtaattttaaaaacttcccaatgaagaaagcacaggaacaaatggctgtacttctgaaatctaccaaactttttaaaaagaaccaatatcaattctcaaactattccaaaaagtgaaagagaattctttctaactcattctataaaaacagcattaccttgataccaataccagagaaggaaacaacaagaaacaataagccaatttctctaatgaacatagaatcaaaaattatcaacaaaatattagctaactgaatccaacagcacatcaaaaaggatatacaccatgctcaagtggaatgtatcccagggatacaaggacggttcaacatacaaaaatcaataaatgtgatataacacatcaacagaatgaaggacaaaaactgtatgatcaccttaatagataaagaaaatgcactccataaaattcatcatcatcccttcatgtaagtgctcttaacaaattagctacagaaagaacatatctcaacacaataaaggcaatatatgacaaacccactgtaacatcatactgaatacgaaaaatctcaaagtatttcctctaagaacagaacaagacaaggatgcccactttcacttctcttactcaacatggtactggatgttctagccagagcaattaggcaagaggggaaaagagaaatccaaatgggaaaaaaggaagccaaattatccttgttcatagatgacatgatcttttatttagaaaaacctaaagcttctgccaaaaaaaaaaaactgttgaaactgataaattattaagtaaagtttcaagatacaaattcaacctatgtaaatcataactatttctatacatgaatagtgaacaacctgaaaaaaaatcaagaagtcaatcccacttacaatagctacaaaaaattgaaatgcctagaaataaatttaaccaacgggctgaaagactgcaatgaaaattccaaaacactgatgaatataaaaataaaacacgaacaaataaaacaacctcccatgctcatggattagaagaatagcattgttaaaatgaccataccacccaaagcaatctacagagccaatgtaatccctttcaaaatacaatgactttcttcacagaaatagagaaaataatcaatcctaaaattgacatggaaacacaaataccccaaatagccaacaacattgagcaaacagaacaaacatggagtcatcacactaccatacttcatatgccaaaacaaaaagccataatagtcaaaataacacagtgttagtaaataaacagatacatagacccatggaagagaataaaaaaccaaaaagtaatttcatgtatttacagacaaataatttttaacaaatgcacagagagaacatacactggggaaaggacagtctctttaataaatggtgctgtgaaaactgaatatccacatgcagaagaatgaaactagaccccatctctcaccatatacaaaaatcaactcaatgtgaattatggacttaaatataagaactgaaactataaaactattagaagaaacacttcagtagattggtctaggcaaagatttaatggctaagacatcaaaagcacaggcaacagaaacaaaaatagaccaatgggactaattgaactaaaaagcttctgcacagtgaaggaaacaatcaacaaaatgattagacaatctttagaataaaagaaaatatttgcaaattatttacccaaagggactaactctctagaatatacaaagaactcaaaaaactcaacaacaacaaaaaaataaaatatcctcattaaaaagtggacagcagaaatgaccagatatttctcaaaaggagacatacaaatgtccccaaaacatatgaaaaaatgctcaacatcactaatcatcaaggaaaggcacaccaaaccacaatgagataccatctcaccccagcagaatgactactatgaaaaggataaaaaatagcaaatgcaggcgaggaagaaaagaaaaggcaattcttgtataccattacaagaaatagtggaaatgtaaattagtacattagtacatagacacgatggagcacagtataaaagttgcctaaatatctaaaaataaaagtaccatacaatccagcaattccagtacaggatatttatctaaaggaaacaaaatcaatgatatatttatatatctaacagacagattaccatattggttaaaataggaaaatccaatgatatactatttatagaaaattgtttaaatattatataaagtcatgaatagattataagaaaaaggattgaagggaccacgcaaacaataataaaaagagagctcgagaggctatattaaaataagagaatgtagacttaagaccaagaactaaaactaggactaaagaccaccatcaaatagtgataaaggagtcagctcaccaagaccaataatcctaaaagtatacacacctaacaccaccacttgaaaatgcatgaaaaaggccaggcaaggtgcctcacacctgtaatcccagcactttgggaggctgaggcggcagatcacctgaagtcaggagttcaagaccagcctggccaacatgacaaaaccctgtctccactaaaaatccaaaaattagcatggtgtggtggcaggtgcctataatcccagctacttgggaggatgaagcacaagaatcacttgaatctgggaggcagagtttgcagcgagctgagactgcactccagcctgggctacagagtaagactctatctcaaaagaaaaaaaaaagaaaaagaaaatgcacgaaagaaactaatagaaataaaagatgaaatatacaaaaccacaattatgtttaacccttcaatacgactatttcagtaatcaatagaattagttgacatattagcaatatcaggaatgaaaaggttaacatccctaaaagccactgggcattattaagaggataatgagagaacattatgaacaatgttaactcctaattttgtgaacttagatgaaattactaagcagatgaagacattaaacaagaagaaaactaaagactggtattccttctgaacatagactcaaaattctcagcaaagtattagcaaatcaaatccatcagtctgaggaaagtatatcatgaccaagcacaatttatcttgggtgtgcaagatcagttcaacattcagaaatcaattaatgtaattcaccatagtgacagatccataaagaaaatctatatgatcatctcaacaaatgcacaaaaaaagcatttgacaaaattcaaaattcagtagctacttattctcagcatatgaagaattaaaacggaattccttgacatgataaaaggaatctttatatctttatcttacataatatgtaattatgtattttttaatatacttaaattatatttaattgtgaaagactaaaaattaccccccagtattgtttactagataaggatgctcactgtcatcactcttattcaacatcatcctaaagtttctaaacgtgcaataaacaaagaaaagaaattaaagctgtacatactgtccctattcatacacaacagaattgtctagagaaaaaaatcacaaagaagttactaaaaagttactagaataaataagctcagaaagattaaaggacaaaaagtcaatagaagaaatcaatcatatctctatataattagcaataagcaattgtaaattaaaaattaaaatcagtaatatttgtaacaccaataaaatttataaatctaataaacatttgcaaaatctctactcttaaaactagaaccactgataaattttaaaaaggtctaaataaagggagaaacaaaccttgtgaatggattggaaggctaaatgtcaaaatgtcaattctccatatatcgatctagagattcaatacaatcccaactgaatactcaaccaactggttctaaaatgtatatggaaaagcaaacaaactaaaaaaaatcaaagcaattttggaaaaaaaacagtgtggggttggaaaagagactgaaacatagtttactggaataaaactaaatgcagaaatgcaaacacttacatggtcaattgattttcaataaaagtgcaaaggcaattcaatgtagagaagaaaatatttactaattggtcatcaataatccacatgagtctgggctcagtggctcacgcctgtagacccaccactttggaaggcagatgcaagtgaatcgcttcagcccagaagtttgagaccagcccaggcaacatagcaaaactgcatctcaacgaaaaattttaaaagttagctggcagtggtggcacatgccactagtcccagtaactcaggaggctgagatggaagaatcacctcagcccaggagctcgagactgcagtgagccgtgattgtgccactgcactccagcctgagtgtcagacagatgctgtctcaaaaaaatagtaataaggaggcagataaagataaagaaatagaaagctccataaattatccccttccccagcaaaaaaaaaaacaaaaaacaaaaaacaagttaacaactatctacacagaaaaaaacaccttctgtaagaaccaaaaatcagatgagcactgacagtacctggttttaacttcatatcactgaaagaggcactgaagagatcacaaaaacagtcctgaatcaccaatgcgacccctccccaacccaggcagctacagagtggtgcaaagagcatctctggctgctgagagggggagaacacagtaattgtgacgcactgaactcagtgctgttctgttagagctgggggaagaaaaacagaccaaactcagctgatgcccacccacagagagagcatttaaatcagcccaggtcccattgtgagtgcccacacaccttccaccaagggccaaagtgctcttggtctccaagtaaacttcaaaggcagtctaggccataagaactgcaacttttaggtaagcctagagctgaactaggccagagacattggactggaaggggcacgtgagatactgagatatcagctggggcagccaaggaagtgctggcatcacccttcccctaaccctaggctgtagagcttgtggttccaaaagaaacacttccttctgcttgaaaagaggaaagaaaagagtagtgaggactttgtcgtacatcttggacaccagctcagccacagcatgatagggcactggtcagagtaatgaggcccctgttccaggccctagcacccagatgacatttctagacacaccctgggattttgtagaggagcaccaccttgatggtcttggagaactttttcaaagttatttcaatctctacgttaaattcatctgatagaattctgaattccttctctctgttatcttggatttgagctacctcaacacagctattttgaataggtagcccagaaaacagagagactctgtatatttattagaaagtaggggaaaagataaagagcctctgcctgctaatccagagaatatactcagatcttctccaagacgatcaaggtggtacatctctacaactctgctagaaccacaatgtaactgggcttggggtgccccctaaagcagatacagcttagatcacagcacccaagtccttttgaatatctgaaaagcctttacaagaaggatggctataaacaagcccagaaactgaagactaacactaaatacctaactcttcaatgcccagacaccaaaaaacatctactagcatcaaaaccacccacaaaaacatggtctcaccaaacaaacaaataaaacacaagagaccaatcctggaaaaatagagatatgtgacctttcagacagagaattcaaaattgctgtgttgaggtaactcaaagaaatccaagataacacagagaaggaattcagaatgctatcagatacatataacatagagattgaaataccttttaaaaactcaagcagaaattctaaagctgaaaaatgcaattggcatactgaagaatgcatcagggttcttcaatagcagaactgatcaagcagaagaaagaattagtgagtttgaagacaggttatttgataatacatataggagacaaaaaaaaaaaaacaatgaagcataactacaggatctagaaaatagcctcaaaatagcaaatttaagagataatggccttaaagaggaagtagagaaagaagcggggttagaaagtgtattcaaaggaataacaccaaagaacttcccaaacctggagaaagatatcaatatacaagcacaaaaaggttatggaacaccaatgagatttaacccaaagaagggttacctcgaggcatttaataatcaaactcctaaagatcaagcataaagaaaggaccctaaaagcagcaagagaaaggaaacaaataaatacagtggagcttcaatacacctggcggcagacttttcagtggaaaccttacaggccagaagacagtggcatgacatagtcaaagggctgaaagaaaaaagcttttaccctagaatagtatgtccaacaaaaatacccttcaaatatggaggataaataaagactttctcacacacatacaaaaaaagctgaggtatttcatcaacaccagacctctcctataagaaatgctaaatgaagtagttcaatcagaaggagaaggatgttaatgagcaataagtaattacctgagggtacaaaactcaatggtaatagtaagtacacagaaaaacacagactattttaacattataacatagaaaacccaaggaaaaattatactacaaaactacagtaagcaaaacagcatggtactgacataaaaacagacacatataccaatggaacaaaatagagcacacagaaacaaacacatgtacagtgaacccatttttgacaaaggtgccaagaacatacactcaggaaaggacagtctcttcaataaatggtgctgggaaaacaggatatccatatggaaaatgaatctagacccctatctctcaccatatacaaaaaatcaaatcaaaattggttaaataccttaagacttcaaactatgaaactactacaaaaacacattggaaaaaatcaccaggacattggtctggccaaagatttcttcagcaatgtcctacaaacacagacaaccaaagcaacaatgaacaaatgacatcacatacagttaaaaagattctgcacagcaaaggattcaatcaacaaagtgaagagacaacccacagaatgtgagaaaatatttgtagaaatttcatctgacaaataattaataacaagaatatataaggagctcaaataaccctataagaaaatttctaataatctaatcaaaagatgggcaaagatttgaataggcattttggaaaagaagacataaaaatggcaaacaggcatatgaaaaggtgttcaacatcactgatcatcaaagaaatgaaaatcaacactagaatgtcttctcgcctctctcaaaatggctaatatcaaaaagacaggcaataacaaatgctggtaaggatgtagagaaaagggaacccttgtatactgttggtgggaatgtacattagtccaaccaccatggagaacagtgtggagctttctctagaaactaaaaatagagctaccatatgatccagcaatcccactgctgggtatataaccccccaaaaaagaaatcagtatatcaaagagatatctgcactcctgtttgatgcagcactttgggaaaaaccgaagtgttcaccagcagatgaatggataaagaaaatgtggtaggtacatatacacaatggagtattatcagccataaaaaaaatgagatcctgtcatttccaaaaacatagatagaactggaaatcatattaagtgaaaaaagccaggtacagaaagacaaacattgcatgttctcatttatttgtgggatctaaaaatcaaaacaattgaactaatagacaaagagagtagaagaatggttacccaagcctggaaaggatagtcagtggctgacaggcaggtggatatggttaatgggtacaaaaaaaacaacagaaagaatgaatatgacctactatttgatagcatcacaggatgactatagtcaataataacttaattgaaagatggccgactagaaagagatgcagtgggaggctccaaccaagaggggaaacagctagtgaatcctgcatcggcaactgaggtatcaggctctctcattaggaaagactaggtggttggcgcgaaccatgaagagtgaggaaaagcagagcaacagcccacccagcagctacacagggcaaggggagctcccacccctagccaagggatgcagggagtggttgtgctacccaacctgggaagccatgctttttccactgatctgtgcaacccatggatcaggagatcccctgatgagctcatgccaccagagccttgagccccatgactgtgcagattcttggcagtagttcagctggagactgcctaaaattatcaagttcctggagaaatgggtggctgacatcactgcggctgcctgcttgctgtcatcactgcggctgcctgctgcctaggatgactgagctgctggggcgaggggaggcggccatcactgcagctccagtctgctgttttcttctggcagtgctgaggaggctgggcaaattggacccaggaggaattctccacagctcagcacagctgatgtggcagatcttgaccagactgcctcttcaggccagatccagacccatccttcatcactgggcagggcctccctgctgaaatgtcagcaagtccagccaggggtttacggacaaaactctgatctcccttgggaatggagccactaaggagaggggcaaccacaacctctgtaaatcagaggacttaagtatttccccctgctggctctgaggaatctgggcagcccagatgagtgagattcgccccagtgcagacagcccctccaccaaagagcaggcagagttcttcattaaaagggtccctgatcccgtgcctcctgactggatgagacaggggttgccagacactttatacaggaatattccctctggcatcaggtcagtgcccctctgaaatggagctcccggaggaagaagcaggcaggcattttgctattctgcagcctccacggtgacatatccagatacaagagggacccaggcaaatagagtctggagcagaccctcagaaaaccacagcagccctatgggagaggagcctgacttttgaaagcaaaacaaacaaacagaaaataagaacaacagcatcaacaaaaagtccccataaaaactccatccaaagtcatcatcctcaaagatagaaaccagataaactcaggaagatgagaaagaatcaatgaaaaaaacactgaaaactcaaaaagccagagttcctcctctcctccaaatgattgcaacatctctccagcaaggacagagaactgggctgaggctgagatggatgaactgacagaagtaggcttcaaaagataagacaatgacaaacttcacagagctaaaggagcatgttctaacccaatgcaaagaagctaagaaccatgacaaaacattacaggagctgttaatcagaataaccagtttagagaggcacataaatgacctgaaggagctgaaaaacacaacatgagaatataattttgcaaccacaagtatcaacaacctaacagaccaagctgaggaaagaatttcagagcttcaagactatcttgctgaagtaagacagggagacaagattagagaaagaagaataaaaagaaacaagcaaaactctgaaaactatgggattatataaaaggagcaactctacaactgattggggtacctgaaagagacagggagagtggaaccaatttggaaaacatacctcagaatatcatccaggagaacttccccaacctagcaacacaggccaacattcaaattcagaaaatacagggagccccagtaagatattccatgagaagatcaatcccaagacacataatcatcagattctccaaggtcaaaatgaaggaaaaaatgttaagggcagcaggacagaaaggccaagttgcctaaaaaaagggaagcccatcagactaaaagcagacctctcagcagaaaccctataagccagaagagaataagagccaatattcacactttttaaaaaaagactttctggctgggcacggtggctcacacttgtaatcccagcactttgggaggccaaggtgggcagatcacctgaggtcaggagttcgagaccagtctggtcaacatggcaaaattccgtctctactaaaaatgcaaatattagccgggcgtggtggcatgcacctgtaatcccagctactcagaatgctgaggcaggagaatcatttgaaccctgaaggtggaggttgcaatgagccgagatcacgccattgcactccagcctgggcaacaagtttgaaactccatcttaaattaaaaaaaagactttccaaccaagaatttcttttttttttttccttgtatttggtcaccttgacttcacatcattctcatggcaactcctggattcgctgttcctcttatttaaccatgtcctctaaaaatgttcttggcgtgggtctctgtgtggtgaatctcctgaggccttgtaagcctgaggacattttaatctcgtcctttctgtttacgtgagggtctgactggctttaatgttgtttccttctagattttgaaaatatcagcatctttcctgtctgtgttgctgctgaaaggccccagtcagtcctgtcctgccgggaggtgcggccaggtcttccccagagcctttaggatgctgtctgtgaccttgggtgtcacacctaggtgtctgccagcgagttttcctgtagtttctgttctttggcatccgtggactcttttacctgtggctcgtcctctttccttaattccaggaaactaattttcatgatttctatacatatttcctctttccactcttactataacttccttttgggcttcttttatatatatatttatatatatatatatttgtttattatactttaagttctagggtacatgtgcacaacatgcaggtttgttacatatgtatacatgtgccatgttggtgtgctgcacccattaacttgtcatttacattaggtatatctcccaatgctatcccttccccctccccccaccccacaacaggccccggtgtgtaatgttccccttcctgtgtccaagtgttcttattgttcaattcccacctatgagtgagaacatgtggtgtttccaaccaagaatttcatatctggccaaactaagcttcataaacgaaggagaaataaaatcattttcagcaagcaaatgctgaaggaattcattgccaccaggtctgccttgcaagaggtcctgaaggaagcactaaatatggaaagaaaataccattaccagccactacaaaaacacactgaagtacaaaaaccaataacattatgaaacaactacataaataagtctgcaaaataaccaactatcatcatgatgacaggatcaaattcacacatagcaatattaaccttaaatgtaagtgggctaaatgccccaattaaaagacacagaatggcaagctggatagactcaagactctttggtgtgctgtattcaagagacccaataatagacaaacagagagccaaatcatgagtgaactcccattcacaattgctacaaagagaataaaatacctaggaatacaacttacaagggatgtgaaggacctcttcaaggagaactacaaaccactgctcaaggaaataagaggggatacaaaaaaatggaaaaacatttcatcctcatggataggaagaatcagtaccatggaaatgaacatactgcccaaagtaatttatagattcagtgctattcccattaaaactaccattaacattcttcacataattagaaaaaaactactttaaaattcacatggaaccaaaaaaagggcccatatagccaagacaatcctaagcaaagaaaacaaggctggaggcatcacgctacctgacttcagactacactacaaggctaaagtaaccaaaacagtatgctactggtacaaaaacaggccaatggcacagaatagagaattcacacatcaacaaccatctgatctgtgacaaacctgacaaaaacaagcaatgagaaaaggatgccccatttaataaatggtgctagtaaaactggctagtcatatgcagaaaattgaaaccggactcctaccttacaccttatacaaaaaataactcaagataaagacttaaatgtaaaacgcaaaagtataagaaccctagaagaaaacctaggcaataccattcaggacataggcaggaaaaaagatttcatgatgaaaacgtcaaaagcaattgcaacaaaagcaaaaactgatgaatgggatctaattaaactaaagagcttctgcatagcaaaagaaacaaattatcatcagaatgaagagacaacctacagaatgggagaaaatttttgcaatctttccatctgacaaatatctaatacccagaatatataagtaaattaaacaatttacaagaaaaacaaacaatcccattaaaaagtgggcaaagggcatgacagacacttctcaagacatttatgtagccaacaaatatgtggaaaaaaagctcatcactgatcattagagaaatgcaaatcaaaatcacaatgagataccatctcctgccagtcagaatggtgattattaaaaagtcaagaaacaacagatgttggtgaggctgtggataaataggaacacttttacactgttggtgggaatgtaaattagtttaacctttgtggaagacaatgtgatgcctcaaagacctagaaccagaaataccatttgatccagcaatgccattactgggtatatacccaaaggaatataacttattctattataaagatacactcatgtgcatgttcattgcagcactattcacaagggcaaagacatgtaatcaacccaaatgcccatcaatgatagactggataaagaaaatgtggtacatatgcaccatggaatactatgcagccataaaaaggaatgagatcatgtcctttgcaggcacaaggatgaagctggaagccattatcctcagcaaatccatgcagaaacagaaaactaaataccacatgttctcacttacaagtggaagctgaacaatgagaacaaatggacacagggagaggaaaaacacacaccggggcctgtctggagttgagtacagtggtagggagagcatcaagataaatagctaatgcatgctgggcttaatacctaggtgatgggttcataggtgcagcaaaccaccatggcacacgtttacctacataacaaacccgcacatcttcacatgtatcttggaactaaaataaaataaaataaagtggatcttacgaagataaagagtggattggtagttactagagaacaggaagagaagggggataaggggatgaagagaggttaattaataagtgcaaacatacacattgacctagtgtgtttgataacatggtagggcaactgtagttaacaataatttcttgtatatttcaaatagctagaaaagaagatctagaatgttcccaacataataaatgaaatgataaatgtttgaggtaattgatatcccaaacattccgatttgatcattgtatattgcatatgtgtatcaaaatatcacatgtacttcataaatatgtacaactataatgtataaattttaaaaagcaagacttttaggtaggaattccatgaggaaatatcatgtaactggataggaaatcacacaattttaaagattattaatgaaaacacaatcttttggctattcacaatgaaatagttttaatttttgtttttaaatgaaaatcactgggattaatgagaatataaagaaatggaattgacacacactgttagtgaaatggtatgttgacagtgaacttgtggaggacaattgtacaatacttaataaaaatattaacctttaaatcaacaacaaaataataataactatcacttaattgtacatttttaaataactaaaagagtataattcgattatttgtaacagaaaggataaatggattgaggcgatgagtgcctcattctcaatgatatgattattacacattgcatgcctgtatcaaaacatctcgtgtgcccccataaatatatatatctacaatgtacccttaaaaattaaaaattaaaaattttttgaataatagaaagaagaactatcagatttcaacaacaaaaagcaagccaattcaaaaaaaggcaaaagatttgaataagtgtttctcaaaagaatatatacaaatagttgctaagcacatgaaaagatattcaaccacactagtcattagggaaatgcaagtaaaatcaacataagttaccacttcacacccactctgatggttattataaaaaaaattaaacaaacaaaataacagatgttgatgagcatgtggagaaattgaaatattggaacctttgtgcattattgatgaagatataaaatggttcagccaacacagttcataaagcctcatctttggacacagaagaagataacaatcaaaataaacagcatttgtgagacgtggggccagaaaataaaactattcaaccccactaggcccagggactatcatggaagaggcgggcatgtgaaattgcgagggccaattgtgggagttaaaattagttcagaatttctctgtaaatcaaacattaatatcaaaggcatactaagcaataccagcatctgggcccctgtattagattaacaaggttttcttggaacattaacccattctttaattaaaaagctataaaatattatttaaaaatttataaaaattatatcttatggtcaacatatttattaaaatttaataaatttgcatataagatttgagagacagatttaattggccccatgatgtatttattagggcttttggtttgggaaagcaagtctcctttcacaaaaaataaatgtttttgcaattcttgttgaaatcttagagttatcactttggctgagtgaatgactaattatataatgacctgtgatcctattctgttatatcaagtgttttaaagttttggtatttcacaaactttccaaaatctaattctatgttgagtcctttggtactcattaagtttttgacattaagtcacctgaagtccaaaatagatatattcagcttcttcagtataataaaatcatataggaagcactgtcaaatgtaaaatgttgtttaaccttctttggattatatttatataaatgtgttattagtatgtgtttcaaaattgtatgagattcctgtgattctgttatgtcctaacatatgttatcagtagcaattatggttatgatgtaaaattgttgtattccacagaaccaaatttccttgtcaattgtgtctttaattatggctgttctaagacttttgtcatccataattgttttactttgatccttgtatagaggagtttataatcagctctagaaatctgaggaacactcttaaatacaggtttctgataactttggagactatgccattgaaatagagagaaaaacttccaggattctcatgaagagctgatgcattcatgaggattgttgatccaatattgagaagaggtgttaattacacaaactgaattaacagaaaattaaaataatattttgtgattttttttgtttatagtatttgctaattctttttttgtctttcagagtcaagaaaatttttttaagctatttacagcctttaacaatagagtatactctcatgagcaaaatttaaaagatgattcctttctctcgatctaatttctccaaaatttataaactattttgtgagtattcttaatttataacaatataattattcacagaagttcaataagaacctattttcttttataatagggcataattggagacactggttattttaccaagattttgactggaatgacatattttcaaatggcattaagaacaatgaggctgatccatggaaaaataaaagccccttagaaaactttgccatatctcttgtcccttacaagttcctgacttgtggctaagtaaaaaatgtcactttctgacaggtccaggaactgcaagttttcttgggacctcaaaagaaatgcacccaattcacacaggtatctgcaggcacagataaatccttggctgggctcaaggctttttaaaaggtcttaggttccttatcaaaaaggttccagcaaagccaattttaacaaaagagagagaatctatatggcaaattattattcttgctgctttttatgcaaataagccaagtataataggactaaaacttatgtgacaaataaattgatactactataattttgtctttaacaaaattggagaattggaaagaaaaaatgtttgaaaataaactatagtatgcctgttattagattctagccttgcctaatgtttttcaatttttattattttctacaatttgaaatgaattctaaaatttttcctggctacaagtctccaaaataatgttttcaaatttttctttctttctttccccttttttccccattttaagatatgcttttctaaaagccctgtgaattgaagctagacaagctatatttcagaagaaaataacagcaatgtattttatatatatatataaatcactttgactttcatacctgcctactgatgtatggacttcagagtaatatggcctatatcaggtttccaggattgttctccctttttgtttgcttgttttctttctctcttcctctccctgcttttttctttgtgggtacatgagacttcacaacctgctaaaattataataacatgggatctatctatctaggaataaactgtcctagccaggagagatcagacaaaatctgataccagagactcattttcttccaaaatgctttctctgggagattttaaaaagaaaagaggagagaaatgtgaaaggaaaacaaaaacttgggacctcaattcactatgccaaaacaaaaaaaaattaagctgaaaaccgagtcatgcaataaactgccttaccttttgttcctaagcagatagctacagataaaaagtcagatattgccacaggtagctactctatgttcaccttatcttatgtaaagtgctgatttactgagtgtgagacaaaaacataattgactattctcctacctgctccttttctcttgcaacctgtggattaccatatcctccctgtttcctgtccagcccacttttcccctttaaatattgaagccctcaaaatcatctttggagaaaggcacagaacacaggctgtttctgtgattccatgcttatttcttccaggcgtgccctttaccttggcaaaataaacatctaaattgattgagaaaaaaacaaaacaaacaaataccagcaagattttttttgtagaaatcaagttgattgtaaaatttatatgggaactcaaaggacctaaaatagccaatacaatttcaaaaaacaagaaaattatggagaatttacactacataaaaacaagacttactgtaatgacaccaaaaatagcatggacatcagggtagacataaaccagtggatcagaacagagagtccagaaatacatccatatgcagctccaacaaagctgcaatggtaatttaacctgaaaataatgtttttactacaaataatgctagaaaaactgaacatctttttaagaaaaaaaaatgaaccttatcctgtccctgacacaaaatcaacttgaaattgatcatagacctattattaaaactataaaacttctagcacagaaatatctttgcagtcttggagtaggcaaatatttctaagatgagatataaaaagtctaaaccataaaagaagtggaggttgtcaactgggaggagaaaaaagggaacttcttagggtaatgaaaatgttacacatcttgattatagtgaaggttacattagtgtgtatattttccagaattcattaaattgtatgctaaaaaacccaataaagtttatctttcaatgcttaaaagggaaagtggctataatccattgtaatgtcatagaattaagtctacttattatatgtaaaattaaaagtataaatattgaaaaaagtagaattacctatgactcatatcccttaaaatcctgttctcattccctagatgcaaatgctcttaatcatcttagttgctcaagtattattctacagagtaactttacacatctacatcttaatttatcattatcaaacaacatgtattgaaactctgctagaaaaaataagaaaatggttcatgtacatcacactccacttctctaacaatttttgttatttctattatttttttgttttgttttgttttattactattattatactttaagttttagggtacatgtgcacaatgtgcaggttagttacatatgtatacatgtgacatgctggtgtgctgcacccactaacttgtcatctagcattaggtatatctcccaatgctatccctcccccctccccccaccccacaacagtccccagagtgtgatgttccccttcctgtgtccatgtattctcattgttcaatttccacctatgagtgagaatatgtggtatttggtttttttgttcttgtgatagtttactaagaatgatgatttccaatttctttttttttattattactattattattattattatttttaattatactttaagttttagggtacatgtgcacattgtgcaggttagttacatatgtatacatatgccatgctggtgcgctgcacccaccaactcgtcatctagcattaggtatatctcccaatgctatccctcccccctcccccctccacaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattctatggtgtatatgtgccacattttcttaatccagtctatcattgttggacatttgggttggttccaagtctttgctattgtgaataatgccgcaataaacatacgtgtacatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcattgcggttttgatttgcatttctctgatggccagtgatgatgagcattttttcatgtgttttttggctgcataaatgtcttcttttgagaagtgtctgttcatgtccctcgcccactttttgatggggttgtttgttttttccttgtaaatttgtttgagttcattgtagattctggatattagccctttgtcagatgagtaggttgcgaaaattttctcccatgttgtaggttgcctgttcactctgacggtagtttcttttgctgtgcagaagctctttagtttaattagatcccatttgtcaattttggctttggttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgaccagtggtttgtagttctccttgaagaggtccttcacatcccttgtaagttggattcctaggtattttattctctttgaagcaattgtgaatgggagttcactcattatttggctctctgtttgtctgttgttggtgtataggaatgcttgtgatttttgtacattgattttgtatcctgagactttgctgaagttgattatcagcttaaggagattttgggctgagacgatggggttttctagataaacaatcatgtcgtctgcaaacagggacaatttgacttcctcttttcctaattgaataccctttatttccgtctcctgtgtgattgccctggccagaacttccaacactatgttgaataggagtggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcttgaagggttgttgaattctgtcaaaggctttttctgcatctattgagataatcatgtggtttttgtctttggttctgtttatatgctggattacatttattgatttgcgtatattgaaccagccttgcatcccagggatgaagcccacttgatcatggtggataagctttttgatgggctgctggattcggtttgccagtattttattgaggatttttgcatcgatgttcatcaaggatattggtctaaaattctcttttttggttgtgtctctgcccgactttggtatcagaatgatgctggcctcatcaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtctacgaatgtatccatttcttctagattttctagtttatttgtgtagaggtgtttgtagtattctctgatggtagtttgtatttctatgggatcggtggtgatatcccctttatcattttttattgtgtctctttgattcttctctcttttcttctttattagtcttgctagcggtctatcaattttgttgatcctttcaaaaaaccagctcctggattcactgattttttgaagggttttttgtgtctctatttccttcagttctgctctgattttagttatttcttgccttctgctagcttttgaatgtgtttgctcttgcttttctagttcttttaattgtgatcttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcagctttgagtgagattcttaattctgagttctactttgattgcactgtggtctgagagatagtttgttataatttctgttcttttacatttgctgaggagtgctttacctccaactatgtggtcaattttggaataggtgtggtgtgctgctgaaaaaaatgtatattctgttgatttggggtggagagttctgtagatgtctattaggtccacttggtgcagagctgagttcaattcctgggtatcgttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttcagcctatgtgtgtctctgcacgtgagatgggtttcctgaatacagcacactgatgggtcttgactctttatccaacttgccagtctgtgtcttttaattggagaatttagtccatttacatttaaagttaatattgttatgtgtgaatttgatcctgtcattatgatgttagctggtgattttgctcattagttgatgcagtttcttcctagtctcgatggtctttacattttggcatgattttgcagtggctggtaccggttgtttctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattattttctttaagaatgttgaatattggcccccactctcttctggcttgtagggtttctgccgagagatccgctgttagtctgatgggcttccctttgagggtaacccgacctttctctctggctgcccttaacattttttccttcattgcaactttggtgaatctgacaattatgtgtcttggagttgctcttctcgaggagtatctttatggcgttctctgtatttcctgaatctgaacgttggcctgccttgctagattggggaagttctcctggataatatcctgcagagtgttttccaacttggttccattctccgcgtcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcatgtagttctcgagccttggttttcagctccatcagctcctttaagcacttctctgtattggttattctagttatacattcctctaaatttttttcaaagtcttcaacttctttgcctttggtttgaatgtcctcccgtagctcagagtaatttgatcgtctgaagccttcctctctcagctcgtcaaaatcattctccatccagctttgttccgttgctggtgaggaactgcgttcctttggaggaggagaggcgctctgcgttttagagtttccagattttctgttctgttttttccccatctttgtggttttatctacttttggtctttgatgatggtgatgtacagatgggttttcagtgtggatgtcctttctgtttgttagttttccttctaacagacaggaccctcagctgcaggtctgttggaataccctgctgtgtgaggtgtcagtgtgcccctgctggggggtgcctcccagttaggctgcttgggggtcggggtcagggacccacttgaggaggcagtctgcccattctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaagcctccttgacctgtggtgggctccacccagtttgagcttcccggctgctttgtttacctaagcaagcctgggcaatggcgggcgcccctcccccagccttgctgccgccttgcagtttgatctcagactgctgtgctagcaatcagcgagattccgtgggcgtagggccctccgagccaggtgtgggatatagtctcgtggtgcgccgttttttaagccggtctgaaaagcacaatattcgggtgggagtgacccgattttccaggtgcgtccgtcacccctttctttgactcggaaagggaactacctgaccccttgtgcttcccaggtgaggcaatgccttgccctgcttaggctcgcgcacagtgcgcgcacccactggcctgcgcccactgtctggcactccctagtgagatgaacctggtacctcagatggaaatgcagaaatcacccgtcttctgcgtcgctcacgctgggagctgtagaccagagctgttcctatttggccatcttgatgatttccaatttcatctatgtccctacaaaggacatgaactcatcattttttatggctgcatagtattccatggtgtatatgtgccacattttcttaatccagtctatcattgttggacatttgggttggttccaagtctttgctattgtgaatagtgccgccatacatacgtgtgcatctgtctttacagcagcatgatttatagtcctctgggtatatacccagtaatgggatggctgggtcaaatggtatttctagttctcgatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcattgcggttttgatttgcatttctctgatggccagtgatgatgagcattttttcatgtgttttttggctgcataaatgtcttcttttgagaagtgtctgttcatgtccctcgcccactttttgatggggttgtttgttttttccttgtaaatttgtttgagttcattgtagattctggatattagccctttgtcagatgagtaggttgcgaaaattttctcccattttgtgggttgcctgttcactctgatggtagtttcttttgctgtgcagaagctctttagtttaattagatcccatttgtcaattttggctttggttgccattgcttttggtgttttggacatgaagtccttgcctgtgcctatgtcctgaatggtaatacctaggttttcttctagggtttttatggttttaggtctaacgtttaagtctttaatccatcttgaattgattttcatataaggtgtaaggaagggatccagtttcagctttctacatatggctagccagttttccaagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgtgggctcttttttggtgccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttctttgtatcctctttaatttcattgagcagtggtttgtagttctccttgaagaggtccttcacatccattgtaagttggattcctaggtattttattctctttgaagcaattgtgaatgggagttcactcatgatttggctctctgtttgtctgttattggtgtataggaatgcttgtgatttttgtacattgattttgtatcctgagaccttgctgaagttgcttattttaactattctgttgaagtggttatcaatgtaagcagtttgcattttagaaatttgttgaggcattgtttgttttaataatgatgcaagagcactgatagcatttggttggtggagattagggaggctagtggagagtcctatacaacttctaaatgtcccaccagacattcaggtatgcaaaaatcctattcataaatatgtgagcttagtacctacctctgcctacacgtacatgcaaaaaatttaacatggctttaataaacactgtttttttccaagaatgcaagtaaggtgtaaaccaaggaaaggttatagtgaatttgttcataattttatccaaaaatatcatcattttagaaaatcatatcaccaaatacattgtcattcattatatttgatttattaatacaacactaccatatcaatcaacatttgtagcagttatgtttatagcgattccacacacaaatacaaatattggaactctttattatggtttctatttgcctggatatatgcatatttgtttttccttatggagaagtcctacccaacctgtagacgtgcataaaatgtcatctcctctgggaagtcatatctgacttccccaagcaaagataattattgcttctctgtgttcccacagaacattgtttatacctttcttacagaattattactttttaattatgtgtatctttttacctctagtgattatggtttctcatcagaagagtctaatctctttttatcactactttccctgtctccaccctatgtatgacataatgcttggcacaatgtcagtaatctataaaaagtcattgaattactaaaacaaaaaaaggacttttaggacctaatttgatttgaatactaactattgtttttttgcttatctgttaagagcatagtggtcatgttgtattctaagtcatcaaaagaacaaacagatatttacatttacagtgtattaagataaacaattacaatataatgagatgaagtagtcaaagaaaacaagacactacaaaacatgcatgtattgacacagacacaaaaggagaggaaaaaaaactaagcctgcagtgttaattcaatataatggttgattattttaatgtacaaggcaggaaatacaaagttattattctcagagaaataatatctcaattacattctacatgcacataaaaccattaaaaataatgacatttacagcagtacaaaataaggtggcagagttattgttgctatggaataacttttatatttattgacttctgtgcattttaatattcaaccacatagttgtttcacccatattttcagattcaaactctttactcttcttttaaaatgccccaaactcagcaaaggcagcatgaattactaagaattcagatttcacagtcacatagatttaagattgaatccacctacttcagatacatactgcagtataacatactttgttaagtaatttaacctctttgagtctgtttatttcccttaaaatattgttctgaaggttatgtaaaacacatgtaaattacttagaacatagtattcactcagtaagtagttggttattattattagtcatcatccttatcattactattattaagacacctgtatattaaagaaaatgtatttagtgaaaagaataaaagattcagttctataaagtataaagaaagatttggaaaaggaaagaaataatttaaattgaaaccatgaagaatatcttggtgaaaagtaatgtaaagtaacactgaatactgtagcatccagttaaattacacactaaaacacccttatatagtatgcaaaatatttgtccccaaacatagagacagaataacacaatggtttttttcaatttaaggaagttagagatggaggataaaataattgtggcttatctttacagaagtaaaggtctcattctaataatgttattattattatatgccttgctgacattggttctacagcctttaaaaaataatgtatgaataatgaatatttagcaagaaaattatgaacatattttggggcagagggaacaaagaaaaatgtgtatctatagatgtagcatgtacctggtgaaataatataattataatctcatttcactcttataaataggcctgctgaaacatctagaaatagactttagggctgtgtaaatttttgatatttaaatgggttatgctgctgatggatgtgaaaaaagctcgatttgtttcatttttacattgaaaactacttcacacaaattatgagcagttcatattggtcaaagtgaagaaaacagcttattaattaaaactgacctttttatatgacacgtatttcacctcagaagctaaaacaccttcgaagaggtaaaaaattacctctatgtataagtgacatgtagttaaatgagtctgtcaaaagttccattataaagccatatttccagggcttcataattttgaaagaaaattacattaaagatgagttgtaacccacaaattctcagccaaaaggataaatctaaaatttctacttgtggatgttttagggaagataatctatatgtttggaaactttagtctcagtgaactagtacccattatatagcttcttcctagcattttataaaatctttccatgttacttctcattgaaaatctatctacaagatatactgcaataactcaccaaaaaaacccctaaacattaaaaaaaaaatttctcaaatacacataccctaattctccctagtcacatagtctacaacacaaacaagacatcttggtttgttaagctacaatcaattagaggatgtttcaattaccaaatatgtattgaagatctatttttgcacccaccctgtcttgtgcccagaactaaggagaacatataagacacataagctatatatcaaactatcactcaataaaagaataaggatatacaaacaaatactatagtctcaaaaagttgaccatctagttaaggactatactaaaaacaataaaacaaataatgaaaaaatgttctacttcttcaagaagggaaaattcagtacagacaatatagttttgtaacacagagtttgaagaaatgtggacctaaggctgaatacttggttggccacttttggggcatatgaccatggatgagaccaaattcagcaagtgatgatcttggacttctctattttcatcgcacagttgtggggaaaaaaacagtggctcatttttccctgaaaggggagtttgcatacaattttccaaccttttacagtaagtgatttccctcccttggtcttacacaggaatcacttacacctttttctattttgtattatagttaattacatatgccttaatgtccacttcccaaccagtcacttaaacactaaccttctacttatgtgatagtcatagtgcaaataactatatattctttgtatacttttaattgagatacctatattcagagaagcagcatctatgccttcctcacaaaaggcttcctggagagcatgccacctgaactacctcaaatatgtgtgaaaatgagttccaagaagattatgcacggaggaacaaagtattaacctgagtctggagagagaaaaagtagctagatcatggaaggcattgtatgatatgctaagaaggttagattgtatcctaaagagagtaaaaaccaatccctgaaaaaaataaagcaaggcagtggtacaatctagccttggggctcaaagcccagagtattttcacagagaggagaaaaaataaagctgcttctgtgatgatgacttgaacacagtaggtgaagtgtggtaaataaataagggaagcaggagtgttagaggagcaagaagtctgggatggttcaccctgtcatgcagaagcagagaccattctccttccatacagactgcactgtttcaggaaggcataatgacagatcagcctttggagaatttacatatgtaatcttgtcaagctctacaactgcattctggttcccaaattagacttgcacttctaaatgaaattttaatttatatgctaaaaacagaacccttaaaaacaacatctggctggttttcctaatttatttctgccagattcaattttcaaagagttccagcacaatgttctccaaattgtggcctatcaaaggaatttggtggtctcattaatctccctcagcatttaccaggtactcactctgtgctaggcgttgtgataagtgctggagatccagatatgaataagacttaggatatccttcaaggagtataggcaaggaaggtggagtaaacaagtgtaataaagtgctttacattttgtgatatatatatatatatacattgtgtgtatatatatacattgtatatatatatatgtgtatgtatatatatatacattgtgtgtatatatatacattgtatatatatgtgtgtgtgtatatatacacattgtagaatggagatctaaacaaagaggtaaaaaaactccctatgttaggaaggggagaaggaagaatccagatagttttttttagaaaaaaggtaacatgatacaaactgagtcttcagtagctacccacaagacagccaaggtatgaagttgtgaatctggaaaagataagttgttctaaaatgaaaggcccggagattcaaaagaacagctgggagaatttatagaagtcatactataaacaagcttatatgggtatataaaaatgtgtatttatgccataaacaattgaaattattaatggatcttaagcagtgagtattttcaatatttgctttgtacaatagaaagacccttctggcagtaaaatggacaattaattgaagaattaagattgtccaataaaactggacagcaaatgcagttgggagatcaaaacaatagtctagatgaaagattatgagagtctgaacaaaagcaaaaacagtggaggtgaaaatgacagatatctgcatggcgtaccgaacaattagttgttgttattcccctaattcttgcatcccattcttaggaatacattcctcttacaaattaatcaatgataataagtgaatataagagaaaagatgataaaaataaaaaactgcaaccttcaaacatggcaatattaaattctcacatttcctgggaaaaattgatcactcaaacaggttcaacatttttatttaagacttagaaaaaataagtgtttgttacataattttttcagatattttcagacgggaggctagccataagcatagatgtcagactccagattcaaactaccttcataaacaaaaatgttaagccaaaattaacaaagataaacatagatcatgcacagatcttgcatttagcttgtgcaagaaatcaactgcacaaatattgatccagcctactggaaagaaatgtgaaaaaagtaatctcaaagttttaattgatcaatattataaaaaattaacacaacttaccataacattaacagaagttagttctgaacatgtagaataagttttaatgcactatgtactgatcagaccatagttgaagaactttggtccatttcaggtatcacattttaagaaatacactaactacagtatttacatagggaaagaatcatgacctattgagtcatatgagattcatatccaataaaaagctgaaaaaaccttagtgacaataacaaatttgtctatacaaccactacagagtagctattcctaatatttaattaataaataagagttaaactaaagggatacattacaactgtcttcaaaaatttgaagagttaacaagtaaaagaaggatgggactaccagacttgcactattagattggataacagccaccaatgggtagatttcagctcaatagatgaaaaaataaatatctaatgaacataaccacccaacagtgaaataagaccatagtaaattgctctcctttttcatgagaggcagttaaagcagagactgatcaatatttgggttttctgtaaaatggcatcttccttgaataggaagttggacaagatggcctcgtagtatccacaaaagtctatgattcaaagaacttactaagcatgtactatatgttcagctagtacaaaataacaaaaaacaaaataaataaagtatatggcttctgctctaaatatgcttattttaaagttgagaagattcaatcaatatatgtgaaacaattaaattgttcacagttgttcacaattaataactgttaaacaattaaagaataattaaataacaaactacatactacacaagattagagatgaactcatcggaaagacctcgtgtagttggtggaaaatgagttagttcctgaaggatgaacaacttttgcttttaatgttttcatcagccaagtgtggtggtacccatctgtagtcgtagctactccagaagctgaggcaggaggttcacttgagcccaggagttcaaggattcagggagctatcaccacaccacctcacttcagccaggagtgacagagcaagaccctgtcttaaataaataaataagcattttcatcaactgactaataaaataatactttttttctttttcaattcactgaagtgatgacatattttgtattttctaatatatgagtgggaaaattgatccatgactatgtaacctaaatatagaaataatcaggtttctataatcccagctctttgggaggccgaggcagttgggtcacaaggtcaggagatggagaccatcctggctaacaaagtgaaaccccatctctactaaaaatacaaaaaaaatagctgggcgtggtggcacatgcctgtagtcccagctactcaggaggctgatgcaggagaatcacttgaacctgggaggtggaggttgcagggagcccagaccgcaccactgcactccagcctaggtgacacagtgaggctccatctcaaaaaaaaaaagaaataatcaggttttctaatcttctaaatttaaacttcacaacagataatacactattcttgtctcctcacattgccgaacaaagtgtcttaaatagaatagataagttataaaaccttgaatgaatggatgaataagtgattaaattaaggaatacaaatgtagaagctctctcagattatgcttatatcatttcaataagtttaaagaggtgaaaattacacgtattgaaccactgaaggcaaaatgaatcaatcgggattcaaagtagaatttggtgaaaaacaacaaaaatagctactactttttgagcacttacaatgtgtgagacattgggctaagcattttatacattattttgcataacagaaaaatcctagggaatagttcttaattcctttattttactgataagaaaaaattgaggcttaaacggttaactttcccaatatcacacagaattagtgaaaaggctgtaattaaaatccagctctgatttcaaaatcatgactcattcatgcatttattccttcaataaataattgagtgccaactgcaactcagaaaagttctaagtgtggagacaacagcagataagaaagacaacactcattcaggggcccttgcagcaaatattactgtgtgccacttatttgccagacattgttctacgcatttgttacgacatggaggagaaaaaaaaagtcaaaatctctgcctctatggaatttatattctggttggagagatacttaataaatatataagtaaataatactatggtagatttataaatatataattccaccaaatcccacttcctcttctttcctgggtatataaactgactgcatttcccagtctcccttgcatttagataaggtcatgtgacggaactctaggcaatataactgtaggaaaaagagattatttcatttccagaccttctttcaaacataatcctccatactctttcccaattcaccagccaaaaacagaaaaacatgatcttagcagatggaggaggcatatataagaaagagcttgactccctaaatgactagatgactctctagtaagcccaaaactatgatcagagtaagaaatagattttattgtttagtcaattaaatttggggttcatctggcataacagtaagcccatgcacattaatacaaatataaatgacaggtagtaaaatgtgctatgaagaaaaataaaacaatgagattgagagaggaggtactactttagataagatggtagggaagaattctctgaagaaatgacattttatttgacccctgagttaagggagacagtaatttctgtgaagatctaggcaaaaagcatcagaggtagaagaaagaaaaagtgtaaagatgctgaagaagaagcaaacttgtaacattcaaggaacagaaagaactaaaagaaattgagagcactattccattgcctttaattgtacacttctgatgcaaaatggaaaaaaataagtgagcaagttaacttccctcctcccaaaatatcactgaaatggaatgaagatgtgtaaggaaagttctaatttcttcatctgtatcagtgattctcaaccctgggcaattttgctgctcaagggatgtttaacaatgactacagacattttcatttgtcacaactgtaggaggtgctagtggcatctagatggtagaggccacagatgttgatcaataacctataatgcacagaaataaccccacaacaaagaattatctggctcaaaatgtcaatagtccaaggttgaggcatcctaacctagtaagtcaaagaagggtgcttgaaagtgaaacctgatataaaccccgaaaggtgagtaaaaattacgttggtgaagaagagaaagtggtctaggctaatgaacttgcaatccaaaggctagcagaaagatgtatcagggtgtacagaaacctcaacagaattgataagacaagaacatagaatatgaagaggagttaacaatgcagactctcctccatccagtaatactggtctccccattcattcccatgccactatccatgttgctttcattacaaagaattgagtattcacttaacactttgagactaagtgaaaaacaaagcttaaagtttaagcccctgtcttcagagctacatcatccattccaaaacatttcaatttcaacttgctggataagacggcagctgagaggcagcagggtaaactggaaaaagccctgatctggaactaaaaaaacaaaggaccagagggacagagcatgatggccaaataaacacacactgcaatcagtgaacaagatagcaacaaatgccaacagtctcctttcctggaagttcaccagaagcaccaacaaatagtatcttctcaacctggcaacctaagtacttgctttgagtttggtaaggacaattaatatcttttaataactatattatcaatttataaaattgtcaattttaatatgtattctctatcaaatctatctgcctttctctgacttgttaaagctaagggaaaaaaagtatattgataagctctcaaatggctgatacaaggtccctcctcaattccaatcattcccactattaaacagtatggtaaagtagcacctccaaattattcattccttctacttagtgtgctaaattaagcacatgcaaattattgcatcccatttgatttttttacctagtatgtacttcattttatcttttcatacatacctgacctgttcccttctataataccaatgctttttgccaatcactgtaccttctatgcttgctctatctccctaccatttcttttcctttacaccacatgcttaaccattaccatcttcatcaagcatcacccccttaatggtacactctgcttcagaggcttcaaaaaccttttctccctgaagtccttacaaaaatactatgagataagctgaataagtattattattcatattttgtagatgagaagactagatgtcacctattcctcacacttttctgtttcatacttgctcttacctttcaacttcagtaaattctcctttcttctttacctcttatttccagtttaccccattattcatggtagtctgctactgactactcctttcttagctacttcagtccctgttctcttctcttttcctaatactttgcagttttgttctactcttcacagtcttagaaatagtataaatagaagtccagccaggagacactaaataaaatacattagaggcatgccagggttgtcaagaagctccctaagaaacaggtccaccaaagtgaaagaaatggaaaatcaacaatccttagaagggaaggaagaaggtgcaaaaatccatgaagtcatgtctttgcttccattgttatacccagctatatcttttagtatagctgagaggcagcagagtatactggaaaaagccctgatctggaactaagaaaacacaggaccagaaggacagagcaagatggccaaataaaaggctccaccgattgttctctccacaggaacaccaaatttaacaactatctacacaaaaaaactaccttcataacaaccaaaaatcagacaccagcttggccacagtaaagtaaaccacaaagtaggctcttgagggacccaattctaggccttgactcttggatggcatttctggaccagtcctgggccagaaggtagcccactgccctaaagggtgagtcccaggcctggccgcattcaccataaacagactgaaaagcccttgggccttaagcgaacattgacaatagcctgacagtactccctgcgagctatggtagtggtaatcaagaagagatgctcctccaccagtggaaaaatgaggaaaacatgggaaggactctgtctcatggtttgagagccagctcagcctcagtagagagcaccggttagatttctaaggttttttgactccagtctctgcctcccggactgcatctcaggacccacctgggtcctggaggagcttgctgccatgaaggagagaacacaagctgggctggtttcacaaactgctgattatacagccctagggctttgagtgaacataggcagtagacaggtagtagttacagtgggccttgggcaagacccagggctgtgctggctttaggtctcactcagcacactcccagtggtagtagtcacactgatgctcatgtcagcccaaacccagcaccagatggcacagcacaaagagacagactctgcttgtttaggagaaagtaagggaaaacaacaagagtctctgcctgctaattcagagaattgtctgaatcttattgaacacaaccaaggcagtacctctatgaatctgcaagaaccacagcagtactggactgggagtgcctcctaatgcagacacagcttagatcacaacactgaagtccttacaaatacctaaaaagccttccaaaaaaggacagatagaataagcctagattgcaaagagtacattaaatacctaactcttcaatgcctggacatgaatgaacctacacaagcatcaaggacatcaaggaaaatacgactctaccaaatgaactaaataaggcactagggatcaattctgaagaaacagagatatgtgacctttcagacagaaaattaataatagctgttgaggatactcaaagctgttttgaggaaaatagctgttttaaggaaactcgaagaagttcaaaatcataaagagaaggaattcagaattctatcagataaatttaacaaagagattaaaataattaaaaggactcaagcagaaattctggagttgaaaaatgcaattgacatactgaaggatgcgaaagacactcttaatagaggacttgatcaagtagaagaaagaattagtgagctcaaagacaggctatttgaaaacacacagtcagaggatacaaaagaaaaaagaataaaaaccaatgaagtattcctacaagatgtagacagtagcctcaaccagccaaatctaagatttactggccttaaaggggagatgaaaagagagagagatgggtaaaaattttttcaaagtaataatagtagtttccaaacctagagaaagatatcaatattcaagtacaggttatagaacatcatgcagatttagctcaaagaagactatgccaaggcaattaataatcaaactcccaaaggtcacgaataaaggatcccaaaagtagcaagaaaaaagaaataaataacatacaatggagttccaatatgtctggtagcaacatttcagtggaagccctacaggccaggagacagtggcatgacatatttaacgtgctgaaagaaaaaacttttatcctagaatagtatatttagcaaaaatactctcctgggaaaagaagactttcccagtttaaaaaaaaaaaaaaaaactgagagatttcaacaccagacctgttctataagaaatgctaaaggcagttcttcaatcataaagaaagggacattaatgaacactaagaaatcatcagaaggcacaaaaatcacaggtaaccgtaagtatacaggaaaccacagaatattataacattggtaatcataagcacacaggaaaacagaatgttataacattgtaaatgtgtaagttactcttttcttaagtagaaagactaaacaatgaaccaatcaaaaataaatataacaacttttcaagacataaatagtacaataagatataaatagaaacatagtacaataagatatagcttttttaaaaattaaaaaagtagggagataaagttgaaatgtagagtttttattagttttccttttgcttgtttgtttatgcaagcactattaagttgtcatcagttgagaataatgtgttctaaaatagtattcacaagacacatggcaacctcaaatctaaaaacacataataaaaacatacatgcaaaagcaagaaattaaattacaccaccagagagaatcaccttcatgaaaagaaacacagcaaggaaaaagaaaggaaaagaagaccacgaaacaaccagaaaacaaataacaaaatggcaacacaagtccttatttatcaataataacatcaaatgtaaatatactaaactcctcaatgaaaagacagagagtggctgaatggggtaaaaaaaaaaaaaaaacgagatccaactatctgttgcctacaagaaacacacttcacatataaagacacacatagactgaaaatgaaagaatgcaaaaagacattctatgcaaatggaaacaaaatagagcaggagtaggtgtacttacatcagacaaaagagatctcaagacaaaagctgtaagacaagacaaagaaagtcatcatgcagtaattaaggggtcaattcagcaagagaacagagcaattgtaaatatatatgtacccaatattggagaacccagatatataaagcaaatattattagagctaaagagatatagaccccaataaaataatagctggagacataaacaccctgctttcagcatcagagagatcatgcagacagaaaatcaacaaagaaacttcaaacttaatctgcactgtaaacaacatgaaactaatagattttaacaaagcatttcacactataaggaaaagtctctgaccaaagaaaaggctgaaacctgatggcttcactgatgaattttaccaaatatttaaagcactaataccaatcctacacaaactattctgaaaaaatagacgaggagagaatacttctaaacttattctatgaggccagtagtaccctgataccaaaaccagaaacagacccatgaaaacacacacacacacacacacacacacacacacacacacacacacacaactaaatgctaatatcactgaacaaaaattgatgcaaaaattctcaaaaaaaaaatactagcaatccaaactcaataacacattaaaaagatcattcctcatgcatgaccaagtaggatttctccctgggaagcaaggatggttcagcatatgcaaatcaatcagtgtgatacatcatataaacagaatgaaggacaaaaaccatatgatcatttcaattgatgctgaaaaggcatttgataaaattcagcaacccttcatgataaaaaccctaaaaaaaaactggacatggaatgaacatacctcaatacaataaaatccacatacaacagacccacagctagtatcaaacttaatttaaaaaaactgaaagtctatcctctaagatctggaacaagacaaggatgcccactttcatcagtattattcaacatagtactggaagtcctaactagagaaatcaaataacagacagacataaaggtcatctacattggaaaggaataaatcaaattgttcttgtttgtagatgatataaacttgcacttgaaaaaacctaaggactccaccagaaaactattagaactgataaattcagtaaagttgcagaatacacaatcaacatacaaaaaaatcacatttctatatgccaactgtgaacaatgtgaaagagaaatttaaaaactaatcccatatacaatacccacaaataaaattatatacgtcagaattaacctaaccaaagaaattaaagatctctaaaataaaaactataaaaaattgatttaaaaaattgaagaggacacaaaaaagtggaaaaatattacaagttcatgcattggaagaatcaatattattaaaatgtccatactacccaaagcaatctacagattcaatgcaatccctgtcaaaatataatgacattcttcacaaacatataaaaaaaatcctaaaatttctatggagccacaaaagactcagaagacccaaagctatcctaagtaaaaagaacaaaactggaggaatcacattacctgacttcaaattatactacagagcgatagtaactcaaacagcatgataatagcataaaaaacagcatgataatagcataaaacatagaaaaatggagcagaatagacaacccagaaataaatccatacatctacaaggaactcactttcaacaaagatgcaaagaacatacattagggaaaggacagtctgttcaataaatggtaaactggatatccacatgcagaagaatgaaactatacacctctttttttccatgtacaaaaatcaaatcaaaatggattaaacacttaaatctaagactttgaaattatgaacctccaccagaaacactggggaaactctccagaacattggactggacaaagatttcttgagcaataccccacaagaacaggtaaccaaagcaaaaatgaacaaatgggatcacatcaagttaaaaagtctctgcacagcaaacgaaataatcaacaaagtgaagagataacccactaaatgggagaaaatatttgcaaattacccacgtgaaaagggattaataatcagaatgtagaaagagctccaaaactctacagggggaaaaagagctagtaattcaatttaaaaatgggcaaaaggcctgaatagacattctcaaaagaagacatacaaatgacaagtaggcataagaaaaggtgctcaaattcattgatcatcagagaaatgcaggtcaaaactataaagagatatcatctcaccccagttaaaatggcatttatccaaaggcaggcaataacaaacaccggcgaggatgtagagaaaaagaaccctcatattctgttggtgggaatgtaaattagtacaactgctatgggaacagttttgaagttcctcaaaaatctaaaaatagagctaccatattttatacaacaatcccactgctaggcatatacgcaaaggaaaaaaaatcagtatatcaaaggcatatctgcacacccatgtttactgcaacactattcaccctgggcaagatttggaagcaactcaagtgcctgtaaatagatgaatggataaagaaaaagtggtacttatatacaataaagtactatccagccataaaaaaagaatgagatcctgtcatttgcatcaacatggatgaaactagaggtcactgtgttaagtgaagtaagctaggcacagaaagacaaacttcttacattctcattttttgtgtgtgggagctaaaaattataccaaactgaactcatggagacagagagtagaaggatggttaccagaggctacaaagagtagtgtggatgtgaagaggaagtggggatggttagtgagtagaaaaaaatagtagaagaaagaataagaccttacatttggtagtacaacagagggactatagtcaataataatctaattgcacatttaaaaataactaaaagagtgtaattggattgtttgtaatacaaaggataaatgcttgcggggatgaatacccaattttccatgatatgattatgacacattgcatgcctataccaaaatatctcatgtgacctataaatatatacacctactatgtgtccacaaaaataaaaaaaaaattaaaataatgaataagacacctatattcactagcacaacagggtgattatagtcaataataatttaattgtacatttaaaaataactaaatgagtataactgaattgtttataacacaaaggataaatgcttgaggtgatggatacacaatatacacttttgtgattattacactttacatgcctgtatcaaaggacacttactatatatccacaaaaaaaaaaaagaaaacaaaaacttaggttcacatcccttctgggccacttactatgtggtcttaattattctacctacatggacttgtttctttatctgtaaaactaaggacatcatattaaatgacggctttctttgcctatagaatcaaaacagctaaccaattaaatcagatttgagtaaaatgggacttactgtgactcctggtttatttaattggtgtcgtacataaaaggtatataaaacatgtttgctcaggctgggcacagtggctcatgtatggaatcccagcactttgggaggccgaggcaagcagatcacttgaggtcagcagctccagaccagcctgtccaacatggtgaaaccccatctctactaaaaatacaaaaattagctaagcattagtggcacatgcctgtaatcccagctacaggggaggctgaggctggagaatcacttgaacccaggaggcagaggttgtggtgagccgagatcgtaccactgcactccagcctgggtgacagagcaagactccatctcaaaaaaaaaagtttgctcaataattgggtagaaggaatgggttgaagaaataaccaacaactctatcaagatcaaatagagtgacactaagcaggcttattatcttggtgaatctttcacatattgcttctaactgtagaagctagtgtctcctaatgtcaagagggttttttctgttgttgttgtttctttttttaattaattttatttttttattttttgagacagagtttcgctcttgttgcccaggctggagtgcaatggcgcagtctcggctcaccacaaactctgcctcccaggttcaagcgattctcctgcctcaacctcctgagtagctgggattacaggcatgcaccaccacgccaggctaattttgtatttttagtagagacagggtttctccacgttggtcaggctggtcttgaactcctgacctcaggtgatctgctggccttagcctcccaaagtgctgggattacaggcatgagccactgagcccagctgtcaagaggttttataaagtcaagaaataaggtggcaaagttcttcattttccccacactcttcctatacctgagatgaagcaaatatcacactaatgcctaaagccacattttaatacccaaaaagcagtagaacagatccagaggatgaaacaggaggccaaaagcttatgtcagaatgtgcttatggtctcctgggacactcctctgattcaacaagctaagaataacattctatcgcagagacactgctctgatatatactatctattaaaggctgacagcttctcttttaaacacacatgtaaatgtttaggtaacctctgcagagtattctgcatagtacaaacctgaagaagccttggattacagatactttttttagagtgttgctgccactgctgctattgtttttataggtaccatttataatgatgtaaaatgacttatagtgatgtagtgtaacaaagtttacaaagcaatctttcttttaacacagttaagcacagagtcaaaggacccatgtttgaattttcttcttttatcactctataaagatgaaagcattccaccttgaacagtggaacaagacaaggatgacttctatcaccactcttattcaccatagtactggaatccctggccagagcaatcaggcaagagaaagaaataagagtcatccaaataggaagagaggaagtcaaactatccctgtttgcagataacatgattccatatctagaaaacccaacagcttatgtccaaaagctccttggtctgataaacaacttcagcaaagtttgagaatgcaaaaacaatatacaaaaatcactggcattcctatacaccaacaacatccaagctgaaagccaaatgaggaatgaaatcccactcacattgtcacaaaaaaagaataaaatacataggaatacagctaaccagcaaggtgaaagatctctacaataagaattacaaaacactgatcaaattagagaagacacaagcaaatggaaaaacattccatgctcatggaaaggaggaatcaatatggttaaaatgacaatactgaccaaagcaatttacagattcaatgttattcctatcaatctagcaatgacattattcacagaatgagaaaaactatctcaaaattcatatggaaccaaaaaagaatccaaatagccaaggcaatcctatgcaaaaagaacaaagctggaggcatcacattatccaacttcaaactatatttcaaggccacagtaaccaaaacagcactgtactggtacaaaaacagacacatagaccaaaggaacagaatacagaacccagaaataatccctcatacttacagccatctgatccttgacaaacttgacaaacataaacaacaaggaaaggactcccttttcaataagtggtgctgtgataactggctagccatattcagaagactgaaactggaccccttccttacaccaaatgcaaaaattaacacaagatggatcaaagacttaaatataaaaccaaaactataaaaaccctgggaaataaactaggaaataccattctggacacagaacctgacaaggatttcatgacaaagatgccaaaagaaactgcaacaaaaccaaaaattaacaagtggtgcctaattaaactaaagagcttctgcacagcaaaagaaactatcaacaatcagagaacctagagaatggaagaaaatacttgtaaactatgcatctgacaaaagtctgatatccagaatctataaggaccttaaagaaattcacaagcaaaatacaaacaaccccattaaaaactgggcaaaggatatgaacacttttcaaaagaatacatacatgcagcctacaagcatatgaaaaaatgctcaacattactaatcattagagaaatgcaaatcaggccgggtgtggtggctcacgcctgtaatctcagcactttgggaggccaagatgggcagatcacgaggtcaggagttcaagatcagcctggccaacatggtgaaaccctgtctctactaaaaatacaaaaattagctgggcgtggtggcacacgcctgtaatccaagctactcaggaggttgaggcaggagaatttcttgagcccgggagatggaggttgcagtgagctgagatcatgtcactacactccagcctgggcaacagagcgagactctgtctcaaaaaacaaacaaacaaacaaaccagagaaatgcaaatcaaaaaccacaaagagataccatctcacaccagtcagaatggctattatttttaaaaattaaaaataacatgtttgcaaggttgtggagaaaaagaaatgcttactcacagcagtggaaatgtaagttagttcagccattgtggaatgcagtgtggtgattcctcaaagaacttgaaacagagttaccattcaacccagtaatcccattattgggtatatactcaaaggaatataaatcactccaccataaagacacatgtatgttcatggaaacactattcacaatagcaaagacatagaatcaacctaaatgtccatcaatggtagagtggataaagaaaaggtggtacatatataccagggaatactacctagccataaaaaagaatgagattatatcctttgcaacaacatggatggcgctggagatcattatcctaagcaaactaacacaggaacacagaaacagaaaaccaaatactgcatgttctcgcttataagtggggtctaaacaacaagaacacatggacataaagaggagaacaatagacaccagagcccacttgagggtggagggtaggaggagggagaggatcagaaaaaatacctattgggtactatgcttattatctaggtgatgaaataatctgtacaccgaacccctgttacacacagtttacctatataacaagtctgcacgtgtactcctgaacctaaaagttattataaaaaataataataataattgtatgaacttcagaaagttacctaagctcttttagccacagtttctgccaactgtaaaacaggggttaatattacctatcccatagatttctataagaattaaatgaataatagatgaaatatctattacagatattggcaaataactgtccatatttggtgttcaagaaatactcattcttataataattatagtgataaataaaacaaagtggaaaagtagagctgaagtatgtaggctgaaggaacaaagctgcaaaggtatggtgctgtcagttcagaatgccaggccaatgaactggattctatatagggtctgattagcagtctcaagcactgagaacactccagaaggtaaagaaataagagggaaacaatgtgtgcaatatacttctagaatctgtaacaaatgattatcaaataacttccatacataaaaggtaggcatggtggcagggagcagacaatggatacatttattcattaaggaaatatgtattaaattttcaccatcagccactctgatagatgctaacatcatacagctactaaattcaactcagatctgatttcaaatactcctgctctttccactgtatcatactaaatccattcatatggatacttttcttcaccttagggaaatataaattaagtttattccataaacttatccctaaaaacacaattatacaactttagaccttgaagggtcttagagcttatttggccaccaacatcctatacaatgttataggtgatgaagctgaggctcacctaagagaagttaaggggcatatttaaactcaaaaatacattttagatctatgccagggcacctgaatttccagtgttggtgcaacatgatgacagagacattggataataatacttcatgaatctttgaaattcaacctcagtacaaaaataacatataaactgggaaaaataatcatttcatcaaaatgaaggccaattatggagatcctcatataagaaatgagctcttttaaaaagggttagttggaaaactccaatagcatttgtctccaaactaggttgccttcaatggtacctgtagcagttgtcaaaaaaaatggtcacatccatgtatagcataatcaaatcatatgttctatttctgaaagttgcagagattttcaagaacattgcatttttatagataaaactgatttcttacagagaaggtaaacaatcagcctactttgtactgtgaaaaactttaagttctaccaagtgagctgctagaggctattctcatgccacattaggcagaagacaagcatggctgcaatattctaagttaacaacaatgacactaaagagatgatgaaattacagctgtggggttggcctttggacaattagatttcaagagtgacaaaaaaagagaacaatgcctataaaaaattttctctgctgaacacaacatgagttttatgacgaagtattattcaattttgacaaagcaaatttatcagaattcctcttgtgatgattagaaatttgacaaaattagaaaaagatatttattttcaggcaaagcatcatggcatcacttcacagtataacatataattttcttaaaatatatataacttatataggaatcctccctgcttcacaaatgtttctctaatatttttagaaacaaatttgccttttgtttaacatctaatacaatgtatcctgagtaaggttgtttggggccttgacatgggtggattaaagcatagggagatcataaatacatttcatcaccagcctgtagtctctgccctgggatcaagatgaaaagtcttttccctgaaataatcacatgattacccttatggtggcctggcttgagttacaagcaaaacccttctgtgttcacaaccaacatgaagcaagtcaaacccttcccttggtccaggatggttcagattatggtccagggtagttcagactatgaaaggaagtcagcagcagcagaaagctgaaaacagaatagatgatacctaaatatttgggggcattaaattttattaggaatgaaaggattatgaaccattccttatttgtctgtatcacttggctattcgctgtgattaagagaatcaaaatatagcctggccaagttaaaggatgtatccccaatttcaacagatcctaaaattagcccacagtcagatagattttgggttagggaatacattacactacagttgtaagaattattaatatgaccaataattaagcataccctcaaaaatatattaagcatatatgaactgtatatattaaaataatagattcataacaccacttacttcttgagtctgtatgtatttaagagaatagagctttaatacagacttacagctgtattaaatccctactctctcccttagtatgagtatgattttgagcttgctttcagaatcctaccccctaggattttataataattaactaagataatgtatataatgtattgagcagattatgtagccattgttgctagtattatttcaaatcttgacaggatttactcattttaagataaagagaaacaggactctgtgtgtgtgtgtgtgtgtgtgtgtgtgtgtgtgtaacttgatccttatccaattaagtagcattgttatgtggaaaaaagttttctccaaactatttaggaaatagtatttattaatttattgcagttattgtacttaaaaacatcttatgtgcataaactcatgtaatcatttatacatgcaaaaatagacatatcagtaaagctaaaagagttcaccgtaccagaagaacccttagagataatctctcttttccttcagtttgcacttatataaaaactaaggaccatcaccggaataagtaatttatattttcgtggttataagtttttccagttacacaactattcaatgccagagagactgatttaataaaaaaatcacccaatccaattgtctttcctactaagcatacccaatatttatgtcaacccccattattggctaacagccaataaatgcaaaattccatacttgtgtaaagtatatctcaaatgctaaaaaaaatttgtcaagatatactaacaattaactgaaaaatatacctagtccatttccaacaataagatgtgatatatgtgtatgtgtttgtgtgtgtgtgtaaactgcatatgtaagtaaacgtgtaaagaaagaaaatactactttctgcctctaaattggtacagactattctttaatttcctccaccagcacatgaaagcttaggacacaggcaatagcaaaaagagcctgccaggaactatttcactctgtatgaaattctggtcttggaatttccttaaatccacattttcttacaaggtcatgaaaaaggtcatgtttaaatataagatgggccattatatattttttctacttaagtcaatataagtttctaatcccttttcatgagaactataaagtttatttcagcaaaagcctttctgcccatgctgaccatgccgaagcttttctaagttgtagcaaaacaatcacaaatgatgtgataaaagttcatatcatatgagttgaattataaacaagcacttgatcaaatatacaaaaggttgtaattcatttaacttaactaagtgcctagttggtataagacaccataatagatgctatataaagaacagtagcaatatcttcacttcttaagtttcttttaatcttatttttaaagggttcctcctatccaagaatgtaaaatttgaaagaaacattaagtataccagtccttattccaaaaagaatatagttttatctgtaggaaaatgagtgcaggttttcccacagttattcctttatacttcattacatcaattaacatgaactgacagctggtactaggcactgtgctttcatatatattatttccattaaatttcattaaatgcccttaggtaggaattattatcttaatttgcaaactgattacatttctaagtgaaagaaaccaatctgaaaagcctacatgctatatgattccaactatgtgatattctggaaaaggaaaaactataaagtagaaagatcagtggttaccaggggctagaggttgagagacagagataaatacatggagcacagaggatttcaagggcagtgaaaaatgctctgtatataattataatgatgaacacatgtcatgaaacatttgcccaaactcataaactgtacaaaatcaagagttaatcctaatgtatgataataatgtgtcaatgtaggttcattgacacaacaaataataccacttttctggaggatgttgataattggagaggctatgtacatgtgggggtgggggtatgtgagaaatctcttcctttaattttgcgataacctaaaactgctctcaaaaaataaagtctttaattaaaaaaaaagattatactgagaattagaaaaattaagtaacttgtcatacgtcatttaactagttagtagtgcagctgagataaataaaactttgttaagaaagtgtctcaaggccaggcatggtggctcatgcctgtaatcctaggactttagaagattcaaagctggaggattccttgagctcaggagttcaagaccagcctgggcaaaataaatgagacctcatctctctaagctttttttaattagccaggtgatacagtttggatgttgtcccctctaaatctcatgttgaactataatctcatgttggagttggggcctagtgggaagtgactggatcatgggggaagatttctcgtgaaaagtttatcaccttcttcttggtgctgtcttcacaatagtgagtgagttattgcaagatctggctgtttaaaagtactcggcaccctcctcccccttcctctctattgttccatgtgacatgcttgctcccactttgccttctgccatgattgtgagcttcctgagtccctcaccagaagcagatgccaacattacacttcctgtactgtctgcagaaccgtgagccaattaaaccttttttctttataaattacccatgcttagatgtttctccataagaacacaggaatggcctaatacactgggcatggttgcaagtgcctgtagtcctagctacttgggaggctaatgtgggagaattgcttgaacccaggaggtcaagaccagcctgggtgacagaatgagaccctgtatcaaataaaaaagggggtgggtctcaaactgagaaataatagccatttgcttatcagactactaactgatattacaagataattatcttgttattacaatagtcaatatccattaataatacttcatgaatgaattttaaaggctatactctttttatcttgttactgctagtgaatttcatcactgacaattgctatttatacatatacatatgcatactgaaccctatctaagagacaatagggcataatatagttaagtacacaatagaagaagatggcctaacttccaatctcaggtatgccactaccaactgtttgaccttggaaaaggtacttaactgcactgtacctcagtttctccatctgtaaaataacaataataatagtacttacttccctatgccttatgggtgttataaagaataaataatatttgtaatttttgaagtatctggcatatggtaagagttatgtaagagcttgttaaatatatacattcatacacacacacacatatacatacccacatatatacataagtatattatatgtttctttgcaagtaaaggagatagagggttagaaatgggttgctattttaaatagggtggtcagaaaagatctcctttgagggtgatttgagtagaaacctgaagaaagtaaggggacgtaagccatgtggataactgaagaaaatgtgttccaagaagaaggaacagcaaaagcatatatcctgaggtgagagtgttcagcacagtcagtaaagacaaggacaccagtatggtctgaacagagttagcaatgaagacagaagtgggtattggagaggtaggggatcatgaaggaccttaaggatcagtgtaaaaacttaggtttttagtctaaagcagatgagatgtaatcagaagattttgagatgacatatatttttaaagaatcactctggctactacctgaaaaactaactgtaggggtagaaaagtggaagcaaggaaaacatcaggactcattcatcaggatttacatttgctaatgaatctgatatagattgctagagaaagagaggatttaagaataacttcaaggtttctggcttgaagagcatgaagaattgagcttttgtctattgagaaacagatttgaaaggggagaaaatcaaaagtttatgtctgggcatatatgtttgggaagcctattagatatccaagtaaagatattaagttgagagtttcatacacaagtatggaattcagtagagatgtcgaggcttaaggtataaaggtgggagccatccacatttagataatacttaaaggaactaaactgaataagatgacatagggaaccagtagataggaaaattttctagagtactaaatcctgaggtatttcaaaggtttaaggttcaggaaaatgagaaacaaacaagtgaaacatcaacaacaacaacaatgagttaggaggagagccaagagagtggtctcagaagctaagagatgaaacagtttcaaaaaggtagaggacataatcaactgtgtcaaatcctgccaaggtcaagaaaatgaagaatgagaaaaactgactattgcatttggtaaactggaggtcactgatgaccttgacaagagcttcagtggagtagtgggcaatgaaagcctgattggagcaggttcaaaagagaaaggaggacaagtggtaatatcaagtacagtaaactcttttgggggaagttttgctgtaaaggagaatagagaaatggagcaaatgatggaagagtatgttagaaggagaggcgtcaggtggtataatccaatatcagaaccttgaaagataaatttttatgggaaggagtttagaacaattatctggaagtgacaatgagatgaatgaagaataaaaaaaaaaagaaaaagaaaaaagaaagaaaaccgcgccaggcacggtggctcacgcctgtaatcccagcactttgggaggccgaggcgggcagattgcctgagctcaggggtttgagaccagcctaggcaacacggtgaaaacccgtctttactaaaatacaaaaaattagccgggcacggcggcatgcgtctgtagtcccagctactcaggaggctgagacagaagaattgcttgaacctaggagatggaggttgcagtgagctgcgatcatgccacttccctccaggctgggcaacagagcgagactccatctcaaaaaaacaaaaaagaaaaccaaccttttgaatgtaggggaaacttttcaaaggatatctagttttcaattacagtaaacttgtggaagggaggttcagagttgagattgagattatagattttgctgatgataaaccatgagttccagaggacatagtagactattctgggcagttatacaggggtggatggaatgtgggagtggggttgtatagtgccataaagaaatgagagtccggattaaaaataatgagctggactcgcgagccttttgtaactgaaataaatagaaaaataagaaatacattatttctgtgattgttgagaggaagaaatggtggaaatcttgtgagaagcacactgagctctagcaccacctcttcactcctacagatggtggaataaacggcaggcaagttcaaaatcacatatagtcattattgcaagatagttctatggatatagatactacatacaatataaatcatgctcattgaatggttcagtggaaactactctgaacttcaaatcaacaaacttgggacatcaccaagatagcaaaatagaaggtaaccccactgtcagtctaaagtctttttatgggagccacaggattgaggcaggattttgtgaaacccctagtggagcccaaaacctaggagggtcattttcagagtgtaaactgatgcccaggtggctgatctgccccacagagtgtgcttgctggttcaagcctggaaaagtcccagtcccctaagaggcttggctacagtcccatttggccttgagcctgcaaccaaaaccatctgccacggggtccaaaaggaatcacacacaatagtgcactggtgaaaaggctcacctacccccttacattggtcttggcagtgaatcttaaagttgcctgtgctttggctccagccttcctcacctgaggtcccagctcacaactgcttgcacagggacctgtattttacagcccaggagtatgagattccctgactggcatgccaacttctgtcacagcagatcctgaggggctaagtctcagctttggttcttcttgctgtggttgaggaactattccatctgcgctaagacctgctacaacacatgtatctgtatggactaaagagatgggctccccagcctctgtcccacaggagatcccaagagggcccagtcccagatccagctcccctgctataatgagaaaactatcccatctgtgcagggacttgcgaggagacatgcctctcaaagtcaacaagaccaggttctctagcctatatcccacagcaaatcctgagagggattagtctcagctccagtcccttccactgcagttggggagctatcccatctgtgatctgatggttactgtaagaaaaagtatctggacagttataggaaggcttctctgagaacgcagtaataagaaacagtaataacaacatctaatattttatagtatgtaacattaccaaacattattcaaagtgttttataaatttagctcatttaatcttcgcaacaaccctatgagctacatattcccattttatcagaaactggagtacagattgattaagtaatttgttcttgtctcacaggaactacgtgtaagagctgggcttaaaacctaagcaacctggaaaaaatacctatatcctagaccattatgctaccctaacagtttgctaaatgtcttagtttatcttcttctgctataacagaataccacagactaggtagtttataagaaaaaaaaacaccttatttggctcaacagttctgtaggctgcaaagtccaagaacatgccacatctggtgaggataattccacaacaaaaggcagaagggcaagagaacatgtgaaatagagggaaacaaagaaccaaaatcccacaataactaattcactccacaataacagcattaaatgattcatgaggacagaactttcatgactaatcacctcttaatggtccccgctcttaacactgttataacgacaattaaatttcaacatgagttttaaaggggacattcaaaccatagcattcatctgctggcaccccaaatctcatttcctttgcacatacaaaatacatttattctgtctcaatagccccaaagtcttaaccagttcaagcacaaactcaaaagtccatggtctaaagtctcatagaaatcaaatatgggtgagactcaaggcatgattcttcctgaggcaaattccctctaactgtgagcctgtcaaatcgaagcaagttatctacttacaaaatacaatggtggaaaaggcataggatagacattcccattccaaaaatgaaagacaggcaagaataaaagggtaacaatgtccatgtaggaacaaaactcaacagggcaaacaacattaaattttaaagctgaagaataacctccattgactacatgccccacatccagggcacactggtgtggatattgggcccccaaggcctcaggcagtcctgcccctatggcgttgctgggctcagcccacacgtcagtgctcttggattagagcctcatgcctgcagctctctcatgcttgagttggatgctggtggccctacagttctgtgatcttgaggatggccccataccatggtttcactaggctttacactgataagtactgtctgtgacagctctgcacctgcagcaggttgctgcctgggcaactaggctatttgcaacatccttggatatagaggtagacagagctacactctccatagcttaacatcacatggatgacaccaaggtttatggcatgtaccttctagagcagtgtattgagccacacctgtgcctacttgagccacaactaggacagctggaaagcactgtgccagaatgcaagaagtagactctcaaggaggccctggcagcaagcccatggagggtgccccaggcccatccctaaaaacaattcttccctcctagagctctggacctgtaatggaaggagcatccttaagggtctttgaaatgccttcaaggtctttctcccattgtctatatgaatagcacctggctctcttctagccatggtaatctctttagcaaagtatttcctggccacaccattgtttcactctcctaaagactccttatcattctactttgccaggctgtgaattttccaaatctttccaatctgcttcccttttgattataaattgtgtctttgtctcatttatttcctctcacatctctctgtatgtggttaaaagcagccattttaaaagtttaaatgctttgttgcttagatatttcttccaccagatatccttgttcatcactcctaagttctgcattccacaaagccaagaggaagtgaaacaattcaaccaaagtctttgcaactttataatgaggatggtctttactccagtttccaataccttttccttacttctgtctgaacttcatcagaatagcctttgctgtctatatatctaccaaaattctgctcacaaccacttaagtaatctcttggaaaattcagaatttccatatagatctcttgagccctcaccagaatcacccttactgcttcttttatggcaatacaggattcttctagcctactcctccaagttctttgagcctctatctattacgcagatccaaagccactcccacatattcatatatttgtgatgacaacagcctgagattcctgtaccaattttctgtcttaattcattttctgctgctataacaaaataccacagactgggtgatttataaagaaaaaggttatttggctcacagttctgaagcctaggaagtctaagagcaaagtgtcatatctgaggagggtgataccatggtggaagacagaagagcaaaagggcccataagagagagaaaaggggggctgaactctcatgtaactaacccactcccacaataatggcattaatcccttcatgacctaatcacctcttaaaggtctcacctctcaaaaatattacaatagcaattaaatttaaacataaattttaaaggagataatcaaaccataacactgaataaagataattaaaagaggctacttaggacaattttaagtaaaaattatcgggcagttccaagatgaccaaacaggaacagctccagcctacagctcccagcgtgagcaacgcagaagacaggtgatttctgcatttccaacggaggtactgggttcatctcactggggcatgttggacagtgggtgcaggacagtgggtgcagcccaccgagtgacagccgaagcagggtgaggcattgcctcacccaggaagtgcaaggggtcagggaattccctttcttagccaagggaagccatgacagacagcagctggaaaactgggtcactcccaccctaatactgtgcttttccaatggtcttaacaaacggcacaccaagagattatatcccgcgcctggcttggagggtcccacgcccaccgggcctcgctcattgctagcacagcagtctgagatcaaactgcaagggggcagtgaggctggggaaggggcacccgccattgctgaggcttgagtaggtaaacaaagcggcccacaagctcgaactgggtggagcccactgcagctcaaggacccctgactgcctttgtagacgccacctcttggggcaagggcatagccgaacaaaaggcagcagaaacctctgcagatttaaatgtccctgtctgagagctttgaagagagtagtggttctcccagcaaggagtctgagatctgagaacggacaggctgcctcctcaagtgggtccctgaccctgaggagcctaactgggagacaccccctaataggggcagactgacacctcacacggccaggtactcctctgagacgaagcttccagaggaatgatcaggcagcaacatttactgttcagcaatattcactgttctacagcctccgctgctgatacccaggcaaacagggtctggagtggacctccagcaaactccaacagaccttcagctgagggacctgattgttagaaggaaaactaacaaacagaaaggacatccacaccaaaaccccatctgtacgtcaccatcatcaaagaccaaaggtagataaaaccacaaagatggggaaaaaacagagcagaaaagctgaaaattctaaaaatctgagcgcccctccccttcaaaaggaacacagctcctcgccagcaacggaacaaagctggatggagaatgactttgatgagttgagagaagagggcttcagacaatcaaagttctccaagctaaaggaggaagttcgaacccatcacaaagaagctaaaaaccttgaaaaaagattagatgaatgactaactacaataaccagtgtagagaagtccttaaatgatctgatggagctgaaaaccatggcacaagaactacgtgatgaatgcacaagcttcagtaaccaattcgatcaactcaaagaaagggtatcagtgattgaagatcaaatgaatgaaatgaagtgacaagggaagtctagagaaaaaagagtaaaaagaaaagaacaaagcctccaagaaatatgtgactttgtgaaaacaccaaatctacgtctgattggtatacctgaaagtgacggggagaatggaaccaagttggaaaacactctgcaggatattatccaggagaacttccccaacctagcaaggcaggccaacattcacattcaggaaatacagagaacgccacaaagatactccttgagaagagcaactccaggacacataattatcagattcaccaaagttgaaatgaaggaaaaaatgttaagggcagccagagagaaaggtcaggttacccacaaagggaagcccatcagactaacagcggatctctcggcagaaaccctacaagccagaagagagtgggggccaatattcaacattcttaaagaaaagaattttcaacctagaatttttatccacccaaactaagcttcataaaagtgaaggagaaataaaatcctttacagacaagcaaatgctgagagattttgtcaccaccaggcctgcccaacaagagctcctgaaagaagcactaaacatgcaaaggaacaaccggtaccagccactgcaaaatcatgccaaattataaacaccattgatgctaggaagaaattgcatcaactaaggagcaaaataaccagctaacatcatcatgacaggatcaaattcacacataacaatattaaccttaaatgtaaatggaataaatgctccacttaaaagacacagactggcaaattggataaacactcaagatccatcagtgtgctgtattcaggaaacccatctcgtgtgcagacacacataggctcaaaataaaaggatggaggaagatctaccaagcaaatggaaaacaaaaaaaggcagggtttgcaatcctactgtccgataaaacagactttaaaccaacaaagatcaaaagagacaaagaaggccattacataatggtaaagggatcaattcaacaagaagagctaactatcctaaatatatatgtgcccattacaggagcaccaagattcataaagcaagtccttagagacctacaaagagacttagactcccacacaataataatgggagactttaacaccccactgtcaacaacagacagatcaatgagacagaaagttaacaaggatactcaggaattaaactcagctctgcaccaagcagacctaatagacatctacagaactctccaccacaaatcaacagaatatacattcttctcagcaccacaccacacctattccaaaattgaccacatagttggaagtaaagcactcctcagcaaatgcaaaacaacagaaattataacaaactctctctcagaccacagtgcaatcaaactagaactcaggattaagaaactcactcaaaacagctcaactacctagaaactgaacaacctgctcctgaatgactactgggtacataacgaaatgaaggcagaaataaagatgttctttgaaaccaatgagaacaaagacacaacataccagaatctctgggacacatttaaaggagtgtgtagagggtaatttatagcacgaaatgccaacaagagaaagcaagaaagatctaaaattgacatcctaacatcacaattgaaagaattagagaagcaagagcaaacacattcaaaagctagcagagggcaagaaataactaagatcagagcagcactgaaggagatagagacacaaaaaaaacctccaaaaaattaatgaatccaggagctggttttttgaaaagatcaacaaaagtgatagaccgctagcaagactaataaagaagaaaagagagaagaatcaaatagacgcaacaaaaaatgataaaggggatatcaccaccgatcccacagaaatacaaactaccatcagagaatactataaacacctctacgcaaataaactagaaaatctagaagaaatggataaattcctcgacacatacaccctcccaagactaaaccaggaagaagttgaatccctgaatagaccaataacagcctctgaaattgagacaataattaatagcctaccaaccaaaaaaagtccaggaccagatggattcacagccgaattctaccagaggtacaaaaaggagctggtaccattccttctgaaactattccaaacaatagaaaaagagggaatactccctaactcattttatgaggccaacatcatcctgataccaaagactggcagagacacaaaaaaagagaattatagaccaatatccttgatgaacatcgatgcaaaaatcctcaataaaatactggcaaaccaaatccagcagcacctcaaaaagcttatccaccaggatcaagtgggcttcatccctgggatgcaaggctggttcaacatacaaaaatcaataaacataatccagcatataaacagaaccaaagacaaaaaccacatgattatctcaatagatgcagaaaaggcctttgacaaaattcaacatcccttcatgctaaaaaactctcaataaattcggtattgatgggacatatctcaaaataataagagctatctatgacaaacccacagccaatatcatactcaatggacaaaaactggaagcattccctttgaaaactggcacaagacagggacgacctctctcaccactcctattcaacatagtgttggaagttctggccagggcaatcaggcaggagaaagaaataaaggggattcaattaggaaaacaggaagtcacattggccctgtttgcagatgacataattgtacatttagaaaacctcatcatctcagcccaaaatctccttaagctgataagcaacttcagcagcaaagtctcaagatacaaaatcaatgtgcaaaaatcacaagcattcttatacaccaataacagacaaacagagagccaaatcatgaatgaactcccattcacaattgcttcaaagagaataaaatacctaggaatccaacttacaagggatgtgaaggaactcttcaaggagaactacaaaccactggtcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagacaatcctaagccaaaagaacaaagctggaggcatcacgctacctgacttcaaactatactacaaggctacagtaaccaaaacagcatggtagtggtaccaaaacagagatatagatcaatggaacagaacagagtcctcagaaataataccacacatctacaactatctgatctttgacaaacctgacaaaaacaagaaatggggaaaggattccctatttaataaatggtgctgggaaaactggctagccatatgtagaaagctgaaactggatcccttccttacaccttacacaaaaattaattcaagatggattaaagacttacatgttagacctaaaaccataaaaaccctagaagaagacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtaaacaggccacctacagaatgggagaaaatttttgcaatctactcatctgacaaagggctaatatccagaatctataaagaactcgaacaaatttacaagaaaagaaataaacaaccccatcaaaaagtgggcaaaggatatgaacagacacttctcaaaagaaaacatttatgcagccaacagacacatgaaaaaatgctcatcatcactggccatcacagaaatgcaaatcaaaaccacagtgagataccatctcacaccagttagaatggcgatcattaaaaagtcaggaaacaacaggtgctggagaggatgtggagaaataggaacacttttacactcttggtgggactgtaaattagttcaaccattgtggaagacagtgtggcaattcctcaaggatctagaactagaaataccatttgacccagccatcccattactgggtatatacccaaaggactacaaatcatgctgctataaagacacatgcacacgtatgtttattgcagcactattcacaatagcaaagacttggaacgaatccactgtccatcaatgaaagactggattaagaaaatgtggcacacatacaccatggaatactatgcagccataaaaaaggatgaggtcatgtcctttgtagggacatggatgaagccggaaactatcattctcagcaaactatcgcaaggacagaaaaccgaacaccgcacgttctcactcatagtcgggaactgaacaatgagaacacttggacacaggaagtggaacatcacacaccagggcctgtcgtggggtgggagtatgggggagggacagcattaggagatatacctaacgtaaatgatgagttaatgggtgcagcacaccaacatggcacatgtatacatatgtaacaaacctgcacgttgtgcacatgtaccctagaactcaaagtataacttttaaaaaaaagaaaaaaaaacaaacaaacaattctaattgggttaaacaaattaaaaaagggtcttagaaaaaaaattgtcttcaatatcctaaaactcactaagagcaatgcaattcaatatatcaaacgaaaatttatattcataattttaaattttaaccatcaatgcaaatatatctaagtattagggttctccagaaggacacaactaataggatatatgtatatttgaaagggagtttattaggatcaaaggctcacacgatcacaaggcaaagtcccacaataggccatctgcaagctgaagaagaaaaaagccagtagtggctcagtccaagtccaaaagcctcaaaagtagtgaagccaacagagcacccttcagtctgtggctgaaggccagagagcccccagaaaaccactagcgttaagtccaagagtccaaaagtcgaagaagctggaatctgatgtccaagggcaggagaaaaagaaggaagcatccagcatgggaaaaagatgaaagccagaagactaagcaagccagcatatcccaccttattctgcctactttgctctggcggcgctggcagccgattggatggtgcccacccacagtgagggtgggtcctctccctcctcccagtccactgactcaaatatcaatatcctctggcaacaccctcactaatacaaccaaaaaaatactttaccagctatccaggcatccttcaatccaatcacattgacacctaatattaaccatcaccatcttgttttctaagaaatgaaaattttctaccaagttaaagggagaaataaacacataaaagaatttgtgctttctgcatttattgagaaaatcatgtttttgtcttttgtggttttgtttttgtttatgtgatgagtcacatttattgatttgcctatagtgaaccaagaatcctggggataaagcctacttgatcactgtgtataagctttttcatgttctgctggattcagtttgccaatattttgtcgaggatttttactctcaataaactaggtattgaaggaacatagctcaaaataataagagccatatataacaaacccacagctaacatcatactgaatgggaaaaagctggaagtattccccttaaaaacaatcaaaagacaaggatgccctctctcaccactccaattcaacatcgtatttgaagtcctcgccagggcaatcgggagagagaaagaaataaaggtatccaaattggaagagaggaagtcaaagtatccctgcttgcagacgacattatcccatatctggaaaacaccatcatctcagcccaaaagcttcttaagctcataaacaacttcagcaaaatcttacaatattttatatacaaaatcaatgtgcagaaattgctagcattcctacaaaccaacaacagccaagccaagagccaaatcaggaacaaactcacattaacaattgccacaaaaagagtaaaatacctaggaatacaactaactagggaggtaaaaaatctctacaaggagaactacaaaccactgctcaaagaaattagagatgacacacacaaatggaaaagcattacatgctcatggataggaagaatcaatatttttaaaatggcaatactgcccaaagcaatttatagatttgatgctattcctattaaattagcattgagattcttcacaggtgaactagaaaaaaaactttttaaaattcttagggaaccaaaaaaagagctcgaatagccaagacaatcctaagcaaaaacaacaaagctggaggcatcacgctactcgacttcaaacaatcctacagagctacagttaccaaaacagcatgtattggtacaaaaacagacacatagtccaatggaacaaaatagaaaccaagaaataagactgcaaacaaacaactatctgatctttgacaaacctgacaaaaacaagcaatggggaaaggacaccctgttcaataaatggtgccgggataactggttagccatatgcagaaggctgaaactggatcccttccttttaccaaatacaaaaaccaactcaagatgaattaaagacttaaatgtaaaacctaaaactataaaatccctagaagaaaacctaggaaataccattttaaacaaatgccctggcaaagatttgatgatgaagatgtgatgatggtgacaaaataaaaaaaaaataagtgtgacctaagtaaactaaagagcttctgcacagcaaaagaaacgatcaacagagtaatcagaaaacctacagaatgggagaaaaattttgcaaactatgcatttgactaaggtctaatatcaagaatctataaggaacttaaacaaacatataagaaaaaacaaaataaccccattaaaaagtgggcaagggacatgaacagacacttctcaaaagaacacatacaagtgaacacaattatatgaaaaaaaagctaaacatccctgttcactggaaaaatgcaaatcaaaaccacaatgagataccatttcacaccagtcagaatagctattattaaaaagtcataaaaataactgatgctggcaaggttgtggaggaaaaaaagaatgattctacaatgttgggggaagtgtaacttagttcaaccattgtagaagacagtgtggtgattcctcgaagacctaaagacagaactaccattcaacccagcaatcccattactagagtatatacccaaacgaatataaattgttctattatatagacacatgcgtgtgtatgttaattgcagcactattcacaatagcaaagacatggaatcttcccaaatgtccatcaatgatagactggataaagaaaatgtggtacatatatacaatggaatactatgcatgcagggacagggttggagctgggggccattatccttagcaaactaacacaggaacaaaaaaccaaatactgcatgttctcacttacaattgggagttaaatgatgagaacacattgacacatagaggggaacaacacacactggggccttctggaggatggagagtgggaggagggagaggatcaggaaaaataactaacgggtgctggcttaatacatgggtgatgaaataatctgtacaacaaacccctatgacatgtttacatatgtaacaaacctgcacacatacccctgaacttaaaagtttaaaaaaagaatgggtgttacctaatccaaatataaaataaaaagttttatttggatttatttatttatttatttatttatttgattgattaggttcacaaatatttatttagcatttactatctagaaggcatactgctggtcactgcataggtgtatgaataatatctaagttttatagtgcttgctatatgccaggcatcatgctagtatttcaattaagatgataaactatccaatttaatcctcatatctcccacaacaataaggtaattgctattattatttacactgtaacagaaaaaatagagaaactgagaataatgccctcaaaatagtaggggaggaggagcaagatggctgaagaggagcttccaccaatcgtcctcctcatgggaacaccaaaattgacacagcaactgggggatactgcattggaatgcactggaatgcagtgctgccaccactgaataaagtactctggggtcctaaataaacttgaaaggctgtctaggccacaaggatggtaactcctactgctgtgctgggctaagagccagtaaatgggaagaagaggagccaggtaacctagtgcccagtgaaacaccagcgaggtggctaagggagtgcttacatcacctcttctctaatccaaagcagtgtggcttgtagctcatggggtgactccatcctttcacttgagaaaaggaaaaacaggattggagaggactttgtcttgcaacttggatgtcaacttagctacagtgggatagggcacctggcagagtcacggggccctcattccaggcactagctcctggatgacatttctggacatgccctaggctgaagaagagccttatttcttaaaggaaaggacctggtcctgacaggattcgccacgtgctgactgaagagccgttgagccctgaataatcatcagcaacaaccaggtggtacaggctgtgggtcttgagtgatagtatgagacatgctggcttcattcacagccatcatggctacagggagtggtcccttctccttgagaaaagcaaggggagaaatgaaggggactttgtcttgagcttgggtgtcagcttggccaaagagggacagggcatcaggtggactcgtgaggtctctgattcgggccattgctcttggacagcatctctggacatgccctgggccaaagaggagcccactgcaatgaaacatgagccctacacctggcaaaatataccacaagctggctgaagagcccttggatctgaagtgaaattggcagtgccctggcggtgctccccgtgggcaggtggtagtggtgaacacaaggagattcctctgcctggggagttggtgagggaagagtgggaagaactttgtcttgtgtcttggatgccagctcagccacagtagaataaagtgccaggtagattcctaaagtttctgaatccaggtcctggttcccagatagcatctttggatccacctggagcacaggagaacttgccaccctgaaggaagctacacaagcctgtctggctttgccacctgctgactgtacagcccccaggccttgagcaaacataggtggtagccaagtggtggttacagttgacctcgagcaagactcagggctatgctggcttcaggtctaacccagtgcagtcccaaaggtgctggccacagaggtacttgtgtcacccctcctccagctccagacagttcaaaagagaaagagacgttctgcttattttagagaaagtaagagaaaagaacaagagtctctgcctggtaatccagagaattcttccagattttattcaaggccaccaaagtggtgcacctatgagtctgcaagaaccagatcattactaggcttggggtacccttaatgcagaaacagctgcagtgaccgaaaacttagatcacaatacccaagtccctttgaatacctgaaaagccttcccaaaaaggaggagtacaaataagccaagattgtgaagacaacaaaaaatatgtaactcttcaatgcccagacaccatcaaacatccacaacattaaaaccatccaggaaaacaggacctcatcaaatgaaagtgaactacataaggcactaggaaccaatcccagagggacaaagatgagacctttcagacagagaattaaaaatagctattttgaggtaactcaaagaaatctaagataacacagagaagaaattctgaattattaagtttaacaaagagattgaaataattaaaaagagtcaagcagaaatcatggagtaaaaacttgaaattgatatactgaagaatgcatctgggtctcttaataccagaattgatcaggcaaaggaaaaaattagtaagctcaaagacaggctgtagggttcactagagggacagaactaataggatatatatatataaagggagtttattaaggagtattaattcacacaatcacaagataccacaataggccatctgcaagctgaggagcaaggagaaacagtctgagtaccaaagctgaagaacatagagtttgatgttcaagtgcaggaagcatccagcatgggagaaaggtgtaggcttgaaggctaagccagtctagtcttttcacgttttttctgcctgcaacattctggccacattggcagcttattagatggtgcccacctgattaagggtgggtctgcctttcccagcccaccaactcaaatgttaatctcctttgccaacaccctcacagacacacccaggatcaatactttgcatctacaatcaaatcaagttgacactgagtattaaccatcacaggctgtattagtccattttcacactgctaagaagaaatacctgagattagtaatttataaaggaaagagttttaatggactcaaagttccacatggccatggagacctaaagaaacttacaatcatactggaaggcaaagaagaagcaggcacctccttcacagagtaacaagatggagtgagtacaagcaggggaaatgccagacgcttataaaaccatcagatcttatgagactcaagcattatcacaagaacagcatgggagaaaccacccgaatgatccaattatctccacctggtcccacccttgacatgtagggattatggggattacaattcaagatgagattttgggtggggaaagagccaaaccgtatcacagtttatatgaaagtacacagtcagaggagacaaaaaaaaaaaagaatgggaaagaatgaagcacatctacgagatctagaaaatagcgtcaacaggacaaatctaagagttattgaccttaaagaggaaggagaaagagacacattaaaagtcaaaacatctagcatctgatcaaacattatgtagcatgcaatagtcagaaaatgctgccaataattaacagaataatcaatcagttaaaactgacccagaattaaaagaaatgataaaatagacaaggacataaaaactgttattttaactgtattccatatgttcaagaagttagagaaaatattgtacatattagatagacatatgggaatgtacaaaagttcaaattccacttttagaaacaaaaatatataattaacgagataaaaaattatactgaatggaatgaagattcacattgaacattgtagaagaaaagaatgatgatgaaattaagacacagaaacagaaattatctaaaagaaaaaagactaaaaacataagtatcattgagctgtgggacaacttcaagcttgtgctattggagtaccttttttattttttatttttatttttatttttattttttgagacggagtctcactctgtcgccaggctggagtgcagtggcaggatctcagctcactgcaacctctgccacccgggttcaagcaattctcctgcctcagcctcccaagtagctgggactacaggtgagtgccactgtgcccagctagtttttgtatttttagtatagatagggtttccccatgttggccaggatgatctcgatctcttgacctcgtgatccacccaccttgacctcccaaagtgctgagattacaggcgtgagccaccgcacccgggctgaagtaccttacagaaagaaaagattggaagaggaaggatagagaaaaattatgtgaggaaataatggtcaaaatttaccatatttgatgaaaactataaacccgtatatccaagaaaatcaacaaattgtaagccaagaaaccagaatagaattacagtaaggcacatataatcaagttgcttaaaaccactgatataaagaaaatcctttctcaaagaaccaacagttgacccaccatttgaccctgtatcccattaccggtatatcctcaaagaaaaaaaaaaaatcattctaccaaaaagacacatgcacccatatgttcatcgcagcactatttgcaatagcaaagccatggaatcaaaccagctgaccatcaattatggattagaaaaagaaaatatggtacatatatggcataaaatactagacagccataaaaaagaatgaaatcatatcctttgcagcaacatggatgcagctggcaacaattatcctgagcaaattaatgcagatacagaaaaccaaatactacatattctcacttataagtgggagctaagcattgggtacacatggacataaagatgggaatgatagacactggggaatacaagaaggggaggggggcaaagattgaaaaaccacctattgggtaacaggctcacttcctgggtgacaggttcaattgtactccaaacctcagcatcacacaatatacctttgtaacaaacctacacatgtaccccaagaataaaaaataaaagttgaaattgaaaaaaaaatcctaaagcaaccccaaaaaaggacacattattcacagaaaaataaatgtaagaatagcttatttcttgtcagaaactacctagaacaaagtggaacaacatttttaaagtagtgaaagaaaaaaataaaaactagaattatttatccagtaaaaatatgtgccaaaaactgaagtaaataagtaaattttgtggaatttaaagtacatttcaataagctgtttataaacaaaattaagattaaatgaagactttatctgacatacacaagctaacagaattgatcaccagcagtccttcattaccaataaatgataaagtttcaagcagaaaaaaaaaagattccagctggaaactggggtctacctaaaggaattaaaggcagcagaaaatgtaactacacaaataaagactttttatattatctaaacttatcttaaaataataacaatgtattgtgtagtctataaaacatataaaagtaaaatgtttcataacaatagcacaaaggtcagacggataaaaattgaattataatactctcagttccatatgctatacatgaagtggcatcacatcatttgaatatagactgtgataagttacagatgtattttttaagaaatccatcactaaaataacataaaagttatacttaataaacaaagagaataaagtgagataataaagactactagttctttaagaaagcaaataaaattgatacacttcacatggtgatcaataataaaaaagggaaaaaacagaaattatccattttttagaatgagatactgaaatcactatagactctacagatattaaaggttaataaggaaacattatgaacaactttacactaataaatttgacaaattaggtaaaattgataaattccttgagacacacaaattactaaaactcaggacagaaaaattaaataatgtgaaaagcttcatataaaataaagaaattgaacttaaagataaaaacctacccacatagaaaattccattcccttttagttgttgaactccaccagacataaggataaaaataacaccaactctacacaaactctttcagaaacttgaaaagaatgccagtattattctggtacaaaaaccaaatgaagacattacaagaaaataaaactacagaccaatatattcatgaacatatatgcaaaaattctaaataaacttttcacaaatcaaatcccactacacaaaaaaacacatgatgtatcatgattaactgggatttatatgaagaacacaaggttggtttaacattcaaaaatcaaccaatcatcaaattaacataccaaaaacatgtaacgatctcaatatatccattaaaagcatatgatgacgtcaaatacccactcaataagattctcagcaaaataggaacagaggcctcagcatgataagaaaaatcaacaaaaaaatacagtaatatcgtacttaatggtaaaagactcaatgtttttccacaaagatcaggagcaaaccaaggatatctacatcaaccatttgtattcaacattgtatttgaaatttgagccaggtaaatgaggcaagaaaaaatttaaaagcatcctgatttgaaaatagaacttaaaactgtctttattcacagatgacatgattgcctatgtagaaaatcctacggaaaagaatataaaagcaccactagaaataattaatgagtataacaagattgcaggatacaatgtcaatgaacaaaaaccaagtttatttctacatatccgcaatgaacaatcataaatagaaatgttaaagtacttcttacaatagtgtataaatatgaaatacttaaaaataaatttgaacaaagacatacactatctctatattataaactacaaaatattactgagaaaaaaataaagacttaaataaatgaagatatactatattcatgagttgaaagaatattgttaagatagtgcattagtccattttcacagtgctataaagatactacctgagactgggtaatttataaacaaagaaggtttaattgactcacagttctgaatggcttgggaggcctcaggaaacttacaatcatgatggaaggtgaaggggaaacaaggcacatcttacatggtagcagaagagagagagcaagacgggggaagtgccagacacttatcaaacaaccacatctcatgagaacttactatcatgagaacagcaagggggaaattcgcccccataatccaatcacctcccatcaggtccctccctcaacacatggggaatgcaatttgagatgagatttgggtgaggaaacagagctaaacagtatcagatggcaattttccaaaaattgatctaaagatttaataaaattctaattaaaattccactgagtatcattttagaaattcacaagctgattctacaatttatacaaaaatagtgaggacctagaagagccaaaaacaactttgacaaataaggacagatttggaagactaatgctacctaacttccagatatattatgaattcacagtaattaaggcaatgtggccccagttgtgtatccctaatccaaaaatccaaaatccaaatgctgcataatccaaaatgttttgaacaccgacatgaaactcaagaaaaacgtttagaggagcatctcagattttgggttggcagattaataatgatcaactggtaactataatggaaatattccaaaataaaaaaaatccaaaatctaaaacatttcttttcccacacaattcaaataagggatattgaaactgtactggcatcaagataggaaaatatatcaatggaacagaatagagagttcagaaataaaactagacatacatggtcagttgattttcagcaatgatgcaaaggcagttcagtcaagaaaatataatagtcattttaaaaattagattgagaacaactggatgttcacatgcaaaaagaaaaaaaaacttcaatccctatgtggcaccttataaaaatgttatttaaaatgaatcattggccttaaattaatatgaaaactataaaattcctagaagaaaaacataataaaaatctttgtaaccttcagacagacaaactcttcttacacacattaccaaaagtaagatcaataaaagaaattgataaactggacttaatcaaaattaggaacatctaccctttgaaagacaagagaatgggaagtcaagacactaaccggatgaaaagtgtaaatcaggtatctgataaaacacatatcaagaatatataacaacccctcaaaactcaaaaataagaaagaatgacagcagcaaaatggaaaaataaaaaatcccaacccactttcctccccacaaaccctcctagacagaaacattgatgaaaaaacaatatttgggtcaaaataccattatcaaacccaactgaaaaattccctagagagcttctaaagtcgtctgacgaagcccactaaagaatcagcaaatgcaaaaactaaaattattcaatcagagtagaaaatagaaaaatagtttaaaaagagtcaaggaagtctacaaaccttatgaaacacaggcgggaaaacctgtatacacatcatgggaatgccaaagaagacgagagaccaaaaacgtcagaaagcatatttaaaggaagaatagggttcaaatacttcacaaatcttctgagggaaatggacatccagatttatgaagcccaaaatatcccaaacaggatgaaccccaggaattctacactgagataaacctgcaatcaaattttcaaaatttaaaggcagaaagaaatttgaaagcagcaagataaaaacaaatagtaatgtacaagtgagttcccaaggctatcaccaatttcccaggagaaatattgcacatcagagggagagggcatataattcaaagtaataaaaaaaactgtcaaccaagaatactatccccagcataactgtccttcaaaaatgaagagatagaggttcccaaacaaaagctgaggaaatatgttaccattattcctgtcttacaaaaaatgctaagggaattcaacaaaagaatgaaaaggtgctaaacagcaacacaaaagcatatgaaagtaaaaaactcactatgaaatataatatatagacaaattagaatactgtcatactgtaatgatagagtataaataacttgtcatttcagtgtaaaaatttaaaaaacaatattaagaactataaattacaaaaacttgttaatggattcacaataaaaaagacgcaaattatgacaataacaaagtgtgaggggggtgaaataaaagtgcagttttgtaagcagttgaagttaagttgttatcagctaaaaacaaactattgtaactacagaatattttatagacacctaatgaccatcacaaatacatacaaaagacatagaaaagaaaaagagaaaggagtaaaaaacattataagaacatcagcaaaaacacaaagggagatagcaagtgaggaaaaaagaaacacaatcagacaggacacaattaaaatagtaataatccatctctgttaataattactttaacataaattaaactccccagtcaaaacacatacaatggctgaatatataataaaacaagatccaagtatatgttgtctacaaaagatttattttattttagctttaaggacacatgtgggctgaaaatgaaggcataaataaaaacaagggacaaggaaacacatacaactataaaaggataaaatcatcataagtagatagcaatgtgtacatatgagagctattaaatatagaaagcaaatataaacagaactgaaaggagaaatcaacagcaatacaataatagtaagatatttaaatgcagcagtgtcaaaaacaggatatccagacagaaaatcaataaaagataaaactttaggtaaaatggacctaagagacatattcaaacattttacccaacagcagcagaatataaattctaccgaagcacacatggaacattctctataagtagtcatatgtgaggtcacaaaaagagtcttgataaatttaagaaaactgaagtcacatcaggtgtcttttacaaccacaactatataccacaactggtataaaactaggaatcaataacaggaaaaaagttgaaagattcacgattacagaaaaattcagctgcatgcttctgaacaaccaatgggtcaaaaaagaaattaaaaggaaaatcaaaaattatcttgaaacaaattaaaatgtcaacaaaatataccaaaacctgtgatgcaacaaaagtggttctcagacactttagaccaataaatacctatagtaagaataagaaagatcttaaatgagtaacctaactgtacacctcaagagactagaaaaagaagaacaaacaaaacccaaagctggtagaagaaagtaaataataaaatatctgagcagaaatcagagatacaaaaaaaaaaaaaaataggagagggcagccaagatggccgaataggaacagctccgatctacagctcccaacgtgagcgatacagaaaacaggcgatttccgcatttccatctgaggcaccgggttcatctcactagggagtgccagacagtgggcacaggacagtgggtgcagcgcaccgtgtgcgagtcaaagcagggcaaggcattgcctcactcgggaagtgcaaggggtcagggagttccctttctgagtcaaagaaaggggtgacagacagcacctggaaaatcaggtcactcccaccctaatacagcgcttttccgatgggcttaaaaaacggcgctccaggagattatatcccgcacatggctcagagggtcctacacccacagagtctcgctgattgctagcacagcagtctgagatcaaactgcaaggcggcagcaaggctgggggaggggcgcccgccattgcccaggcttgcttagataaacaaagcagccgggaagctcgaactgggtggagcccaccacagctcaaggttgcctgcctgcctctgtaggctccacctctgggggcagggcacagacaaacaaaaagacagcagtaacctctgcagacttaaatgtccctgtctgacagctttgaagagagcagtggttctcccagcaggcagctggagatctgagaacgggcagactacctcctcaagtgggtccctaacccctgacccctgagcagcctaactgggaggcacccccccagtaggggcagactgacacctcacatggccgggtactcctctgagacaaaacttccacaggaactatcagacagcagcattcgcggttcatgaaaatccgctgttctacggccaccgctgctgatacccaggcaaacagggtctggagtggacctctagcaaactccaacagacctgcagctgagggtcctgtctgttagatggaaaactaacaaacagaaaggacatccacaccaaaaacccatctgtacgtcaccatcatcaaagaccaaaagtagataaaatcacaaagatggggaaaaaacagagcagaaaaactggaaactctaaaaagcagagcgcctctccacctccaaaggaacacagttcctccccagcaatggaacaacgctggagggagaatgactttgatgagttgagagaagaaggcttcagacgatcaaactactccaagctacaggaggaaattcaaaccaaaggcaaagaagataaaaagtttgaaaacaatttagatgaatgtataactagaataaccaatatacagaagtgcttaaaggagctgatggagctgaaagccgaggctcgagaactacgtgaagaatgcagaagcctcaggagccgatgcgatcaactgcaagaaagggtatcagcgatggaagatgaaatgaatgaaatgaagcaagaagggaagtttagagaaaaaagaataaaaagaaacgaacaaagcctccaagaaatatgggactatgtgaaaagaccaaatctgcgtctgattggggtaccttaaagtgacggggagaatggaaccaagttggaaaacactctgcaggacattacccaggagaacttccccaaactagcaaggcaggccaacattcagattcaggaaatacagagaacgccacaaagatactcctcgagaagagcaactccaggacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggagccaatattcaacattcttaaggaaaagaattttcaacccagaatttcatatccagccaaactaagcttcataaaagtgaaggagaaataaaatcctttacagacaagcaaatgctgagagattttgtcaccacaaggcctgccataaaagagctcctgaaggaagcactaaacaaggaaaggaacaaccggtaccagccactacaaaatcatgccgaattatacagaccatcgaggctaggaagaaactgcatcaactaacgagcaaaataaccagctaacatcatcatgacaggatcaaattcacacataacaatattaactttaaatgtaaatggactaaatgctccaattaaaagacacagactggcaaattgaataaagagtcaagacccatcagtgtgctgtattcaggaaacccatctcatgtgcagagacacacataggctcaaaataaaaggatggaggaagatctaccaagcaaatggaaaacaaaaaaaggcaagggttgcaatcctagtctctgataaaacagacattaaaccaacaaagatcaaaagagacaaaaaaggccattacataatggtaaagggatcaattcaacaagaagagctaactatcctaaatatatatgcacccaatacaggagcacccagattcataaagcaagtccttagagacctacaaagagacttagactcccacacaataataatgggagactttaacaccccactgtcaacaacagacagatcaacgagacagaaagttaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagcactcctcagcaaatgtaaaagaacagaaattataacaaactgtccctcagaccacagtgcgatcaaactagaacgcaggattaagaatctcattcaaaacagctcaactacgtagaaactgaacaacctgctcctgaatgactactgggtacataatgaaatgaaggcagaaataaagatgttctttgaaaccaacgagaacaaagacacaacataccagaatgtctgggacacattcaaagcagtgtgtagagggattatacatttatagcactaaatccccacaagagaaagcaggaaagatccaaaattgacaccctaacatcacaattaaaagaactagaaaagcaagagcaaacacattcaaatgccagcagaaggcaagaaataactaaaatcagagcagaactgaagaaaatagagacaaaaaaagcccttgaaaaaattaatgaatccaggagctggttttttgaaaggatcaacaaaagtgatagaccgctagcaagactaataaagaagaaaagagagaagaatcaaatagatgcaataaaaaatgataaaggggatatcaccaccaatcccacagaaatacaaactaccatcagagaatactacaaacaactctacgcaaataaaccagaaaatctagaagaaatggataaattcctcgacacatacaccctcccaagactaaaccaggaagaagttgaatccctgaatagaccaataacaggctctgaaattgtggcaataatcaatagcttaccaaccaaaaatagtccaggaccagatggattcacagccgaattctaccagaggtacaaggaggaactggtaccattctttctgaaactattccaatcaacagaaaaagagggaatcttccctaactcattttatgaggacagcacatcctgataccaaagccgggcagagacacaaccaaaaaagagaattttaaaccaatatccttgatgaacattgatgcaaaaatcctcaataaaatactggcaaaccgaatccaacagcacatcaaaaagcttatccaccatgatcaagtgggcttcatccccgggatgcaaggctggttcaatatacgcaaatcaataaacgtaatccagcatataaacagaaccaaagacaaaaaccacatgattatctcaatagatgcagaaaagacctttaagaaaattcaacaacgcttcgtgctaaaaactctcaataaattcaacatagtgttggaagttctggccagggcaattaggcaggagaaggaaataaagggtattcaattaggaaaagaggaagtcaaattgtccctctttgcagacgacatgattgtatatctagaaaaccccactggctcagcccaaaatctccttaagctgataagcaacttcagcaaagtctcaggatacaaaatcaatgtacaaaaatcacaagcattcttatacaccaataaccgacaaacagagagccaaatcatgagtgaactcccattcacaattgcttcaaagagaataaaatacctaggaatccaacttacaacggacgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaacgagcccacattgccaagccaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaacggtgcttggaaaactggctagccatatgtagaaagctgaaattggatcccttccttacaccttatacaaaaattaattcaagatggattagacttaaacgttagacctaaaaccatgaataacctagaagaaaacctaggcattaccattcaggacataggcatgggcaagtacttcatgtctaaaacaccaaaagcaatggcaacaaaagccaaaattgacaaatgggatctaattaaactaaagagcttctgcacagcaaaagaaactaccatcagagtgaataggcaacctataaaatgggagaaaattttcgtaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaacagacacatgaaaaaatgctcatcatcactggccatcagagaaatgcaaatcaaaaccactatgagataccatctcacaccagttagaatggccatcattaaaaagtcaggaaacaacaggtgctggagaggatgtggagaaataggaacacttttacactgttggtgggactgtaattagttcaaccattgtggaagtcagtgtggcgattcttcagggatctagaactagaaataccatttgacccagccatcccattactgggtatatacccaaaggactataaatcatgctgctataaagacacatgcacacatatgtttattgcggcattattcacaatagcaaagacttggaaccaacccaaatgtccatcaatgatagactggattaagaaaatgtggcacatatacaccatggaatactatgcagccataaaaaatgatgagttcatgtcctttgtagggacatggatgaaactggaaatcatcattctcagtaaactatcacaagaacaaaaacccaaacaccgcatgttctcactcataggtgggaattgaacaatgagaacacatggacacaggaaggggaacatcacactctggggactgttgtggggtgggggtatgggggagggatagcattaggagatatacctaatgctaaatgacgagttaatgggtgcagcacaccagcatggcacatgtatacatatgtaactaacctgcacattgtgcacatgtaccctaaaacttaaagtataataataataaaaaaaatagaaaagattcacaaaactaagtgttgaatttttgagaaaataaaattattaaacttttagcttaagtgagaaggaaaaaagtttcaaataaataaaaatataaatgaaagagcagacattacaactgacaccacagaaatacaaaggatcataaaagagtactatgaacaattatgagccaacaaattggataatgtaggagaaactggtaatccctagacatatacaacctacctaataactgaagacaacctagagactgaattatgaaaaaatagaaaatctgaacagaccaataacaagtagatttaatcagtagttttttaagtctcccgtcaaagaaaagtatagaaccagattacttcactggtgaattctaccaaacatttgcagaagtaatgctaatccttctcagtcttcccaaaaacttcacagaggagagcacttccaaactcattttacaaacctattttctcaagaatgtacaggagagaatactaccaaattcatttttgtatcatcattaccctgacaccaaagtcaaagcaaattactacaagaaaagaaaaatataggccaatatccaggatgaacatgatgcaaaaatcctcaaccaaacactaacaaaccagattcaacaacacattaaaagtatcatacactattatcaagttggctttataactaggatacaagaagagttcaacataagaaaattaataaatgtgatgtacccattaatagaataaaagataaaaaattatatgatcatctcaatagatgcagaaagaaaatgtgacaaaattaaaaatctgttcatgattttaaaaaaactctcaaaaattaagtatagaagaaataaacctcaacatattaaagaccatatatggcaagcccacagctaataccatactcaacagagaaaaattgaaagcttttcctccaaggtcaggaacaacacaaggatacccattctcatcacttgtattcaatacagtactgacagtacaagccagagtaattaggcaagaaaaagaaataaaaggaatccaaaatggaatgtaagtaaaattatatgatcttttacatagaaaacccttaaaacaccaccagaagttataacaactaataaagtaattaagtaaaatgttaaaataaataatcaacatatgaaaatcagtatcttcatacactgaaaatgattatacaaaaaacaaatcaatcacatttataatagcatcaaaaatacttagaaataaattcattcaagtaaataacatatttgtacactgaaaactacaaagtgaacaagtaaaactgaagaagacacaaataaatataaacctcatgtcgatagaccgggaaaattaatattgccaaaatgtccatactaaacaaagcaatctatgaattcaaagcaacccctatgaaaattacaatgacatttttcacaagaatagaaaaaacaatcctaaaattcttatggaaccacataagacatcaaatagccaaagcaaacttgagcgaaaaaacaaagggaaggcattacactacctgatttcaaaacatatgataaacctgtagtaatcaagcaacatggcactagcataaaaatagacatatagaccaacaagacagaaaacatcccagaaataaatccacatatttactatcaactgatgttcaacaaaggtgtcaagaacataccataataaaataacagtttcttcaataaatagtgttggaaagattgtctatccacatgcaaaagaatgaaattgtatcccttgtaccatacgtacacaaaaatcaactcaaaatgaattaaagacttaaacatacaatgtgaaactgtaaaacaataaaacatagagggaaagcttcttgaccttagtctgagtaatgaatttttgtacatggtatcaaaagcacagacaacaaaagcaaaaaatagacaaatgggattgtatcaaatcaaaaaaatcaactgagtgacgagacaacctatagaatacaagcaaatatttgcaaaccatatatctgataagaggttaatatacaaaatacataggcaactcaaataattcaatatcaatcaataaatagaaataaccattttcaaaatgagccaaggacctgaatagacatttctctaaagaagtcattcaaatgaccagcaggcaggtatataaaaaggtgctcaacatcactaatcatcaggcaaatgaaaattaaaatcataatgaaatatcacctcacagctgttagaatggttatgagcaaagagacaaaggataacaagtgtcgccaaaaatgtgaagaaaaggaaatccttgtgcacactgttgggaatgtaagttaatatggccattatgaaaaacagtatggagaggatcatggcagatgggaggcaggagtagattgcagttcccactccgatggacagagcagcatgtgaagtactgcatcatgaacttttgctctagaactactgcaggaataaatcaggaaagccaagagaacccaccaaccctctaaaggaagcggattgctcctgcaggacctgggaaacatcccaaatactctaagtgcccaaactgtaaacgtgtaaaagggggatcatccgcccctgaacacacaccctgactggggaacctgaaggtctacaccaaagacaatattctaaccttacctggagctaagtcaatttagagaaccgagagaaatacaggggtagatgaaacagtgggaaaagccctgagagctctctgagtaccctaaaaagccatttctgccttgcctcacaaaggtcctttgagagggctgccagaggtactgggaaaaggtcacagggaaaaaaaaaaaaaacctccagcagaactttgtaacaattccaaccaaatgagaagtctcccagccagaattcaggggagggcatgaatctggtgtgcaggcttcacaggcagggaagcatgaaagccctacttgctttcacaactggaagactggtagcctagggcaagttctcggctgtgctcacccactacctggaaacagactcagtgctgttgtgggagagggcattgtgggagtaagaccagtcttcggagtttcatgggaacataactccatagacctgggaacccacacccccatcccccacagcagcaacagcaagacctgcccaaggaaagtctgagctcagacacagttagcactgcccccacctgatggtcctttcctacccaccctggtagctgaagacaaacggcatacacccttaagagatatagggccccacccaccacctaatcctccccatactaccacagctgatgctcttttgaaagcgccacctcctgacaggaggccaaccagcatagaaatagtacattaaacaaccaaaactaaggacccccacagagtccatttcaccatcctgtcatcttcaccagagcagatggtggtatccacggctaagagaacctcagatgtttcataacacaggactctgtgcagacaacccccagtaacagcccaaagcctggtagacctggtagacctgctggttgcctagatcaaggagagaaataacaatcactacagctcaggcctcaggaaaccacatccctagaaaaatgggaagagtaccacatcaagggaatactatgtaggacaaaagaatctgaacaacaccttaaaccctagaccttccctctgacagaacctacccaaatgagaaggaatcagaattgaattctggtaatatgacaaataaggttctttaacacccaaaaaaaaattacactagctcaccagcaatggatcaaaacaaaaaagacatccctgatttacctgaataagaattcagaaggtcagttaataagctaataaaggaggtaccagaaaaatgcaaagcccagtttaaagaaaccaaaaaaaacaatcatacaagaaatgaggggagaaatcttcagtgaaatagatagcataaataaaaaacaatcaaaacttcaggaaaccacggatgcacttacagaaatatgaaatgctctagaaagtctcagcaataaaatcaaacaagcagaagaaagaacttcagagctcaaaggcaaggtttttgaattaacccaatccaacaaaggcaaagaaacaagaataagaaaatatgaacaaagcctccaagaagtctgggtttatgttaaatgaccaaacctaagaataattggtgttcctgagaaagaagagaatcgaaaagtttggaaaacatatttgggggaataattgaggaaaacttcccccagccttgctagagtcctagacatccaaatacaagaagctcaaagaatgcctgggaaatgcatcacaaaaagatcatcacctaggcacattgtcatcaggttatctaaagttaagacaaaggaaagaattttacaagatgtgaggcaaaagcaccaggtaacctataaagaaaaacctatcaaattaacagcagatttctcagcagaaaccctataagctagaggaaattggagccctatcttcaacctcattaaaccaaacaattaacagccaagaattttgtatccagaaaaactaagcttcataaatgaaggaaacacatgtctttttcagaaaaacaaatgataagagaattcaccactactaagccagcactacaagaactgctaaaaagagctctaaatcttgaaacaaatcctggaaacacattaaaacagaacctctttaaagcataaatcacacagaacttataaaacaaaaatataattttaaaaagtaaagaggcaacaaatagtatgatgaatggaatacaacctcatatctcaatactaatgttgcatgtaaatggcctaaatgcttcacttaaaagatacagaattgcaaaatggataagaattcatcaactaacaatctgctgccttcaagagactcaagtaaggactcacatacataaactgaaagtaaagaggtggaaaaagacattccaagcaaatggacaacgaaagtgagcaagagcatctattcttatatcaaacaaaacagactttagagcaaaagttgaaaaagacaaagagagacattatataatgataaaaggccttgtccaacaggaaaatatcacaatcctaaatatatatgcacctagcattagagctcccaaatttataaaacaattactactagatctaagaaatgagatagacagcaacataataacagtagggaacttcaatactccactgacagcactagacaggtcaagacagaaagtcaacaacaacaataaaaaaaatttaaactacaccctggaaccaatgaacttaacaggtatttacagaacattctaccaaacaactgcacaatatagattctattcatcattgcatggaactttctccaagatagacgatatgatagcctacaaaacaagcctcaataaatttataaaatttgaaattacatcaagcaatctctcagaccatagtggaataaaactggtatcaactccaaaaggaacatttaaaaccatgcaaatatatgaaaatgaaataacctgctcctgaatgatcattgagtcaacaatgaaatcaagatggaaatttaaaaattatttaaactgaatgatgatagtgacacatcctatcaaaacctctgggatacagcaaaggcagtgctaataggaaatatcatagccctaaacacctacatcaaaaagtctgaaagagccctaacagacaaagatcagacctcaaggaactagggaaacaagaacaaaccaaaccgaaatccagcagaagaaaagaaataaccaagatcagagcagaactaaataaaattaaaacaaacaaaaaaatataaaagataaatgaaacaaaaagctggttctttgaaaagataaataaaattgatagaccattaccaagaataaccaagaaaacaagagagaagatccaaataagctcaattagaaacaaaacaagagatattacaactgacacgatagaaatacaaaagatcattcaaggctactatgaacacctttacacacagaaactagaaaacctagtggagatggataaattcctggaaagatacaaccctcttagcttaaatcacgaagaattagacaccctgaacagaccaataacaagcagagagattgaaatggtaattaaaaaaaaaagttcaagaccagacggattcacaggtgaattctatcagaaattcaaagaagaactggtaccaatcctattgacactattccacaagacagagaaagagggattcctccctaaatcattctatgaagccaatatcacccaaataccaaaaccacggaagcacataacaaaaaaagaaaactacagactaatacccctaatgaacatagatgcaaaaatcctaaacaaaatactacctaacccaatctaacaacatattgaaaagttaatccaccatgatcaagtgggtttcacaccagggatgcagggatggtttaacatacacaagtcaataaatgtgatacaccacataaacaattaaaaacaaaaatcacatcatcatcttaatagatgcagcaaaagcatttgacaaaatccagcatccctttatgattaaaactcgcagcaaaatcggcatacaaaggacatatctcgttgtaaaaaaaagccatctatgacaaatccacagccaacattatactgaattgggaaaagttgaaagcattccctctgagaactggaacaagacaaggatgcccactctcaccacttctcttcaatatagtactggaagtcctaccagagcaatcagacaaaagaaagaaataaagggcatccaaatcggtaaagaggaagtcaaactgtcactatttactgattatatgactgtatacctagaaaaccctaaagactcatccaaaaagctcctagaactgataaaagacttcttaaaagtttctggatacaacatcaatgtacacaaatcagcagctcttctatgcaccaacagcgaccaagctgagaatcaaatcaagaactcaaccccttttgcaatagctgcaatatatatataaatatatatatttataaatatatatttatatatataaatatatataaatatataaatatatataaatatatatacatataaatatataaatatatatatgtaaatatatgtaaatatatgtaaatatatgtatatgtatatatatgtaaatgtatgtaaatatatataaatatatgtaaatatatataaatatacgtaaatatataaatatatataactatatataaatatatataaatataaatatataaatatatataaatatatataaatatataaataaatacatataaatatataaataaatacatataaatatatataaatatataaaaatatatataaatatatatataaatatataaacatatataaatatataaatatatataaatatataaatacataaaatatataaatatatataaatatataaatatatataaatatagataaatatagataaatatataaatatatataaatatataaatatagataaatatataaatatataaatataaatatataaaaatatatataaatatataaaaatataaataaatatatataaatatataaatatatataaatatataaaaatatatatatatatatatagagagagagagagagagagagagatacacttaggaatatacctaaccaaggaggtgaaagacctctacaaggaaaactacaaaacactgctgaaagaaatcatagatgacacaaacaaatggaagcacatcctatgttcatggatgggtagaataaatattgtgaaaatgaccatactgccaaaagcaatgtacaaattcagtgcaattcccatcaaaatatcaccatcatttttcacggaactagaaaaaacaattctaaaattcatatggagccaaaaacgagcccaccaagtcaaagcaagactaaccaaaaagaacaaatctagaggcatcacattacacattagaataatttcaaattattctataaggccatagtcaccaaaacagcatagtactggtataaaaataggcacatagaccaatggaacataatagtgaacccagaaataaacccaaatacttacaggatctttgacaaagcagacaaaaacataaagtggggaaaggacaccctattcaacaaacagtgctgggataattggctagccacatgtaggagaatgaaactggatcctcatctctcatcttatacaaaaaaatcatctctcatcttatacaaaaatcaactcaagaaggatcaaggacctaaatctaagacttgaaactataaaaattctaaaaaataacatcagaaacacccttctagacattggcttaggcaaggatttcatgaccaagaacccaaaagcaattgcaataaaaacaaagataaatagctggacttaattaaagagcttttccatggcaaaaggaacagtcagcagagtaaacagaatgctgtgggagaaaatcttcacaatctgtacatctgagaaaggactaatatccagaatctacaacaaacacaaacaaattagcaagaaaaaaacaaacaatcccatcaaaaggtggactaaggacatgaatagacagttatcaaaagaagatatacaactggccaacaaacatatggaaaaatgcttaacatcactaatgatcaggaaaatgcaaatcaccttacaacgcgataccaccttactcctgcatgaatggccataatcaaaaaattaaaaaataaatgttggtgtggatgcagtgaacagggaacacttctacactgctggtggggatgtaaactagcacaaccactatggaaaacactctggatattccttaaagaactaaaagtaaaactaccatttgatccagcaatcccactactgggtatctacccagaagaaaagaagtcattatacaaaaaagatacttgcatatgcatgtttatagcagcacaattcacaattgcaaaaatgtggaaacaacccaaatgccatatatatatatatacacacatatgtatatatatatgtgtatatatatatacacacacatatgtgtgtgtgtgtatatatatacacatatgtgtatatatacacacatatatatacacatatgtgtatatatatacacatatatatacatatgtatatacacatatgtgtatatatatacacatatgtgtatatatatacacacatatatatatacatatgtatatacacatatgtatatatatatgaatactactctgccataaaaaggaatgaactaatggtattcatggcaacgtggataagattggagagtattattctaagtgaagtaactcaagaatgaaaaaccaaacatcacatgatctcactcataattgggagctaagctatgaggatgcaaacgcataaataagaatgacacaatgcacttcgtggattcagggggaaagggagggaaaagggtgagggataaaagactacaaatttggtgcagcatatactgctcaggtggtgggtgcaccaaaatctcacaaatcaccactaaagaacttactcatgtaaccagataccacctgttccccaataacctatggaaataaaagataaataaataaaattttaaaaataaataaatttttgaaaagaaaaacaaagtaatttttctaaataaacacataatgaaagttcaacgaagaaaaaaataacagtatggactttcctcaaaacattgaaactaaaactatcatatgacccagcaatcccaccctggcaagggtatccaaaagataggaaaccagtatgtcaaagagatatgtgcactcccaagttcattgcagcattatttacaatagtcaaaatatggaatcaacccaagtgtcaattgataaatgaatggaaaaagaaaatgcgaaaatgtagtaaaattgaatactatttaccctttaaaaagaagggaatcctgtcatttgtgacaacatagatgaacctagaggacattatgataaatggaataagccagacatagaaagacaaatactgcaggatcacacttatatgtagaatcagaaaaacttgaatgcgtaaaagcagataataggtggttgccaggggatgggggggatagaggggaatcaagagatcctgatcaaagggaatacaaaatttcagttaggatgaaaaatacctattgtacagcacggtgactatagttaataataatgtattgcatgtttgaaaattgctaagtgagtagatcttcaatgttctcacctcagaaaaaggtaagtatgtgatataatggatactgtgaaatttgtcagaatcaacatggagtcacttgtgtcaaatccctgaaaaatggaaacaggaaagccatgaagggagggttctcacacatgtgtgcctgataacaagaactattaaccattaacaagaactatcaaaaaagactctgcaaaaaaacacaactttgcacaaaagccaccatagccttacacagaaaacacttggcaaggacatctgtccagcaactgcctgtccaaccttagattggcaccacccttgttttgatccttgtagccaaggataattgattaaaaacaacttacataatcctcctcatttgccttttaaaacttccaacttcctcaacctccctgaatattcacatagtttactacggcatacgtattcccattgcagtgttactcccaaataaatatcaatttctttaagatagagagagactcttcctttgttatttaggtttggcaatgtatcaattcgttttatttaatcatttcacaatatatatgtaaatcaaaacattacattgtacactgtaactataacaatatttatttatcaatcataccttaaagttgtggaaaggagtagatatttagcagttcatttatggttataccgctaccttatattgagtagaatgtatatggaaataaaaagctgaatttcagagggaaggaagaagcgagggaaggagggaaagaaagaaaaacagaggctaccagggtctgggagaagtgatgaatggggagttattgtttaatgggtaaagagtttctgtttgggatgatgaaaatgttctggaaatggatagtgataatggttgtacaacattgtgaatatatttaatgccactgaatttcacacctaaaaatgattaaaatgctaaaaataaatgtataacccaatttgaaaaaaaggtagagagtggatagtactaagaacacaggaagcctcattccagagaccatgcttttaaccactacgcacactgcctcccacaatctgttacaaccgtaccctgcaatcataacatgtagtggggaatgatacagtaaacaaagtatatgataaaatcaataaaagtggtgtatataaaatcacaaaagttaagcagaagcatttctcatggacaggaaaaaaaagttgaaatttcaagcacttatccattcaatataatttactaaggcttggctatgtgttaaaaatgcctttttacatatggcattccctactttaacattatctctgtgataaaattctcatccccactttaaaaattaagaaattgaacaaaaagtaagaatagccaatatccaaattcagcacctctgactccaaagctcatattcttttgacctctattcactgcctcctcaaatataaatgaaaacaggataggcaaaacccaacattctttgtctcagtcaaaaagactgcctacagaagacagtcccagtaatagattccaaatgatggtagagatttttcttggtgcatggaaaaaggcttgcagatacaggtgggatggtaaagatatatgtacattgagaagcaacaataggaaaagagtatgctgggggcaaagaaagctatagcaaccaaaacaaaacctgaaaatatttctcccactgctacttttactacattatttttcatgatttagcaatccccaataaatggtaagaatgcatgtctctgagatatttctgaaaaccaacctccatgagtagtacagaattatggctagccagtctccttctaaatctggacacataaagcaagccacactgaagtagctaataaaaacataaaagaagaatgatagccatgaacagaagcaagaagtttgcaacaatatttgaaaaattatgcttcaaatctttatctgtcatcatctaggttttatggaccagtaatgaaatgaaatatctaaagtacatattcccatatgtgaatcttttaaaatctgtttacacttcattgatcatatcatttcctaatatttccaagattatgacacaaatggaaaattaaacagttcaagagatccctggctctttcactatctggttaggtacacttctttgattaaatgggacctcattttcttcatacaaaaaacaaaagatataattcatcaaacatacttagtacttttatgctattttactgcaaatttactaataaatatatctccaaataactttagtagaaattttatttttttaatcgagcagaaggctggcatatttttaatgtctattcccagagatcagaagtacaggttgagcacgcttaatccaaaaatccgaaatcctccaaaactgaaactctatgagcattgctatgatgctgaaaggaaatactcaatggaacatttcagatttcagatttttggattagggatgctcaactggtataattccaaactccaaaaaaaaaaatcagaaatctgaaacacttctgatcccaagcattttggataagagatactcaatctgtatctaaacaccataattaaaccaacagagtgctaaaattgctaaatcacctacccaatattctttcttatctctatttaataataaaaccccatttatctgggtgaaaatatgtatttatttatttatttacttacttagatacggggtcttgctctgtcacccaggctggagttgcagtcgtgtgataatagctcactgcagcctcaaagtcctggactcaaacaatcctcctgtctcaggctcctaagtaggtaggactacaggtgtgtgccactccacccagctaatttttcttttttttggtagacacaagatctcactatgttacatatattggtctcaaactcctggcctcaagcaatctctctgtcttagcatcccaaagtgctgggattataggtgttagccactgtgcccagctctagttttattttttaatcttcatttccctggtgagaatggcaataccatttatgatgagtgctaaggctttaagtgtccaccaaaaagcatgtgttagaaacttaattgccagtattaacagtattaagaggtggaacctttaagaagtgattaggccatgagggctctgccctcatgaaggaattaatgtcattatcatgggagcaggctccttatgaaaggatgagttgtgggtacccgctcctccctttctctttcccaccatattcttgcccttccaccttctgccataagatgacacagcaagagggcctttgccagatgctggtccctccatcttgtacttcccagcatccagaatcatgaaccaatacatttctcttcattataaattaccagcctcaagtattctgttatagtagcaaaaatgaactaagacatttcatatggcactataactaagttctgaccagttaggcataaatatgagactttctagaagattctttagggaaggtgacttggctagaagatgcaatccactcatcttcccctttattgtttcttctgcctggtactatccatctcaaactatgaggcattttattttcaagggaggttacaaatggtagagaaaaaaatatagaaggattcttggtgttttaccaccatgaggctatacctactacatgccctacctctgcatctctttcagattgataagaagtaaattctaccatattcaaactaatattattttgggctttctgttacataaaatgagacccaattctcatctcaaagaggcctctcttatatttgattattagatttactttcccgaaatatgtttaccccttcaaaattttattattacatataagagtatataagacccaactgcagttgtgactcgcttacagacaaaggatttttaatggatcaactcctgaattattgaatcatataaaaatattcacacattgaggccaatacattcttgaagatttcaacctgtttcaaggttgagaaatattcttggccatctagattcaccacagaagtttcattgagtataatcaaactaataattcacttacaaaaacaaagtttcactataaaacaatccatttgtgattgtaataagaacacttacagaaaacagaattacattgggtagttcaactactatgtcaaagccaatactcagcacttatttattcccagaggcttctgccttctcttcttccttaaagcatacaaatatgcctagataattgagtgatgcagaagcagcaagggtcccaatactatatattctaatgagatctaattggtttataaatagttaaagaatcatttcactgatgttccctcctttagtttgccccagctcccctatatctataaccttaaactgaaactcaattagaaataagtagggtagagctccatttcttaatgaagtccttcctagtttggaaagagcctaagggcaattctgggtagtgaaagtggtattgaagaatgagacaacactgtaacattagtggccaaaagttatacctctgcccccaatgaactgcccccagataagtgtgccctggaaaaaaaagtacaatgcaatcactctgtgccaattttaggaagattttattaccttctggcttgatagaataatattccataataccccaggcattatttattcccattagacaaataccatctattctaattctcatgagggccatatctcattcattaacaggattttaggaaaatggattcagcaaatgtatattttatataatttactgtgtagtttgtcatatattctcttataattttcaaggtaaatgttattattggctgtagtttccttttttcctcttcctcaaagcactgtcactcatcagaaatatgtcagaacataaatatgtttattttatatgttaaaaattgtgtgatgagcaattaggatggagagataaaatataccatagaatctgacttcaaggagtttacaacctaacagaacatatcaaaactcagggcaagtttaggtaaacaatttttaaaatatgctgaagaacacagctttcaatcttctgggcccaaaataatttgtgacatacatttctacctactctctccagctctaactttagatcaatattaataatactggatatccaacattgtaccaggaagtacagaaaataaaaagaggcataaaaaaattaataactgtttattaaataaccatttactaggtattaagtatttcataatatatcaaaaaagtacattataatgacttacccttaagaaatttacaatgcaaaggcaacttagtatgctaggaagcaaacactgacattagaaaactttgttttgcaaattataaattattggtaaaacaatctttatcaagcttgatcctcatttaaaacataaggttcaaatgagataagatgtcaaaaagataacaccaatagtcttcaaatagtgtttcatggagccccagagtttggaatcccatgaggtgcctcatggaataaggagacaaatatcctttggatcaattaatgacttttggatcaattaataagagtttgaaaaccacctgtataagcaagacatctctgaaagagaactgatcagtttgtcaagagcaaaagattcttcttataggagaaacagtagattaaccctagattgtggagagctttggatgcctggctaaagaatttgtctatacagtgtcagttataagaagtaggagaacaatccaatcaaagcaagacttttagaaagattaatttggcatgaatgtacagcatcaactaaaaatagcaggtaaaagcagaaaagtcaacagaaaggtattacaatgatccaagtgtaattaaataagagctttaactagaatgggcacagtggaaataagagctgtaattaaataagagtgtaattaaataagcgttttaacaagaatgggcacagtggaaatacaaagaatatgtcaaagaaaattaaagcagatcttttacatttgctaggactgctttacctccaactatgtggtcaattttggaataagtgcgatgtggtgctgagaagaatgcatattctgttgatttggggtggagagttctgtagatgtctattaggtctgcttggtgcagagctgagttcaattcctgggtatccttgttaactttctgtctcgttgatctgtctgttgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccttgccttttttttgttttccatttgcttcgtagatcttcctccatccctttattttaagcctatgtgtgtcctgcacttgagatgggtctcctgaatacagcacactgatggatcttgactgtttatccaatttgccagtctgtgtcttttaattggagcatttagcccatttacatttaaggttaatattgttatgtgtgaatttgatcctgtcatgatgatgttagctggttattttgctcgttagttgatgcagtttcttcctagcatcaatggtctttacaatttggcatgtttttgcagtggctggtaccggttgttcctttccatgtttagtgcttccttcaggagctcttgtagggcaggcctggtggtgacaaaatctctcagcatttgcttgtctgtaaaggattttatttctccttcacttatgaagcttagtttggctggatatgaaattctggattgaaaattcttttctttaagaatgttgaatattggcccccagtctcttctggcttgtagagtttctgccaagaaatctgctattagtctgatgggctttcctctgtgggtaacctgacctttctctctggctgccctgaatattttttccttcatttcaactttggtgaatctgacaattatgtgtcttggagttgctcttcttgaggagtatctttgtggctttctctgtatttcctgaatttgaatgtttattgcagcactattcacaatagcaaagacttggaaccaacccaaatgtccatcaatggtagactggattaagaaaatgtggcacatatacaccatggaatactattcagccataaaaaaggataagttcatgtcctttctagggacatggatgaagctggaaaccatcattctcagcaaactatcacaaggagagaagaccaaataccacatgttctcactcataggtgggaattgaacaatgagaacacatggacacaggaagtggaacatcacacactagggcctgttgtggggttggggaggggggagggatagcattaggagatatacctaatgtatatgacgatttaatgggtggagcacaccaaaatggcacatgtatacatatgtaacaaacctgcacgttgtgcacatgtaccctagaacttaaagtataataaaaaataaaaataaatttaaaaaaagaaaattaaagccgatcatggatcacttctgacaaagtggcaaaaaaaaattcatatcccatcttagaggaaagggaggcactaaagaccaaatgagaaagtcacttaacaaattctaacagtcaaacatcaaaagcagcccaagataaaaaaaaaaaaatagaatcaaaattctacctttgactaggcctgactagttattgggtatcaagagagaggcaagcaaagcaaataaaggagtaggagctgtgaatggaaaggaaggtcaggaactagcagagacaaatcagatagtatttgtggaaattcaaagaggagttgcagtatagtctaatttgattccaaagcatggcagatagttttatcaggctgtttttaaatggctggctcagaaatgcccgcaggcattatgagccttttgaaaagttttgatcagcacctggcaaggatttcgcaggtaaaaagaaatagagacaaggagaaaagaaaaatcaaagacgtttcacaattcagatcctggatattttgaaaatagcaggattcatagaaacagaaaagctgagttgagggacagttcaaggtatcagaggtatgaagtgtgaggggagaggcaagaagccaagaattgaaaatgtgcaactagcacaatgcctggaacacagtggctgtttaataaatatttcttggacgaattaataaataaatgagcaagtgaaataggacattcatgcagccaacatgtggaaagcagtgtggcaattcctcgaagaacttaaaacaactgccatttgaccccacagtcccattattgggtatatacccaaagggatataaattgttctaccataaagacacatgcatacatatattcattgcaacactattcacaatagcaaagacatggaatgaacctaaatgctcatcaacagtaaactggataaagaaaatgtggtacatataaaccatgaaatactatgcagctataaaaagaatgagatcatgtcctttgcagcaacatgggtggagcttaagcgaactaacacagaaacagaaaaccaaacactgtatgttctcacttttaagtgggagctaaacgaagaatacatgaatactaggaggggaacaacagatgctggggcctacttgagggtgaagggtgggagcggggaggggatcagaaaaaaatacctagagggtactatgcttattaccatggtgctgaaattatctgtacatcaaacccccatgacctgcagtttacctaaataacaaacctgcacatgtacccctgaacctaaaataaattttttaaagtaaaaattttaaaaaggcagtgtatatatacacaatgaagtactattcgcccataaaaaagaataaaatcatgtcatttttggtaacatggatggaactggaggacattatgctaaatgaaatatgtcaggaaccgaaaattaaacaccacatgttctcactcatatgtgaaagctaaaagacttttaatctcatagaagaaaagtagaacagaagttactatacgctggtaagggtagggagaaggggagagatgggagagatttcataaaagattaaaaaattgcagctagattaaattctagtgttctataccactataggatgactattcttaaaaacaatatattatgtagtttaaaatagctagaaggaagatattgtatgttcccacacaaagaaacaatcaatatttgagattatggatatgctaattaccctgatctaatcactatacattgtatgtatcaaaacatcactgtgtatctcatggataagtacaatcacttgccaatttaaaattttttatttaatttttaaaattttaagttggtattatctccattttataggtgacaaatgtgaagctcagaaaaggaaagtaattttcaggtcatgtagctcataagtaggtttgtgagtaagtatgtttgtctcttatgcactgtgttgcagtacagaaatctaaaagaccacagtatgagtagggaacttgacaattattacatgaatatttgtgagccacgtgaatatctgtgagccacactcagtatttaatagagtgtaaagttcaaaatgaaaaggtaggtaccaaaattgaaaatgtgtacttggaataataaagtgccttctgtgccatgctgaggaagatgggttacgttgaaattgatgaagcatcaccaaagagttttagaggccatagaaagatataattagatatgcatattggaaagatccatgtagtagaatgggataaaaatagaaaataggtaggttttataaagttttagccttctttgtacacttattttaaaacttgttcttggcaagtcatggtggctcatgcttgtattcccagcactttgggaggctgaggcaggaagatcacttgaagccaggagtttgtgaccagcctgggcaacatagtgagacaccatctctacaaaaaataaattatctgagtttagtggtgcacacctctagtcctagttacctgagagactgaggggagacatcactttgagcccaggatttagaggctgcagtaagctatgatcatgccactgtactccagcctgggcaacagagcaagacactgtgtctaaaacataaaataaaatcattcaatcaatgaaacttgttctttaggacttttctactactatgaataccattactgcttctactatgactgttatttctaccattattaaaaattattttaataaaagatgctttgaatagtttagtaaagataattttcttgaaaagcatgccaatatgcattttaattagattccagagcaatcacagttgcttcaacaatgaactaaataatggttcaatcagtaactagaatatatgcagtctcaggaggaacatgaacagaatatactagtcacatggaaagaacaactttggcacaaacaaaataaaattagttccacaaatgaatggaagaaattctaaatagttttgtgtacagcacctttgaaatgttaaaaatcaacactaaccagaaaatatgtaaataactttcttctcattctctagaattcttttggagatcaagtaccaattatattttgtgtgaaagcttctaaacctcttctttagtgactttagactagatatttgaagacaaaaaagagaagctcggatgctgcttcatgaaatacaggggaaaagaagactactaattttaacctgcattaattatcttaatggtctagtaattttatataatgcagaaaagactagacctgtccccatggagttccctaagagggaatcatgctgtgtagtatagagtgcatgaatttcatgatcgccaatcccttcgttaagttgtctaataaaaagaatctaaaaatcattttgctctgacttcctgataagttaattttcatgatgtcttgtaaaagtttttccatttaccgtggtagttttaaaagctccaaattccagtaacagcagcttacatcaggataaataaaatactttttcaaagtgtggggcacatttgaaaaattgattctaatggcatcatttcatcaactgcttcatgataaattacttctgagcaagcccaggtcatctgcatgaagttatcttagggaatcttatattgtacctaaccttccactacatgaaatctcatgtaataaaactaataaaatatgttttcattcaataaatacttagtgagatcttactatggcactgtgctggatatttagaatacaatagtaagtgaagacaaatagtttttgcctcatgaaattcatagcctaggggctcacactcatttttagaaacaatggattaaaacagataatatagtaatttacttgacaatgattacatgaatatttgtgagccacttaaaatcattgaattttagagctaaagaggacctataagatcttctagtctaactccctaatctgacaagggaagaaaagtagggctcagagagataaattgattaaatcaaggtcataaaagtagttattggttgagacaagattcaaacccagacttcctgattgtccagttgataatttgcatcaaatcatgacaccttcccctgcacatcaatcaaagtgactggttatcttctggttccatcttcccatcacaggcttctctggatgaagaccatagaactgaatatacatatatttcccaaacatacgtgtgtgttgggttttctcaaaatgtaagtatgggtcagactataacaagtaacaaaaataattttattggaaaactgcaacacttacaaagaaaatgtaaaatacagagaaggagaatccaaagtagtttccttttgccccagattcccatgtgtcttcagtatagtttcttccttcatcttgttaaggatgcagtcatgtaataaagtcaagtggcacagaagcagtgagtgtttgctagttgccataatatccattcactcccctactccaaaggctagtgactgaactgggaacaccagagaagcaaaacctaactctttttctgtgcctcaatattaacatgatgctaaggcaattatttgaactgctgcagtattcatcagttagctagctcccaacaaaacaacttaagatattaattcagctttggtttcagagtaataaaatattccaacataggcccacctcaggaccaaagtcagggcaaaggcttcttttcatgttggatatatactttgctgcctgagatttctgaaaataacactgaattcagggttctgaatgttagaatttatttttctatcggctacaaagaaaaagaacaaaaggttacaaaggaaatgctccaactgcccatgaatatgtggtacataactaaacttggcaatttgactatatattccaggaaagagcagaaattataatgcagactttgtcatctaggtaaaaagaaccatgattttttaaagttaaattctcccttctctccccaaaaattgttcttcaaaaatgcaatggaataataactaagaatggaatggaaagctgagtgtcataagaaaaaaaaactcatatatctactggaaataggttttctgtttctcatgcaaaaataattacaaaagaaatattgaattaaagaaaaggctaacttcaagggtccaaatatcattcatattgttctctatattaaaatttaatttctctcatcttggttgacagaaccaagtaggatcttgtgcggattcaggattcttccttccagcctgtgatcctccattgagaatctatcctgtagatagatatcatctacatataatgtaatggtgaagaatggaaacataagctttgaattaagacagacctggatttaagtccttcatccgccatttactgaataatcttaggcaagttacttaatcttattaggcttcagatactcatctataaaatggaagtaataataccaacttcatacagttgctgtattaaacagtataatgtgtgtaaaagccttaacgtagtacctgaagacctgatcaagatatttagctaaaagtaagagtactagaagtagcaatggtagtgattttgctaagatttttatctctaagaatctattttctaggtggctaatattataatcattgatgtcaggattgtacagaatataagagtccaaccactcttttctctgtgctttattagatactgtaatattcatttattaaacagttattacagaaatcatccactttaagactacttaaacagtagataattatctattagattttaaaacaatgtattatgtcattaaaaaatgagaaagtctccatttctttaatatagaacctgatttcaaaattgattaaagtccaggaaaaaaaatgtttctagaaaaaagtccaaacattcaaaattattattattgactatggttaagatgacttaactctaactgatctctcccacacattgatttaggacattagattatttttatttataatttaaagtgaaaagcctgaacagctgaatgtgaatataaaacatattttattataaagaacaaattaaacaagtatgtaactgttgattattattagaaagagcaaaagctttggagctagacaaacctgaatttcaaaacccacgtgagtacatattgtatccatgattgggcaagttacttaacctctttatgctattactattgaaattattacattattctcagactaacaataagaaaatccaactccatggaaatcaatgattgcctcctatcaatttctcacaatcccatgctctctaagtgagcacctacatatgcatacgtacatgacacagaccatccccatgtacttatgtaattaccttcagtgtgacccaagactacaatgctttatcttgcttatcctccctctggtcttcttcattaaaaatggccactcaagccctgattttcagctacaggaaagcagagagctgagaagaggcatgagtagaaagcatcacatccatcttatcacacaagactatcaggcaaactggcactcaatccttttcatgtaacctcttcatagtgatagtcccttttccccaaatacatttaattggactatgagttctgaaacctccaagcaagtgaacaaaacccatataaccaaaatagagacagtgagtttcacttaacctccttttctaggtcccaataaaccatttggttaccaagccatctactgtataaagattaatataaacagcaaaagttatacatattctcagataactatgatgtcattgtccaacctttctataggaaagactgcacattgcaaagcagctttgagatcacaaaaagggccaatataacaaggaagttgggctgcttctttgacagctttgtttagtgaccggacaattctacaataaataattttattaaatttttttacattattgaagccatatgtgttcattcaaggcaatttggaaagcaaaaaaataataataataattcaaccagagccccattagtctattacaatgattttttttttttttttttttgagacggagtctcgctctgtcacccaggctggagtgcagtggcgcgatcttggctcactgcaagctctgccttccgggttcacgccattctcctgcctcagcctaccaagtagctgggactacaggtacctgccaccatgcctggctaatttttttgtatttttagtagagacagagtttcaccatgttagccagggtggtctcaatctcctgacctggtgatctgcctgcctcagcctcccaaagtgctgggattacaggtgtgagccaccgtgcctggcctacaatgattattaatagtttgttgtatttctttcctttttttaatttctaagcagagagttatattgttacataattgtaattacttgacataaaattgtatcctgtttctgcatgtaacttaagtacattgcatattaacactagcttttcaaaaatgaacattttaataaatgcataaaattctagcaagttctatagtgttcttaactatcctgctattattcctttctgtaaatgctgctgctgaaaactcaaaacaacacacagggagacagcacagagtggtgattaaacatgcagacattagtaccaaatttcagacgtcaaaccccaccatctccacttagcagtgaaacagtgtgaaaatctcttaacttttctgcttgtcagtttattctagtataaaatgggagtgagaaagaggatgatacagtgtatctatatcattaagtgtcttgtaaatattatctaaagggttatgaacaatactagcacaaagtaaccactcagtaagtattaactattatcataaagccttttactgattcaagactattttcttaaagtagattttcagaaatggaattactgagccaatgagtataaacaactttacgattcttgatagaattgccaaactgctatctaaaaagattatactgttggacatttgggttggttccaagtctttgctattgtgaatagtgctgcaataaatatacgtgtgcatgtgtctttatagtagaatgatttataatccttggggtatatacccagtaatgggattactgggtcaaatggtatttctagttctagatccttgaggaatcttaccacactgtcttccacaatggttgaactagtttacactcccaccaacagtgtaaaagcattcctatttctccacatcctctccagcatctgttgtttcctgacttttaatgatcaccattctaactggtgtgagatggtatctcactgtggttttgatttgcatttctctaatgaccagtgaaccgaaatgtccatcaataatagactggataaagaaaatgtggcacatatacaccatggaatactatgcagccataaaaaaggatgagttcatttcctttgcagggacatggatgaagctggaaaccatcattctcagcaaactatcacaagaacagaaaaccaaacaccacacgttctcactcataagtgggagttgaacaataagaacacatggacatagggaggggaatatcacataccggggcctgtcaggaggtggggggctaggggagggataacattaggagaaatacctaatgtaggtgacaggttgatgggtgcagcaaaccaccatgccacgtgtatacctatgtaacaaaactgcagaacttaaagtataatcaaaaaattgattaaaaaaataaaaaataaagattatactgttgatttatactacagccagaaatatgtaagactatcctaacaagcttaaggccttaatatgtatttcatttttgctaactccatagagtaaacatcttggtttcggtttaaattacatttctttgattactaataaggcagagaactatgccatactgctgactacttatatttattcttttgtaattgctaggtatagactttacagggttttttcaagaacatgggatatactttatttttctaagatccatcagggccgggcatggtggctcacgcctataattccagcactttgggagactgaggcaggtggatcacctgaggtcaggagttcaagaccagcctgaccaacatggtgaaaccccatctctactaaaatacaaaaattagccaagcatgatggcaggcacctgtaatctcagctactcaggaggctgagacaggagaatcacttgaactcaggaggcagaggttccagtgagccaatatcgtgccattgcattccggcctgggcaaaaagagggagactgtcaaaaaaaaaaaaaaatcagcatttccttgaaaaaaatctatcatggctctacaaaagagtatttttaaagcattggacataaaagtaatttagtcttgcacattcacatacatacacaaatgcaatgattttctgcatttttcacatagaaaaatgatttggggcagtgacatgttttcaaatatttacatatacagagtgaaagccaattctatataactttatttacagtgcacttgtgatttttccaaaaactatcaactcgcttacccattctaacaacgttttggcagagctaaaaattgcctttcattatccatttttaccttctttcttaatgtcagaatcttggatagcatgcctactaaaatatttatttcccagcctctactgcagctaagtttctccaggtaattaagttctagcccattaatgtaaacagaagttttgattctgaattcctagaaggctctttaaaagagaaagagcaagcattctattgtccattttttcctgcctcatttggtttccagtttggaacatgaaagggatggctagagctccaaaagccatcttcgatggcatgaaggccagcatagcagagtaagaaaaaaggagccttagtctctcatggcaaagtgacactgtataactagctctgagctacctaactctagacttcttttacattagagagaaataaatgtgtgtggttttaaccattgttatgttaaggttttctgccatatacagccaaaacatcacccaagctgacacacatgaccaaaatgcatctgtatttgcttttgaatagcatgacttgtctttctagtaacatacaagtactcagaaatgtggactgacaagcaacagtatttgaattcgcagagcacacatacattaaactatcaataggaaagaggctgacaagtttcttggttaaaataagaacagtatttcttttaaaccactttattgaggtattactgacatacaaaaagctatacatatttaatgtatacaactcgatgagttggaggtaagaacacattcatgaaaccatcatcaaatctatgccataaacatatccatcacctccaaaagtttcctcctgccctctttgtgtgtgtatatgtgtggtgtgtctgtgtgagtgtgtgtgtgtgtatgtgtatgatacaggcatatttctaagtatacaacacagtattattaactatagacaccatgctatacggtgtatctctaggacttattcatctggcataactaaaactttttacccttaactaatacctccccatttcccccaccccacatcccctggtaaccaccacctactatctacttcttctatggcttcaactactttacctcatttatgaagtatgagtttttctgtgtttggcttattttacttagcataatgtccttcattcaggttcatctatgttgttgcaaatagatttccttctcttttaaaaagctgaaaaatacaccattgtatgaatatactacattttctttatctattcatccactgatagacttttaagctgctcgccttgactgtcatgaataatgcttcttcaatgaacatgggagtgcagatatctcttcaagattctgatttgaagctgtcatagtcaaaacagtatggttactggcataaaaacacagacacatagaccaatagaacagaacagagaacccagaaataaacacacacataaacggtaattcatctttgacaagcgtaccaagaatacatgatggggaaagagtagtctcttcaatagatagtgttgagaaaattggatatccacatgcaaaagaatgaaattggacccttatcttacaccatacacaaaaattaatccaaaagtggagtaaagacttaaatgtaagacctgaaaccataaattaccaagaagaaaacataagggaaaagcttcttgccactggtcttgacaatgatttcttggatctgacaccaaaaacatgagcaacaaaaggaaaaatagacaaataggactatataaaaccaaaaagctcctgaacagcaaaggaaatattcaacagaatgaaaaggcaacctatggcataggaaaaaatatttgcaaaccaaatatctgacaaaggattaatatcaaaatatataaataatggctacaactcaatagcgaaaaaacaaataatcccatttaaaagtgagcaaaggaaatgaataaccattttgccaaagaagacatccaaataggtaacaggtataagaatcggtgcctggccaacatggtgaaaccccatctctactaaaactacaaaaattagccaggtgtggtggtgcatgcctgtaatcccagctactcaggaggctgaggcaggagaatcacttgaaccaaggaggtggaggttgtagtgagtggagatcgcaccatggcactccagcctgggtgacagagcacgactccgactcaaaaaaaaacaaaacacacacacacacacacacacacacacacacacacacatacacaaacaaaaaaaaaaaacagaacggtgcccaacatcataaatcatcagggaaatgcaagtcaaaacgacagtgagatattacctcaactctccaaatcacttcgtaagttataatgtgacagtaagctaattttcaaagttatataactccttgaaactattcatctctaatcaagtgtaagcctctttaacgcagggaatgagtgttatttgccttttatctccttgtcctgatacaaagtaggcaaagttgaatgagtgtgaggatgctatagaaatttactacattaaagtactggattatttaaatataattgataaaatttttgaacacattacactagttcccctttatctgtggttttactttttggcgtttcagttaccctgtcaaccttagtccaaaaatattaaatggaaaattccagaaacaatttatgagttttaaattacatgctgttctgagtagcacaatgatatcttgcgcagtcctgtgctgtcctacctggaacatgaatcatccctttgtccagcataccatactatatatgctacctgcccattagtcacttagtagttatctcagttatcagatcaattgttgcagtatcacagtacttgtgttaagtaatctttattttacttaataatggttccaaagcacaagaatagtgatgctggtaattcagataaaaagaaatcataaaatgccaaaaagaagtcataaagagcttcctttaaataagaaggtgaaagttctcagcttaataaggaaagaaaaaagaaatcacatggtgaggtcactaagaattgcgggaagaaggaatcttctagctgaaactatgaagagaaaaagaaatttgagctaattttgctgtcataccttaaactacaaaggatacagccacaatgtgtgataaatgcttcgttaaatggaaaaggcattaaatttgtgagtggaagaaatgaaagaaaaaaatgttccaattgatggcaacatgtggcatcagaaagtactaagcctatatgaagacttcactaagggatcccctgaaatgaatgatgcagagccattcacttcatctcatcttacaagcgtttttgaaaattttatttatttttatatatttaagtacaagtgcagggtttttttgggtttttttttttttttttttttttttgcagggacggagtctcgctctgtcacccaggctggactgcagtggcacggtctcggctcactgcaagctctgcctcctacgttcacgccattctcctgcctcagcctcccgagtagctgggactacaggtgcctgccaccacacccggctaattttttgtattttcagtagagacggggtttcaccatgttagccaggatggtctcgatctcctgacctcatgatccaggcctcccaaagtgctgggattacaggcatgagccaccacgcccggcccaagtgcaggttttttagatgcatatattgcctagtggtgttttagtgtactcatcaccctaacagtgaacattgtacccaattggcagtttttcaaccctcacacccctcccaccctttccacttttcatagtctccaatgcctattattccactctgtatgtccatgtgtacccattgtttagtccccactaataagtgagaacctgtggtatttgatattttgttttctgagttatttcactgaggataatggcctacaattccatcaatgttgctgcaaaagaaatgatttcattattttatggctgagtagtaatccaagctcttcaagaagccaagatgggaggattgcttaggcctaggagctcgagagcacacagacattttatcatctcacaccatcacaagaagggtgagtatagtacaattagacattttgagaaagagacaacactcatataacttttattacagtttattgttataagtgttctatcatattattgttgttgttaatcccttactgtgcctaatttataaactatattgtaggtatgtacgtagaagaaaaaaacatagtgtatatagggttcaatactatccatgcttcggacatccactggggatcttagaacatatcccccacagataaagggggactactgtacatatgttctaaatacttcacatatattatgttgcttaatcttcacaataactctataaagtaagtaacattatctccattttttagaggaggaaatcaggcccagagaggttactaacctgcccaagatcacatggccattaagtggcagaaccaagacctgaagtgaaaaccaccacctgatagtggtgcacagggccactgccagcccataaggtgcctttgtatgaattagagacaggtgccctttgagtggatacagctctttgccagggttcacaggttggcaagccaaacacaggctaggttttgcccttactcaccccttgcctgcaaccccttgtaaagtaaaccacctgcacaaccataaacagcagccctagtgtaacaggtcagctaataaactgatcataattccaatcatttagagctgtgctgtttaatatggtagctactacatacctgtgactatttaaatttaaaatgcagtttctcagtcacaatggccacccttcaaatgctcaatagctacacatggctagcagctactatgttaaatagttcagatatagtagatcacttccataattgcagaaaaattctttgggaaatactgatttagagtatacgtgtaagagtattagaatgttttaaaatattatacttgatttctctattttacatatataattatatattgttatatattatcctatatattgttatatatggattatctattatacatatatattatatatatcataaataattatatggtatatgaatgatattgtatattatatagaaatgatattgttatatatcatattatatattgtatatcattatatatatgatctatacaatcatttacatttatatcttatattcctaagagcattacagaaaatgcctgcataggacaaggattttttagtgatactttaacatgattttattgaattttctgtactgaggattttaccagactggaggaagggaataagagatatctaacagtactgcagagtggagaaataataattatttattggtaggaacgctaaaacaaatgagtagaacaaaattattcatgaaagaaagataacttttttattactatggcagcaaaatgttttaacttctgtatattacttgcaagaatatgtcttatgaagccatcttaagtggactctttaaaacacatttttgagatttgattagactcttaaaaagaatattagataggagagctatgatacataagaaagtttcattgctttcaacttagtgccccatagtaccagaaacatgtagacaagttataggaagctcaatgaggggaaacagaagtgatcgtgagaaaaaatgagagtgatttatgagaaaatattaataaataaaatatgtatggtgaaaccaggtgatttataaaagatcataataactaaatacaaataaatggaggacataaactttaaggaaatgtttagcagcaatgagaggttataacttagacaaagccattgaaataaatgaggccaaatataaagagaacttaaaggaatagatttcagaaagcaatatttattctcaggtgtggaaatagtctttcttcagctggtaagtgacaagagcagtgtgtatttcttagcactgcatttttaaaaatcaaagtattaataaagcctaggaacagaaatctggtactgatgatctagcattctattttcttttaactgcagttctcaggatgctatagcatgtcatcatctttttctagaaatgattttcatgaccctaataggatatctccaaagagataaactaacaggttttctcctagaaggaagtaacatgtgtgctgatggagttcattcagaaagaagttcacacttaactcctaccatcctctccaatatccacctcctcattgaattcttttgacattttatttttaaatacatatgctttaaatttttaagggaaaaaacactggaatagaaagaatgaaattcacaaaacctggaaaaaataaatatgcaggaaatatttttgtaaatatctaaacctgtatagaagtctacatcatacattatatacatttttaacaaaagtattccatatttcagagattccaaagatatcaaatgatgtggtagttgctatagaaactattctcttttaatgaaactcagattaaataactgcataaaacaaattcaaatttgaaatgcaattactattctaaagcatatttacatatttgattttataatggttacagaaaacaagataaaatattaagaacaccttttacattgcaaaatcagtggcagttataaacttaattgcaactctgcccttaaatacagtactgttgggtataatgaaattctatttcataataaaatctcatacaaactctgtaccattcgactgcttggaaaagcactaatttgcatgcagtgaaaacagttctgcaagtttaccactttgcataaatggtgtaaattcaaggcaagtataaaaaattccccaaaggcttgagtacatcagatcaatgctcagaaaatggccagcaagtaaccaatgaaattccacagcaagtgacttgacataatagtcaggaaaggttctacctatctaaaattttaacactttctcccagcctacagagctaagatccagactcttgaggtttgcacgctcctgtcttaccacttcccatattggaaatatcacagaatttgtaatcaaagagaccacatttgaaatcgtagctctaatatttacactctataatattttaagcaagatacttaacccctctaaacctgtaaaacaaagataacacctacctcataggatcaatgaaagattaacaatattttgtctataatgcctagcacggtttctgcacatttggtgctcactgcctgatagcttctgttattattattactactactaagaccattattgttcctactactgctgctgcaagtactaaagcaaaaagcaaagccatggtaacttttttgacttttgtttcttatatttaacatgtcttcacagtcttcctaatgcgcgcattgaaaggcagggtaaggggtgtcagttatgtctgtttaagagaactggcttgaatctggctgtgaagatgacctgcctgggctcatcccagccacctgctaatttcaccagttccttctatgtgacacattagaggagacaaacaggcttcactttggaagggcttctgaaaattgagccaactaacaactagaatttctcattatttgtctttttaattttaattgtagaatttttgttcattcattctttcctcagacaagtcttcccaggtcatcttttctatgttgaagcatatgcatagcacttttttcaatgtatttggtattctagcagattggttacattattggaccatattaatggcttccctgtacccatgcactttgggggttaaaatgtatattgatataaataactgcactagatagatattgataaatatcctagtagagattataaataaaatgccatgatagttcgaaaaagggaaactaactctaacaaggaaaatcactgggtagcccatttttttcatctttgtaattcaggtaaaactgtcctcagttttggaaaccctgagccattttctgattaagtatagagaacactttctcatgtaatatcacagcttgaaaagctcaaaataaagcacctccagatttacttaaacttgtgctacaaaatggcatcagcatcacagagctttataatgatgtcaaacaatcctttaaggaatataaaattcctatgctactttgtaattttaacaagcaaaacatatatacatagttttaaaatactgacaggcaggtccactattctccatccctgacgcagtcctctttcaaccatttctgactttagttcttctaaaaccatctcctccatccctctaaatagtatgtatccatctcaatttcttaacttaatcaatttagaagatacattgtgatgatatccttctgtaaaagattagtctttagccaatttactcaatatacacacatacttccctttgccaatatttttataattataagttacctttataatcttaaatattaactcatatttctaattcttgtctctttaatagttttttcaactctcttcactgtcagatgaagatattattttccttattcttccctctatctttcattcacttcacctcccatcttccatgagcttcacctcccttcttccatgggcttcacctcccaaattccatgagcttcacctcccatcttgcatgggcttcacctcccttcttccagaggcttcacctcccatctttcatgagcttcacctcccatcttctatgggcttcacctctcgtcttccatggacttcacctcccatcttccatgagcttcacctcccatcttccatgagcttcaactctcattttacactattctacttttatattatcttctgtagacataataaactttcatgctatgtctaaaagttggttatcaatcaatcaacaccattcaaaacagaaaaacagttcactgaaggaccagacggtatgtgaggacagcatttccttttttatggctccaatgccacagcccatagaccatctgaaggagaatattttctgtacaatagtaaaatgtgttctcttctctcaccttccatcaattgctttaaataataccacgttttatttcacttcattttaaaatattatttgtgctacatttattttatttctattgttttcaattggctaatttttgtcacacacacacacaaaaaacttcagcctgtctatccatccactgcatagatggttagggatattccttttttcttcaaaggtattcttccaataaccttctatctttctgctctaatcaggactgatcattctctaggcctgctgcctagccattatcttccaattctctttcactatcatctaagagtaaatctacttttctctttctgcatattctctttaattctgctggtacatatccttaagcaacttttgagataggaagcctcaaagatacacattctgattttcaacgtgcctgaaaatgactttatcttcaaatttgactgaaaatttggcttgacatagaattttaggttgaaaataatttcttttggaactttgatggccactactttttgtttatacaaacacaaacatacatacaaataattggtcagatgcagtggctcatacctgtaatgctagaactttggaggccaaggcaggaggattgcttgaggccaggaatttgagaccaccctgggcaacatagcaagatcctgtctttacaaaaaaaaattagccaggtatagtggtatgcacttgtagtcccagctacttaggagactgaggccagagaatcacttgggcccagaagttgaagactgcagtgagctctgactgtgccactgccctctagcctaggcaacagagagagaccctatcactaaaataaacaacaaaaaaaattatttcagggttgtttataaaaagtaaaactgtgaaaccctaaatgcccaacaatagggacaatttaaaatagtagttacagtagttatagtatatccaaactgtagagaacattcagtcataaacatgatgacaatgtgagaatatggaaagatattcagaataaacaggtaaatattttccagaaactagttacaaatgaacacacatataccattttagttaaaatatacattttaagatatactgtgtatacacatacacacagacacctatatgcatgggtaaaggaatagaagaatatataccaaaatattaacagtggttatactaaagaaaatgtattttgggtgattttattttattcatattttctgtattatctgaatttttaataaaacacatgtgagccattagaaagctcaaaaaataacatacagttggcccttcaacaacatgggtttggactgtgtgggtacaatatacagatttttttcagtaagtatattgaaaaattttttgaagatttgtgacaattttttaaaaacctatagatgaacaatgtggcctagaatattttttaaattaagaaaaagttaggtatgccatgaatgcataaaatataggtagatacaagtatcttttataatttactactgtaaaatacatacaaatttgttataaaaagttaaaatatatcaaaacttacaacctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgcctcaaaaaaaaaaaaaaacttacaacctgttatagacattacatggtatattcacaggaaaaaatgtaagcaattataaaaatgcagtgttaaatcataactgcataaaattaacagtagtacatactgtactactgtaataataaccacttcctgttgcttttgtggtgagctcaagggttgcaaatatctgcttaaaacactgtgtgacactaatcatctctgcatgagcagttcatctctccagtaaagcatattgcattaaaaaatagtctttcttcgtttagtgcaataccataaactttgaataacaacacaggacccatgtggaatgccactagtgatgctggaagtgctcccaagaagcagaggaaagtcatgacactacaaaaaaaaattaattgcttggtatgtaccatacattgaagtctacagctgtggttatccatttcagaaagatgattcatcttgtaaacagacaacataaatttggggtattgataaatacagtatagtattataaatgtattttctcttccttatgattttcttaataatattttcttttctctaacttacggtaggaatacagtatataatatatatacaaaatatgtgttaattgactatgttattggtaaggtttctagtcaacagtaggctatgagtaaagttttgggggggtctaaagttacatgtggatttttgactgtgtggggctgtcagcgcctctaacccattgttcaagggtcaatcacatagcagaaattttttatctttaattttagtaaaaacacatagcataaaatttcacatcttaatgatttttaagtctatgtacagttcactagtgatagatatattcatattatcatgcaacagatctccggaactttttcattttgcaaaactgaaactaaattttgtaaaactgaaactctctacccatcaaacaacttcccatttccaccttccctcggcccctggttaccaccattttactttaataataaatttgactactttaaataccacatataagtggaatcatacagtattgtctttttgtgactggcttatttcacttatcataatgtcctccaggttcaccatgttgtaccatgtgacaggatttccttcctttctaagactgagtaatattctattgtatgtatataccacattttgtgtatccattcatctcccaatgaacatttggatagcttccacctcttggctattgtgaatactgctactgtgaacatgagtgtgcaaatatctcttcaagatcccgctttcaattgatttggatatataaatagacacttttaaagctaatcaactcttaacttcaagataaactggtattctccatatcctctgtaaaacactctggctaattgtatggcatattaactgctcaaagataaaagctgttctcaagtatgccctgtacttctgctagtaccaatttatattgttttctaagagttcacttttatctgataccaggtttatttatgtcatttgcacttggtattgtaattactttaattgagtattacataaactatttaattactaatatgaaagaaggccacttatgaagaaacaaagttgaatgcttctggaaattttaagaaggtgaaggcaagtagcttaaaaattgttaggttaaaggcagaacagggaactgcaaaacacttataaaattataacaatctcaaaggattctgtacacgcttgctttataagtgtcttcatattctagctcaactttgaagaaagcaaacctggaaaatgtagacaatgcattatttttgtagtttatgcaaaaaagacaatatggaattccaatcgtcagaataataccaaaaggaatgccttagtcctacatccaaagattagagaatgagtatatatttatatgtcttaaagtgtgtatgtaccatttttatgattcattgctttaactgacctttccaattaactaaacaactatggattcagactgctccagataagaggcattttactatttccattttaaactaaaaatatttaatatatacacactatatatgtatataaatatatatatacacacacatctatatataaatatgaaagcaatggatacaggctgtctgcattcaaatcatagctccaccaatgactagctagatggtaatgtatttaacatctctgcgccttcctttcctgatcaagataataatcgcattaactttacagagttgtgctgggcagataataaatgtgtgctattataattaagtaaaccactaaaccaatttcctaatctagcctggggacaatctggtaaataaatctgataaatggattatatcctttggctcttttatctattttgtaatctttaccagaaggattttcttcctctatgtgttccttaaatttccccttttataattcaaaatcatttgttcaattgtttcaaacatgaaactcattggatttcaccagggatccagagcgtaactcttgatgtcaaagatactaattaaatgtttagtgaatatcactgttgcagctaaagtactgttttgtgtccactacgggtatttcttaatgtgagaattttttgaagagaaaggtcactaaaaatagtgaatacagttgaatggtgatcattaagatgtgttcaaaattaagtagtatcccaacactacgtgaaacttagtgatggcaacagtggcccatctagagcccctgctgccatggtgccaggtgcagtgggggagatgtgcccagggctgcgctccacagagctggcaggagccaaggacaggtagaagccctctgcccttctgagttgacagagtgggagctttgtgctccctgtgcacagctgggtatgtgcatgctcagggcagtgctgacacaccagccccctgccaccttggccccctgcagactttgggtgccaacaaacacagaagagaggccaagggggtgctgagggcagctcagcactggcctacaggcgccccctcagcatgaagagcctgggcaccatgaacagcagcaggaagcagaaaggcttggggcagaaaggggtgggtccccaatgaagccccaccttcaagctggggagggcctgaagcctgggagccaggctgccagtcccgtggaccagagtggggacttacggtgctttttctggggctacctggtggccgcccatgaaccaatcaacatgcacttcatcccctctgaaccccataaaaaccccagactcagacgtcaggacaatcagctgtggagaggggctacccactccagggtctcctctctgctgagagctaagaggtatccagacgaccagctatggagaggagctacccactccagggtctcctctcttctgagagttgagagacattggggcaaacagctgcagagaagagttacccactcctggatctcctctctcatgagagctgagcactcagcagaacagcctggctatgaataagagctatccactgcaagtctcctctgagctgttctatctatcaataaagctcctctttgccttgtttaccctccacttgtctgcatacctcattcttcctggacatgggacaagaacttgggacctgccaaatggcagggctgaaagagcttaatacaaacagggctgaaaaacgccccttactcgccatgttgcaggcaacaagaaggagagaagagctgcagcactttgaggagcccagacttaggagctctccaaaccagaactgtgacaccctctttggggctctgcagttcctgacgtctccaagcttctgggcaccaatgcattctccagtgccagacaaggaagctgcttgtggtacacctaatccagctacagcctcacagagagccagcaccttgtgctgcctgccccactgcagccagcatgcctggctgtgcacagtggtgggaccccatgctcacttgctcacacaccgctcgctgctctactcacctttggcaggcatgggatccaggccagtagcacaagtcacaggcagcctgccaggtgaagtggccagtggcatctttgccctagttttgcttggccaaaaaaactcaggcaaaggtgccattggctacagaggtttccagctggcaaagcaacaccccaagcatcccgtaacattagtaagattagaatttaggttaatcagtactttgaatacatctactttgatcatgaacatttttttgatttttttcatacttgcagaagttcataaagaaaagattttaaaatattgtgctataaccatagatcagttatgcatacctggctttgcagtatgcatttcactgtgactcccagtcccaatcactgactgaatgggctccctgtggcccaggagaccccagaaaaaccttaaaaccttaaaactgagttcccagccatgacgggacaggtccaatgtggcttgttatactctccctcttttggggtttagacacaactgactggcattgttaaaatagagatcatgagactgatagagcagactcttctatggcagtaagataccaaattatatacgggacctaagtccatgccaggcaagggtaaagtcaggcactcctatacttaacgaataaactatgttctaactgccacaagatttttcttgttctctagcagctaaacaagcactgcccttgagataagcaatattaaaacaattacagctcatccagctcacagattctgactaactgactaaccataactacagttttcattggacaagggactgatttcagtaactttctcgtacagaagaccaccagccatggactggttctgggcagtttacagagactgcatctttgagagccttcatgtcctgaaaagaccttttgacatagagagcttaactgtaacacatttaaatgttaagtctctacccagggtgaacataggtcttatgtaacatacgtgtttgttcaatacacatgcatcaggactaccttcatgaatattcatagctcctcctgtaacctgttgaacatgtatatttagccaaattgttcagcacaaactcccaccccaaaacccctcctgcttccaggtgcctatctttggtctttgccagaggcacacttcccagcctgcagtatggccaccttgcaggctgtaactctttagaagaaataaagtctcctctccaaatttataaagactttgtgattttttacagttaacaattgaaaccaacagaaatataagatattacataattgaaacaaaagcagcttatgaaagggtatcaaaaaccataaaagacatttataaatgagtctgagactcagcagtggagtctgacatggagcaatcactgcagaggcagaaacaaaagattaaatggcatcattcaaaaagagcacatagattgagagaaaagagttaacaatagaaccctggaaacaccaagatagagaaagagaagtcatcggataaggcaaaaaacacagacaattgtgagaaaaatcacttattctatctttcaaccagcacttcttgcccaactacagtactacatgcttgggagaaatatgttatagaagccaaggggtatattgcatgatactgaggtttatagtacgaataatcttgtcacccaggtaatgagcatagtatccaacacttagtttttcaacccttccccgcctgccccacattccctcttgtaaaatacctacacaatgtatccccgaatctaaaataaaaattgaaattattttttaaaataaataaatcattttattagaaacgaatccaagaggaaggtgactcaaagacagaataaacaacagtggcaaatgctagagagagctcaagaaataaaggcctgagaaacatatttagaaggtaattattaactttagagagtgtattttctctatagtgatgggtgtagacgatggatggaaagttgagggaggtaagtgaagagaaaaaaaatcacaagtatagactttcaaaaagttctgttataaggcagtagccagaggtgatgcttacttgagaaattgatttgttgttctatagatgagagatggttaagaatgcttacacataatgaggaaaaagccagtacacacgggcctttcagcacagtctttaacaacatatttgtttgctgttcagctcttcataaaaaattacttgtttgaatgcagtattttacctacagatgttcagctctttgaatgtaatgacccctaatctttgatacttctttgattcatttaataagaacaggtgcaattataccatattttacaatacctgaaaatcaactatgcagttgatcctcacaaacatcattttccctatttacagataaatacctgaggtttaaagtgggtaaataattttccccaaactagtaggtagcaagtttcttaagaaaaaaagggaaaataaaaaagcccaattcctcctgcttcaacgctttaattatatcctactactcttctactaaggacattccagataacataagaaatctcttgagttattgaaacagattgatttttaactctttttatgtagatgtaacatacatacagaaaagcacaccaatcataagtatgtagaccaataaaatatcacagtgaacacatttatataacaatcacccacatcaagaaacagaacatttctaccaccacaaagtcctcatcttgccccttcccaatcaatagatcttatgcctccccaaaagtaaaccctgttctgacttccaacaacatggagtagttttttactgttcctgggcttaatattaacgaaataatatgatacatattatttactgcccatttctttaactcaatatttcattcattctcattgctgtgaagtattacattgtaatatgccattctgttgactgttatgtgggttactccgacttccacctattatttaaaaaatactgtttcaacatttttgtgcacatctttggtgcacatatgtacatattcagaggaagtacatatacctagcagtaggtcatagagcatgcatatgcccaacttaaatagatcctaccaaactgttttctaagtggttgtaccagtttatactcccatcagcagcatatgagagtttccagagctccacatactgtgtggcagattcattttgaaaatattttacactaatttctcacacatttctatttcataatgcactctttaaaagccaaatcttttgttaatatttcttctttattgaataccaatgtcccaggccttactaaacttgaacagttaactttcttacatgctaccattgcccgtgaaaacaacaaaatgatacctatattcatcaatgtactttaaatgtattttataccatgagttatctgttattccaaattataatctttctttcttcacatttcttagtaagaaaatatttgtgtgatacctggagtgcctacctaacatcatctatcccccaaaaatctgcagaagattttgatgggtcacttattcctctaggaaaccacttccctgctggtaaaggaaatgatctatgtataatacagccactcaagggaaaaaaacagatctgtaaaaaacatcagcatatactagcatgactgccaactatatttaatgctttgcaaggcattgtttatacttaatgccaaatcattagagtaattctaattttatcaacaaatgtcaagaagaggcagaaaaacagtctcaatcataagagttttgaaattatttattccattttctaagaaacaagccttctagccaaagagctttggtatattgttaacatttttacattagccctatgataataagagctgagctatctaaaatagttcttcctaaaggcaaatcaattcaacagtttttaacaactaaatggccaaactgacatatctttagggagatgggattcagggatcttttatcagtactcagaaaacaaatgaaatatatttcaagacatctagaaaatgtgaggagaagctatgtaaaatagcaacgtaacaacaaacaaaatactaatgagcatttttgtgtttggtgttatccatctaaaacttgccaagcacatattatatttaagacaactccaaatctaagactgtccactgaattcatactttattcaaatactatatagaaattatacacttttaaaatttttataaaagttgttatattatttgtgtaatttttattataaactttttcacccaatttctcatgatgtaactttttaacaaatacatctacattgtgtttactgtactaagtactttgcaactattaactcacttaattgttaaaaacaattgtaggtaaatggagagccagaatttgaacctagacagtctaattcaagttcatgcctctaaccacacaaagtactgaaaaaacatgtacgaatttaaccaaaaaaaaaaacccctattcttttttataataaatctttgctatacctagcctatagaatttatttaagggaagaaaagtttataggaagactcaaagacaaaaagtataatcctttgctatatgcatatttagcttgcttaaaacagtatgtcatcaattttataaatatattaagagaaaatatgaaaacatatttatccttaagcaataaaagcttcttttaaacagtttagaattataaaacctgaagcgaataaaaataattttaacttctctaattatgctttaatcaagaatgcaattctaatcaagtttttatccatccatttatctagactttcctaagcacagtatttgagaataccaaaaggcaatttcattttgtttgtcagggaagaaaaaggatataagagaactctaaggtcacttagtcaatttcctgctcagtcgttttattttccctatattacccagggctttgcagagctgcaatagagagtgctagagtgcacattttcccctcagtgatatagaatgtttccagcaaaatgaaaatatgttcaagtcaacttttttaaaaaagaaaggcatgcctgcatgaagcaaagaaaggaccattcaagtatttactttcctggtcttaacagatttcaactcataatggccctgcttcctctgactagttttactatttaacttaagtactgtagttctaaatcaaatacatctagaatcctcacatattaccaaaataactgaaagaatatctggaaaaaactatgattctgcagctataaaaatcacttcaatcccaatgtaaattctctgtaaactccatcccagtttcttaaaaagtaataggagtagtaactgcaagaggattaatattagaaccagactatatttttgatgtgcattcaaaaatgcttctgtctccagcaaaccatagcacctgaaattcccattcgagtaactttttgaatatccagataacaccattaaactgccttaatgctaatacttcatgcataacacacacaattaaccctagaaacaaacccgtatttgtgcatctgtcataagagaagaatgagactcagtgaagttagcgtctaacagtcccaagatcacacagcttgacggagctaccattcaaatcctcaatcaaaactagtgtaaatatactacagctgcctcagttcccaagtgggttgaaaggaataacagatgattacacatcaacataaaataatggattaatttaacagaaaacagtatacaacagagctgtgaggaaaggggaaaacaagacatgtgcatctgaaatgtagagaaggctgaactttgggagatctgcagcctaatgccctaatcaggcaggaaaggctccaatgggatggcaccaatgaggtagggtctagataggaacaaggaggggacaagtacagcagagacatggtacatagataagtagctttcacagcttaacataggcctgttgtggtagttacatatccaatactataggtatagttagtatctttatttctgccagcttacaaacttatttttttcttcaaaatacatgaagaaagagcagatacccttccagctttagggcttgctcaaaaatgcccataattgacatcaatgaatgtcctctatttagactatttaaaggactatcagaaattctcctttgttttaaatcaagttgttgtttgactgatttaaaaagattaaatcagctatatgtctgtgtatttgctttaaaaataaaaatgtttaaatatgaaatggcattccaatctgctctaccatgctgaaatgctccagaaatttttaaaatattctctctttacagtattatttccttacagataccacagatcttacagtagctgtacagtataaaatgcaagagagtacctgaaggtcctaggcattttgattacttcctggtgggtataccttcaattacataattttccataatttcctatttctttccagaaagggtaaacacaaaaaatacttagtgagtgaggggtggaaggcagctagagattatctgttaaatcctgtgcctctaggcataacaaacaaattgtgtattttaaacacaattttgtaaaacaatccaaacaaattaaaaaagaaaaagcaaacctttcaactcttaccatatactggtataatttttataatgacactaagtaccaacattaattgtaataccaatgtaaagatggcatttgtttttcacatttaatatggttaggctttctgtccccacccaaatctcatcttgaattgtaatccccaggtgttgagagaggaaactggtgggaggtgattgaatcatgtgggtggtttcccccatgctgttctcataatagtgagtgagttctcatgagatctgatggttttataagggtttggccacaagttcttctttcattcacttgtctctctcctgctgccttgtgaagaaggtgactgcttctccttttgccatgattataagtttcctgaggcctcctcagccaggcaaaactgtgagtcaatcaagcctctttcctttgtaaattccccagtctcaggtagtatctttatagcagtgtgaaaacggactaatgcaacattttattttcttttagctactgtatacaatctttataaagccctaggttgagtagtactaattgtaatggcatacctaaaggcatctgtgatctgtcaccgattagccatgtaatcttggccaagctatttaacaacacgagccacattcctcactataaaactgatgatactacagtataatacctctgaataggtttgtaaggattaaataagtttcagaaatctgtagcgtgtaggatatgtttagcacaatgacttttactaatgtgaattacacatatgaaatttctgtgtatgttctgaagtgttgtaaagatgcactattatcatcactaacatatcatattaaagattatatgcgtaatcgtcattaaaaaaactcaaacctaatagggtcatttgagaactaacagcatagcacatgtgaaaaatgtttaacacaaagcaagctctcaataaatgtttatttaaaagtctatgagtgaaatacacccagtgaagccaaacagggagatttagtaaactatgtagctccagactattatatgactgcaatatttacgtataataacctttcatttatgagacagaacattatgttgcatattaaaatcatcaattattaatgttttgagtccaaagaccctcatgaaatgttattagagacaatataatatgaattccccttgtaggacattagttttagtatatattaaaaaacacgtatataattatatacctatatttcaatatatgtataaataattcttatgcatctgcatacatgacaatcacttctaaaaacaaatatattgcaatctttataataatcagattttgccaaaaattttacaaagcctggtttttctaaatctttaaacaaatgatgtattttcatatccaacttactttagacaatataaatctatatttagataatcaaccatacacactttcatcagttttatctcctctcctgattctctcccagagtcaagtttcacatttctaactgcatcctcatcatatccacatggatataccattattactgcaagttcaaggtgcctaaaataaatctatcctttccacaacaaaactatgtcctcctttgattcttccatttctgtcaatgaatccccaagtttgacaacttagttttttttaattcctttcgctctcctctctggagagacaacatcatatacaaccaacattaaagggctttggagtcaactagatctgaattagtcctgtttctacttcttactaactatgtgagcttaagcaagttattatatactctacacttaagttccatatctataaaatagaaattaatctcatttaccttgcaagattatggaagacttaaatataaggcatataaagtacctaggaaatagtgagcttttatacatgttgataaagccacttctcttccttcatcacaaccagtcatcaagaactataaatccttactttgggccaggcgcagtggctcacgcctgtaatcccagcactttgggaggtcaaggcgggcagatcacgaggtcaggagatcgagaccatcctggctaacacggtgaaaccccgtctctactaaaaacacaaaaaaattagccgggcatggtagtgggcacccgcagtcccagctactcaggaggctgaggcaggagaatggcgtaaacccaggaggcggagtttgcagtgaggcgagaccgcgccactgcactccagcctgggcgacagagtgagactccgtctcaaaaaaaaaaaaaaaaaatccttactttgaaatgtcccctatgtcactaccttgttctggggccttctcatttaaatactcaggttttgggtctcatttagttccctatgtatctgggataatggccacaaaacagccagcctatccagtgatcatttcttacctggcatactagctcccaataacacaaaagctactttacatctatttaggattcctgaacattcactccatcaaagttccttctgcctacctttcaatactttccctcatccctatgatccttcataattcctttaggagtctctgagagtgaccctgacacaaattctccatttccttattgcctatcctttttgtatccatccaattgctctgccaggcagacaagctcccttacgtcatcctaccttgtagaactaatgtgatcttgaggactctcactcctataaactctccccaatgctcctatactcttcattgaatgttcccactaagggaacacactataactgcactatttcccttgcagtcctcttaagaggagacggctcacgttttcttttttaccattggttctcaaacatgagaggagaaacagccccatgttagcttgcacatcattactattccatccttattcaaaaacgctttctctttggaatgccaagccataagactaaaccatcctttccctacttatagtgaaatgttatagaattccttgtcatttcttcactggttgatatgaatacactgatgaataaagcaaataaaacaggatattaagtgggatatagtgactgaaccaaaatacaataagattaatttcaccatttaaaaaatattttaatgtggttactagcaaatttaaaattacaaaggtagattacatttaaggttgacattgtatttctactggacattgttgagattgagctttccattccaagttccttgatccagaaatctagccttcaatggactagattagctgaatgtgagtttttaatttaaactctactatactcttcctttctagttttgatagtctctactcttctatccagacagtatacctattctcctgaaaactacttctcactaactcctctgtgcagttgtgtctcttcctacccagaatacccttttcctttcccttctcacccacaatagacatccctgtgacagaatattcttcaaaatacttgctgcccggccctatggcagaattacacaccccatcttgttaatattaggcttgctaatatcatgagaagtaacgtgtgccatttccaagcagaagctttaaaaaccattgcttagttccaatatggtcccttttcttcttacatgagaccagcagtaacccaaatagaagctactccatcagcctggattctgacatgaaggtgtagatcaacactacaactggcccacaataagcatataaatggaagcaagaaataaacctttgctgttgtaaactcctgggatttttaagtatttactatcactgtacaatttagccaaaactggctaatccttttaccagaatcattcccattgttcaagacctattttaagctccactatcaccataaaactttcccgatcagttttgccctaaattagcttttcctcctctaaattccaaaatttcagctgtacgatgtttttggcaattctagtccattctggttttgaattattattcaaatgtgaatcatgcataattacttaatgcttgctaacatcacaaaaacagaagaagccagacattatgtgtctcttaagtggcacatacaatagtacttttgaagtagtcttgcagggggaagggcgagggggcctaaatctaatcaagcttctagatatatccaataatttacagaaaatatagaagacaatacaatgtgttgaactacaccatgggaaagtatttagcaaaatgcaaaaaaaaaaaaaaacctgctttcttcaaacaaaaaaaaattgcagggggaaaaatagacagaatgaggaagcagtatatgaaataatcaaattaaaaactgagggcagaggtgtggtaacacaggtctataatcctggggctttgggaggctgaggcaggaggatttcttgagcccaggagttgaaggctgaagtaagccacaatcatgccactgcactccagcctggatgacccagtcagactcttgtctctgcagaatataataataattttcatttaaaaactaactgggagcttttaaaaaaattgcaaatgggaggcaggactagcttgtggctccactcagagcagcatatggagacttgtaaacttttgctccaagaatgaccacagaaacataccaggaaagctcagagaatctacagaccctttgaaggaagcagcttgctgctgcagactccataagacagttgaaaagctgtaagtgcccaaagtgcaaaaggggaaacatccacccccctcccaatacacatcctcactggggtacctgaaggtccagatcatgggagaaggatttaacctttcctggagctgagacaaatataagagatgagcgaaatataggaatagaggaagcagaggaaagagccccgtgggcactcttggtccccagggaagccattgttgactttgtctcagaggggtccatggggagagatgccactagaattggggaaagactacagggagaaggaaacttccagctgaactttgtaacaatttcaagtaaactcaaagtttcctggacagaatctgggaaaggggtgacccaggagagaagatacagcacagaaactggggcaggtggggaggcacaaatcctgaaagctgcttgctttctcagtggagaggcttggagcctgagacaagttttcagccctgctcaccggctgcctggaaataaactcagtgctattggggtgcacagtgaaagtgagaccagcctttcaggctgcgttggagctggatgaggcctgtcactgcggcctttcccacttccctggccacctgtatgatgcagaagaggcagccataatccccctgagaacacaactccactgggctgagaaccacaaccccataccccacaggggctgaagcaggccctgcccaagaagagtctgagctaaaacatgcctaaccctgccctcacctgaaggtctctctctacctgccctggtagccaaagacaaagaacatagtctcttgggaactctatgccccaaaccacagcctgagacacccaaatacttatccaagcaaccctagggcaagcttgtattctccctatactactgcagctgatgctctcttgaaagcaccacttcctggctggaggccaaccaacagaaaacgagtatgctaaataaaaatacaaccaaggaccctcacagagtccacttcactcccctgctacctgcaccagagcaggtgctggtatccactgctgagagtcctgaaaatggatcacatcacaggaaatggatcatatcacaggactctttgcagacactccccagtaccagcccagagcccagtatctccactaggtggctagactgagaagagcagtaacaatcactgcagtccagctctcaggaagccctatccctaggggaagagggagagcaccacatcaaaggagcaccctatgggacacaagaatgtgaacagcagcccttaagtcaaatatcttccccctgacataatctacccaaatgagaaggaaccagaaaaaacagttctggtaatatgacaaaacaagattctttaacacccccaaaaaaatcacattagcttaccagcaatggatcaaaaccaagaaaaaaaatctctgaattgccggaaaaagaatcaggtcaattattaagctactcaaggaggcaccagagaaaggcaaataccaacttaatgaaattttttaaatattaaagaatatggatggaaaaatccccagagaaatagatagcataaataaaaagcaatcactacttctggaaatgaaaaacacacttagagaaatgcaaaatacattggaaaatctcagcaatagaatcaaacaagtagaagaaagaacttcagagctcgaagatgcttctaaattaatcaaatccaacaatgacaaagaaaaaggaataaaaaaaatgaacaaagcctccaagaagtctgggattatggtaaatgaacaagcctaagaataattggtgtactcaaggaagaagagaaatctaaaagtttggaaaatatacttgagaaaataattgaagaaaacatccttagccttgataaaaatctagacatccaaatacaagaagcacaaagaacacctgggaaattcatcacaaaaagatcactgcctaggcacatactcatcaggtaatctaacatcaagacgaaggaaagtatattaacagctatgaggcaaaagcatcagggaaactataaaggaaaaccaatcagattaatagcagatttttcagcaaaaacacaagctagaaggtactgaggtcctatctttagcctccttgggaaaaaagcaattatcagccaaaaattttgtatccagtgaaactaaacttcgtaaatgaaggagatagtctttttataataaatgctgagaggatttgccaaaatcaaatcagcactacaaaatctcctaaaaggagttctaaatcttgaaacgaatcctcaaaatataccaaaatataacctccttaaagcataaatctcacaggacctataatacaataatataatgaaaaaaatgaggtattcgggcaacagacagcatgatgaatagaaaagcacctcacatctcaatactaacattgaatataaatggcctaaatgctccacttaaaagatacagaatggcagaatgggtaagaattcaccaaccaagtatctgctgtcttcaagagacttgcctaacacataaggactcacaaaaactcaaggtaaagggatggaaaaacatattccttgcaaatggacaccaaaagtgagcaggagtagctattcttatatcagacaaaacagactttaaagcaacagcagttaaaaaagacaaagagggacattatataacaatgaaaagactattgtaatgggaaaatatcacaatctgaaatatatatgcacctaacactggagctcccatttataaaccaattactactagacctaagaaatgagatagacatgaacacaataatagtggaagacttcaatactccactgagattactagacaggtcatcaagacagaaagtcaacaaagaaacaatggacgtaaactataccctagaacaaatggacttaacagatatttacagaacattctacccaataactgcagaatatacattctattaatcagcatatggaacattatccaagatagaccatatgatagggcacaaaacaagtctcagtaaatttaagaaaatcaaaattatatcaagtactttctcagaccacagtagaataaaattgtaaattaactccaaaaggaaccctcaaaaaccatgaaaatacatggaaattaaataatctgctcctgaatgatcattgggtcaacaatgaaatcaagatggaaatgaagtctgaaagagcacaaatagataatctaaggtcacatctcacagaactagagaaacaagaacaatccaaaccaaacccagcagaagaaaagaaataaccaagatcagaacagaactaaatgaaattgaaacaaaaaaaaacagataagtgaaacaaaaagcagattctttgaaaatataaatgaaattgattattagtgagattaaccaagaaaagaagagagaagatccaaataagctcaattagaaatgaaacaggagatattacaactgataccacagaaatacaaaaaatcattcaagactactatgaacacttttatgtgtacaaattagaaaacctggaggagatggataaattcctagaaatatacaaccctcctagattaaaccagaaagatacagaaactctgaacagacaagtaacaagcagaaagattgaaatggtaattttaaaattgccaacaaaaataaagtccaggacaaaacagattcacagctgaattgtatcagacattcaaagaagaattggtaccaatcctattaacacttttccaaaagacagagaaagaggtaaccctccctaaataattctataaagccagtatcaccctaataccaaaaccaggaaaggacataacaaagaaaactacagaacgacatccctgatgaacacagatgccaaaatcctcaataaaatactagctaactgatttcaacaacatatcaaaaagataatccaccatgatcaagtgggtttcacaccagggatgcagggatggtttaacatatgcaagtcaataaaggtgaaacactgcataaacagaattaaaaacaaaaatcacatgattatctcgatagatgcagaaaaagcagttgacaaaatccagcatcgctttatgtttaaaaccctcagcaaaatcgccatggaagggacaccccttaggtaataaaagccatctaaacaaacccacagataacattatactgaatgggaaaaagttgaaagcattctgcctgagaactggaacaagacaaggatgcccactttcaccacttctattcaacatagtactggaagtcctagccaggccaatctgacaagagaaagaaagaaaggacgtccaaatcagtaaagaggaagtcaaactgtctgggtatatgatacgatcatatacccagaaaaccctacagactcatccaaaaagctcctagaactgataaatgaattcagcaaagcttcaggatacaaaattaatgtacacaaacagtagctctgctatacaccaacagcaagcaggctgaaaatccaattaagaattcaaccccttttactaccactgcaaaaaaaaaaaaaaaatactcagaattatacctaaccaaggaggtggaggtaaaaatctctacagggaaaactacaaaacactgctgaaagaaatcatagacaacacaaatgaaatacatcccgtgctcatggatgcatagaatcaatactgcaaaactgaccatagtgccaaaaactatctacaaattcaatgcaattcatatcaaaataccaccatcattcttcacaaaactagaaaaaacaatcctaaaattcacatggaaccaaaaagagcctacctagccaaagcaagactaaacaacaacaacaaaaatctggaggtatcttagtacccaacctcaaactatatcataaggccaaaacagcatggtactgatataaaaataggtatacagaccagtggaacagaatagggaacccagaaataaatccatatacatatagccaactaatctttgacaaagcaaacaaaaacataaagtagagagaggacacctattcaacaaatagtgctgggataattcgcaagccacatgtagaagaatgaaactggatcctcatctctcaccctatacaaaaaccaactaagatggatcaaatacttaaatctaagacctaaaaccataaaaattctagaagataacatcagaaaaacccttctagacattggcttagacaaagacctcatgaccaaggatccaaaagcaaatgcaacaaaaacaaagataaaaatagaaggacttaatgaaactaaaaatctttggcacagcaaaagaaataatcagcagactaaacagacaacccacaaagtgagagaaaatatttgtaatctatacagctggcaaaggactaatatccagaatctacaaggaactaaaacaaatcagcaagaaaacaaacaaccccatcaaaaagtgggctaaggacatgaacagacaattatcaaaagaagatatacataccaccaatgaacatatggaaaaatgttcagtgtcactaatgagcaaggtaatgcaaatcgaaaccacaatgtgataccaccttactcctacaagaatggccataatctaaaaatcaaaaaataataagatgttggcgtggatgtggtgaaaagggaacacttttacactgctggtgggaatgtaaactagtacaaccactgtggaaaacagtgtggagagtccttaaagaactaaaagtaaatctactatttgatccagcaatcccactagtgggtatctactcaaaggaaaagaagacattatacaaaaaagacacttgtacaggcacgtttatagcaacacaattcacaattgttaaaatacggaaccagcccaaatgtccatcactcaagtacataaagaaaatatggtatatatacaccatggaatactactcagccataaaaaggaactaaataatggcattcacagcaacctggacaaaattattctaagtgaagtaactcaggaatggaaaaccaaacatcgtgtgttctcattcataagtaggaactaagatatgaggacacaaaggcataagaataatacaatggactttcgggactcagggggaagggtgggaggagggtaagggataaaaaactacacattgggtacagagtatgctgcttgggtgatgggtgcaccaaagtctcagagaccacgactaaaaaaaataaaaataaaaaattatttaaaaaattaaaaattaaaaacattttaaaactagatatttgatattaaggaattattattggttatgattttatacacatgaagtgattatatatatgtctgtatatgtggtatgaccacatgtgtatatatatatatatgcacactaagtgtaaaatatttatatatataaaatatttcaatatatctctctaaaagacatactttatgtataacaaaaaaggcaaatacacgtgatatatttaggagtaagtagactaagtaaacccaaattaagagataaagcctgatagtagaagagtgactttatgaaagtagaaggaaaaaaaacacaatcttaccttacatctctggtgaattttttcaacttaggaaaaaaataatttgtgtgtgtgtgtgtgtgtgtgtgtctgtatatgtgtgtgtgtccgtatatgtgtgtgtctatatatacatatatatgtatgtgtgtgtgtatatatatatatatatgaatgtatatataaacattcacagggatagtctaaaacgggttgcaaattttaggagctacgcaagtaaaacaaaatcagtgaagcagactaaaaataagaaattaaggagaaaatagggaatgacggggactgtcataccaaacggcctttgtcccctgctaaaggtggcaccagctgctcagctccagccaacagtgaatgtgctgcaacacaggcccagttttaccaaatcacatggattttccaaagtcagaaattcatatttttacatgaaatcttcctattttgaaataattgacaatcaatctaatctaattctttattatcttcatgagcccaacaaaatatatctgatagcttgatccatcctacgtgctgccagtttgcaaccactggtctaagagaaacttaatatagcatggcatggtggaaatgaaaggagatgtattttagctttttcctgataacaaaaatttattttgttaatagccactgagatgaaaaaagaaggacttcaccagattcactgctaccttcagtgtactttttgtacactgtaaataagttcttgaaagtaagttctttgtgggcagtttatttactactctctctcattcctaggcatggctccattaaacaagactctgctaaattaatgtgaaagagtactcataagcttcagtttgagtaggtgagtcaaatacaccaaaggtaatcggctttatctttaacttatatagccagtttgggaaaagatacaataccccagtgttagctgagaaattgtactggtttactccgatttatttgagcccttaaatctgccctagttcttttttttttttttttttttttttttttgagacggagtctcgctctgtcgcccaggctggagtgcagtggcgcgatctcggctcactgcaagctccgcctcccgggttcacgccattcacctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccagccctagttcttatacatggccatagagaacttcaacagaggaattaactgtggaggactggtgtgtaagagacagaaaagactaccagaggcctttcaccttaatgctactatcttttttattactaggatatgcattacaggatgctaagagcctcaaatttcctatgttcctactctctgtatggatgccaagtttaaattttaaaatcttattataattcaaaaatcacaaaaaagtaaagtaaaaataacagaagttaaattaacaaaataaaagttaatagaagttaatcaaagttaaaacaacaaaaaagtaaagtccaaggccaaaggaagctaacgtggaggaaaatgagagcttctactcaccaagtccaatgagacattcacccaccccatattaactcatgtctgatataaatttgcttataatcttatgaggaaaaatacacaaaattaagaatcatatacaaaaataactggaatacaagaatgtgataaatatgactcaaataaagctatataaaagttaacatgaaataagtatgtttcattattaaattccccataacaagttttgctttttgaaaatgagtaaatgaaacttgcaaggcaaagagacagatagtttcggaattaagaaatgtggttattacccagtgcattcaaagattgctttactattctcatcagaaggagtttccttagattcagaaaacaaatattaatagaaagtggattttaagccttgacttactatttttaatactgcaatattcaaaagacaaacttgatttttaggaatttcatatacagaagtatttttaaaattatatttcctagactatttcttcttttcagcactaaatattcatagtacttaaggtagctggcaatgataaacagcatatgaattttagaactgaaatccccagggaccagagaattctattggcctgccagagagacaatagccaagtaataaaaagagaaagagagaacaataaaggtcagaaggaaggaagaaaggggccaaagatctagggcttattcagtaggccagtgtcttttatttaactggagcaaggaaagggtaggtaaagctcatagcagaaaaattcaggaacactacagcgaaaagtttaaggattttacctaatttctacattctttgaaaaagaaagttcttgggtggagccagacagctaaatagaagcctccatcaatcatccttcccacaggaacaccaaatgaacaactatccacacaaaaaagcaccttaataagaatcaaaaatcaagtgagtggtcactgtacctggttttaatttcctatctgtcactgaaagaggcactcaagagaagaggaaaaatagtcttaaattgcctaagccactgctcccccatcctctggcagaagccacatggcacagaaaaagaatctttgcgcacttgagggagaaagaaatgcagtgattgtgggacttttcattggaactcagtgctaccctgtcacagcagaaagcaacactgagcagaaatcaaccagtgcccccagaaggaacatttacaccagccttagccagagggtaattacccatcccagtggttagaacctgagttccagcaagcctcaccaccatggacaaaagggctctggtgtactaaataaacctgaaaggcagtctaggccactaggactgtaattcctgggcaagtcctggtgctatgttgggcttggagacactgtgagaaaccagccaggatagccaagggaatgcttgtgcatccctcccccaaccccaggcagtgcagcttacagcaacaaaagtgacaccttccttcctccagaggagaggagaaggaaggctcaagaggaactttctcttgcaacttggataccagctcagccacagtaggacagggccccagacagagtcctgagacctcattccagaccacagctcccaaatgacatttctagatgtaccctgggcaagaagggaacctgcagccctgaaaggaagggaagagtcttagcaggatgcatcatttgctgattaatgagcccttggaccctgaataatcagcaactgtatccaggcagtgggccttaggtgagaatcagaatatgctggcttcaggtgtcacccagcacactcccagctgtggtggctacagggagggactccttctacttgagaaaaggagagggaagaacaagggggacttgtcttacacctaaataccaactcagccacagtggggtacagtaccaaatggactcttggaatatgcaattccaggaatgtagagcacaagcagattcctaaggtttccaggacctagctcgctgatggcatctccagacctgccggggaatgggaggaactcacagccctgaagggaagaacacaagccttactgacttagccacctgctgattgtagagccttagggacttgagcaaacataggcagtagccaggtagtggttatcgcaggcctttggtgagacccagggatatgatggcttcaggtctgatccagcacagtcccagtgctggtggccacaggagttcttctgccacccctccctcagctccaggcatcccaatacagagagagaaactctgtttgcaacaaagtcaggtaagagagtaagagttctgcctggtaatccagaaaattcttccagattttatccaaaacaaccaagatggtacctattagagtctggaagagccacagcattactgggtttcaggtgcccccaaatgcacatatagttgcagtagccaaaatcttagatcacaatacctaagtcccttcaaatacctggaaaacctttcaaagaaggacaagaataaacaagctcagactgcaaagactacaataaatacctaactcttcaatgcccatacaccaacaaacatctacaagcatcaagacaattcaggaagacatgacctcaaacaatgaactaaataagtcaccagtgaccaattctggagtcacagagatatgtgacctttcagagaattcaaaatagctgttttgaagaaagtcagtaaaattcaaaataacacagagaaggaattcagaatcctatcagataaatttaacaaacagattaaaataattaaaaagtatcaagcagaaaatctgtagttgaaaaatgaaattgatatactgaagaatgcatcagagtctcttaatagcagaatcaatcacacagaagaaagaattagtgagcttaaaggcaggctatttgaaaacacatagtaagaggagacaaaataaaaaagaattaaacatgtctacaagatctagaatatagcctcaaagggcatatccaagagttattagccttaaaaaagaggcagaggccaggtgcggtggctcacgcctgtaatctcagcactttgggaggccgaggtaggcagatcacgaggtcaggagatcgagaccatcctggctaacacggtgaaaccccatctctactaaaactacaaaaaattagccaggcgtggtggcgggtgcctgtagtcccagccacttgggaggctgaggcaggagaatggcatgaacccaggaagtggagcttgcagtgagccaagattgcgccactgcactccagcctgggcgacagagcaagactccgcctcaaaaaaaaaaaaaaaggaggtagagagagagaggagtagacagtttatcaaagggataataaaagaggatttcccaaactcagagaaagatatcaatattcaagtacaagaaggttatagaaaaccaagcagatttaatccaaagaagattgtctcaaagcatttaataatcaaactcccaaaggtcaaggataaagaaaggttcctaaaagcagcaagagaaaagaaacaaataacatacaatggagctccaatacacctggcagcagacttttcaatggaaaccttacaggccaggagagacaagcatgacatatttaaagtgtagaagggaaaaaaaaaaacaaaagaacaaaaaaactttaccctagaatagagtatccagctaaaatatccttaaaacatgaaggagaaatactttcccagacaaacaaaagctgagggatttcatcaacactggacttgtcctacaaaaaatgccaaagggagttcttcagtttaaaagaaaaggacatgaatgagcaggaagaaatcattggaacatacaaaactcactggtaatagtaactacacaaaagacatagaatattttaacactgtaattgtggtacacaaactactcctatcttgagtataaagactaaatgatgaagcaatcagaaataataaccacaacaacttttcaagacaaagacagtataagatataaatagaaacaaaaaaaattttaaaggggtgagacttaaaatgtagagtttttattagtttttctctttgcttgtttgtttatgcaatcagtgttaagttgtcattagtttaaaataatgggttataagaatttaattgcaagccccatggtaacctcaaatcagaaactatatgacgtacacaaaaaataaaaaatcagaaattaaaatatacctcaccacagaaaataatcttcacaaaaaggaagacaaggaaggaaagaaagaagaccacaaaacaatcaaaaaacaagtaacaaaatggcagaagtccttatctatcaataacaacattgaatataaatggactaaactctccaatcaaaagacatacagtggctacatggataagaaaacaagacctaagaatctgttgtgtataagaaacacacttctggctaggcacggtggctcacatccataatcctagcactttgggaggtcgaggagggaggattggttgagcccaggagttcaagaccagcctgggcaacaaagtgagattctgtccctacaaaaacaaaacaaaatgaaaagctgggtgtggaagcacatgcctgtaatcccagatactcaggaggctgaggcaagatgattgcttgaacccaggatgtcaagactgagtgagacatgatcatgccactgcactccagcctaggtgacagagtgagaccctgtccaaataaaagggaaaaagaaacacacttcacctataaagacacacatgaactgaaaataaacggatgaaaaaagatattccatgcaaatagaaacccaaaaacagcagaagttggtatatttgtatcacacaaaagaaattccaagaaaaaaacaatgaaaagagacaaggtcatgatctaatgataaaggggccaattcagcaagaggataaaacaattagaaatatatgtaccccacactggagcacccagatatataaagaaaatattattagagttgaagagatagatagaccccaatacaataatagctacagacttcattcaacaccctgcttttagcactggacagacaatccatacagaacatcaacagatgcaatctgcactgtagaccaaatgaacctaacagatatttacagaacatttcaaccaatggctgcagaatccacatttttctccttagcatatgcctcattctcaaggatagaccatatattaggacacaaaacaagtctttaaaatttttaaaaaataaaattatatcaagtatcttctctgaacacagggaataaaactagaagtcaagaacaagaggaattttggaatctatagaaacgtatggaaattaaacactgctcctaaatgaccagtgagtcaataaagaaattaagaaagaaattgaacattttcttaaaacaaatgataacaaaaacataacataccaaaacctgtgggatatggcactagcagtactaagaggagagtttattgccgtaagaaactacatcaaaaaagtagaaaaagttaacaacctaatgatgcatcttaaataactagaaaatcaagggcaagacaaacccaaaattaatagaaaaaaataataataaagattaaagaagaaatatatgaaattgaactgaagtaatataaaagattaacaaaacaaaaaacttggctttttgaaaagacaaacaaaactgacaaactttagccagactcagaagaaaagacaagtctcaaataaataaaatcagaaatgaaaaaagaagacactaaaattgatgtggcagatattcaaaggatcattagaggccatcatgaccaaccatatgccaatcaaatgaaaaacctagcagaaatgcataaattcctagacacatacaacctaccaagattgaaccataaaaaaatccaaaaccaaaacagaccaataacaagtaatgaggtagaagccataataaaaagtccccagcaaagaaaagcccaagacctgatggcctcactgctgaatgttatcaaacatttaaagaactaacaccaatcctactattttgaaaaacagaggagaagggaatacttctaaactaattctatgaggccagtattaccctgatacctaaaccacacaaagacacatctagggaaaaacaaacaaacaaacaaaaacactacaggccaatatccctgattaacagaaattgatgcaaaaatcctcaacaaaatactggcaaactaaatttaacaacacattaaaaagttcattcatcatgaccaagtggaatttatcccagcaatgcaaggatggttcaacatatgtaaatcaatcaatatgatacatcatatcaacagaataaaggacaaaaaccatataatcgtttcaattgatgccaaaaagaatttgataaaattcaacatcctttcatgataaaaaaaaaaaactcaaaaaactggatatagagggaatatatctcaacacaataaaaaacctaaagacagaccacaggtagtatcatgctgaatagggaaaaactgaaggcctgtcctctgaaatctggaacacaaggatgctcactttcaccactgttattcaacatagtaatgaaagtcctacccagagcaatcagacatgaaaaaaaaaaaagggcatccaaattgtaaaggaagaagtcgaattattattgtttgtagatgatcttgtatttgaaaaaaatctaaagattccatcaaaaatctattagaactgataaacaaagttgcagggtacaaaatccacatacaaatatcagtagcatttctatatgccaaaaatgaacaatctaaaaaagaaatcaaaaaattaattccatttacaatagtcacaaatgaaattaaataccaaaaaattaacttaaccaaagaagtgaaagctctctacagtgaaaactataaaatattgatcaaagaaattaaagaggacgtcaaaaaataaaaagatattcggccaggcgcagtggctcatgcctgtaatccctgcactttgggaggtggaggtgggtggatcacgaggtcaggagattgagaccaccctggctaacaagatgaaaccgtgtctctactaaaaatacaaaaaattagccggatgtggtggtacatgcctgtagtcccagctactcgggaggctgaggcaggagaatcacttgaacctgggaggcagaggttgcagtgagccaaaatcatgccactgcactccagcctgggcaatagagcaagactccatctcaaaaaaaaaaaaattcaacattcatggattggaagaatcaatattgttaaaatgttcatactatccaaagcaatctacagattcatgcaatctctatcaaaatatcaatgagattcttcacagaaatagaaaaaataatcccaaaatttgtaaggaaccacaaacacacacacacacacacacacacacaacagagccaaagctatcctaaagcaaaaaaacaaaacaaaactggaggatcacattacctgattcaaattatatgatagagctatagtaaccaaaatagcatggtactggcataaaaacagacacatagaccaatgggacagaatagagaacccagaaacaaatccacacacatacaatgaaatcattttcaacaaaggtgccaagaacatacactggggaaaggacagtctcttcagtaaatggtgctaggaaaactgaatatttatatgcagaaaaataaaactagacctctatctcttgccacatacaacaatcaaatcaaaatagattcaagacttaaatctaagaaatcaaactataaaactactacaagaaaacattggggatattctccaggacattggactgggcaaagattcctggagcagtatctcacaagctcagcaaccaaagcaaaaatggacaaatgggatcacatcaagttaaaaagcatctgcaaagcaaaggatacaatcaacaaatttaagagacatctcacagaaagggagaaaatatttacaaactacccataacacagagaaggaattcagaatcctatcagataaatttaacaaaaagatttgttaaatttgttaatttgttaaagagattaataacaagaatatataaggagctcaaacaactctataggaaaaaagtcagtaatctgatcaaaaatgggcaaaatatttgaatagatattttttaaaagaagaaatcaaaatggcaaacaggcatacgaaaaggtgtttgacatcattgatcatcagagaagtgcaaatcaaaactacaatgatatatcatctcaccaagttaaaatgtcttatgtcaaagacaggcaataacaaattctggagaggatatagagaaaagggaaccctcgtatactgctggtgggaatgtaaattagtacaaccactgttgagaagcgtttggaggttcctcaagaaactaaaaattgagctacctatgatccagcaatctcactgccgggtatataaccaaaagaaaggaaatcagtatattgaggaaatatctgcactccaatgtttgttgcaggattgtttacaatagctaagatttggaaacaaccaaagtgtccaacaacagatgaatggataaagaaaatgtggtacatacacacaatggagtcctattcagctaaaaaagaatgagatcctgtcatttgcaacaatgtggatggaactggagatcattatgctaagtgaaataaaccaggcacagaaagacatatgtcatcacatgttctcacttatatgtgggatctagagatcaaaataattgaactcatggacacagagagtagaagaatgtttaccggccgggcgcgatggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacctgggaagcggagcttgcagtgagcggagattgcgccactgcagtccgcaatccggcctgggcgacagagcgagactccgtctcaaaaaaaaaaaaaaaaaaaaagaatgtttaccagaggctgagaaggttagtgggaggctggggatatggattgaaaaaaaaatagaatgaataagacctaccacaagacctgctatcgtgatagcccaatagggtgactatagtcaataataacttaattatacattttaaaataatttagagtgtaattagattctaactcaaaggataaatgcttgagaggatggataacccattctccttgatgtgcttgtttcacattgcatgcgtatatcaaaacatcacatgtaccctaataaatatatacacctactacatatccagtttttttaatttttaataaataaataagaaaaaattttaaattagcaatataagaacatttagcttgctaggacagcaacaaaaataatttatctatcctcctgataatatttaatcctgtttttgaaaaccagttaaaactcttaagctttcaaaatatgtatatgttcagagaatacctcagtaggataaggatgcttttgtcaccctaaaagcaagaagctcattcccagagctttttaagtgtatagtgtgttttcaagggtgagttggcaacttttgatagcctaaatgtgaaactgcattaaaattagatatctgaagaaaattatactttttcaggatcacatgtaaaattttctgagaacaacttttttgccaacttgaaaccacgttgatcgtaaggatgtacaaataataaaaggaaaaaaacatgccctggtttgtttccaccaaaaagtaatgtgaccctggaatcataatttgtttcagtagttagttacaacacccattgtctcagaatataaccacttccaatttccattaaaaatatatacagtacttcagttgtctattaagttccttaattgaagaaactctatcgaattaaagatacactgatctagtcaaaatgtaaaatcttccagaaatagaaaagctctaatcagtacaacacaacacgaaattagtcccaaactagcaaatgtgaatttaaaggaagaaatagtcctctgtcttagggctttattaaatcaggttataggaattaataaaaagagtaaataagatcatgagtccttcctcaaaatataggggaaagtttctctcgtgaagctgagtcctagaccatgtgtagtttctattaaattgaagcaaaagaatcagtctcattagagaaaagaataaaaaattacccaccacttttattaaatcatttggttttcatccagctgtataatatgtgtgatgcaaattaaagaccccacaatttgataaacctaaactgagataaaagctttctagtcttttataggaaagtttaaaacatttacaattgttagtaagctgcaaaaagtttactagcatttcccataatcactgctattcttgtgatggtacatcattggtaatgacactactaagataagaagttacagtattacagcttaggaacatatttccaatttttattaaaattattaagttcttcctaatatgtttatgacacagggtctgatgttccatccaaatacatttataaaattgttttcttaaagcacctggggtagttacatgactggagaagatctttaaacatgtataaagctgtatgtctaatagaatgaaaggcaccaattaatccaattacttagtgaagacagtttctcctatactatatgcactacatacacctcacaaccctatttgataaaggactagtatctccatttaaacatgaaaactgggttagagaaacactattacacattaattggtagagttgaatgttttaaatcttatctttgtaatttcaaaatccatgccctatttattatgtcacactgtcaacagagacagatacatccaaatgaggttttaaaggccaggtgtggtggctcacacatgtaatcccaacactttgggaggctgaggcaggcagatcacgaggtcaagagatcgagaccatcatggccaacacggtgaaaccctgtcactactaaaaatacaaaaattagctgggcgtggtggcatgcacctgtagtcccagctacttgggaggctgaggtaggagaatcacttgaacccaggaggtggaggctgcagtgagccaagatcacactactgcactccagcctggccaagtgggactttgtctcgaaaaaaaaaaaagataaagaaaaagataaacaaaacaatttaggggccagcatttgctttggacctgctctaatacaaatgttattagatcaacccttttcaccaaagtattcctactttcaagatcagtttcctaaatagacctcataactaatgaacagaggatttcttttttttttttttttttttttggagagagtcttgctctgtgcaatggtatagtctcagctcactgcaacctccacctcccaggctcaagcaattctcctgcctcaacctcctgagtagctgggactacaggcacaagccaacacgcccggctaatttttgtatatctagtagagacggggattcaccacgttggccaggctggtctcgaactcctgacctcaggtgatccacctgccttggcctcccaaagtgctgggattacaggcatcagctaccatgcccagccaaaaggatttttaatttgagcttcaggatttcataccttgaaatcatttcaaatttttgtgtgcttgcacgtactgtgcatttccatgaggaagaattcattggtttttatcagttaatcaagggaatctatgactccagaaatgtttaagaatctgaggagaaaggaagaaatatagtctttagctctgttaataggtgtgcaattttaacaacattctaagtgagcattattctctcacctccacaagtttgtgatgcacatgttgttttctctgcccttcattccttctctccacacttctgcctaccacttccactgggctaattccttctcatcattcaagactcaattaatgtgtcccttattctaatctaagacaccttcttgaactacgaccactacccccaggctgtcagggaaccgttctctggcctcagaattctgtgtacaactctatgttgcctgaatgataattttctagctctatttctcctccactaggataggagctccttgaaggcaaggactttttataatacatctgtgaatttccagagtttagcacaatgcttgatgcatagaaggtattcagtatagttttgaataaacaagtaattttaaaaacaaataaaaatcctgtgaaacagagtgagaccttgcctctacaaaatattaaaaaattagctatgcgtggtggcatgtgcctgtagttccagccagttgggaggctgagatgagaccatcacttgagctgggaaatcaaggctgcagtgagccatgatcattctacagtattgcagcctgaatgacagtgcaagaccctgtctcaaaacataaataaatatacccaaagcaattctaagcaaaaacaaacaaaaaaaacaaagccagaggcatcacattacctgacttcaaactatactacaacactacagtaactaaaacagcatggtactagtacaaaaacagacacaaagacccatggaacagaacagaggaagcagaaataaagctgcacatctacaactatctgatcttcaacaaagtagacaaaaacaagcaatagggaaatgactccctattcaataaacagtgctgggataactggctagtcacatgaagaagattgaaacatatacaaaaatcaactcaagatggattaatgacttaaatgtaaaaactaaaactgtaaaaaccctaaagaaaacttgggaaataccattttgcacataggccctggcaaagatttgatgatggagacatgaaaagcaactgcaacaaaaacaaaaattgacaagtgtgacctaattaaactaaagagcttctgcacagcaaaagaaactatcaacagagtaatcagacaacctacagaatgggagaaaacttttgcaaactatgcattcaactaaggtctaatatccagaatctataaggaacttaaacaaattaacaggctgggcgtggtggctcatgcctgtaatcgtatcactttgggaggccaaggtgggcagatcacctaaggtcaggagttccagaccagcctggccaacatggcaaaacccacctctactaaaaaacacaaaaattagccaggcatggtggtgtgtgcttgtaatcccagctactcaggaggctgaggcaggacaatcacttgaacccaggaggcagagattgcagtgagcaaagattgtgccactgtactccatcttaggtgacagagtgtgactttgtctcaaaaaataataaataaaaataataaaaagcgggcaaaggagatgaacaggcagttctcagaagacatatatgtggccaacaagcaatgctcagcacacacatacatgcggccaacaagcatatgataaatgctcaacatcactaattattggagaaatgcaaatcaaaaccacagtgaaataccatttcacaccagtcagaatggctattactaaaaagtcaaaaagcaacagatgctggagaggctgcagagaaaggggaacacatacacatagttaataggaatataaattagttcagctgctgtagaaagcactttggagatttctcaaagaacttagaactaccatttgatctagcaatcccactactgagtatatacccaaagaaatctaaattgttctaccataaagacacatgcacacatacgttcatcgccacactattcacaataggaaagacatggaatcaacccaaagcccatcaacagtggacagggaaaagaaaatgtgatatatatatatatacataaaataaatccccgctctacagaagccatcagcaaatatttctttacacaagcaaccacatctataattctcatgatagctatcatttccaataacctgtcttctggacaatgaacaataataaatactattaatcaattttcatccttaataataataacggccctagtaataaaactaggaatagccccctttcacttctgagtcccagagaggacccaaggaacttctctaatatctggcatacttctccttacatgacaaaaactagcccctatctcgattatatttcaaattttcccatcaataaacatgaacatccgcctatctatcacaatcctatccattatagtgggcagttgaggaggactcaatcaaatacaactgcgaaaatcctagcctactcctcaattattatatacatatataccacagaatactacacataaaaaagaaagccatataaagaaacaagatcatgtcctttgcagcaacataggtggagctggaggccattatactaagggaattaacgcaggaacagaaaaccaagtaccgcatgttctcacttataagtggaagctaaacactaattacacatggagacaaagaagggaacaaaagacaccaagacctgctttagggtagagaggggcaggagggtgagggttgaaaaaccacctgttggatactatgcttattagctgggtgatgaaataacctgtacaccaaaccccagcaacatgcaatttatccatataacaaacctgtgtatgtaccccatgagcctaaaataaaagttgaaatggaataaaataaaaatacaaacatacataaatacataaataaagtaacacagcccataatagtaatttcttccacaaagccaagacacagagattcatctattactcctgaaagaaagacaagcaaactgtaattattggcaggttgtttttgatgtcccttccccaagagatttatttctataatatttttcaaaatatttatttaggaattgacaatcttatataaaagttttcaatcctatataaaattttagaagtctttttgtgtttcattgctttgttttccttcagatgacatgaaagtacacttttttccaagtctgtttagagactcaaaagtatacacccaacagttcttaaatacatatgacaaataaaaacatcttcctttgaagttttaaaaaagagaaatttgttttatggatcccattaaataaatgaggaatataaaaagcaaagattagcatattccaatatggtgaacactatcaatgaagtactgcaagcttttaaacttgcaataatttttataatgagaaacatcaaattcatctaagaatgaaatttttccttaaatctgtattaaaattaatactccattgctgaaatttaacaactaataaaaatactctgaaactcacatagaactgtgctgttcttaaatgactcaaagagaaagctgtgattttatttagaatatatatgcaaaatattcacatcctctgactttcttaatatatatagatctttagtagctttcattgaaagtgacactgagccacaatgctgaaactgaagcaaattacaacattcacggatctcagaaatacagacatgatcaaagagccttagaagaaacaagcacataaactttctgtcaaaaaatagttttctgtctcaatacttttgagatattaatattatgttatagctcacttataatatagaaaatctaaaagtgagaaaaatattttaaacttttgaaaatatttccaaaaatgaataaaattatgtaagtccacattcccttttccataattccaaaatcaccaaatatctaactttagcaccaaaattaatttgatagcaaaatccaacccaaatttatgtgactctgtttataatttttattcacttactgtgaatgtgatattgatgtgtttgattacatcttactatctcacaccccattgggggtattatgtaattgacagtacatatgcagtattgcctttccataataaaaagaaatctgagttctgaaatatatttgcatccatacctgccagataagggactgcagacctggatttcctcttcttttaaaggtgattttctcctatgcctttaggaaaaaaaatattctctctctctctctctctctctctctctctctctctctctctcacacacacacacacacacacacacacacataaacacacacagacaccaattaagatatcatttctctgggggtgtaagacattgtatactttccataacttatctctaattttcaccttaaaagtagctgttattatccccagttaaatacaggtactaaaacaaaaaaggcttaactattactttgtccaaccactaacacaagctatcaaacaatattctcatttctaaggcgttttacaatttcaacattctgcccataattggtttctgattcatataaacctgctttttaaaatagacccatttatttcacagagagtgataaaggtacggtccattttaacagactgcatcatttaaaaaaatgtttgcctacatgggcttccacagaataacttgacaaaatagaaaaacaaattattttaccgggtaactaaaataaaagcttttttaagatagctggaagagagggagaagaagctaagaaaaagaagcaggtgcaatctagcatgagactaatactcctacatgtaattaactgtaaggttttcttttttattagtattgataatcaaatttatagggaaaaagtcctgacatttgtgtccccattttaaagcacaagatttaaaagaagaaacttccttttataaatctgaccctcttacagagctatctacatgctctgtaagaagcttgaatataaaaaatttctaatgtattgcatatactttacatataaaagcatgcttaagatatcttaagtgtcccttattcctccaagaaattcctcaaaatctacctcacacagagaccggtcccatgatacacagttcaggtaacaattctacattctccaaaacttaatgtctgcctttcttctgacagcaaagcagtgaaaaaccaatgaagaaaaaacagaatttcttatactcatcattgtatgtttatataatttcttttatatgtaaagtatatgcaatacatttgaaattttttatattcaagcttcaagtgaactacggacataacatttattggacacttcaagtatatgatctctaatattcacagctatcctgcaaatatcatccccattttacaaatgaggaaactgaagatcataaaacttgagtccaaggtccacatataataagtcacagtcacaaaagtagggtttacacaaggatctgagcccatttctttccatttcaccttgttagaatatgcttagtttagaatatttcctgtaaggcagggattttcatcatggctatgatttcttcagaacgtagtatgttgtaatacaaacacaaagccaaataatgaatctgggtaacatttaaattgtcaaaaaaactaatcttctactaattctttgcagatcttaattaagttgtcaacttctccgtgccaaaacttctccacatataaaacatagagaataccttaaagagttgttatgagactgaagtaaaatgtataaagcacttagtacaatgcgtggtacaaaataaacacttcataaatgttggctatttcaagtgagattaagaaattaccagatggccatattttgtatcaggtgactccagccagcaatagctggacacctaatctaaaaccagtcaatcctgacactggactgtgatttagtggtaaaagacaataagggtcaataaaattatctctctcagaaatttgaattaaacaaagactgaggcattatttgcctaaatgacctggctttttaccatcatcaattttctaccatcaatgttaccaatgacctctctgttgctaaatctagttttttagcccttcattttatattgtttggcagcattcagtctactgagtattccatttatcttgaaacattcctttagctgtgctctaatctctccagtcgcaccttctcagtctctttggaaggcattgaaatattgcagctactcaacacttcatcccaggcctcttctccctctaggcaatttcatccacacccatggcttgagtaattatttctatgtcaaaataattatctctatgccagtttacacttttcttgtaaattcaactgccttgtcaatctctctgcttatctggatgtcctaaagatacctcaatctccacttatctaaaaccaaattaatgatctttcctctcacacctacccaaggccccttccaatgctccctatcccaataatggcaccactaactatccagttgaacaaattagaaaatgagaagtagtcttcgatacttccttctccatcatcctcatatttcactaagtcctattaattttatctcctaagtatttctcaattccttctcttcatctccactgctaccttctaaggtctctctatatgcattcttgtatcctctgtactctcctcaatgtagctggtggagagtatatcctatatccactcttgtatcctctgtactctccacattgtagccagagttattttttaattattctaatcatggcatgctcccacttaaaagccttcaatggcttcccattattcttaggatttctgacccaaattcatatcatattctacaaagtactggaagatctggcttcagcgtacctcttctctcttcccattgccccacatgtacccacacttgtctcctttcagttcctcaaacacagcataacatgtttccacctgcttgggttctttgcacatggttttcctgctgcctcgaccactctttgccctttttttcaattatccaatccctatcatatgtcagctaaaatatcacttccagacaatatcagtaattcagttattcatttaagaaatctttattgagaacatactatacacttagaaaagttctagacatgtggtattgataaaacaatgcccttgtagagcttacattgtagtggaaggagacaggaaataagcaatacaagcaagtaaattaaatagtatgttcaaaggcaataaatgctatgagaaaaaaaggaaaagaagaacaaggtaagctcatccaaagcagggaatttccaatgcctaacttattgccaggcatatagttagcactcgatatttgttgagtggatgaatgaataaaggaataagcctgttcaagttatgagggagctaaaactataaaatgagtagaggagctactcaataaaacagaggtgccatgaaagaaagagaaataatgaaggccttgagacataatggttcctcgaacttatttctgagggtgtcatagttttcagttccagtttctggggtgtggtgtgtatgtaccataaccacacacacacacacacacacacacacacacacacacacacacacaccaggaccaaagtaattcaagtggatcactcttgtaatgataatacctgatcaggacatatatacaaggttatgtataccactgccaacacccatcacacacatattcccaaagccacttcttttctacccacacacccatgccatcccgtaacatccagttcttcagtggtcagcctcatttagaggcaaactccctcccacatactcaaaactgtaaaaacctttgctttcttctatgaccctgtgagaaacttaaagtcagtatctcacaaatcccagccatatgcacaaggggtcccctcaggaataggatcctgggtctcccttcctgtcagtcttcctgtcccttaaaggctatcttctacccacagaagtgtggacatgcactcctttgattctgaatgaccttcaagatcattgaacccacacacactcacactcacgctccagcctcctttggtaggctcctaaaggactggggctccgggtatcccctcaaggcctcttgtctttttaaggacccatacaagaattatttgcataaatttctctgtgaccaggagtgaccctgaggacactgcacatccccaaacacaaatactctaactcccccttccatggcactgtctgatattaaagtaacacaccttccacgtatacctccctctttagagtcagagcctcctactcccaccccgagcccaaatcatgcccctttagggatctctcccatgctcccacagggcagtgtacaccctttccatgacacagcctagccctaggattagccttcaccacaggtgatcccaggattaagatcctgtctcttccctcaggtcccagcccctttcgggcccatgttctgtcagaagtgtgcacactaacccacactcccctccaccacccggacttcgaggtccctgcccgccattcagaggggtgcacgccacccttgacccctgaccctgaagtcataacccaccgcgcaaatatacaggaccgcctcctcaggagtaggaccatgcccgagtcccctgttgcctgagacccaggacagcctggccgcctcagccttccccagatcggccgcccccacagacctgcctcaggcgccgactggctcccctccgccatttttgttgtccctcagtctccgagctcacgcgaagaccgcggggcagtagggagcgggtggtgggatcagtgggctgacaggagctacctcaggaagacgcggcacgacggttgcctgggcaacgggcggcaggcgcgcgggtggccggcgcgcggct

SEQ ID NO: 199 - DNA, 200576 bp, Homo sapiens
ctggtgataacaacgatgaggtttatttttgtcaaaacatccaagggaaacattaattgttgtttgtcaactgtgaacttcacactacattgtctaaggatagaaaattgatgggtatcactctgtcagaaaatcctcaccaagaagccaattcaaggaatatgaaattgacaagcctttcaaacaaagatgtgttcggacttcactgatgcgatggtaggtcttttgggttacaatagatagggatgatataaaacacaatcttttcctgtctattccattttagaaactggtgggtgtgctcacgtttgtctgggcattgcagcactgcacacatacatgaattaagcaaagcatcggaaagtattgacacatgagactaaaataaataagagaaacgagctgctctttatacctagaaatagctggaaattactgaaaaaaattaaagtgcagaggttttcattttagcaccatgaattgtgatgaaatcccatttctctcactatggcaggactgtatgcagtaaggaagctagagtgatgtgtttgaggcaatgtagatttttgcttcaaaaacagaagtcatgttatcattttagaacaatgggacatagtgaataaagtctgtaaaacatttcttctttgcttttcttaggcggattttcctgcattgggggtagtagttgcggaagtactttttggtagaggaaatccaagtcctaatccctttggcctctgcatggcttgaattggctcagagatccccttgccatctcgtccaaggcctgacccaggcgtccagcccatattctgaagcattcggtttccaatattattttctaggattggctgggcattttcacctacaaatcctgaaatgataaaacaacagcacacattaatcagtatgaacacaggtgaagatattaggctatgaaaacgatgttctcctaagttttgttttgttttgtttttcaaccaggtactagagggggttgcgtattcatctttggatactttttgtagttgagagaacaatggaagaaagatcttgtttagaatttcaattctagcacttcacagcagggtgagctattcagcctctctgggcttttgtttcctcatctgtgaaacagccataatacaacctacattgcctatctcacagaactttgtaggacagatgagatcatgtatgtaaagaaacttctcagtaaaccataaagtactctactaatggatttattttcattaccatgttagccttatggattattcagaaaatcaccaacctatattgtaatatctcacatttgcccatgaccttgacattcaacagaaccaaaactaaaaccaaaccaaacaaaaagcacaactggtggcatcttgaattcctaggaatttacattcttataatctctctccttgttatttattattcagtctgtaacatatgcctcctttagttcctttcctccttttccttccatggccatgtttaaatgattatataagttagtagaaagaaaatagaggaaaataatattaaagagatatatattataaaacttaaaaaatatattatatacatttgcaggtacatagaccacaattcccttcataggcctccagagatagatatatttcttccttcccttccctccctccttccctccttccctcccttgattccttatttgaaaaaggagattggttagtgcttaacatgaaatttagatatagatgttgtttaccatattttcttagcaggtaattgagaaatgcatctattttaagcattttctctttgatgacattttcaaaaatagactttgaattttttttgtaggctcttatagaaaaagttgagcatagatactgtatattttgttctagggaaaaactcagaagtactagatatctgaaatccaaggatggagaaattaacaaacaccataacagtcaaaaaatacaagaacttgagctctttccttcaattgcaagcttgggcttgtccttggccttggttgatctgtcccaggtgtggtataggttggctctttccttgactggttcatttctgttccttctctagcagcaggtattagattatggtgtatgaaaagggaatatagtaaatctggagctaaccaatacaagcaatcagaagtcttaattatcagagcatttcttatggttactccccttttagaagaaagtgaataacagacaaactaatattgcagtctttgagaaaaaaaaagagagatgaaagtctatcttaaaagaacctttgtcttagtgagaacatattcggcccagtccaatctcttacaccagggctcaaatttacagggacacagagtttgacaccattccctccataggcctcctatactacactttccaaatatcagtagaatgcctgtggtatagcagctgagtcctggctctagcatatttctgctctgaaatgtggaccatgtcttcctagacagaggttgaaatggtcagctgttgacataaccacttacttctctcaaagtttcatgagtctctttagcaccaatctacacctcaccctgcccctatccctttcccatcatcagttttcttcttccctgactcaggattattacggcaccttctccccaactacaaaaaaaagttggaactctctgtcctactctttctctgagactatgttcagaatggtggtaccagcagagaaggatccttggatctcaaacatcaataagaataacaaaaatattaacgatgaaactccagagtatagtagtgttctctttcttatcctgagttgtggttacccaaatggccaatttattattgttctttaagctgttcatatatatatatatatatatatatttatttatttatttatttatttatttattttggcagagtctcactctgttgcccaggccagagtgcagtggtgaaatcttggcttactgcaacctccacctcccaggttcaagtgattcttatgcctcagcctcccgagtacctgggattacaggtgtgtgccttcacccaactaatttttgtactttttagtagagaaaggatttcaccatgttggccaggctggtcttgaactcctcacctcaggtgatccacctgccttagcctcccaaagttctgggattacaggcgtgagccaccacacccaaactgtacatatacatttttaagtgtattctttgaactatgtatttcacagtaaaaaataaaataatagtaaaaggaatgtcagcattgaaccaacggtgtatattctctggtaacttgtgtctcacattgtggggaacagcaagtgagtcacgctctgtgattctcacttgtagaacaaggaaagccacaaagtgctagacatgagttttaatacctacacccctgttatttactatggagtagtcatcaattgattttcaaagccgtttattaaacattttggtattctcaatcttcagtgcatttcaagaccaagaagaagactacatcattgccatttgctaaattccttaaagggagtaagaactagccaatgattaattggctttggatttctcaaatggattcatagctcatggaaacaagtaccttaccatgtaacagaaagaaccttcaactacttgcctcttgagtggcaacacccaacaatgtcaaagaaaaattcttgactaaaattattgaccacttgagaagggcaaaatgcatatacagagattataaatatatgtgtgaatgtgtgttgtgtgtgacagtgaaaaatggacctcttagtcatacacacgcaagcacgcacaacataaaaatcttttgtcaaaaatgtttaatataacaaaaaagcagttaattttttattttgaagccatgattatggtggtaaccaggacagacctccaaggtatgtagttttttctggatagctgctaatcaggtatgccaggttaaacagtgccttagcgtgttgtctcatatccctgatttttcagtgattgccatgaattaatttacttctaccctaagctaaagtcagaccagaggtctattgctgctctgggctatacatctgtttactcacatttttgataggatagcttgcaaaagttcagaattaaaatttgtttaatatttaagaaaacagtaaggccaatttaaaatatttctaaaaaactgctaaattatggtgaattttcagtcctaaagtgaacagcaaatgataattgattcactattataattgaaaaatgttggtatttcaagcagggtagcccaggggtgaccaccatactctcatgcttttgtttttatatagatggaaaagaactcattctcatttttttaaatgatggtttcatttctcttcttcataaaaataaaacaatataacataaaacaaagcattatcttgtactcagaagaaaaatgaacattttattcttcaaatgctaaatctttcctcatagaaacacaacccaaaaaacaaaaaaaagtaacagatacttcattattcatggaaaatgattctagagtgaaatctactgttggcttctcatccttcttttatgagattaagacttgggagtggaacaactcagcctcagcgcagtatacaccacaaccataatttccctttctttggctcctggcagtgttaaaatcctttaagacctttcctagaaggctctcctgctcaggcagctttagcaatacatctcctactaacctttctgcctgcttccgctcccagcctcctgtctgctggatctctcatatctattacagctgagtcagtcctttcccctcaaatcttccaaagagtaccgtggagggtaattcacttgcataattggctcaagagatgaaaatcttgtatcggcctctcttagccactaatctatccagctgactgcaagcctaattggcagcttgtttagtaatttggctcctaaagtgttgtattgatgttggataaacagccaatggaaggggaggtgacacatgctgcttcccatagaacagctagtgcactccgcctctgtccctatcttgtattcacaaggcatttattagtttgtgatcactctttcttcccatactcttttcaccattacttgactagccagctgaggggctgggctattctcattattattaggaacattataacaatgataagttatgatactgtcctctgttctcagcaactaatttagggacatggatttttgattattattattatgaactcaaagaacagcattaagcacagtttaagatgagagaaagtggtaggtgttactattcttcgtctaatattttaattatttcatttactaatatagaaatgcttcactaattcagactagtctataattttatctgcaatattgcagacatacttcatgatacttttgttaattaaaatcagtttaaatagttaagtgcataaatatatgatgcactgacatttaaataacagaaatttaatgtaaaactagtttttttttccttaagggataaaaactttgtaaagaataaaagacatgatctgttactgacatgtttagaggaggaagtgttcttattaacatatgtttttaattaaaccgaaacatatttcttatggaatgcttatgtatcaaacagtatgcattttcaaaaaaaaaaaatcttacaaatagaaaactgttttggccctgaagtcagacaggaatgtttatctgctacaatataatcagaaccatttttggtcttcctactagaaagcatgcctacacaaagcatgtggtatatttgttaggtatctgacattcattatttatactcttcattcaaaaaggaaattttaatggtcctcagagagttgaagtaacttaaccttgaccacacagtgagtaagctaggattcaaactttggttaagcttactccaaaagcctacacacatttctttacctgattcccctgattccctataagaatttttagcagagatgttgtacaaaccactaaaaaaattcattgagtaatatatgaattgcaatattaggttctctcaatttgtatatgaacaatatatcgcactttgtatatggacaatatatcacagacacatttggataacgtagaatacaatgacgtctgtagcccttatacattataaatgcttctgtatccataatttcttttgatcttatcaacctgaaaggggagtattattggccccattttgtagatgtaactgatgtttggagagataattcagctgcccgaagtcaattagctaaagagtaccccagttagaacttgaacttaggacatttgatcccaaatgttaccctttcagccgactgaacactgaacttgcaatattatatcatcaacattttctgatgcatggggagttgccggcaagatggctgaataggaacagctccagtctgcagctcccagcgagatcaatgcagaaggtgggtgatttctgcatttccagctgaggtacctggttcatctcactgggactggttagacagtggatgcagtccacggagggtgagcagaagcagggtggggcggtgcctcacccaggaagtgcaagtggtgagggaactccctcccctaggcaagggtagcctggaggaactgtgccttgaggaacagtgcactccagcccagatactacgctgttcccacgatcttcacaacccgcagaccatgagatccccccgggtgcctacgccaccagggccctgggtttcaagcacaaaactgggcgactgtttgagcagacaccaagctagctgcaggagctttttttcataccccagtggcacctggaatgacagcgagacacaaccattaactcctctggaaagggggttgaagccagggagccaagtggtctagctcagcacatcccacccccatgaagcccaacaagctaagatccacaggcttgaaattctcactgccagcacagtagtctgaagccgacctgggatgctttgaatttggtgggggaaggggcgtccgccattactgaggcttgagtaggcagatttcccctcacagtgtaaacaaagctgctgggagttccaactgggtggagcccaccacagctcagtaaagctgctgtagccagactgcctctctagattcctcctctatgggcagggcatctctgaaagaaatgcagcagccccagtaaggggcttatagataaaaaaccccatctccctgggacagagcacctgcgggaaggggtggctgtgggcacagcttcagcagacttaaacattcctgctggctggctctgaagagagcagcagatctcccagcacagcgcttgagctctgctaacggaaagaatgcctcctcaagtgggtccctgacccccgtgcttcctgactgggagaaaactcccagcaggggtcgacagacacctcatacaggagagctccagctggcatctggcgggtgcccctctgggatgaagcttccagaggaaggaacaggcagtaatctttgctgttctgcagcttctgctagtgacacccaggcaaacagggtctggagtggacctccagtgaactccaggagacctgcagcagagggacctgttagaagaaaaactaacaaacagaaaggaatagcatcaacatcaacaaaaatgacgtctgcacagaaaccccatctgaaggtcaccaacatcaaagaccaaaggtagataaatccacgaagatgaagaaaaaacagcacaaaaaggcagaaaattccaaaaaccagaacgcctcttctcctctaaaggatcacaactccttgccagcaagggaacaaaactggagaatgagtttgaggaattgacagaagtaggcttcagaaggtgggtaataacaaactcctacaagctaaaggagcatgttctaatgcagtgcaagaaagctaaccaccttgaaaaaaggtaactagaataaccagtttagagaagaacataaataacctgatgaaactgaaaaacacagcatgagaacttcctgaagcatgcacaagtatcaatagctaaattgatcaagcggaagaaaatatatcagagattgaagatcatctaaatgaaataaagcatgaagacaagattagagaaaaaagaatgaaaaggaatgaacaaacctccaagaaatatgggaccatgtgaaaagaccaaacctacggttgataggtgtatctgaaagtgatggggagaatggaaccaagttggaaaatactcttcaggatattatccaggagaacttccccaacctagtaagacaggccaacacctgtcttctcgctgccagattcataacgcaagttcttagagacctacaaagagacttagacttccacacaataatagtgggagatttaacactctgctgccaatattagacagagcaacgagacagaaaattaacaaggatattcaggatttgaactcagctctggtccaagcagacctaatagacatctacagaactctccactgcaaatcaacagaatgtacactcttctcagcaccaaatcgcacttattctaaaattgaccacgtaattggaagtacaacactcctcagcaaatgcaaaagaacggaaatcataacagtctctcagaccacagtgcaatcagactagaactcaggattaagaaactcactcaaaaccactcaactccatggaaactgaacaacctgctcctgaatgactactgggaaaataacgaaattaaagcagaaataaataagttatttgaaaccaatgagaacaaagacacaacgtgccagaatctctgggacacagctaaagcagtgtttagagggaaattgatagcactaaatgcccaaaggagaaagtgggaaagatctaaaatcaacaccctaacatcacaattgaaagaactagagaagcaagggcaaacaaattcaaaagatagcagaagacaagaaataattaagattacagcagaactgaaggagagagagatacgaaaaacccttcaaaaaaatcagtgaatccaggagctggttgtttgaaaacattaacaaaatagactgctagtcagactaatgaagaagaaaagagaaaagaatcaaatagacacaataaaaaatgataaaggggatatcaccactgatcccacagatatacaaaataccatcagagaatagtataaacacctctacgcaaataaactagaaaatctagaagaaatggataaattcctggacacatacaccctcccaagactaaagcaggaagaagtcgaatccctgaatagactaataacaagttctgacattgaggcagcaattaatagcctaccaaccaaaataagcccaggaccagatggattcacagtcaaattctaccagaggtacaaagaggagctggtaccattccttctgaaactattccaaaggatagaaaaagagggactcctcccagactcattttatgaggccaggatcatcctgataccaaaacttggcagagacacaacaacaaaaaatttcaggctaatatccctgatgaacatcgatgtgaaaatcctcaataaaatactggcaaaccaaatccagcagcacatcaaaaagtttatccaacatgatcaagtcggcttcatccctgggatgcaaggctggttcaacatactcaaatcaataaacgtaatacatcacataaacagaaccaatgacaaaaaccacgtgattatttcaacagacacagaaaagcctttgataaaattcaatacccctacatactaaaaactctcaataaactaggtattgatgaaatgtatcttaaaataatcagagctatttatgacaaacccacagccaatatcatactgaatgggcaaaagctggaagcattccctttgaaaactggcaaaagacaaggatgccctctctcaccactcctattcaacatagtagtggaagttctggccagggaaatcaggcaagagaaagaaataagggtattcaaataggaagagaggaagtcaaattgtctctgtttgcagatgacatgattgcatatttagaaaaccccattgtctcagcccaaaatctccttaagctgataagaaacttcagcaaagtctcaggatacaaaatcaatgtgcaaaaatcacaagcattcctatacaccaataacaaacggagagccaaatcatgagtgaactcccattcacaattgctacaaagagaataaaatacttaggaatacaacttaaaagggatgtgaaggacctcttcaaggagaaatacaaaccactgctcaaggaaataagagaggacacaaacaaatggaaaaacattccatgctcatggataggaagaatcaatattgtgaaaatggccacgctgcccaagtaatttacagattcaatgctatccccatcaagctaacattgactttcttcacagaattggaaaaaactactttaaagttcatacgaaaccaaaaaaagcccacatatccaagacaatcctaagcaaaaagaacaaagctggaggcatcacgctacctgacttcaaactagactgcaaggctacagtaaccaaaacagcatggtactggtactaacacagatatatagaccaatggaacagaacagaggcctcagaaataacgccacacatctacaaccatctgatctttgacaaacctgagaaaaacaagcaatggggaaaggattccctatttaataaatggtgttgggaaaactggctagccatatgcagaaaactgaaactggaccccttccttacatcttatacaaaaattaagatggattaagagttaaacgtaacatctaaaaccataaaaaccttagaagaaaacctaggcaataccattcaggacaaaggcatgggcaaagacttcatgactaaaacaccaaaagcaacagcaacaaaagccaaaattgacaaatgggatctaattaaataaagagcttttgcacagcaaaagaaactatcatcagagtgaacaggcaacctatgggagaaaatttttgcaatttatccattgacaaagggctaataaccagaatctacaaagaacttaaacaaatttacaagaaaaagtcaaacaaccccatcaaaaagtgggcaaaggatatgaacagacacttctcaaaagaagacatttatgtggccaacaaatatgaaaaaaagctcatcatcactggtcattagagaaatgcaaatcaaaatcacaatgagacaccatcccatgccggttagaatgctgagcattaaaaagtcaggaaacaacagatgctggagaggatgtggagaaataggaacacttttacattgttggtgggagtgcaaattagttcaaccattgtggaagacagtgtggcaattcttcaaggatctagaaccagaaataccatttgacccagcaatctcattactgggtatatatccaaaggaatataaatcattctactataaagacacatgcacatgtatgtttattacagctctgttcacaatagcaaagacttggaaccaacccaaatgcccatcaatgataggctggataaagaaaatgtggcacatatgcaccatggaatactatgcagccataaaaaggatgagttcatgtcctttgcagggacttgaatggagctggaaaccatcattctcagcaaactaacacaggaaaagaaaaccaagcaccatatgttctcactcataagtgggagttgaacaatgagaacacatggacacagggaggggaccatcacatactggggcctcttgtggggtggagggctagggaagggatagcattaggagaaatacataatgtagatgacaggttgatgggtacagcacaccaccatggtatgtgtatacctatgtaacaagcctgcacgttctgcacatgtatgccagaacttaaagtataagaaaagaaaaacaaaaacaaaaaacattttctattacatcatttcttttgccatatttccccaactgattaaggttttattctattcacagatttctaactcctggtaaaagtataaatctaaacaagcatagcaaatctgagtaaagagagtattctaactcctgaaatacctcaagattcattttgtttgttataaatccagctactctagctttctttggctaatatttaaattaaaccttatatttagttgtatttatggtaaaaagcatatactgagttttcttcttttatccattataatccctaaatttaacagatgtagtttctccatttacatttatcatgattactaatatacctagatttatttttactatattatataatgctactagctttgctttttctgtgaatttttatttcttcctttctggaatttattgcttgcttatactatcttgaagactatatgcaatatttctatccttttaagtgatgacctttaaaagtcaacatgcatatcttgtttattctctcacattttacatattattgtccatcttacttttacacatccaaattaatcatctacatggtcactgtcaccatcattattacttttatacagtcaatattaatttagcttttagtacacgctcaacaatttctttgctcaccattacttcctgaatttcattcgtttttaatggattctgttttcttctacaagaggtataaaatttagtagtggtcagtctttatccgaaatgactttatttcatcctcactcttgggtaataatttagctggatatgtaactcaggttcacttggttattttgtcttagcactttggaaatattctctcttacattctcaattgtactgctatttttaagtttgctaccggtacaatttcattcttacgtaggttatattttttctccttggctgctcttaagtcattctccttgtctttggtgttctcaagttttattacaatgtgactttatttatatttaatatttcttgatatagactcgtacttgttcaatatgaaaattcatgttttccttccattctaaaaattcttattttcctgaatattgcaccatcttattctctctactcttccttctgtaagttctattggacataggttgaacttcattgtccttaagtccttcagcctcttttatattttcaatcattttatctctctgtgctgcttttatgtagcatagagatcactcttcagatctcgcctaaaattcagtgtcttttcagctgtatctaatctgtcatataacccattcagtgatttgcacagtttttaagatattttcataataaaataatctcaaatttctactcgattctttaccacatctgtcttttctttgtctacaattatttcctttcttttttgaatatgtttttataactaactttttagttttggtttatgagatcgtcattggtaggtttttatttgtggtgcttctctgaggcctgggttgaaggcctgcacctctagagtggctttgaatgtgcttctgaaaccagtttttatgttaatttttggcttagtgtaatttaaaactagaaactcattgtgagggcagcctcttggtcacaaatcttcagagagttttctatttggagcccaggcagaaacaagattatttatcttccacagtgcctgtgggtaagttttgtttccagtctgcccatttctgatgatggagcttttagaggttctgacttgataaggagacttacgctgggatcccaggcttgactccctgtccacgggggaactaacgaacatgccttaggtttttgagcttgccagtagtgtgagtgagtgtgggggctgctcagggccattttggtcttgaacatttccctttctttcctgtagtctcagctatctttgtaaaaagatggcttcaaattttattcagtgttttcaggtgttcggtagtttaagtgttttctcattatttagtcttttatcaggaaacagcaattcttttctatcttttctatctaacacgtgtgcttactctgtccatcctgtactgaatgataatggaaaactgtttattaagattctactaaaacacaaccgaagagtgggctggtggtgtatgtgtcaagaggtgaagaattgcatatatcctaggctttactattcattcagatagagtctggttttaaaattaataacaatccccttggaaaagtctgcctgttttaaaatcttgaaagagctacaataatctacagcagctatatgcacccagggatagcagcaaataaaaatataattattgataagataaatttggacaaataaaatctagtaccttgaaaaggagcttggttgcaccacacatttctgattatatttggcatgacttttaattgcaaatgagcctttaaaaagtcttcactcattattattatttacaacctgccttcactgccttaaatattcaagaagattattttcctattgaaatatcagtaggacgtggagaaaaaagttgaaaagtcacaaaaagctgtaatgtaacctcttgccagaactcacatgttcatgaaaaaaactaccctggaacaatatgcatatcaagacattaaacttcaaaaggcatttcacttctatacttaaaatgtatagaaaaaaggctgactccttataataaatattttactatgacattatttcaatagaaagcaaaatagtaataggcaatattaattgtggataacattgaattttcatactgtacagtggacaaaattttttaaaaatatagtagccataatatctcaaaaaaggaacttaaatctttttactattaaatcctcaataagctatgccttctaccaaaaacatggaccacaaccaacattgctaacgcctttttaaaaagtgttaataatattcctcttattttgttcactgcttttcttcacctttacagatgacatttttcaaactataaaatgcattctgctggcaaaccttcttgcttcgatagttctcaattttataatagtaaatctacatcctttgctactgagacatccactaagtttcattatgtgactttgaatgacgcagagaacaagctatacattaaaaaaatcaatatctaaccttatcaatattcattttcctttgtcaatacaaaatacaaaggtgaaagagcagtaaataagctaaagcactgaaataaatttggtgttcctgtcacaattaataaatgttcaaatgacaacactgctggttagtctagcgctttctaaagcgactgaaattatgcttcaaagctattgctaaaagagggtgagaaaaattttcaatacactagcaggtaaacgtaatcaattctgggttattaatttcataggaggctttaaatcttttattaaaagtgttatttattatgaatacaatttatcttcagtcataaattgttatacaaatgcagttttggatttaaagtgcctaattatagttttctgacaattttttggtaaatcctttctaaactcgctgtttgattatataatatttcacatataaatcagaggggattatcaaacaatactcaagctgtcagtcttttaactcttactccctatttcaaataaaagactgttatcatctgcatttttcttgtttagagttaatgctgactaaaggcaaaagaaactacgaaaatatatctcaactcaatgtgtttttcaggagttctgcaagggcctataaaagggcaagaatattgtccttagctaaaaatcagaagtttacaaatataactaactctttattatgtgactgactctttttcagaatttgaaaactgtaattttcagagacaagatgatctaggattcatgccctcattatcaaagtgtatttatgcaaaaccatttcttacttgaatttggataataatcttcaccttagagttgattcattggtattaaaagatattctatttaaaactgaggactttaagataacctcaatctcttcctcttagagacaaacagttatgcatagattttaaaaatgcctcgaaaataagtgatgcaattctcctgctccactactttttgagtaattaaaagtgcattaaatttctatgaattttatcttctaagtaaaaatgtagtaataccaacatcctgaatattaagaaaatcacaattttgaaatataaaatctggtatatgctggtgtaagcttatataaaaaaaactgttttaggctaaagttcaatgtttgtacccatatgccatataaatgatttcttctgatgttactgagttgtaacgtcaaaatcgccttgcagaaataattatattatccgctcctcaaccattatgcattttccttctcatttcacatatgttcggagtgttaggacgtgaccccagtattttcttttccttattgctgccactaaggtgctttagtagaattcctaagattgttcttgtactgtttctgccgctaatggttgaatcaatgaaagataagaaaattcagggaccattcaactggaatgcagatgttaaagaatcctatacctgccttatgaaagatctgaattgcaagactgatgacatgtgtttcatccaaaatgtggctacatgttcctgtatgaagagatatattagaaatatttcatgaatattcgcatttctacatagtaatagttagataaatcttctataaaacttaaggcatatagtagtgcgtttaagtcagcatatgcaataggacaatctttatatatatgtaatgtgcatataaagaaaatatatatattcttacaaagaggctgtaagtacattgctatggaaagagcatggatttaggtgttatgcagacctaggcttgaaaccttcccttgcgttcaataattctgtcatcttaggtagctaacctaacacttctttgcatcttcattttatgatctgtaaggtgatgataacaccatctccctcatacagttgttataaagataaaataataaagtttctggtacacagtaggtactcaacaagtggcaaatattattctatacaaatacaaacgcactctacacacaggtgtttcctaatcttgaaaattcaatacagccagaagatgatcaggtatgcatctaaatgcataattttataatctagtcccttatatggaacaactgcattagaagtgctccaattttaagttattcttcaattttctagtgctttactatggaataggttccctaatagagaacgtggctgggtgcggtggctcacgagccacctgtaatcccagcactctgtgaggccgaggtgggcggatcacctgaggtcaggagttcaagaccagcctggccaacatggtgaaaccccatctctactaaaaatacaaaaattagctgggcatggtggtgggcgcccataatcccaaccacttgggaggctgaggcaggagaatcgcttgaaccctggaggtggaggttgcagcgagccaagatcacactgctgcattccagcctgggtgacaagggtgaaactctgtctcagaaaaaaaaaaaaaaaaatagagaatgtaagtttcacatcttttttttcctcttaaactcaccatgctaccccacccccataaaaccatgcatatacttacatatatttttctttttactgtttactctcctgttgataggaatcttattttcatagtctataattaaaatcacttttcctataaaggctgcccaaatgaagctaagagaaaatttctaaatgtgtatggttaaagatcccagacaataggtcaaggctattattctttgtatctacactgaaaaacattttctcatacagcttgctgcatcacaaatccattatggctaacggctgtttatttatatgttggtgtctacattttaatgtccacttggcttcctcctatcactgactttatctgtgcctcccttaccactgctcttgcatgagactttcaatacatactattttattcacaaccttcactacaaggcgagtctttgccctttcagtaaggcaggcttcctgtcctctccgatctacagtgacttccctctgatcagtacttgtagtcttctcaataccacgctcattattagaatggcatattattagaacgacatgatttttgaggtagaaatgagagctttcgcaatctagtactaatgttgtctaaagaaggaatgaggaatctaagactgctacagaactgggactagaaaccagactgccacatttgctcagtcaggtgtccatctcctaccacatggggtcttgtgttttggggctgcggctatactttttgaatttattactattaatctcttctggggttatttgtcatttcatctatttatgccttattttcccaacaagactgtaaatttatagaggccaaagatatagcctttgaagtttttgtatccttttaataccttacacgaaatcttgcatttgggcagggatgtaacatatacgttaacctggaagatctacacatggaacatgtaatacaccctgataccacatgcaaatgatttgttttcatagtttcttgcaactgtgcttcttcttcattgcaagtgattaagaagtatctacattttattcttcatgatttatgaactctacatttgtgctccactctaaccctgcttttgttttacctgcagtagtaggtccaggcaaaggtgcagcttttcttctccgtttgatatctcccgtgcataaggatcctaaatgcatgcttgtttgcctacgaataattatcagaaaaaactattaacaaagaagaaaaaatgacacataaatacacagcttgtatcatctgaacctaaatcaaaacgttctcaacaaagatggagctgcgtagtaaaatcaccaatcttgtttatatcgaaacataattacatttgttgacaagcgttcagcagctaaatgcgccatcataaattgttactggaatgaataatataaaaggaatgctttttaattttcaaaactggcaatctttctggctcaacataaaatcaagcactgttgcttctgacaggaaaatagctaagattaattatctaaagagatcacaatattgttgctaggttatcaattggttactaatgctttactgtcagaacaacatttattacaggaaaagtatgatcaatttcttttaggatattacgcagcagtgaattctcttaaaacattttaaatagaaggaaatagtgatgcttcccttataatttatatgattagaattcttcagttaattatttattagctgagtgagaaaacataatttgaatgcattaatgctggtctactgctatttaacattctaacatgatactggattatatttgtaaaaacatgatatataaaaaccgagaagtggaccttctgctatttttggaaccagttactatataattagattcttctgtctaattttggtctcctaaattgaaaagttatataaaaaaataagaaatgggccagttagaaatcaagacgaatacaaaaaagaaagcatttaaagtcttcaaacttttcaagctatagaaagattctgtgttcatttcctgcatcataatccttgatgcagggttgggatagggcctggggaacatgaagcagaaataaatgaaagcatgtttatgacaacccatgttcttttagtaagacagagagatatctgacagtatcttgaggttttaaagaaactaatttgagaacaaacagattattaggaagaaaaaaagggaaaaattaactaaaatttattcaggtaaaattcaaaattcaaggtatatatttaaacacatatactcatatggttaaatataatgaaaaattagtgctggagagtacagttatttcaaatatagattttatttataaagcacaaagtacagtcataattaatgatctgagtaatctaagggccacatgcagtcaaaaaaatacaccacaaaaccttatcaacatatcttaacagtaaatgagcatttgtctagttttcttttacctttttattgagcgcatactgtttctgttacaaaataattataattattaaaatatttcaaaaaacctttcaaaaattcattctgttaatgactaacttagctctgcttggctctccaaaagttcattaacatgcatgactataacatttttattggattttgaggtatggtcttggctcatgatgccaagaaaaatgaatagttatgactgtgtctactttttaagattatatatacatttttaaaaagtagaatgatgtcacagagaagacatactctttttgtacaaatttaaagttattcctttacttattcagcaaacatttatcagtatctattatggacttagcataagactccagtggtggtgaaaatggggagggggaaaagagaagatgggagatacaaaggaaatgaaactttcagttctcattattggaagaatttaaagtcagagtggcgaaagaaaacataaatatgtgtatatgaaatcattaggtacagtggtagtggcggcaggcataaccaactttattaacgactagtgaagactgtattatttagtccttacaacaatcctaaatatgctgcatcaaatatacattttttccttggtaggataaaatttgtgcttccatggaaaaactatgctttcaggagtataccctttcagtcattgaatgctaattctatggaatctattttacaactctaccttgtagctaaccgaaagcaatgggaaatacttcttaactacagaaacacaaataaattctgtcctgtggaatgacaaccttcctttctgtggaaaagctagttttgggtccatttaaaccatcatttcaatactcctttactccatatacacttgagcttctttgacttctcctttcaactggttataacatctgcccagttccctcattagctaatgagttaaataaaatctttaacacatacccactttatatccatatgagagtcataatattacctttttgtaaaaaagtatcctttcacatatcttatccctattgaaatctccccttagcaaaagactggagcaaagtttaccttctgtagagcatataccagacaggctcagatatcagaaatagctgaagaggaggggaaggtaccattctgaaaacagggaataaagtgggaatctgaattctgcagtgcgggtcttctgtaatcaagctgtgaaaaccaactcatgaactagctacttctgatcctctgttaaaacataataaacattcttacagtttaagccactgcaggtcaggttttctatacttgctgaacgaatttctgagtgataaagagtttgctctgttcagggagttatgagtagttcaggatgcctgcagagcagtgttggcagaagggactgtataacacgaatggaaaagagcactgcggctggaccatggggccatacatgccacctttgtcccatgaagatgtttggacttaacagcgatgtggagtcattaaagtagaccagatgcatggatgctggtagagagctcgagttggacacggttgagactgaagagggaggagaccaactaggtttgccatagttcagacactcacttcctcatctcagttataataactaaagaatgatgcaagttactgcacaatgaaacttcttggttgtacaaatattaaatatcaataaaaattttaaaagaattaaggctggttttattgatttcagatacttttaaagctcaaactaagctaaaacaattattagccagggcacgtttcttaagaaacacatttttagaaataatcagaagaaatacttgagtgcctgatattagatgctcactgtgactattaataccattggtttctatttactttgtttttgcactagttatatgtaattggagtattctaattgcttaaaaataactctcccaagtcaatattgcctttataactattttttcatacttcttaaaatttattatgtaggcctatttacaaagatagtgaaaaacaaacttcaggaacaaccaactccctcttctaaacctttttttttccatctgctgggccaaacattttgggtatcttcacagagcaaatgaaatataacattttcattcaactcccttccccgacccccaacatagctacataaagaaaaagagaaaaatgttcaaggagaataaagttaataaactcagcaacaccaaacctgaagacctgagccataagaaaaacagctagctgtatatttcagtaattctatcaagaattgactgtctgctacacagcattgagagatctggattattgatccataagatcaccccatttaggcttgccccacaccccccttctttcagacaggtgcagtggagttgctacaaatgacactaagtaaggtctactctgttatttagttgtcactcttcatgtaaacaatagcagttattttttaatttaaaatcaatgaatgtctcaaaggcagccttgtttcttcagtctaaatgagtcatttgtctttgcaaagcagaacatttggaatactactcaaggtgatggtcggcattttctgtttctttcttctgcagtgttttgagaatgacaatgcaacgtcctaggaacagacccaaagttattaaagaacaatattaagatccttttgtaaggtgtatcagaaaaacaccaatcaactagatatgtgttttagttgggatatttgcatggggaggaagagaagggagacaaatcaaaaccaacctattctgaagtggaaaggataaagaaatggtgcatttttgttacgggtctgtcacttacgatttgaaacatggtttcccaagtattacttctgaaaattttcctattaaatattagaaaagcagaactcaaaaagaagtctttttgttttattttgctttttaaaccaacttcacttggtttattcccatcgttggctgcaggctatcttttaaatggggtggtggcaggaagctggacatcttatctggagggaaaaaagtagaaacaaaacaaaacaacaacccaataaactcaaaacaaaaaacagaaacaaaaactctactgagaaccaccttgcctgaaaacctggcttttgacacgggctgacaaggaccgaagcaggcagtgtcagacgcaataatagtaaagagaagacaagaggaacttgtctcttcattgcatgcaattacaaacagaggctgttcagagaattaggcctagttaaagctgccccctggataaaatgtgttcccaagcagcctcggacaagctgcaaaacagacaaacagacgtgactatgggccctggcatttggcaagaacactcactgtcagttagaaaaatatcagcctggacagggcatcagctgcacagaaataaagcaggtctgtggtgtcactggaggagcattccaatggcagagataaggatgggggttgggaaacccagccccatgtgaacttccttttctagatccaaattaccctccccgctttacttggtgtcaatatgtctcaacgtattaaactgaacagacagacatcagtatctagctttttttcctttagtacccaaacgcacaatacaataagtatcaagcactttcaagtataaatgttttataacgactagaatgattgaattaaatccttgtttttctggcctggtgcggtggctcacgcctgtaatcccagcaccttgggaggctgaggtgggcggatcacgaggtctggaaatcgagaccatcctggctaacacggtgaaaccccgtttctactaaaaatacaaaaaattagccgggcgtggtggtgggcgcctgtagtcccagctactcgggaggctgaggcaggagaatggcgtgaacccggaaggcagagcttgcagtgagtcgagatcgcgccactgcactccagcctgggcgacagagcgagactctgtctcaaaaaaaaaaaaaaaaaaaaaacctttcctttttttttcctcccctttttgagacagagtctcactgtaccccagtttggagtgcagtggcgctgctcactgtgacttctgcctcttgagttcaagtgattctcatacctcagcaccacgcccaccctcccggcccccacgggtagctgggactacaggtgcacaccactatgccctctaattttcatatttttactagagacgggggtttcaccttattggccaggctggtctcaaactcctgacctcaagcgatccgcccacctctgcctcccaaagtgctgggattacaggccactgcaccccaccaaatccttgtttttaatggtggtgttttctttcaaagcagctttttgtgcatgatctctttggacattcatagcaaccctttgcatttggtatcgtggatcacagcctgaccagttcttggctctggtcttctctcttgatggctttggtcatttgactacacattctgcctcaaacctgatcttagcaagaggtggtttaagttttagctcagtgcactgaagttagtacttgggtttcagtaattggatccaagctttattctagacttaccctaccttaccacaaaccttgtagtaacttagttctttcagaactcggtaattgccttgacctcctagatgctcaattcctggccatgaaatggaatctggtgatggaggctctttctaatgctgcctgcctacccttctccaagcatcagctgcccctggctcctatccctgttcactgcctacctgttggcaactcttgactctatgttgattaaccttccaccacatgtagtctgaggctctaccccttagatagaatgatctgcctgccactgtgtagttcctctcactgcttcagatggatctgtcctgttagtgcctcttccactctagtcagagggttcgagtccaaacttccttcttcccagtctgctttatcctgctacaggtaattggtggcctcttctggagctactgtttattgtgtttcctatgtgcctagtgtgagtgagccactgatatggacaggagacagggaaacactaggtagaagatggcagtaccccagcaaaggtcccaccctcaagcctggaaacctatggtcctaaatgagaataggcattcctgtttttgcgcccaaaagttgcctttggactgccacacctccctatcctgtacccatataaaccccaggccccaggctccagcagcagacaaggagaagacagacaaaagagcagaagcacagcagaatggtgtggcagagagaagagaaggagcatctgaacgtcaagaagaatttggctggggatagtcagagaggaatttggctgctggacggccaaattccaggggaagaccatcttcccactccgtccccttcccagctccccatccatctcactgaaagccatctccaccactcaataaaagcccggcatttaccatcctcaagtccctgtgtgaccgaattcttcctgggtgctggacaaggacctgggtaccaagagggcactgagctggttaacacttaagctgtctgtggatggcaaagctaaaagagtgcactgtaacacacaccatgcccacttgggctttgggagtcacaagtacccacccctagatgctactgtggggccagagccccaaagtgctcacccctggctcctgtatctgtccatctgggtgttccacctcctgttaggggtttgagggcacacagtggaccaacagacaagccacacccctgtcacacctcctgcgaggggtgacagggaacactcccgttttagcaccactgtgtcagaaggcttctgaaggagctcaagggcctcatttcattcctgctgccaccctgctagtgaaggactctcctgactcctcaaagcagtgtcagcagggctgaaatgtagtgtgcaaggaggtgagatgcaggggacaaggtgggagccttcagaagagccagaaacttactgaaattatgtgcaaaatacaggtatgcatacttttctagcaagaggatgcatgaattttatctgattctgaatgattaacagagagggttacccaaaaaaatagactcagtagttttaaagcaaactattcataacctaaaatagaaaatacttgtcttaaaatatcattggaatatttaaaaatatgccacatatataggtcaccttttaaaatcacaatatcaaaaaacacagaataggtgtgtgcgctaaactaaaatatccaaatcaatgaatatgcataggcctgggttgaaaggcatggaagactgtgcaacaaaatactgatgataatgatttgtgtgtgatggcattttgtgggaattttcttctttacccttctcattattaatattttttcttacattaagcacgcaatgaaagatacaaattataaccagattaattagaaaaaagaaaaacaatggtattgataaatgtaagtggttttggcagctggatgaatttctcaaaggcaaagtcaagcttttcacactggggcagctgtggtgtaaattgaagctttaggttgcattggtttgatttgcatttgggatgagccagagagtcaggacatgttccttcttgtaacaccatgtctgctttctcactagagctttgaaaaagtccgcttatcaatgtttgagaaggctttttatcagcctttggcatgttacttacattctctttgcctcaatttccttaacttcaagaattatgattaaactaatgcttacctcaaaagatttcatttagaaatcatttatgtaaaacattttagcacgtatatattcaataactgttagctattactcttactattattatcatccccaccctacagataaggagcccaggcacaaaaaagttaagtaatttacctagagtcacagatggaaggcactttccatacaatacatgcagaagaatgcttagtgtagggtgtcactaaacacataccaaataaacacatagcagagtaaactcattacatctgaaaattgccattatgctacaataaaggaagaattagggtcatttgaaaaaatcatgtaggcatttttttggtagttaatagaaaggttaactttttcttcattgtccatttctgcttgctttaaatgtgtcataacatacaagaatgaaacactcattttcatttcaaaaactcaattaaaactcacaagagtccttgagaagaaaacccactgatattctgacatcagcctattgctgcagattctctcttggccaccatttggtactttctcttcaaagatgtcttgcttggccgggcgcggtggctcacgcctgtaatcccagcactttgagaggccgaggcgggcggaccacgaagtcaggagatagagaatatcctggctaacacggtgaaaccccgtctctactaaaaacacacaaaaaaattagccaggcgtggtcgcgggcgcctgtagtcccagctactccggaggctgaggcaggagaatggcgtgaacccgggaggcggagcttgcagtgagccgagatcgcgccactgcactcctgcttgggaaacagagcgaaactccgtctcaaaaaaaagatgtcttgcttccttcatatggtatgcttcatgctttatctaaagcctagagggactgctagtccaatgatatcattccttgtgtatgttaagaaatacacgacaccatattcctaaccagctcagttaaatatttcttttgtactgcttcattattccacacaaatgataactgaaaatggtagcggctgttttatgaaattcaggtaattattacaacttctttaccatatgtaaatgaagacattctcacatctgggggaatgttgaatggggtttctaaaaatcgattcgagagacctgctgttatatcttagcttacatcatgccccgtatttttccaggtcctttagattttttttcttaacaactggtactcatcgagaccatatatatgtgctaacattagagcaatgtattctagctactttaagaaattttctgtgtttcctaattctgccctaaaaatttttctgtttcctaattctgcccatgttagagagcctgcttttttccttcagtcctcttagcgccctcaagtctaaacgtctttctcctctttgaactttcctaaccttgctactcttccaagtgtttttctccgtatttccatatcaatctgtgcatgttgctgtcatatcttaccatacagtatatagtatttgcctcaagttgttttaagattagaggagactgtcagctaaatatatatggaaaacaacttgaggcaaagaaccatgtctaattcccagaacctagctttgtttttcatatattaaaagcacaagaaaagcttattgaactaaaatgaataaaaccaccataactatcattgtctcaacatttcaggtggtaatcaatcatgaattttttaaaataataacacttctttcttgaactgttatttaaatttattcaaaaacattcccttaacaattgacaaattttgacaaagtatcagttattcttagatgctaaactaaacagaagggtaagatagctcccaccttcaaggagttcataacctaatgtaggaaatgaacatgaacaataaattactatgcaatgtaataaatccacagggctatactagcagaccacctctttggggaaattgaggaaaattcatttcgcctgaactgaaattggatattgtctctccaagtagaatctgatatttgaggcatcttggagtattcttttattcttcacaccacagtacctaggaaatagtaggcacttactaaactgtttacctcattctcagctataattatgcatttctggaatctgtttatcattgatatttagtgtagagtttcaacaattatgctcattgtaatttgcttaaaaatgatatcttggatctcacataaaaaacctatcaaaatagactacagattcagatgtaatcccacactctctctttgataatgacactattattaaatgtttcctaggatgctatggttgccattcataatatctataataaaattatgagatattcctaatattcctaacttttttgagggaagtccatgcatttactcatttttggatctacttcatctagtgcactatatgatatctggatatgtttgttgaattgaccttttactgtattcttctgtttgatatctcagactctaagccaagctctaagttccgttctgaggtagcatgttaggacagatacgtgctaagtttttttctttcatcagcacaggaaataatagaatttaaagagcaaagtagagaatatatatatttaattttatttttccatttaatacatgttggtttcttaagtattggaatttattatctgaactactacaaacatccaggctcactgagttttaactatataaaaggtattatgccagtaatttttacataatgtaatcctcataaaaacccattacatatctgaggaatctgaagtccagaactgttacttgtcaaagatcccatgaacagaaagttaagttattgtatttgtaacaaagctttcttgactccaaggaactacttttcccccgtaccttactacatcatccaacgtactttattataacctacttaataaacttctgctgaaaacgtaatgtatgccatgccctatgccatcagacaggaaatacattttttaattgagaaataaaaaagatacgatgttcattttctaggggttcaagtctattgatcatgtgggaaaaatgattccaaaccaattttcaaagagaatcctcaaccagcatataagggcattctaggcccctaagtgagagaacacatttgcagaggcacaaaggcattcagatgtgcacgtgacgtgccatagctgtgtcgctctgtaggcaactcagtataactggagttggcacatatggagcagtgggaggagatgacacctctctgcacacatcaagttttagtaaattctataaatctgtctattcacaattattgaaaattccccttaagaaacttatttaatttatgcagtttattaatcatactgacaaattgaattcaatggaaaaagtccgctccataattctctatagacacaattctggaagttgctctcaggcagagatggagtcaaatgtggatccatttccaagctaactcttgaagttgagagtccccactcattcaagagagtctacaatttacttgcataattgatttggcaaatacaggctgaagactgaattcagctttgattttctgcaacgtgtcccatgactttgcttgtcgtgcaaagtaatatggtaatgataatgtaacagttctatatgctataatgtacattttctgagtaggactactaaagagcaaagaaaaatgtgcttgctacttttatctccatattgagaagataagactaaatgtcttaatattaggccagaatatcagaaacttttgaaatatataagaagttatttctattttgaaatatgtcagacagtgttaccatgtaaatgcaaacttacttgcatttaggttaaactattgcttattggtggaattcaattggaaacctatgacacagttgaaatgccacctcctttatgcagagtcttctgatacccattgccagaaataatctcttactcatgggagaaaacagtattttctgccttaaactacagctatatatgtacacaaactaatattctagccagactgtatattccttgaaggcagtaaggcccacatctgatttatttctttaagtacattttccttagcagttacatgccttgccatatcaggtatttaataaatagttattgaataaaatttaacaaggcatgtcaaggcttttttaaattagtaatctgttttcatgttaaccagtctttttattgtggttccaatttctttaatatataaatgcttagttacagaacactacaaaacatatttgttccatttcttgggctttagaataaaaatatctgcaaaactaagcttgttaactgaagctagtttttacagtatatgcatgtacttttattctaaaatgtttccctttctacataattttgcatttcactaactgtaactttatgaaaagaatgctttcagaccctcctcctccctgatagtttttggtagatatatgttatatccctaaaacttttacagacttgttagcaaatatttactagactataaaacatactgtaatagctaggtgaggtatcacgaggcttgtgataagtacgtgaacattaatgttcaacaattgggaggaagaggatttcaggattctcctaattcacttcaattgaaataactggaaagttggggagcattaacttatattcaggatagttttgacattaagatctttgaaccaaaggcagtttataattttgttaaattgggtctattacttgctgtatttaagaggtctactgattttaaatgtctatggagaaaaacactaccctacaaaaattaacttcaaatataaactgtcttttcctcttctcatttttacaatgcttttctttagaaaaacatacaagtccctatgttttataaacttcagaaatcaaatgccaaatgattcaacaacgatcaggttagtcatgattgcaaaatgttgtcacttttctttgcacataaatcgatctacatactgtttaagtgactattttagaagaatcaacagttttgactaaaggcaagataacagatttcaggaagcagtcaagtttacttttaaatggcatagaaataagactaaaaaacaaaaaaaagacactgctgtataaattatccaccatttgacctgagaaagctatttaacccttctatttcctcctatgtaaaatggggataataagaatatctacctcatagggtaatactggaaattcaatgagttaaaatacatcattaacactcaatgaatcttagctattatggtgttcgctataaacatgatggggaaatctttttcttcaactaaattcatatattttaaattatctgttttttcatttctcctcacctactcatctactcatcttgtgaggcagaagagcacagcagttaagagtgtggactgtgcagcccaaagagacaaagttcaattcctgctcccttacttaacaacttgggtgaacctgggcaagttagttaatccttttatgcttggcctttctcatgtgtgaaatggagatgatagcagaaccaatctcacagagttgatgtgaagattaaagaaatgtgtgcctcacagtatgcagtcaataaatgttacccataatttcccacaaaggaaatttgtataaaataaactgaatatggcataatttggcatttttgaggcccaatcataagtacaaaagagtaaagaaactctgcggttgagatcatattttattgttacagtacaaattggaaatagaatagatttattagtagctaataaggtctaaatgtattctacaaactaaaatatgaaagtgtcatttatgttaacatggcagaacacagcacaccaaatcatagtttctcaagctgatttcccacaacactttatatctttttcatgcgtcttaaaatctaccgtagagatggtatagtttacttgaggaagtaaaacaagttcattgcagctggtatatcgcattcaaggtaagaagtaattggatatgaggctgaaaaaataagaaaggctagaccaggaaggccttgctagccatgtttaggacttggttttaaggcaatgagaagccattaagaatttttaagtaggccagcaggatgatttatgcctgtaatcccagcactttgggaggctgagatgggaggactgcctgaggccagaagttcaagaccagcctgggcaacatagcaagaacttatcactccaaaaaaaaaaaaaaaaaaaaaaaaaaaaaaaaaggcaggcatagtgatgtgtaccttagtgctagctacttgagaggctcaggcacaaagatagcttgagcccaggagttcaaggtttaattatacataaatagatttgggttccctaaaagtcattctggttatgatgtggagaatggataaagagaacaagggtgagagattgaaaggagtgaaagacagaatccaggtttttctggccagaatgtaagttcctggaatgcagacagaatagcatctgggttccacacatatcacctagcctaatgtcttttatatactcagaataaaaggcacttaatggtgtgtgaaggactgcatgaaacatcattttttttctagtaacagacaataccatcctaaaagaaattaaaccctgaccacttagcactctaataatttatttactcacttaaaaataaacatgctatgtagaagccctgaaatcctagaatttaacaaagaaagtcataattaagagtactctgcgaatatggtggcaatgacactgttgttgaatgtatataataacatgtggcattactgaaaacccctggacaccaatacctagccaacaaggtattccccaaaccctccccttctcatcctcaaacaggtggttggatataaactattggcagctatgagatgccatatcaacacctgggcaggaaaaagagaggaatctgcaaatggccccaagcacaggaaaacctccaaagctctaccactcaatggaaagtacagggagacaagatgaacaaagatgctaaacataggaggtgtactgaaagataccagtttataaatgagtgcaagaggaccaagatgtaatagttctgtggtgttgaattagttggatcatataaattcttgaaattaaaaaattaaagtgatttcccaggataaaaaacccacaccaaggaaaaacagtggaagtagaagcgaactggagcagaacagaggccaaggggaaaaggaaacagacggtcttaataaaaatattgagaggaatacaagaggcagatattggaaaatatgaggccagaattttgattggtttatgaaaacaacagaagagagaggtataaagccatgaaattagaaagctatcctgtctcatgtctccttcttaaaagtacaggaaacctcattcagaacagtgttgcagatacataaataagaacgattattaaaaggaaaaaataaggtccttagagaccgtaagagtactctagatatgcccacaaaaatgaaaactacacctgataattctaaaacaagttaaagcaaattaagaaaatgatagaagatatatgaaaaagtcacaactagagaggttgagaaataaagggactggatagaaggaagatttaaaagaagagatgatagcatttaggaagcaattagaaataaaaggaaaaaaatcatttcagaaattaaactaaaaggaacagaggagtgagccatatgatggagaactagaatatgaaaatacaataaaaatggaaaaggcaaaaaataaaaactttaaaattaaaaaaagaaattaaaaggaaagtgataaattaaaaagtgaattagaaagtgaaattaaaaggaaattaaaagaaagtgatagctacggaagataggcaaagaagatccaatataagtataatacaaatttttaaaacaacaaagtcaaagcaacaaaacaaaacaaatataaaacattataattggagaacatcttgaaatttatttttaaaatgagatggtctgcctgtgtcctcactcaaatctcaacttgaattgtatctcccacaattctcacatgttgtgggagggaccagggggaggtaactgaatcatggggaccagtcttcccatgctattctcataataatgaataagtctcatgagatctgattggtttatcaggggtttctggttttgcttcttcctcattctctcttgccgccaacatgtaagaactgcctttcattcttcaccgtgattgtgagaccttccccagccatgtggaactgtaaatccaattaaatctctttcttcccagtcttgggtatgtcattatcagaagcatgaaaacagactaatatataaaacaataacaactagctactaaaaaaggataacttcatccctgggaaaaatcacctaaaattatcaacattagaatgtagtctagtcaaactcttggcctttaaagaaaaggaaaatgcacattgagcatctaggcaaaaccaagtcacttttatgtctaagaaaatcagactatatcagatatagaaagcaacgttttatacaggcattggagtaacatatttaagatagttaggagaagaaaaacatgagccatggattgcatatctggccaaaatgacctttaaatatacagttcatgcataaactgctaataacaagcaagaactcaggaaatattgtttgaatgagcacttccagaggaaaaaactagagaataaacttcagacaaaaagagtacagaagcattgacttaagattttgtggtaatcattaaaaatatatttacgtatagaactaaaactgaatggactgaactaaaactaaataaaactagaactgaaaaaaaaaaaggaggcagtatagtactaaatggctgtatgtgtcagacaatgtacacacagtataactacctaaaagtggatgaaaatacttgttttttctttctttcttcctttttgtggagaatgggtctttctatatggcccaggcaggtctcaaactcctgggctcaagctatccctctgcctctgcctccctaagtgccgggattacagtcatgagccaccatgcctggctaaaaatggatgacaataaaaagtatataggaaaaataaaataaattccctgactgtcttatagatacgaacaaatgaaaggagggcacatgaggccagctaacttcaatattgctcacagtagggaaccagcagcaaggggcctcaaaaaggaagggagagggcctgaaactgttacacagaggtaataataaacaggtaattattagaaaaaaaagccttcttcaaagtccaatggtataccagactgagaatgagggcaagagaaaggagaaaaagaaaggtaaaggtagtaagagaaggagagagagagagatgtttgcttctcttaaaaacagggaaacaaaagccaatgaaaggatatatctgctgggcgcggtggctcacgcctgtaatcccagcactttgcgaggctgaggcaggcggattgcctgaggtcaggagtttgagaccatcctggccaacatggtgaaatcccgtctctactaaaaatacaaaaattagctacgtgtggtggcacgtgcctgtggtcccagctactcaggaggctgaggcaggagaatcgctttcacgaacctgggaggcggatgttgcagtgagccaagatcatgccactgcactccagcctgggtgacagagtgagactccgtctcaaaagcaaaacaaaacccattttggggaagaaacaaatggagggaaccaggtagaagcgagacttctttgaaaataactgcttgtgaaaatttgattgtggatcccatgagtatttttatattattataaaacaaaattaaatacattaaaaagaaacctgttgctgaaaatgacactaattatacattggtatacctatacttagaaactatttcaagttactttaaaacacaggaaaatgattgcatattcctagcgtacttatagtaagtaccaaataaaaatagaaaaaagaaaaaacactttttagtgattattttactggtagtgatgacagtatggtgattctgagattgctgtctgtgtatggtggggtaaataaaatgagtattccattgtcattgagatgtaatatttttaatatggttggaaaaagattaaaatcaatgacagaaagtataaacaataaagtcttgaatttgaactggaactatcagtatgaatcaatatgatttttctttaaaaaaaaaaatcctaactcatttatctgaaaaggcctagaaacacagacattcctaacatccagactgtggtttctaaacctatttcctattatagtaaaggaatcagcacttcttggagaagtgggtgactcctggtctaagccagaaaaggtccaagaaaagcctagaaaatgtaaacatatcagaaagcaaagactggcagcaaagaaacacacaattaccttaaataatctcccattggccacagatgggacaattttagcatcaattagaattataactaatggacgaaacatatcaaatgtgtttaaatcagtgagttcacctttggaaaatgttaggaaccaattcattttgaaaactggcatataataaggggaaagaatcaagtatttctcttgctttccctacatgatctgtaccttaaagtaatcacatagttggggaggaggaagttttcaacagaagtaactagaacatattaaaagaattaacacagcactattttgcaacccttagtgaataaatctgggcaataatcatcatggcaaataaatcacggaaagagatataagtgagggaagtacacaatatcacctttggaacaatcttgccaaacaaaacaaaacaccaaacctgaatctctaatcagttctctagatgtaaataccaattacaggaaacacagaggacagtggagtatgttaaaagacaccatgtagagaaaatcggcaacattccaatatgtgagaaactttatgggccaaacacctgatgtcttcaaccaaaaaatgtcaaggaatgcacacacaaccacacacacacacacacacacacacacacacacacacacacacacacagagagaaagagaaagagagatagaagagagagctggagaaggggaatttatatatcaaagggaatctgagagattataatgcaataaaacaataaaggaaatgtaaatatcaattgcatatatacatattcatatattaagggattattgttattttttatagatgggataatgatactgagacttttttttttaagaagctgttaccttttagagaaacacactgatgtatttcagtggggatacagatgaaacagggtttgccacacgttgataattatctaagccagttaatagacacaatgagtttatattttgtctgtatttctgtatataaaaaattttctatgataaaatattgttaaaaattgctttcatcatcctgacaatgtaagtgaaaaagcatcttttcaatccttaagattgccagtataagtcattacagctttttcaaggcttcatgaaagagactcttcataatttttaagtgaccaaatttgaaattaaattaagttatccatgaggtctaaatcatggagtctgcatagacccctggactgtaacttgatttaaaaagattacaaaaatctttatctgaggtttattgtccttagaaaggataatagtagtttttattccatctttctaattagtaatttaagcatatgttcagcatttaactctaaatgtttgccttttccccaagctcgaagacagctgtccaagatttgaatgccagaaaacatttaaatatcaacatctgttgaattatgttaatttagtgtaatataattgggcatgagttggaactgatcagaagtatatgaaataaacaaaggtaaattcccaccaatatcttggtatacaaataaatcactaaggaatgatgaaaaacaatttgaaaaacaattatttctacaaaaaaagcaaaggaaaggtactgattataaagaaattgattcttttaaaaacatagttataactcttaagacattatcttgctatttttaaattgttcctgtaattgaaaggaaatgaaaattatctaaaatgagtgatagccaaatatttgatatttgaatatttttattcattattaagtaaaacattctaattatacttatatatgcattaaagttttagattgcagaataattcttgttatattatgagcagtaaatattcaagggttgatgtgatttctgtagacataaagtaatattttaaaattgaaagtattttcagtgtggcagatgaatttaataggttttttcctgaggacggtaaggtacaaatgatcaagcagcagatgttgtttattattttgcagatttaaaatattaatttctacagtgattctcttactaataaattaggactgcttgtttgttttgggaaatattctggcacttacacattggattaacagatccccaaatgtacccataatgaagttataacccaggctgcagtagtgatacaagctgttgtgatatgggcctgcaggtgtatcctaatcatttcctaggagaatcatctctgggagttaaaggttagttctgtgtccatgcccatttaatcacaggaccaatttggagagtgccaactgtgaaacaaacacctgtccttaaggaaatggactttagaccacaaattcatttcagttaagggtcactggaacagctttcacatgctaactgttttccatccttagtgaccatggccaaattcaactgcaatcctagagatgagaggctgttcatactttctggcatttgaaaatatctagttcatctaccagaaaaagagaagacgtaagtaataagagtttcactagttagtagtagtgttttgtttttgttttatttaccacccactgggcatattacttatttctaaatgtcaaattcctttttttctgtgtgggcttttcatataaaactgaaaagcaccctccaaaattctaagtggctgataactaattttatttcatataatgacaatttaaaataaccctctatgatcattagtttaaaatcttggcaaggaagaatttcaggatgccaaaaggacaggaagcatgagaactggcaatgtgagaatagtgtagttttatacaatacaataatttggttatatagagtaaaacagattaattaaatcccttaaaaaccattttatgttgtatatgtggtatgcttccaattattctactctaaggatctctatacttagacgccatttgagctttctttttaattggaatatatatgtaattaaatgcattccaattaaacaaatatagaaagtatacattctaattaaagcaaatatatgaatactttctattcattcatgcgtacataagaatgaataaaaaaaactaagatatttttctatctgaaaggctaaacttcttttacaacgataaaatctaatgctaattttaggtatggaaaggaaaaaatgagaataaactagaaattttacttttaaagttagtttaaaagcagttttaaaccattattttggacatataaatataaatatataaaatataaaatgtcgagtgatagaatttgctttgaaatatgacaaaagagaatttgttttaaaatcctaaatttactaaggtaggatagacaacttaaaccattaaaataaagcatcacttgctattgttgatatacttaattttgttaatacatttctaggaaaagcagcattaaacaaatatagcccatgtcattaagcggtactctaatgaacagttaccctatcctaatttattaacagctgctcaaaaatgtcataattaatagtttcatttatttttggcaaacctgcaaaatgacaaatagttttgtatctgttgcaaattatgtctcctttccaaacaacaaatgacagtatggggaagactgagcaaactgaatccttaaacatctttggatctttagatggtcaaataaagagcagctgtaactctatctgttacatctgcaacaaaatacagtgatctgtatcatataaaaacaaacgtgttctgtattaatgtaaataggaatgttctttctaacttgatggaagagggctgacatgaatgtgatgagatctgttttgtttctctgattaaatctattgtcactttttttttcattttagaagactccttgtagtgctaatcaggcaaaatgacaggaaaaaaagtttctttcttctcactattaatagacaacctaagaaattatgtcacatagaatccatggattatcaaatcatttgacattaagtagataaaaagtgaaaaatataatgtgtttagcaactaagtgaaagtaaattaaagatgtttctaaaagacactttaaaaaattaagtacaatttaataatgtcagcaataaaaatgtttttacttgatttcaaactacatgtcagactactaaataatttggcttttgtgcttcataacagtaaaggacaaaaatcatataagaaaacatggcaaattcaaaccctcctccttcaaaaaaacggtgccatatccgtaagaaaaggctttgaatctaaacaattgaataaagctgccacaaatgatcaagtttgttgcatggattcttacagcaataaagactaatcataagcataaaaatgtgttaaaacagcaagatcttttcaaaaatgacgtatcacttagtattaggcatcgcttagtgcatgttttcaacagactttttttttttttttttttttttgagacagagacttgctctgttgcccaggctggagtgcagtggcctgatctcggctcactgcaagctccgcttcccaggttcacgccattctcccgcctcagcctcccgagtggctgggactacaggcgcccgccaccacgccgggctaatttttttgtgtttttaatagagacggggtttcactgtgttagccaagatggtctcgatctcctgacctcatgatctgctcacctcggcctcctaaagtgctgggattacaggcgtgagccaccgtgcccagtccaacagactttcaatttggaaaagctatattgaactttctggtgctaaccaaaggtttctgacatgagaaacaatgtgacattatttagctgtagctctaaaatgaggtgatagcagtgggaaagctctttctaattttgagaagcataaaattatatttaaatacagaaataccaagaaaaaaagagattgaaaattgcagaaccgttctccacgttttctcacctgtagtgctcaaggataagtggagaaagaatgtacagagagaggaactggctgaaatggctttggcattgtcctagtcccccctagaaacaggatgcccttcaactctttagcacagcaagttctttcaccactaaggtatataacccagggcatgctaactttctggatccctcagctgtggtgcgactgggcatgtgtggaggaaactatcagtcccaggcagctttcctgagccttgggaggctgctcacaatgaatcataaacttctgtcccttactacctatctgtgagtaatcaatctgcttcatataacctgtggcacatgagtgtgttctgccttagtgagataagttggtaactggtgcacagtgaacttgcttaataaatctagacatcactagtatttctgtctaaaaaacacttaggtgcattgcctcaaggtttagttcagtgtgtgtgtgtgtgtgtgtgtgtgtgtgtgtgtgtgtgttcactttagctaataattgattgcatgtaatgaccattcaaaaaccatgcctgttgattactaaatattgaaaatgacaggtaataggtagtttttttaaaaaaataacaactgaatatgcctttatgtatttatttatgaaaagaatttcatgttttcccgaattgtcatcatggtttcaaaggttttgaggtacatgaaaatgacagaatggcacgaacaaaccctgagacatgcataaaatattagatagataagaggcaataaaactaagataaaacttcatagcaggcaaatggacagaaaacactgaagaaatggaagaaaggatgtaaaaaaaaaacccatagacttatcaaacagaagtgtagagggacataatcaacatgatataagcaaggtggaagaacatgagacaggaaacatgtaactctagggactatgatgcaaaatctcaggaaaacacatcaaatgaatatatgaaaataatgtcatgatgacaattcttcacatcactcactatctgacacatctactttacgataaggacacccctcaggaaataaaaatgaaacaacaaactaaaagaaagattataagactaatatcacttgaatcaattagaaaaattaaatccatattaagaatcagtgtgtttctcccttgaaatttgattataggactcattatgcatcctatgtgagaagaataagaatgttatttacaataaacgtatgaatcaatactttattagtagagaatattaatattcagaatatgatgaaatggcatgtaatgatgggcactgcttatggtaactgatgccacaaggggagatagtgaagcatgagaagcaagttaagaaatccacaggaatcctgcccttttaggaaaagagagaagtataggataccttgaatacagtgtccattattgatgaagtagaacttcctcatagaaaggattaaaatagttaaaatgagctatttgtttaaaggaaattataaaggtcacttgtttggtattgttaagatatagaaaggtcaaagagttgggagacaattcttctgcactcataattaagttaaagagcctagatgaaaattaatgtgaatgtggcaaaaaaggagaaatggcataaattggacataaagaaaaccaccacaaaagtgaattacagtaagtggcattggtaaatatgtccccaaatccctttttacagaggtcctgaaaactcccctgaggagttgagggtgagatgtcctacattccaaagactaaagccataactgcatagcactttattcagagcttttgtgaggaatgcctacgttaagggcatgctttagtcacgcacttcaaagtcttggctttgaatcatgaacagcggaccatctatgcatttatctttttttacctgcttggtatattttgggagtaaatgaccctacaatttattgatttaatgcattatagttctcttctctcacctttatgtttttctacaagttgaaaaagggaagtgcagtcactcatccaaaaggggtaagaaaagtcaagatactattaaaaatactaagaaagaaaatggattgaatgagagtaacatagaaaaatgcatataaataaaaaaggtgaataatttttatcttgcatttaacaaaacttgtaacaagaattaaacatgagtagtctttctcttcttacacacgtatttcaccttttcaagttgccctgtgcctaacataactgaaggcttcggagagaagaaaaaaatatgcactcacaaaccaagaaaaagaggatatgaaaggaatgttcaaagaaacaagagaaggctcggcgcggtggctcatgcttgcaatctcagtactttgggactccgaggtgggtggatcatttgaggtcaggagtttgagaccagcctggccaacatggtgaaaccccatctctactaaaaatacaaaaattagctggatgtggtggcagatgcctgtaatcccagttacttgggaggctgaggcaggagaattgcttgagcctgggaggcagaggttgcagcgagccgaaattgtgccactgcactccagcctgggcgacacagcaagactccatctcaaaaaacaaaacaaaacaaacaaacaaaaaattaaagaaacaagaggagatcttggaaatgaaaagagtaagataattttaaatatcattaagttacttggggcagagtgttgagaaaactgcctccaaatcttccaagaaaatactacataaaagaaaagtgtaaaaagttagaggatcatttaagggtgctccaatactgaaaaattaggagcacagagaaaatggcaactactgacaactgaaagacattggagcaatgccttcaaaaccctgaggaaaaaaattttcaaactggaattcaattcccaactaaatcaattaatgtaagataagaataaagacattttgagacatgcaaaattccataaatttaaccatctctgttctcttctgggaaagctgaagaaaaataatgcctttggatccagggcacataaaatcccacacaggggatatatgaaggaaatctcaagcatgatagttaagagagatgccaggacattagatgtgcagcaggtccagaaagcaaacagtccagaacgagcctgaaaaatggagggctccaagagagatgccaccaagaaaactaactgagaggtgtttaacttctgtcaagaggcgtctgatgagtttagggataggcacatagaacaaaaagcaaataagaaacaaaacaatgataaccagaactaaaagtgatatatctgtgaatatctacacagataatcatattaatgaaaacaatggatatttatttggtctggaagaaaagagggaaagaaatccagatatgagtgtgtgtgtgtgtgtgtgtgtgtgtgtgtgtattgttgtgggggacacagcaagaaatcgatatgcacagcacctggggtggagcaagatggcagaatagaagaccaccaattgccaccccctccaggacaccaatgtaacaactatctacacaaagaaagctcattcatagcaaccaaaaatcaggtaaggactcacaatacctggatttaacttcatactgctggaaaaggcactgaagaggcaggaaaaacagtcttgaatcactgatgctgcccctaccctgtcccccagcactggtggtgtagtatgaaagcacgtctatgctctagggtgagggagagcacagcaattgtgaggcactgaacccagtgctgccctgttatagcagaaatcaaaacggaaccaaactcagctgacgcctgcccacggaggaaacatttaaaccagccctagccagaggggaatcaccaatcctagcggtccaaacttgagtttctgcaaacctcgcaaccataagctaaagtactctggggctttaaataaatttgaaaggcagtctatgccacaaagactgcaactcctaggagagtcctagtgctgaactgggcccagagatagttgactgcgggggcatgcaacatactgagacactagcgggggtggttaagggagtgctagcatcactcctctcctaactccaagccgcacaactcataactccaaaagggatccctttcatcttctggaggagatgagagggaagagtggggaggactttgtcttgcatcttggataccagctgagccacagccagataggggaccagtcagagttgtgaggccctcttttcagggcctagctcctggatgacatttctagatacatcctgggccagaagggaacccactgccttgaagggaaggacttggttctgacaggattcatcacttgctaactgaagagcctttgggccctgtataacaagcagcgatacctaggtaccacactgagggccttgggtaagcctctgagacttgctagcttcaagagagactcagcacattcccagctgtgctgactctgtctgcttgagaaaagcagagggaaaagtaaagaggactttgtcttgcaccttaggtaccagcttggccacaggggcacggagcaccaagtgggatcctggggtccctgattccagaacttggttcctgtatggcatttttggacctgtcctgggccagaggggagcccactgccctgaagagtgagtcctaggccaggcagcatccaccacaagctgactgaagaccccttcggccttaagggaacattggcaatagtctggcagtactccccatggcctgtggtaggagtggccatggggtgaggatcctctgcctttggaaaaggaaagagtgggaaggactttctcccctttggggaggaaagagtgggaaggactgcaactactggtgtgagtgccaaatcagtggagtataacagaacaccaggtagacttctaagctttttgattctattccctggctcccagatggcacctctggacctacctggggtcagggagtgtggttacaacaggccttggttgagacctaatgctgtgctggcttcaagtctgaccctcagcccttctggtggtgttcaaggagatgcttgtgtcactctattgctagcttcatgaggctcagaacaagagagaaactatgtatgactgggagaaagtaagggaagagaattagaatctctgcctggtaatccagataattctcccagatcttgtccgagactatcaaggcaatacctctacaagtctgcaagaaccacagtgttactgttcttgggatgccgcctaaagcagatacagcttagattacaatatccaagtcccttttaatatctggaaagcctttgcaagaaagatgggtacaaatgagcccagaatgagaagactacaataaacacctaattcttcactgcccagacacagacaaacacttacaagtatcaagaccatccaggaaaacatgaccccaccacatgaactaaataaggcacgagggaccatcctggagaaacagacagaactcaaaatacctattttgaggaaactcaaagaaattcaagataacacaaagaaggaattcaaaattctattagacaaatttaataaagagattgaaataatgaaaaggaattaagcagaaattctggagtttaaaaatgcaactggcatactgaagaaaggatcagtctttaaaagcagaatagatcaagctgaagaaaaattagtgggttgaagacaggctaaaaatacacagtcagaagagacaaaaggcaaaagaataaaaaacaatgaagcacacctacaggacctagcctcaaaagggcaagtatgagagtaattggccttaaaaagtgggaaatgaaagagataggggtagaaagtgtatttaaagggataacagagaatttcttaaacctagagaaagatatcaatatgtaagtccaagaaggttatagaacactaaacagatttaaccaaaagaaaactacctcaaaacatttaataatcaaactcccaaaggtgaacaataaaataaagaaacctaaaagcagcaagagaaaagaaacaagtaacatacaatggagctccaatacatgtggcagcagacttttcagtggaaatctcataggccaggagagagtgacatgacatatttaaaatgctaaaggaaaaaaaaaacttttactctagaatagtttatctggtcaaaatatccttcaaacatgaaggagaaataaaggctctcccagacaaacaaaacctgagggatttcatcaacaccagacacatcctacaagaaattctaagggagtttttcaatctgaaagaaaaggacattaatgagcaataagaaatcatctaaaggtacaaaattcactggtaatagtaagtacacagaaaaacacagaatattgtaacactgtaattatgatgtctaaactactcaagtagaaagactaaatgatgaatgaataaaaaataataactacaacaatttttcaagacagtacaagaagatataaacagaaataacagaaagttaaaaagtagagaatgaggttgaggcatagtttttaattagttttctttttgctttatgcaaacagtgttgttataatcttaaaataatgtgtcataaaatagtgtttgcaagcctcagtggtaacctctaatcaaaaagcctacaacagatgacacaaaaaataagcaaaaaactaaatcatattaccagagaaaatcaccttcactaaaaggaagacaagaaagaaagaaagaagagaagaccacaaaacaaccagaaaacaaataaaaaatggctggagtaagtccttacttatcaataataaaactgaatgtaaatggactaaactctccagttaatagacagagaatggctgaatggataaaaattcaagagccaatgatctgttgcctacaagaaatacactttacctgtaaagacacatattgaatgaaaataaagaaatggaaaaagatactccatgccaatggaaaccaaaaaagagcaggaatagctatatttatgtgagacaaaatagatttcaagacaaaaactataagaagagaaaaagaagattacgtaatgataaaggggtcaattcagcaagagggtttaacaattttaaatatatatgcaccaacactggaggacccagatatataaagcaaatattattaaagctaaagagagatataggccccaatacaataatagctggagactttggtctgggcaaaaatttcttgagtaataccccatgagcaaaggcaaccaaagcaaaaatggacaaatgggatcacgtcaaattaagaagcttctgtacagcaaagggaacaatcaacaaagtgaggagagaactcagagaatgggagaaaatatttgcaagctacccacctgacaaaggattagtaatcagaaaaataaggagctcaaacaactctacaggaaaaaaaaaatctaataatctgattacaaaatgggcaaaagatttgaatagacatttctcaaaagaagacatacaaatggcaaacaggcatatgaaatggtgcccaacatcactgatcatcggagaagtgcaaatcaaaccacaatgaaatatcatctcaccccagttgaaatggcttatatccaaatgaggtaataacgaattctggcagggatgtggagaaaagggaaccctttaatgttgttggcaggaaagtaaattagtacaaccactatggagaacaatttggaggttcctcaaaaaactaaaaatagagctaccatatgatccagcaatcccactgctgggtatgtacctaaaagaatggaaatcagtgtatcaaagagatacctgcactcccatgtttgttgcagcacagttcacaacagccaagatttggaggcaacctaagtgtccatcaacagatgaataaagaaaatgtacatatacataatggagtagtattcagccattaaaaataatggtattctgtcatttgaaacaatatggatggaactggagttgattatgctaagtgaaataagccaggcacagaaagacaaacatcaaaaccacaatgagatattatcatgttctcacttatttgtgggatctgaaaatcaaaacaattgaactcatggagatagagagtagaagaatgattaccagagactgggaaggggagtgggagggtagcagggaggtggggataattaatgggtacaaaacaaatagaaagaaagaataagacctagtatttgataggacaacaagtgactatagtcaataataatttaactatacattttaaaataacaagtctaactggattattggtaatacaaaggacaaattgttgaggggatggataccccattttccataatgtgattattatgcattgcatgcctgtatcaaaacatctcatgtactccataaatacacatacctactatgtccccacaaaaattaaagtaaaacaaatttttaaaaagtcaataggcaatattaaactgaaaactttaagaaatagcaatataaatatgtaatactagaaatacagaggtcaacagaagacagctaaaacagttgagagtagtttcctttcaagagtgaaattagagaatggtaaagaatagggttggggaccactgtattttgttataagtttatagaacaatttaacattctaaactatgtataaaaatagtgtgatagaaaaattcaacttaacaagtgcctaaggccaggtgcagtggcttatgcctgtaaccccagcactttgggaggctgaggtaagaagattctttgaggccaggagttcaagaccagcctgagcacatagtgagactccatctctacaaaaaataaaaaaattagtgaggcatggtagtggatgcctacagtcccagctaatcagaaggctgaggcagaaggattgcttgtgcccaggagtttgagactacatatgatgagctatgactgtaccactgcactttagcctgaaagacagagtgagaccctgcctcaaaaagcccaaaaaacaaacaaacaaaaaacaaaacaaaaccaagtgcttaggaaacatacaggaaaaatagaaacaataataatacagtcatcataacagctaacatccacttatttgttattgtttattccttacaacaatgctatgaggtaggtactaccattttctctattttatagataagtaaactgagagagagagagagggtcagtattttgctcaggatcacccagttagtaagtgattaaactggaattggaagtcaggcacctcagttccagggcctacgcacttaatcagtgtactctactccttagatttcattttaaatttattctacaaatattttatgcaacaaacatttattgcctaatagcgccaggcactgtttttggtattggggctacatgagtgagtaaaacaaagaccatgtattcacgaagcttaaaaagaggaaaaatagagacaatagggaagacacataaagcagggagaggggacagggtatgatggtactggtggacagtggaccttacactgagcagagaattgaaggaaatgaggagaaagccatatgggtacttgtagacagagtgttctggcagaggtaacagcaggtgcaaaggccctgagatgtgagtgtggatggtgtgctggagcaaccactaagaggccagtgtgtctggagctcacggtgaataagagttgaagtgggaggagatgaggtcagggaggaagccacaaggggtgagtcacatcacatatagtcttgtaggccaaaaagaaaagacttcagtttttacttggaatgaaagagaaagccactaaagattttatttaaaaaaaaatagtttgaagagttttgacagtttccctatcatcctggtgcctgacatacataaacttcaaatccttaaagtatacaatttgataagttttgacacattcatacacacgtgaaaccatcactataatcaagataatgaacatatctatcatcccaaaagtttctacatgcccatttgtagccctttcctcccacatccccctggtcctcaccccatgtctgggcaacaactgatctgctttctttcactatgtagtagtttatgtttcctagaattttacataaatgtgttatgtgtatcaattcttcattcctttttattggtgactgaattgctttccactgtatggatataccaacattgtttatccatatactctctgtcgaagttttagtatatattggttgtttcctttttgcttttactattatgaataaagatgctacaaatatttgtataccaatcttgttttgtttgtttgtttgtttgagacagtctcattctgtctctgtcgcccaggctagagtgcagtggtacaatcttggctcactgcaacctctgcctcccaggctcaagcaatcctcctaccttggcctcctgagtagatgggactataggcatgcgccaccatgcctgactaatatttttactttttgtagagatggcatctcactatgttgcccaggatggccttgagctttagagctcaagcagtcctcccaccttggcctcccaaagtgttgagattacaggtataagccactgtgcctagaccccccattgctttttttggagacagggtcttgctctatcacccaggctggagtgcagtggtgtggtgtgtacaagtcttttaagtattcacgtggaatgcatagtaggtctatgtttaacattttaggaaacttcaaaactggtttccagaatgtaatatagtacattcattttgttattttagctattctaattgttgtgagtgatacctcattgtggttttactttccattttcctaatgagtaatgatgtttaacatctttgcatatgcaattttccatttacatatcttctttggtgaggtgtccagtcaaacttttccttattgtttaattggattgatttcttattactgagttttcagagttgtttacatattcttgatataaatattttataagatatgtgattgcaaatattttttccaggtctgtggcttttcattttctgaagtgtcatttgaagaacataagttttaaattttcataaattccaatttatcaatttattctttcctggattgtgttctgaagttttatcaaagcaatctttgctgaagccaacatatgttggttacttttaaccaacataccaagtcaatttgactgggtcatgaggtgcctaggcatttggtcaaatattattgtgtctatgtctgtgagggtgtttccagatgagattaacatttgaattggtagactgagtagatttatctcctaaatgtgggtgagcctcttctaatcaattgttttttagaacacaaaaaggatgagtacaaaaaggatgagtaagaggtacctcttcctacctgactactcaggttgaacatcagtttcctgcttttggattggaactaaaaaattggcttttcttgggtctcgagtctgtcgactatcagactagaagttacatcacaggttttcctggttctcaggccctcagactcagactagatctacaccactggttctcctgagtctccagcttgtcagctgaagatcttgggacttctctgtctctataattgtgtgagccaattccttcaaataaatctttctatatataattatttatatatatatatatatatatgatgcacatatacacgtgtgcatatatatgtatacacatacacatgcatatgcacacgtgtatacatatatacacacatatacttatatatacacgtgtatacacatatgaacatatatgtgtatatatgtgtgcatagaggtgatatatgtgcatatgtatataaatacataggaggtataggtatatataggatggatatatatctatatcccatatagatatatatgtatatgtgtatatagatatatatatttacttatatgaactgagtttctctgaagaaccctgcctataaatacaccaaagttgcaaagattttctcctgtgttttcttgaggttttatatgtttaggttttacatttaggtctgttatccatgtgggttaagttttctatgtggtatatacacataaatatatttactatagaaattggctcatgtgattatggaggctgagaagtcccacaatctgtggtctgcaaaatggagaagtaggaaagttggtggagtaattcagctgaaagctagggagtaatggggtaagacttcatctgagtttgtgggcccaagaaacaggagtgctgatgtctgagggcaagagaatatggatctctcagatcaagaggagaaaataaatttgccattcctctgcctttatgttttattcaggcccttaatagattgtatgatgcccatctgcataagagagatctttactcagtctaccgattcaaatgctagtctcttccagaaacacccttacggacaaacccagaaatatttattgagcagctatctgggcatctcttagcccagtcaaattgacacataaaattaaccattacatggtgtacggtgttaggtgtgggttgaatatcttttttttttttttttgcaaatgacaatatacttgatccagtactatttgttgaaaagactgtcaaactttctccactgactttgtaaattggtgaaaatcagttagttgtctgtgcacatgtggctgtatttcttgacctctatttctctctaatgatctgtttttctatcttcatataaatgtagtcaggcatcaattaatgacaaggatacaaacctgatggtgtagcctactacacacctaggctctatggtatagcctattgcttctagggtacaaacctgtactgaatcctgtaggcaactgtaatatggtggtaagtatttgtgtatctaaacataactaaacatgggaaaggtacagtaaaaatatggtattgtaatcttctgggaccactgtcatatatgtgatccgtcactgactgaaatgtccttatgtggtgcatgactgtaccagactgtcttaattaacatagctttataataaagtcttcaaataacgtagtgttagcatttcaactttatttttcttgttgaaagttgtttgggctaagtcctttgcatttccatatgaaatttagaattagcttatccatttctataaaattgcctgctgggattttgatttagatagtatttaatccatagacaatttgaagaaaaccgatcttaagatattgagtcttctgacccatgaacaaggtgtatctctccagttatgcagatcttaagacctaaataaatatctggttcttgattatgtgttctttttcttgcttcatattgttaatatcttcctatatctattttgattaatatttatcatgctaattagaattttgttgactctcttgtgctaacatttctgcttctattggaatctgtaatccaatcgattgtttttcttttgaaaaggctgttcttgtcaaatgtcttttttctttttgttttgttttttgagacagggtcttattctgttgcccacactggagtgcactagcatgatcatggctcactgcagcctcgactgcccagttagtttttaaatgttttatagagacagagtctcactatgttgcactggctggtcttgaactcctgggctcaagtgatcctcccgccttggccttccaaagtgctgggattacaggtgtgagctactctgcctggcctcttcaaacgtcttgtcttagcctatgagttcatcttcctctgagaatattggctagtctgtcaggcaatggcatgtggaaagcaactggggttgtgagccttagagtggagaggctctggcaccggaaaaccacagtcatcacaccccatcccatgaaataacccctttggttaggagaataccttttccctcttctcactcccagagaggagcaggactaattcttcagcactgggttttagaggggctgcagcaaggacatgataatctttcacctagttccatgaagctcctcaaaaacagcactgtgaactactgagtttatttcagaaaacacttagaccagaggtctgagtctttgtgtggggcaggcagcagttctcccaaggcaatggccaatgataaaacagtacagaattgtatttcatattttattctccctgtatttcatattttattttccctcagccaggctggattgcctcctgtctcaagtcaaagccaccctgctttacatacacaagtttaagatagcacctataataccaagggcttcttgaagtttcctatgtattttctctttctaaatttctgctgggttgatcttcagggaggtggcagtaatcctgtagttcagaaacttgattgtaacaggagctgggaccgaatttctaatataaataaacatttaaggcagtagaatttcctccaattaccatctaattgcaatccacatgtcttgatattaatatagttgcttctgacacatgagttgcttggaagagtacttctttttttttttttttttgagtcggagtttcactcttgttgcccaggctggagtgcaatggcccaatcttggctcactgcaacctccgccttccgggttcaggcgattctcctggctcagcttcccaagtagctgggactacaggcaggggccaccaagcccggctaatttttgtatttttggtagaaacagggtttcaccattttggccaggctgatctccaactcctgacctcaggtgtccgcccacctcggcctcccaaagtgctgggattgcaggcatgagccactgcacccggccagaagtgcactttttcactgtaacctatgttttttggagactgagtctcactctgtcgcccaggctgtagtgcagtggcgtgatctaggctcactgcaatctccgactcctgggttcaagtgattctcctgcctcagcctcctgagtagctgggattacaggagcacaccaccacgcctagctaattttgtatttttagtagagacgcggtttcaccatgttggtcaggctggtatcgaactcctgacctcgtgatccacccgccttggcttcccaaagtgttgggattacaggcgtgagccaccgcacccagcctttaactgtaacctttaaaaaaaaaaaatttggtactgatttctaactgaatcacattccagtaaaggaatatattttttatgatccatattcactgaaatttgttgatactagctttatggcctggtaagtgattaattttgtaagtgttgtatgtgtctttgagaagaatgtgtttttactaccagtttggatgcaaggttttatataatattactaatttcagcttgctaattttgtgttacagaaattttccatttataaattttctgggtggcttaagctatcaataatagcagtgttatgatggtgggttagtaagtttctccatgttctcctattgctctttgctttatacattttgaggttatttgagtgcctatacactgaatcttttatcctaaaataatgactttttaaaacttggtaaagttttttttcctaaatcactttggtatgagagctttctttataatgcatctagcatatatcctgttccttctttagttttccacccttccctgtcattatatttcaggtgtgtcttttataaagaacatatactggatatttccagtaagtccaacctaattagttctgcttttaactgacatgtttaatcataaattattttattttattttaatttttaaaaaactattttttttttgagacagggtcttactgtgttgcccaggctgaagtgcagtggcatgatcatggctcactgtaaggtccaactcctgggctcaagtagtcctcctgcctcagcttgctgtgtagctgggactacagacatgcaccgccatagactatttaaaattttttttttttttgtagagacagagtcttgcatgttgcccatggtggtctcaaactccttgtctcaagtaatctcaaagtgctgtggcttaacaggtgtgggcctcttcgagcagccaaccataaatatttcctgtgattactgatctgtgtgtgtgtgtttatgtgtatgattcaattgtctaattttatgctttctatgtatcttattttctcaatgctttttcttttctcttcacttttttttttttttggtagagatggagggtatcactattttgcccaggctggtctcaagctcctggcctcaagcaatcctcctgtttcagccttccaaagtgctggaattaactatttttaaatagttaattaatccatttttaaaaaatggattatttgacgggggcaatattttaattacatttcccccttccactggtttggcaattatatactctctttctattgacttagtagttatttagatattttaccaatgaatacttaatgtagtcttatcaagtatcaaatgcttaactgactaatgaagtagacatcttaaacaattcaaggaccttacattggactttaactataatcgccaaccctgcaaacttaacacgctattgctgtccattattttattttcttttatttattttcttttttgtttgtttgttttgtccattgttttagattgcctttaagtcttacaaattgtcggggcacagtggctcatgcctgtaatcccagcactttgggaggccaaggcaagcagatcacctgaggtcaggagtttgagaccagcctggccaacatagtgaaaccccgtctctactacaaatacaaaattagccgggtgtggcggcacatgcctgtaatcccagctacttgggaggctggggcaggagaattgcttgaacccgagaggcggaggttgcagtgagtggagatcgcaccattgcactccagcctgggcaacaagagagaaactccgtctcaaataaaaaagaattgagaaactccgtctcaaattaaagaaattttttttaaaaagtcctacaaattacattattacaattatcactttatagaagcaatgattatttatataaacattttaatcagtatattggctcgttattcattcttgcatctcagaacttccttgggacttttatgaaatacaccctttaaaacttcttcgcaaaggtctgtaaatattcctcgtttttgaaaatctttattttacttcatctttgtacatgaaagatgggtttccaggtacatagttccaggttgacaatttattttcatgcagcgcaatgaggatgattgcactgtcttctggccttaccgatgctactgagaaatctgatatatcattgtcattcctttgtagataatttgccttttctcttgattcttttaacatttgtctttgcttttggtctactatggtatattattaggtgtggatttcgttttatttatcgtgcatgttattcactgtgctttttgtatctgtatctatggatttataacttttaccaggttggggaattcttagcgaccatctcatcaaatttcatgtttttttcagctgttccattcttttcctcaaggactatgattgattgtatcacagatcttctttgtctcttaagtactccttcagttttccatctccttgaatttttatactatattctggctcattcttcagatgtatctttcctttcactaattatctcttgaacaatcacatttctcatttctaaaaattatatacatttttcacttcttattgattcatttttatggtgttttgttgcttgctcattttatttctataaacatctcatccatagttattttataatctatatcttacaattttaggatctggcaatcttaggagaaaatctcttagtcatttatgttgactatcactgatggtgaattatcccattttgtgtttggtgatttttgattgtctaaattaggtatgctgggtaggatttgcatttgcttctgcagatacccagtgggatctcagttggcattagtctgcatgacatggcactttgaagctgtattttggttacttgggaatgttaaagtcagtggatagcacactagcactgggaagccatgggatgcaatggtggctgctgaggtcagttatctgttcttaagaataaaataaatgtaaatatcagggcagtttttctaatcaacattctgacaagaagggtagccattttcatctaaacaaaaattaagtcttcagaaacaccatttgcacaatttgaaaatatattgtctaaaaaacaaactgggagaaattctttgtattatggaaaaaactaacattggaaaaaatgaacaagattataaaagcactctttaaaagagactactttcttcccagtctttactcatttatatgttattagaatacacatatttctctctcataaggtctaaatgccacttaagtttagggaaagagattaagccaattttttagattaaaaatgaattattagtgtaaatgctgatctaaaattcagtaattaagggagataaatattttattttaaaaattaattattttttacaagtttaaaaaatataaataaaatatctttttattcattgctcgtaatcctaaaatagattccaataaacaatacataaaatattttaaggtgactttttagaaccaaaggcaacctaacaacaattcattacattcttataggcatagaaaaaaagaaaatgaatgaataaaaagcgattttgaattgcttacctgctggctgttctcacagaacaatttttcttgtgtcctctttcagctcgattatctctcagaagctgatgctacacaaagtgttaagacaaagtcatagaaacaaaaatattttcattatattattttgcaagtaggaaaatattctcattcaaagggacactactcatttatttgcacggctttttttttttttttttaactggtttctcttaaagcaaagactgtaagtactactttttctggagttcaatagttcagggagacaagtttttctttttaaaattcattctttattgtcactgttgcaaaattatcagtgagagttagcaatcgagttcttcctggacagctaaactgccctcttagtcagttaagatgtagcctggagatggaagcctagaactcagttctttttttggttcactgcagtagccctggttgaagtaatgcaacctctcttgtcaacggccttcactgttgcattcagctgtgaattttttaaggctttgttacctatgctgacataaagagctaatattattttctctgtacctactggcctaacatggtaaagaaacacgcttaaaacattcttcttcaaagaaattattggcttggaaatatataattagaaaaaaacatatttgattgcctcctcaaaatgccttaccatccacttccctttacacttgctttaccctaactaattggaaagaaaaaaacaaatagtcaatattcttcactatgtgctcactcaaactctagcttatcttatttatgcagaaaatatgattatatgcaagactgggctaaaacgaagttgtacagaatattagcaattaaccccaacaaaaataaaagtcttggaaataataatacaggatagagctgggttctaatcccagctgggccagtaactaaaaagtcactaggttccaataatagctttaccatttacaacctgtgtaactttaggcaaagtacttaacttctctaagccttggtctccacctgtaaaatggaaataacaataatatctacctgtaaagctactgtgagtattaagtaatataaaccatttaaaatattcagtgctataaaactggaacataggaaatgctgagaaataatatggcttaaatgctatgattataattatgatgaaaattaatgggactagctctcagtaggtattatctgaccagtatcaataatttctaatgacgaataactgctttgaactgttcaattacatcacttagaatcaattattagtttacttagctgtccttgagaaggaatagaccttccttagatgatcaagaatatggttaggctcattctttcaggaacgtctgaactaaataagtattcttaaattttctcttaaatatctacttcttttcatcccccttgcaaccatcccagtttagaccaccattttctctgtcctggaaaagtctcccaaatgatctccctgcttccaggcctgcttccttctaatctactctccacactgcagacactatgagctttctaaaattaatctaattatatgactctatggagatcaaactcaaaatcttgtacaaggctttcatgacccttcataatttgattacatctctaaattcataatttattatgcttcctcctaccccaacctaaccttctttcttctaaattatatatcctagccatagtgaagttcttagtttggggtatgtaccatgctgttgctcatctctggccctttgcttgggttatgcaatttgcctatatcttcagggttcatgcactgtgtctggagcattttagtgctcagcaaatatttgctgaatgaatggatgaatgaaataaaggaacaggaagtgagatctggtatctgatatgtagctgaagccatatctcattattactacttatagaaaagagcaaccagttatcttaaatccattaatctgaaagtgtttcaatttagaaacacttcgtaccatgaacactaaattgtttctgaaaataaagaaaattaattactttggcatttctaagtctagtgccttttaaaaaatatatatacaaaccaacatttgtgacacagatagctagaagtaagatgatgaaatctctacctctacattaaattaataataatagttaatagttaattatgttttctaattctaagataaaagacagatacttgaacactattcctgaggcttgtgttacaacagttcaaacaaagaactcaaaatcccaaaccaaatgttatggaaaaaaaaataaaaaatttatagtttagttttgaaaaatgcaattataaggaccaaaataaacattaggttgtatctactaggtttcgatagttctcagagaggccaccaatctggatgaatttaaatgagatagcaccctctctgaacgttgatgttatagctccttttattagatttatattataatgtgttttcttcctcaaatgtatagttttgatgggctttgtacataaaaacaagtcaaacaatggcattacttaatgcaatgcatctatatgtataaaacccatcacaaacttatctcaccttatcagtacaattatacatctggggataccactgcaacttcaaaaggaagctcagataaaactacagagatctctgggtcatgaatcacaagttaatatgtgagcttagatcttttatggggcaaagatgaaaaaattaatctaaggtgttacttgaacaacatgtatttgcatttagaaggctcctggccaggtgcagtggctcacgcctgtaatcccagcactttgggaggccatggcgggcggatcacctgaagtcgggagttcgaaaccagcctggccaacatagcgaaaccttgtctctactaaaaatagaaaaattagccgggcatggtggcaggcgcctgtaattaatcccagctactcagggaggctgaggcatgagaatcgtttgaactcgggagacggaggttgcagtgagccgagattgcgccactgcactccagcctggatgaaaaagtgagactctgtctcaaaaaaaaaagaagactcccaacatatttttttttaaagtcagattatgaattcaaaacaaacaagaatccttgatccctgctctaataagcaagagcagctcaaaagactctgaaaattttttcattcttcttcttgatacatttttttttttctgttcccttggactcctatcagtgtcacaagtgaggttgctttctggattctgactcaataatgtcaactctgatcaaaaacagaacttgtgaatatggtgcgaagtgcttcttaccttccaactttcagattgctggacttaggccaaacgaagatacaatccccttattagtgacctgcagatgtatattaaaaaataactcatataagaattacattaaaatctgtaagtaaaaaacctaggtacaattggaaaaactgctgaattaaaccaggaagaaaagtataccttgtggataatggtttttacatttaaagaaaaggaactaagagtttctgtggctattcatgacatttttcaagattattaaaagtctcacatcccaagaggaaaggcaaagagcagaattctcattccccaccaatcctctctttactacctgattatacataaggcactcaagctcaggagtgcttctattggcagccactgttcaggtaattcctcaaatgtctgcaaaataatttcaagtctcttcacactcaacagtgtcctcaaaattaaaaggggaactaagtaaaaactaaactatgatctgactcactaagatacttcttgtaaactcagtcaaaatgtctcaaggaagaaaagcttcagaattaaagaagacaaaacaaaaaatgatgcttcctatagttgcctctccctctttccttccacccctgaactaactttcacatttctctttcgtggccttcatagtgccttctctatggttttctgaaacatttaccaacatagtataattactgcttacctgctccagactataaccacctcaggggaaaaactatgttgttttttacaaataactcttttaataaaaatagagagtcctcaatagatagtggctggtgagtaagttatttaacaaatgtatagtaaaggcacgatcactatgtatagtaaattgaaatgggacttagcactgaagaatagcaagaaagaagaatcaataagatggagaaaggagtgagagatgggattttaaaagtagggttaatattattgtttctttgtgttaagttggtatgagaaaagcataaggtaatcatgcatgctaattagtcattccttcaacaataaactaaaagattttatacttcatggtcttgcatttcaccacttgcacctgactttagacaacagtttagtctgctatacagttaggtctgagttgaactaagaaattattatcccttatgtaagtagaatgtattgtacatatacatacatgtacaattcattgtcattattcagattccatacacctacttgctaacatttatttgtaacacaaaaaccaatacttcccctgcttttgcagtcatttgcagacatgtgtagccagagtggtaaaaatctgagtagcctctaacacgtttccagctgagctccagccaggtgacacggccttgtttcaagctctcatagtataaacaagtgtatttcttgcagtctgtttaatgctatgagttttttgggttttttgtttgtttgtttgtttgttttgcataattgtgcttctgttggtgacttcgctatttaaaatggccccaagcatagtgctaaagtgctgtctagtgttcctaactgcaagaagacagtgatgggtcttaaagagaaaatatgtgctttagataagcttcattcaggcatgagttataatgctgttggccctgagttcgatgttaatgaatcaacaacagacattaaataaggtatctttaaacagaatcacacacaaaacaaggttatgtattgatcagttgatgaagatgagacctggggctcaaagaaacctaaccctgtatttcccctacaagcaatggttcagtattcattgattcagtgtttgagttgactacatagaacataactaccatatgtaacaagaattaactggatttattaattaataatctacctagtaaggatacagatctgaaatggcacatcaaagtttaagtaaaagctgactcaaaaattggtcaaaaagatttaaaaagataaaaaaaaattggtcaatttcttccctataaggtattagctattaaaggtaatttttaatttcagaataaagcttggctggaagcaaccaggtataccatagtctaaaacctagatttataacattgctttagtacttctcaagttctaaagggtagaaaatgagctttataaaattgtattttcagataaaatatatcctgatgcaacttaatactaaaagcggaatattattgtaagcattgtacatagagggataagaaccatttaggaaagcagaaagtctaatttttgtattgtaaataataagaggaacacatcatagatgtagcttagcttagttcattctgaattcatagaaatagtggcacatagtccattattaatgtgagaagtatctttaaaatgtaactcactctcatggaaaaaagcaagttaaaaaatcatgaaaatggaaggtatttctattaagcttatgtgtgttaaaaaataaagaagggttcaaaatgaagtgtgtagcaccttccttttattagtaaaaggaactctggtatatgcaacagctgtgaacctgctgctcagcccaagaaatcaaacattataatgttaccaattaccattaaagcacaaagtcctctttactacctaagtctctgcctacccctcagaagaaatgattcctgaagatttgaggttgaccactcccctttattttaaaaataacttttatcattcacaataaaagataaaaactttgcaaggatgcaaactctaaaatgtatatgttttaaaacatcacaagtttaagcatgcttccgagaaagaactaatataatcaaggggtaactgctgattttacatgtaaaaataactgtaatgaatgtcaacttctcactgagtcaactaatcattgtgctgccatgtataccagtaagaaatttaaaaaaattcatctagaaatataatgtaaaagtataagaaactcttcctaccttccaaacttcagatacaaatattctcttcctggctgaacttagatttaatacaaattaatttttaagcacatgtactgttttgataccttaactttgtgaaaaataaagatcaatagtgaggtcctacaaatgagtgagtttcagagtctttccatggaggtcacaagtatgactgaagacagtggcagtaaaggaaagaaaactctcatgctgattaaggatcacgcatttatttggtcagtgtatttaatcgttgacataattaacaccttttaaaatgagcggggatttgtattttttctcataaagctgatctactctcctgaagggagacagttaaatacttgaaagaggctgagtaacttccttttggattacaatggtccttacctggtcatgctctgtcctagccccagggctaaaccaatggctgcagaggaaagaaaaaggcagttagagggaacctaactaaaagcacgtgctctcacatgatcgagccgcatgtgctttaagaaatttgtcaccagcaacacagccttaaatatgctttattttaatggatgtttcatgtaattctagacttagaccaattttgacagaactgtaaaagtgctcataacctggtaattttcaatttaataagcaaactgagttagaattacatttccatttaattatgttaacataaactgctgggactgtattcattttatgaatcaattctggttataaaacctacaaatgctatcatttaccacaacttaattatagcatcattacaacacattatgaccctttgattgttggagttataaaaaaaatgttaaaaatacaacaatattacattatctagctatgcccccaggagcaatacacaaagcccttgatatgaattctgcagcatcagctgaggtaccttggacctattccctccacagttataacaacctagattctggctgagaatgaagttcaacaacattaaaaatatagaagtcactgcatcatcaaagccttgccttctcacatagcctagcccagcccattttgcttcagctgcccctgggactcttaataccgatgtatctggcaataccttttccacgggagttgttagcattagctatgcgcccagtcctctggcattattctgcataaaaaaactaactgtaaacatcaaggactaggagattgagagaggtattatggcaaatcaatcactaaaggcccacgatcacagggaatgatactaacattactattaatgctatttatgatttcaacaaccataataccaagtacctctatgtactaagcacgtgacatgttttatttcccatcttcataaaatccttacaaggttaggctcatgttccaaatacagaaatgagggctcaaaatgttagcttacttgcataaggtgtgttttcaccacaccacgctgcagaagggcaaggggctagaaagggtttacatctcctgggacgctccaagacttctttgcattctctagcctctgtggtattaaaaccaggaacaaacagcctctacattaataggccttgtttaggccttaatatagaatttctcaagctcatagatagtgatagtgatgcttctaggcaggtcaaattccaccagtgatgggggaatgtacatttattggtattagtaaataacacctggattaattaccaaattaattaatctttcattgtagttcctctgacagcttgactaagatatttcccctgttttggattgtgccttttttttttttttatttaaagacaaacatttttcttaaacgcattcgcacagtttaaaagaaaaaaactaaaaggattaaaaacagcaatttcttgttccatctatcctgactcctaagctctgttgagagacaccactgtcaactcttttagtcttttcattttgtgtttaatgctatatttctaaagaatatggttataccaatagcttgtaattcattgattttagatgtgaagtactgactttctattgtcagacttagctcttttttaactcccaaccctctatttccaattatagcatctttttgattaatcaattgtaaatacagacattattatgactacatgaatactttctgctactaagcttttctttttgtttctcctaaagttgatatttgtcttgtttttgctattttttctatgtacctgccagccttcttaatttttctaaatacctgccagcctgtctttattacattcttattcttatcactgttagttttcaaatattaaaaaatatctgaaaatatgcccatcccttactcctccctcctcttcagcctccagtgatctcctcccaaagccctctgtctacttggtctcacagctgttgttttctagatctgtcctggaacttccttggctctcactgggtgttcacatcatttctctcctttgctgcacctcttgtttcctgtatcccacagcttctcagttcatttccaccttttgctgaagaactcactcaaatagtgagaatggttgagaagcgtattgtttgagttgattttttcccgcttgtttgttttcttcttcatattcttaagttttcaataggccaacaaaaaatgcttatttttgttgtttggaatgtgatctggatttctttcctctggatgctgttagaagtttttaatttctctagtagtgagcatttttcatttactgtgttgggtgagaccttgcaatctagagatctgggtcctccagtatgagaaaattagtttttgttttttttctctctctggaatgcctaataattaaatgtcagatctcctgagctgatctgttagttcttcttatttttttcctcctaaaatttgtctttttgtttgcctgctaagtgatttatcaatctttacaagaaatatttattttgagataattgtaggtttacgtgcagttggtagagatcctgtgcacctttatcccgtttcccaaaatgataatattttgcaaactatagtgtaacatcacaactaagacactgagactgatacagactagatacagaacaatttattactacaacgatccttcatgttgtccttttatagccatatccatttcactccaaccctcaatctcctacattgaatccctgttaacccactaacccattctctatttttataattttgtcatttaaataatgttacacaaatggtatgatacaggatgtaacctttttagattggcttttaaactcagcaaaattctctgaaaagtcagagaagttgttgcatgtatcaatagtttattccttttaattctgagcagtattccattgcatgggtgaacatagtttgtttaaccattcacctatcggaagacttctgagttatatccaattttgggctattatgaataaagctgctgttaaccttagtgtagaggtttttctatgaacagtgtttttacttcggtgggatcaatgaccaagagtgcaattgctggttagtattgtagttacatgtttagtttcataaaactgccaacattttccagaatggctacaccattttataatctcatcagcaatgtatgagtaatccagtttttccacatcctcattggcattcgatgctgtcactatgttttacttcagccaatctgatagatatgtagtgatatctcattgtggtcctaatttgcatttctctaatagataatgacactaaacatctttttgtgtgcttatttgctatttgtgtatcctccttggtaaaatggatgttcatgttttttgtccattttctaactagattgttttgctttttaactgttttataactattacattttgaaaggtctttatatattctagatactagtcttttgctagatatgtggtttgcaaatattttctctcagtgtgtagcttcttttcattctttcaaaggaaattttccagaacactagtttcaaatattgttgaaaagactattcttcctccattgaacagcttttgcacgtttctcaaaaatccattgactatacttgtgtgtgtgcggggggagctatttttgggggtctctattctgttacattgatttatgtgtctatccctctaccaataccacacagtcctgaatactgtagctatacagtaagtactgaaatctggtaggataattcctacaactttgttctttttaaaaaaattgtttttgtgattcaaattcctttgcttttccatatacattttaaaataatctttgctatatctacaaaaaatcttgctgggattttgataagaattgcattaaacctaattatcaatttggggagaactgacatccttactatgttgaatcttccaacctatgaaccatgaagtctcttcatttttgtagatctcttttgatttctttcgccattttaatctcccattttatttttcatttctttcactttttcttcaaaatgtatgaagaaaatgttcaaatattcaataaagttaacagcatcttagaatgaatacccatataccactatctagattctactattaacattttactctacttggtttataaattatctgtctatggcatcttttgatgagcaggtccttttttcctgtttgttcctctctttatactgaagtctttcctcaaatatctggtgatctttacttatctattcaatatttaaaaagcactacaaaactgatcagaagagctttttcaacaaataagtttacccacaggatgatcatacaagtgtctcctcatggtggaaacttacaggtttactatcttgtctatttttctcatattagtaaatttctgaagaaaagaaagatttactttcttgactgagacatactatttcagttccatgccccaccctatttagaagttttcagattttctagggcctgtgagggacaaatcagcatttatttcatcagactcttaagtttatatttattctacctgcctgtttaggtacaaatctccaagtgctttctagctctagaaattggctgaaatctctaatctgctgaagtgttccttctttgtcattgtgtgtttatatcttttttcttctttctagtggaatttgggtaggaagaataaaaataaatgttcagagcagcaaacaaccaagagacagtggtaccactgaggccatgaagaaacgttttaagaagggagtggtcactggtgttaaatatagagaaatcaagtctgacaggaactgagaaaacacaactggaggggccactggtgaacttttccagagaagtttctaaaaagtgacgtaggaagaaatcaggagtataatatcatggtaggatggagcagaagggactatactgtaatctattctttctagaagtttggctttcaaagtatgagagacagaaaacacattaaagaaaattaaaggggaggttacaaaatgtagtggatgatgaaagaaacttttggaaaggaaaaaaaacctttcaatcaaaagcataggtgttatgaattagccttggacaggagaagagagatcttttcctctaagtctaagaaaaaggggagtgaaagtatatttggataagtttatccaaatttaaatagcagtcttaatgagcctaaagaacacaggtagtgaacataagataaaaaagctgaaagagtattaggttgtggtaagaaaatggtatcataccattcaaaatttcagagctctattagttctgggtgatggttatatataagagtagccaggggagtttctcaagtagcagtcagatgaagaacgttgaattccaggaggaaaaaaaaagtgtgctaagtgccagcatgtactattccatccaactgttggtcaaaggagtacccaacatgcattgagcccttactaaggcaatttaatccttaaactactctagggacagttattattaccattctgcaaataaagaaacaggctcagagagattaagaggtttgccaaagacttcataactaagcagcagagcgggaattcagttaggtctcctgattccaaagcccacgtcccttccaaccattacacatgttgccaccaattaggatagctgaggttgatgcaggaaagaaagactaattcaagcgccaaagtcctgtacgaatgagggcaaataaggaaaggtagatggtagtatgaacctcaaacaacaaaaaaagttttacccaggagtaaaaaaggaataatctgaaagggacaatgatgttgtaggaaaatggtggcctctgtgtcctagggtttataggaatgagaggaggcgaatggcgtcctcctttgggcagcctgttgaactcaccctggcagatttagatgcttccttttccaatcccaatgtctctgccgatatatccactaaagctattatattcgtatattgcagttgattctttatcttaataataaatcagaggtccttgagaaaaggataatgataataacactaacagaaatagtggtagcagctagaaaatgtggtagaagtagtaatcaaagttgcagtaaaagcactatcaccactctataagtgttagttgtgtgctggttatcattctcatggccatacatgaattatctcattcaattcttacaacgattttatgaaatagtcctgtcaccattcaagctcacacagctagcaagtactggaatcagaatttgaattcagtctgtctgattccatatcttgtatttttaaccatatacttccccttcatttccttcaagtactatcatgttttgggggcataatggaagggttggttttctttttcttttctttctttctttttggtgttgccagaatccagcataatacatggaaaataaaagttgcttaataactttttagtgaaaaatgagcaaacaaggaaacacaggaagtagcatccttgaaagtcagagtcaagtttatgcaaaggcagaggaagaaaaaaatgctctgaaagagaatgggtatttatttatgtgtatttacactggagccaaggttccacacgggcttcatggagagactaacagtggtagaaaaatctgggagtagggagcacagaagagtttaaaactgatcaactgtaaagaatggctaggctcagagacacaggcagattgcctgtcctcacaattcataagggttgaatgtggtttccaaattcagttctccccctaggacatagacgcagtttagagaggtctaggaactaagcgtggcatattatttcatttaatcctcaccgcagcactgctgataacaagaatagttatcacctattgagccctcagtacagtgctctttcaagtacagtagagcagttgtggttggtaaccctgtggagtagaaataattttttttttaagaatgactggaaaataaacctttaggaaagaggttttaaaaccaaaatctctgcagatgcagagttccacactaattccttctcactgttccttaattcccccttttctcacccacagtgttgaactacaggtagcagaaatgtataggatttcatgggaagtcaattaatattatatgtagacaaaaggacaaaatcaacctcaagattcttaactgaggtctcctaaaaatgtacttttcagaaggaaagagctattgcaacttataatatggatttttattgttagagataagtttctgtttttggagtcagaggcataatttcattttaacttaatagtggggctaatatatataaaatgatctaaatctgtgctaatatggtagccactagccatctatggttatttaaatttactttattcaattaattaatttatttttatttatttttttgagacagagtcttggtccatcacccaggctggagtgcagtggcacaatcttggctcactgcaacttccacctcctgggttcaagtgattctcctgcctcagcctcccaactggttgggattacaggcatgtgccaccacgccagctaatttttgtatttttgtagagacaaggtttcaccatgttggccaggctggtctcgaactcctgacctcaagtgatcctcccatttcggcttaaatttaaattcatatgaaaaattaagtttcttaattgcaatggctacatttcaagtgctaaaggcatatacggtttcataactaccatactggacagtgaagatacagaacatttccattattgtaaagagttcttctgctgggtaacactggtctaagtggattatcactaaatatatgaattaactttggaaatggtatacagtcttctataccgacagtttccctgtgaactataactactttattgaagagacttgcaagtatgaaaaactatacacgagagaggagggagggggacaaagaagtagaaatatatgccaaactcctaacccaatatactataacagggtttcatagattgagatatggaaataaaaattagggcaagatgacagagtattaagaagccatgtggctaggtaagaacagatcttggtagcagtcataaggaggatgccttttggcctttgggcatcctccttatgattgtcaatgtagaaattgacagggagttcattcataccaagggaacaataaataagcaaaagcaaaccaaaaccttaagtggttttccaaacactcttaggagaaagaatctgtaacatgacctaccagacttggcatcatgtgctccttgccgaaccttctctggtctcatcacataccacatgcttttccttcctatattgtgctcaatatgctttagcataagaatcctttagtttcttgaacacaatacgtattactttctctgcctgaaaagctcttcttgccaccagttcacttagatcctagagagctcattagccgtccccatctcaatgtctagttcaaattcaatttttacaagttcttctttagagtacttagctcagtatataataatgcatttatgtgtcagcatataattatacatttgtgtgtgtgcttactgagtaatctctattacctctatcacactgtgagtaatgtgagaaccacaacaactgtgatcatgtcatcctattcactactgtacacccggcacctagtacaccctcataaatatcttctgaatgaatggacaaatgaatgacttgagatacaggatggagtttcatcaactatggttgctatgctgttctatatgaaggtaaaagaatgagaacactgggctgtgtgatcttttaagattcctttgggttcttatgttctatggactagaagaccaggatgctaacggtattcctcactcaataacatgttgtatgtaacaaaaagtcaactctaaaattatgctcaagaggccctgctaaactttatttcttgtattaaactgctaatgtaaattcaggaagttcagcctgatgtggttactaaatcagaaagacctaagcttggatacaggctctggaacttactggttaggtgaattctgacaaattattttattttctgagtctcagtttcttcctcatgcataaaataaaattaaccactctcagtatttgtaagacttaaaacaacactaataaattggcagatggtgtttaaaataaatattaattttcttcccctaacagtacagtggaatatagtaatatgtaaacttttattccataagttttaacatgcaataattaccttttaatttctaaatgtctataaagaaacaagtgctaaagggcattacttataccctaacaggtttagcatgttaaccaacaattaatagaggcttaatacatttgtctttttaattgacttttggttgagcgatgtgtagtgtgtaactttagaaaagtcaaattatttataaaatggggtctaatacctgctatgactacttgagagaggtagtaaaaatactaaaaacagtggtgcatatgaaaattatctgaaaaaataaaatacagtgtacaatataaagtatgtcatcattatcatcattttgaaatgtttcatacctagtttaataatatttctgtattttacacctaagcaccttgtaaaaatatataagaaaggactgttactgtattatatttattctataaataaacttaagacacgtaagctaaatgactcacccatgggaatcacaataaatcagaggaggaatcgatctgtatttcttatttatctcagtctagagttaaagacactttcactataaagcaatagatgctaaatttcaaagtgtaaaagtattcccaatgaaaataacctttaatccaggcaaatcttgctttaagcaaactcgatatttacacaaaagataaaataaggggtgagtatttgctttataaaggaattcatcataggattataatgagttacccatgtgcatttaaaataagtttgatttacatacaattcctcaggtaaatatcctctacttcaaactgaaataaaagtaaaatatatcaattgcacaatcgattaataaatcatatttatctctatttaaaagcaagtatctcataagtgattggaaaaagaaaggaaaactttctggaaccatgtacagagtacataaatggaggccaaattaataagaagtaactccatttttatgcttacatgtatttttaatgtagtcatatattaattttatttttaacattttaatatttgtagttttaaaaagtcaacagaataattaaaagagaatttcaaaacgtaggttacttttactgagaaattagatactaatttctctagctggattgaggctcttgtcttttttgcatgtagctctctagttatcttagtcagtatttcatttctctgtgctacatatttctgattaaaaaaacctatcatacattaatgattagactttaaatatagtaatatgtttttcaaggaaataattactagatgttatttaagacaattcatacattgttgtgttattttattaaaatgatcgcgtttttataattatgacactctggaaggtttttcagtatctgtcttcaaaaataagactgcagcctggagtggtggcgcacgcccataatcccagcactttgggatgagaaggcgggtggatcacttgaggtcaggagttcaagaccagcctaggtaacatggtgaaacctcatatctactaaaagtacaaaaaagtggctgggggtggtggtgcacgcctctagtcccagctacttaggaggctgaggcacaagaatcacttgaacctgggaggcggaagttgcagtgcaccaagatcgcgccactgcactccagtctggagtgagtcatctggctttttcatcctctaaatataaaagcaacatgtctactgaaataaagtttggtagatactaacatgtacccctacctcacccgctcccagtaaaatacaaaactaacctgcaatcccatcatccagtgatgaccaattttagtgtttatttctggtggtgatttgtcttatatcttctgcgagctagtctctgaactgagcctttctgaacctcaagttctcatctataaaaatcaagtgactagactggacagcacctaaggctcattctagctctagtacttgcttcttctgccaattatcaattgtatttgacaagtattcagttggtgccttctgaatgctttccatcactagccagcagtagaacttgataatcttgaaccgagagcctatgatttgagtgtaacgcattgtgatgtacattgtaagagattcaaagtacaagacaaagtttccaacctcggcaagttcttggtccattaatgggaataaaacatgtattttataattatacaacaaataataatatgataaatactgtaatcaagtaaaaataaaacttaaaggaaaaaataagagagatagagaatgctgatacgaatttgaggggaaacaccaatgattccttaaagtaggttatagcagatactattactgcttcctcaatagctctgaaactgcctccttccagatttctggttctatcagtaaactaaactgctatttgtttaaaccactatttgtagaatattctgttactttttcctgaaagcatgctatacaacagtggtctttaccatttttgaatatgtattgcctgaaatagttatgaaaattcctcatgtaagtttaggaagacatctaatattcttcaacaaaaatttaaacatttgcaaggatttaattttatatcaattataattgattataaattatcaacatgttgataatttaaaataaaaccattatgctactctttgaaatatatacattgggacataaatattattgtgatttgatatcctccaccatttatttaaaacaaaaaccaaaccaggatgcacatttctttaaaagttgaaaattttacatagtttatttttcttcttaaactcctgtttaatatatatttaatatataataatatatcgggtaacagcaaacataaaaaataaaacaacagtaaacacaaaaataaaattttattagaaaggcatcattaatgagctttcccccaaaattagttcattgatgagtacgtcttttagtgccaattctatcaccatcttttaattttatagagtgctcagaaatcttattcatacaaattggtaaatggaaataaaaggaacttggttagagcagtcatttgattatttaaacactttcggagttttgtgcccaaagtcacaaaatgacttctaggttaagaaatatttttaataatctaccagttgctgaaaaaaaagaattagaggccaggtgcagtggctcacatctgtaatcccagcactctgggaagctgaggcgggcaaatcacctgcagtcaggagtttgagaccagcctggccaacatggtgaaaccctgtatccactaaaaaaatacaaaaaaaattatctgggcgtggtggcgcacgcctgtagtcccagttactctggaggctgaggcaggagaatcgtttgaactgggaggcagaggttgcagtgagctgagatcacgccactgcactccagcctgggtgacagagtgagaatccgtgtcaaaagaaaaaataaaataaataaaataaaataaacataaaataaaattagaaactatatacctaaatttgcaaaatgctttatgatgtattcattaaattcaatccctccacatcaataccagcacaatatctgaaatatctctgtttacagcccggaaagattttatactgtgcaccaaagattaggattggtaggggtgtcttttttccctaaggaagaagaaaggcactgggaaaagtaagaaccagcaaaataaccagggctgataattttcaggaaagacatctataaatggaagcaagggatttgaaaattgactcccttaaaactactgctgattctgctagaaattatttgtatatcctgagggtatgaacaccttagtttttctactatgagatgctgaatttgataataagagtcagtttcatgtatctaactcagggagcaggaggaatgaaagaagggtaacaggcagtatagaaccacttattccagctaggaagttggggaagcatataactaaaactctctgcccagagtggatactggccatataccttcttctgttaaaggacctgatgggaaaatttcagatattgggtttttctcctagagcaacaaaagagacaagctgaagtaaaatggagtcagttttaaagcagataggcaggtcagtccctagaagggcatcaacctatgtaacttaactggaagtctgtgtgtgtgtgtgtgtgtgtgtttgtgtctatacagcgttgcctgtatacttatttatttgtgtaaaagaaaattcccatgatgtggtgtcctgtggcttctccttgtcaagagtggggtctgtaagggacctcccccacattggctctacataggtaaggggtgcgcctgaagaaagggatgaaaatacagacttaccaaatgaacctataaaacattatcaaggccaagcatggtggctcatggctgtaatcccagaggtggaagtggaggtggcaggattgcttgaacccaggagttcaagactagcctgggtaacacagtgagaccacatgtctaccaaaaaaagaaaaattagccaggcatggtggcccatgcttgtagtcccagctacctgtggagctgaggccaggggatcacgtaagcctgggaggttgaggctgcagtgagccatgatagtgattgcaccattgcactccagcctgggcagcagagcaagaccctgtctaaaaaaataaataaataaaacaaaatataatctgaattgaattaaagtcttataattagggaatggcattggggaaaccatgtttggaacccctaaatggaaacaggcagtggcatggaagctagatttaacaagcaaaatgactagatcttcctgaatacctctgtgtaggatttctctgacaaagagcatgagcctgctgacaaagatttcctaaagacctatacctacctgctggaggccatggctttgaactgcctcagggcgaagccattaaactaaggagactaagagtagaggaagaacatggaggccagcagcatttgctggcatgaaactgcaacaacaaacacaacagaaaccactatatttttgatgaaatgctagtgctgaaataaacaacttggtcaacaagagtctgtgactgtttagttccttaggcagatgataaaccccttactttcaccaacaagaaatgggctgataaaactgtgcagtaccctgtaaggcatctgctgcaatgaacatatcagctgagatcttcagaggaagaataacaagttaggttctccaagagaggagagagaattgcttgccaaactggatatatgcgttgtggcatgctgagtattaagtatctcatttcctgaatgcgaacttttgttgaaatagcctaccttaggccaggcgcggtggctcacacctgtaatcccagaactttgggaggccaaggtgggcagaaggcctgaggtcaggagttcgagaccagcctagccaacacggggataccccatctctactaaaaatacaaaaattagccaggcgtggtggcacacgcctgtagtcccaagctactcgagaggctgatgcagaagaatcgcttgaacccgggaggcagaggttgcagtgagccgagatcatgacattgcactccagcctgggtgacaagagggagactttgtctcagggaaaaaaaaaaaattagcctaccttctcaacaattctatagtctatgcatcaagcactttgaatgcataggccactataagattatgatatcattttgctatatctgaacaataatctctattttatatttgttaagtagtgattttaaaaaatagaaactaatggatcctaatatgattgcttgccacaaaaaatttattcaataattaattcatgtcttcccatactttatggcctttttaaaagttcaatcaaatttgcaggagatatatggtattgctctaaaatacacaacaagttaagcttttccaacaaagatgtatttacagaacgaattaacccctggaaattcaagcaataatttaccaaagtcaaagctacaactacttagttttaaaaaattatctagtaagtagtctcttccttttgttgcaaaatggaaatatattctggttgtttcatgggtctttatattattaccaaatgcttggcagtagcagaaagtagagaagtaatgaagaaaaccagtcttttttttttttttgagagatgggagtctcaccctgttgcccaggctggaatgcagtggagcgatctcggctcactgtaacctccgcctcccaagttctagtgagtctcccgtctcagctttccaagtagctgggactacaggcatgcgccaccacgaccagctaatttttgtatttttagtagagaccgggtttcacgatatgttggccaggctggtctcgaactcatgacctcagatgatctgcccgccttggcctcccaaagtgctgggattacaactgtgagccaccatgcctggcccccccgcaaaaaaagcaaaacagtcttttactcctttttttttttccttctgcgatggagtctcactctactgcccaggctggagtgcagtggcatgatctcagctcactgcaacctccacctcctgggttcaagcaattctcctgcctcagcctcctgagtagctgggattacaggcatgtgccaccatacctggatactttttgtatttttagtagagatgggtttcgccatgttggccaggctggtctcaaactcctgaactcaggtgatctgcccaccctggcctcccaaagtgctgggattatgggcatgagccaccatgactggcttattactcttcattttagtattttagaagggttgggatagagaataaggatggaggagtacgaaagcttgatgctactcaatgtaatgaaaattttaaatttttaagacaatacataaatttcaataatgcatgaatttcaaatactatcacaaataacagaataactatatttaaaaatccccatttaaattttgtcatggttttcgtttaagttgttcttacattattatcaatggtaaattatacttactctttttaaaaagtacaaattaaataagctttactagtagtagctaataatttcccaaaagagctaagtagaatactccaataaggttatataaacacactgagtactcactcatggtgatgagaatccggggaaaaatgaaccattctcttgttacccactgggccaggaatgggtacctacagggagatttaaaaagaaaaaataaatttcagatttgtttataaaacgaccatggataatagtgatatatcaatttgaagacatcactctaaaatggagaatacaagattttcaaatctcagacaacactgtgtggatcaaaagtataatttaattcctggtaagaatacttcacttgttttggtctagtgtatttcctctgctagatttttttttttttttgacagagtctctttctgtcccacagactggagtgcagcagcgcgatctcggctcactgcaagctccgcctcccaggttcacgccattctcctgtctcagcctccccagtagctgggactacaggcacccgccaccacgcccggctaatttttttgtatttttagtagagacggggtttcactgtgttagccaggatggtctcgatctcctgccctcgtgatctgcctgcctcggcctcccaaagtgttgggattacaggtgtgagccaccgcgcccgactcctctgctagatttttaagactattttaaaagaatcttggccgggcacagtggcttacgcctgtaatcccagtactttgggaggctaaggtcacctgaggtcaggagttcgagaccagcctggacaacacggtgaaaccccatctctattacaaatgcaaaaattagccgggcatggtggcacacgtctgtaatcccagctactcgggaggctgaggccgcagaatcgcttgcacccaggaggcagaggctgcagtggactgcgaggttgtcactgcactccagcctgggtgacagagcaagactctgtctcaaaataatactaaaaaaaaattttaaaaaaaggactctttataatagtgtaaatatcctttaaaaaaaaaaaagaccagtgacttattacataaaaaaaaaagtttaattagatcagtgttaagcagatatttccgaggaccaatgtatttgtagctagatcctaaatataaataacatgtattataacacatacatttaaatatatacaaaaacttagatcaaggaagtggtgagcagcccttttcatagtttccccgaaaagacaggagtcatctgtgtatttacacagtacaaaatgcaatttcatctaagagaaaaatattttcactcctttatttctaaataaaatttaaaatctaaagtaagctactccttttttttttttagaatttcacaactttcttatcatatagatggttctcaaagggaacatagcactgtacaagaatgaatctatcagtcacaaatgacaaggcatacatttacagcaaaaggctttaagttatgttccattttaattttaaaaaaaaaccctctgtaattatagaagtgccatttatatagaatggggggaaaagcatgagacagcaataaaattcctcttaaaaaaaccctaacattttcaaaaccttacttcttcccgtatcacttgggttacaagaatgccagtatatactcagaaattccaagaaatgcaaatactgcaaatgtgcacagatgatgacattaataaccctatggtttgagcgccacaggtaaacatgtggctcaactccaggactgcatcctgcattcatctcaaaatgaggttttcatgctattccagtgggtatccctggaatacagtaatccattttctacactgtggctatgagaaaagccgactgtgcctatgtcatgctttgttagaggttcatgatcacattatctcatggtggacctgacacttttattcagtttacagtatgttctatgtacaggcaacttatttcctttgccaaggctgctgacaaccttttccacactatattaatcttgtttactgactttatcttggtacaaatatcagaaaactaaactttttatctcagagaaaaaataaacaacgtgttgacagaagcagaagctattttcaggactaaaattgtttgtttacctgaagctatacttatggaaaaatgtttaagtcttgctctggcttgaaatacataatctgaaatttaataaatgaagaaatttcacatacacccatgtgataaattgcctgatgaaaacaaagcaactgaatgcaataaaacagaatttatagctaatttataccataatacaaatgtaagctttcaatctagtcagaaataatcatactatgtatttctcagcaatcatatatatgtataaaaaacctgtaagctcagttcaactgcagcaagtaacccacaaaagatttacagtttcaagtatagatacttaaataattttacctatttacctagtacatgatccctttaagaaaacagaggtgactatcctttattgttattttagttcaatttctgttttacttttaaagatatgcaaaataggcataatttagaaatttactttttttaatgaaataaagcaacatataatgatctcttcagggtcaatgtcagtggtctgcctcaggagtaaaatgttcttacaatgagaaccttttgctactgtggcaactagacacacttacctaaaatttgagaacaatatatttaatatagaatttggcttatggaaagcagtgttatactgaagtttcagtgaattttaaactttaaaacatgtttaatctgattattaggagactacttcaaaatattataaaacttcaaggaacatacttaaggaattctttctaaaagtttctgtcttatcattaattcaagatagaaaataatctttacaaaaattaaagaagcagttttaaacatcagatcaaagtattaatttctagcatataattaagtatggtgactgttttcttctccaaaacacatgctaattttagtgatttcagaactgtcttagaaatcacaaattttaagaagttgtttcactttaaatatctaataaaatattcacatagtaaagtttattagtaagaaaaatacattttattccataagattagacaggaaacaggtattctgttcttcatgagaaacagtatctccacaatccaattcttataattgacaaaactctggagacaatcatttatgtaattagccaatatttagtgttgataaacttagacatcacattacacgccctgaattcttatgattcatttgttaaatattactatataaataacgactacaatctgaaataaagcagatatatttctttttattagacgcttatcacacaaagtcttaagaagtaaactgaaagttagaaaggaattgatgctttctagataacataacttttgtgtcctaattctaaaagatcacatggatcttagattttgctgttgtttaaatattatcagtctcaggaaataagaatgtagtagcaagagatgaaaatttaacaatagttgtacaagtaccactatcgattcaggaggtcaatatgtaccaatatattggaaattctgctaaatgatcaattatcaatgacaaaatgtctgttctctcaaagttataagacatattaaaagcattttcttattctttttgtccctgatgtattgataccaattttataattttgcttaaaagataaaaagttggttttatgtctcattttcatttaattgtgtcattatcaaacccaatgcatgccatactattcttccacaattacataactgaataactctccaaatcaggtaaacctatctgagacacaagagtcacgtaagattaatacagaggccattcaatatggatgatatcttacttatattctcaatgattgagattccttctgtaaattaatgaagtttcttttcatgtccacacgtaagaacaagaaaccatcatcctttcttctctccctctagtatagctggtccccttcaacttcgctctgcttttcaactatattttatttgccttccaaatgctactctgcttcagtgcccacactgacaaacacttatgttggcaagctgccattcaaaagaaggcctttccattttgtgaggactggtcaatcaaacctgcctggcctccaggctgtcgggaggcactgcctcagcctcccggccagtttgtcaagacccagaggtttctggtttctcttacggcaattattaatttgactcaacttctttgaagaaagaaacaagacttttaagtaagataatattctaaatgttttacaataattcattttaattaatagacattaaaataaatgtgttgaatatttatctcttatccccatacagaagaataaaggaagattcttcgaaagcatttcaaatgagcacacctttgttttatattggcgttttataagttctgttacaagacagtttgaggaatgaataaaatatttcattgtgtatctattcttataatattacagaatggtcacaaatcacaaaaagcacaatctgtttggggatgagaaacatattcaagaaaataacactaaaattacttttaaagcaacatacaaacatgtaaaaattactttagaattgcttttaaaagaaatacaaaaagtgataattcaaggaacataaattggatatcatttataagattaaaaggaaacaaagtagttatctgatttaagaggaataaagaggaataaaaaatcacctctaagaagggagttgcatgcattatctcccccctgctccaatccatcttaccaacgtgccaaattcaactttctaaattgctgcttttcacatgtcaactttctcattccacagccaactatggcttacactgaaagtaaaatgaaaattaatgagatatgcatgcaaggctttccctaagctgatccttacctacttgccaatgtgatctagcaccttatgcagccactgagagcttcttattttaaatccagtactgcttacttggtacaattccactagtaacctaatgtacatataaaattatgcttaaccttattatataataagtgatatgtgttccctttcagttgggtgattttagttatattgttcacctgaactaatctttttgatgtcttgataaagtcaagttatagaactcctctaattccaagggtttttttgattgttgttttttaaacatgaaaaatattagtaaatataattcacgtaataattcatgtttcacctttatctgtctagatttctattaaagtaaaaatgtgtttatatggcaggcctggaaaaatcctcatcactggctacaagaaatgaaaaaattggtgcatatgaaatatacgccataaaaactagaacatctaatgtattcctggtaatatgtctaatgctagggagaagtcactacaaatccttacctaccagatcttttagtttcagacaatgtcctcctagaaagaatattcaggaaggaagatgatccattcctgaggacaactgaattgctagagagttcaaaactgttgtagaaaattactaaggttatggaatataactcagttttccaatggagaaaatgcctcaaagtttggaattttataaaatctaataacggtacaaaaaggcccatcaggttcctatcattcatatctttaaaaatgtcaatattgacaaacaatcttgctcttattagcagagctcacactgtatgacttttaggaaaagactttgaactaggacctatatagtatcgactagtcatagccctcatgttatctaaattatagtatagtgggtgaaactgattatttttacctgttagtcaaggttaaagtaaaaattctatattgtttgttatgcttttacaatgcaattttaaatctttcttggaagggcttaagcatgaacaaactgacaaagaatgtgtaataatgatcacaaaagatatatcaaaaattaatataattagaaatatttctattgtcattaataataatatccttatttttatttgtttaaatttatttaagtgtatttacttatttgagacaaggtcttgttctgttgcccaagcgtgagtactcacaactcatagcttaatgacagctcactgcaccctcaaactcctgggctcaagcaattcccctgcctctgctgctggagcagctaggactacaggtgtgtaccaccatgcccagttacttcttaaaagtttgtatagagctggggtcctgctatgttgcatgcactggtcttgagcttccagcctcaagtaatcttcccacctcagcctccccaagtactgggattacaggcatgagctacagtgtccagccactcttgttctttatagcctaccttatggcttgcttttcataaacaatgtgcctagagtgaagaaacatcattattctcaaataatagtgaagaaactaacactcactgaggtgagggcacatgccctagactataggaatggaattaagctaactttgaaccaaaattgtccaatttaccacctagtactttttcccctacagggagactgcaaaaaaaaaaaaaaaagatgatatatcaaaacaaatgttttctgtatttggggatttgtcccaggagatgatggcctgaatctagaatacactctaggaaaatcttcagccaaggatactctagaccttgcctgtaacttctgggtagcatgcgggctattttaagtatatgcaatgcagggcatggcagcactaaacagggttaccagcacatattatagaaggactaacaagaataacaaacggctcccctactaatcattacagcaaaagaaggctaacatttacaaagtgtactggagaggagtaaacactccgcgatgagaatatgtgaaagaacttgggggaaaattagagaacttaggctatctttcctttgaaagcagacataaatctaaatacgtgattacatctttaaaccacaaaggttttgtttaaaaaaaaaatagccaaagataaaccatagagaagtacaaggcttgtctttctgttgaggatttgccttcctagaggaatccgtacacgtgtgttgcagggaagatgctaaccttacagctgccagcattgcattaagtagtgaataaagacatagacttcagttagtttcgaagcgatctcactatatttttaagtaagagcagcaaatatatttctctatgaaatgacagaatgaaaattatactgtttagaaatatatacatacacatatagttgtatgtatgacattagcaattatgtttttaacgtaaaactaaacaatataattgttttaaatcttcattgtaaacaattttttcctagttaaagccattctgcattgataattaagaatttagaattattggtctattagaataataatacttctaattattaaatacataaattctcatttctggtatacactactaataaaagatctaaatgctttcacaaaaaagattaatcactaaataattcaaaaacaaatacagcaacaacttttttcataccactccatggtaatactattttttttaagtaaagaactaaaaattaaccagctcagaatgatgcccaatagtgatagtaaagaatttcactttgccgtccagttttagtaacaagctgtgagtggcctctactggctgaccaaaggcttcttaaatccctcatttatgaaccttgcaatattatgagcatcaagaaagtaaggatatggccacatatgtttacgtaaaatccactgtgcctaaagatcttcttttatgaataaatgacaaagtaataaacaaaatgtatataagatggtgtaaaaaacttccatcatttcgtcccactgctatacacttggattagattggcaatctatatatcttctaaaattctaatttatataccatgataatctaaatgtggattttcttactcaattcatatcaaagcaattcacatctgcatttaaaaacaaatagttttggggacttgttcaatacacacacacacacacacacaacttctcaaaattaagtttatatttaggcttggcaaactgactttggaggcaaacacaaagaagactgaatttaaaaacttgaaagaatttgtaactttaaaaaacagattaacattttatgtaatggtttatgaaaatactatcttggaaacatagtaatccaaagcaattaaaaaaatttctatattattgctcctatgtttgggtggaagtaattttatattcaaaatgaaatagcaattaagaaggcaaaaccttgcttgtattaggaaatgtcaattcagtattcataatagagaagaaaaaaaatttcagttttttattttattttatttttttattgatcattcttgggtgtttctcccagagggggatttggcagggtcacaggacaatagtggagggaaggtcagcagataaacaagtgaacaaaggtctctggttttcctaggcagaggaccctgcagccttccgcagtgtttgtgtccctgggtacttgagattagggagtggtgatgactcttaacgagcatgctgccttcaagcgtctgtttaacaaggcacaacttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacacgacaaccatccgatttctcaatcttttccccacctttcccccctttctattccacaaaaccgccattgtcatcatggcccattctcaatgagctgttgggtacacctcccagacggggtggtggccgggcagaggggctcctcacttcccagtaggggcggccgggcagaggcgcccctcacctcccggacggggcggctggccaggtggggggctgacccccccacctccctcctggacggggtggctggccgggcggggggctgacccccacacctccctcccggatggggcggctggccgggcggggggctgacccccacacctccctcccggacggggcagttggccgggcggggggctgacccccacacctccctcccggacggggcggctggccgggcagaggggctcctcacttcccagtaggggcggccaggcagaggtgcccctcacctcccggatggggcggctggccaggcggggggctgacccccccacctccctcccagacggggtggctgccgggcagagacgctcctcacttcccagacggggtggctgccgggcggaggctcctcacttctcagacggggcggctgctgggcggaggggctcctcacttctcagacagggcggttgccaggcagagggtctcctcacttctcagacggggcggccgggcagagacgctcctcacttcctagatgggatggcggctgggaagaggcgctcctcacttcctagatgggatggcggctgggcagagacactcctcactttccagactgagcagccaggcagaggggctcctcacatcccagacgatgggcggccaggcagagacgctcctcacttcccagacggggtggcggccgggcagaggctgcaatctcggctctttaggaggccaaggcaggctgctgggaggtggatgttgtagcgagctgagatcacgccactgcactccagcctcggcaccattgagcactgagtgaaggagactccgtctgcaatcccggcacctcgggaggccgaggctggcggatcactcgcggttaggagctggagaccagccctgccaacacagcgaaaccccgtctccacccaaaaaatacgaaaaccagtcaggcgtggcagcgcgcacctgcaattgcaggcactcggcaggcttaggcaggagaatcaggcagggaggttgcagtgagccgagatggcagcagtacagtccagcttcggcttggcatcagagggagaccggggagaggggagaggggagaggggagaggggggaggggggaggggggaggggggaggggggagggggaggggggagaggggagaggggagagggagatttcagtttttgctcagcagcttcctaataataaaagcttctcgtgtgtgggaaaatttggaatttttatttatctatttaaatatataatcatatatttaattcacttcatcctttacccaatctatttacctaaatatactctattaaaaattattagcaaatatatctaatgatgtcaaaaggtgactacatttattttaagaagtgattgttctcacatgtaacaatattccagtatatttcaaccttcatttcagaattcagtcccattatcttgcctgctcaaaatggttcacagggttatctagctgacatataagataaccctccatctcactagacaccactgggatatgacacactgacccacagtaagcccttattattatcctgaaatacatagcacataatgtagttcctgccaaggaatttgtttataaaaatcttttttatctctctggacatttgagtcattctttaaaagtaatgttcaactattttaaagaatttcatacaatgaataaacattctattttatgtttaaagtcttcattcccatttcccacaattttaccaaaggttaaaaaacaaaacccacatacatagaaaataaaagccagaaagtattttctccttgttgcttaggttatatagagcctattatataaaagataagacttaaaagagatctcagtagttcattcctagggagaattatgcatattgaagcttaatacatgtaaaattaattgtcttctttttaattttttggggggtagcagaagaggtcagagggcaatacggtagtgaagataatggtgagactcagcaaacatgtttgaggacataacaaattattaatatagctttttgaaaaaaattctacatgcacattttaaaaatttatttaagaatataagcagactaggaaaacttttaagtgcttgcttacaaactacttaaattattttggtactcaaaatcacatgatcaacattttggcagctaaaatttattttctttccacattattcaacaatgtgtcatatcatccattgtgcatactttttgaactgggtattatttctactatttttcaaagtgttttcataaactagtcaatttcttcttaacctgatagtggtgttgcataaaaccttaatttacatcaggggaaaaaattacagctggtttttataattaaaagagcgtttctaagaatctcaaggaccaatagtaatttataagaaaaatgctgatagtctcaacacttttaaactgacaacttaatatggtttatatttagcaaacaaaacacttaaaatattgttctgtacaggctgttctcctaaaacaaacatgcaggcaaccattcaatcattcaatcttacgtgatgcagttcaagaccttactataccattaattgcactaaaaatttccatagctaaaaaaaaagtatgtaatcatgatttgatgggggagggaaaaagtacaaaagtacaacatattgcaaactattctttgcggtatgaataaatgagtgaatgagttaattaaaaagaggtaaaatattagttaacaaatagcagtgtaagcataatcttagcatattacatactcaataaatgacaacaaaaatcccaaataacctaaaacttttaacattttttggccaatatctattctaagtaaataatcacagtcagactgtcatatttttgaaatacttattagctttaccttgatagaagtaaatgtctatcccaaatctggttgtttatagcagggaaccccaaccacacacagcaggaggtgagcaacagacgagcaagcaaagcttcatctgtattcacagctgctcctcactgctcatattaccacctgagctctgcttcctgagagatcagtggtggcatttaattctcacaggagtgtgatcccaattgtgaattgtgcctgcaaggcatcaaggttgtgtgttccttatgagaatctaatgcctgatgatctgtcactgtgtccccatcagccccagatgggactgtttagtttcaggaaaacaagctgagtgctcccactacctctacattatggtgagttgtagaattatttcattatgtattacaatgtaataatgatataattatttcattatgtattacaatgtaataatgatataattatttcattatgtattacaatgcattaataatagaaatacagtgcatgataaatgtaatgtgcttgaatcatccccaaaccatccccctacccccagtctgtggaaaaattgtcttccaggaaaccagtctctggtgtcaaaaaggttggaaagcactggtttataaagtcggtcaggtagccagagataactcacttcctgtgaggtgagttctggacaataagaggtatgtatagtcaccaggtgaagcttctaaggaaagttctttaagtgactgactcagttggcatgtgccttgtgcccttctttgtacttcatggtgcctgggatacggccaataacatccattttttttttttttttgactaggagttaaagaccaaaagaatcaaaggtttccaccatggcatcttttatctggataaccaagccactacgtgcctttctatgtcaggagggaaacaaacaaaacaaaacaaaacaaaacaaaaccctctcttgttcgagccaccattatttggatactttattatgtacaccaagctcaatccctaattttaataataatgaagccaattatatctattaaattctacatttagtcctagaaaacaacaagtcatttggtggaccaggaattcactaataagagaggagatagtgaacaactacttcatatgtccagcactcaggtgctacatggaagattctaatgaattgcacaatatcaaccctactagctaatatgttgcagacttaaaacataaaactatataaagattaaacaactactaaactgtgttcatttagttataactgcaacggaagttaaaaaaaatcattaaagcccaaattagcaaatgtgggttttggaggagatgagacttatgctgagtgttagagctggctaggatctaagccaatggaaggaggggtgactgtatgcataaacaagttatgaatcaaaagggtatatatattggaaatgaggaaataaacctgactagaagttcatggaaaataatggttggataggcaacaaaggttcagaaatctaagaatattgttcatcctgtaaaataatctctatgttcaagtctttaaaaattaagccagattttcatgactaattgacatcatcagactctgttaagggtagccaagtaaaaataactaaaaagacacaaacaagataacgttttcatgtattaaatttccatatttttgcctttacttcctcgttgctttctagatcctgtatcaagagcttgaagatacatagtttcttctacacacagcaggatgaggcaaatccttctgcctacgatgactaggacctgaggcatcctgccctttcttgctccttggtgaatgaaaaggagaactaaggctgaagtaggaggagtaagtcagaaaccaacattctaatgatctccatgcctcttgcataaagtaaggtggaaggtcagagaagcatggggggactgagggatgtctgttccctgaggtacagtcagggaggtaacatgtctagaagaggtgccacatttgaactggcaccttgtccaacagggcacagaggtaaaaatgctgcatttgtggaaggaggaggccagacagatagcctgagagaatgctgttggttccccaaggtctgagtgtgagacaggtgatccaggagttcctgtaccctcttgaggggaccagggtgaggactgtcttgggattcaagaaagcaaagggacttgaagatccgaggcaaatggctggaatctgtgggcttcagtaatgaataccagaataatacccccaaaggccaaatggaaccagactcacagaagtgaatgtggtgccagtgttcagtccagaccagctagaggtcagcaaggcaaagaacagtgattggacagacagatgatgcatggatctgaggtaaaagattcccctataattacccccaggacacataagctctgtagtgccaccatggagagaatcagatggagacagaggagaactgcaagaacaagcatttgttaaaaaggggctgagttacccaaataaatagtttatacagagataactgtaactggaaaatctttttcacttcctgccatggtttggatatggtttgttttgtccccaccaaaacttatgttgaaatttggtccctggcataatggtattgggaggtggggcctagttggaggcatttgggtcatgggatccctcaagaatggtttggttccctctgcatggtagtgagttctcctgctggaagactggattaattcttgtagaaatggattagttccctccagagtgggttgttataaagccaggacatcgctcaggtttttctcttcacacatgtctgtttcccctttgaccttctcctccatgttatgaggcagaataagagccctcaccagaagacagtgcggtacccttgaaattctcagcatgcacaactgtgagctaaataaacctcttttctttataaattattcagtcttgggtattttgttatagcaacacaaaacagactaagatgattcccagattcctgttcctccaccaatgtacttctttcccaatttccccacacccggcactaacagtcagaagctcatgagaaataacaaatgtagtaaataaagaaggtatattttatctcgcccaagagttaactttttgctctccacacttacaaactgacatcaactctttagaacatactcatgaatagaggaattatctttacaaattagaatagataaaaatcttccaatgtatccacaagtagtaaagtactaaatactagtttaagctttttcactgtttcatagtaaaaaaatacaatgtaatgtatgtcatgcttttcaatctacaggttacaaaatcaacagtgacaaagacataacctttgtggtaagtctagaaaacaaagtaatatggagtcctagcagtaattcttgttatccaatgcagtgatcacaatgaaatatgctatccaccaagtttaacaaaataaactgaaatttgtggatttcatcattttttcccctccagtataaagtagttcttaataatggaagagcacagagatgaaaactgggctatggagccagactgcctgggtccaaatactaacttctccatgtttcagtgttatgactgtctcaattgcttcatctacaaaatgggggtggataatagtacctatttcattgctttattacaaaaattaaagagatcatttgtaaagcacatagatcagtgtgtattagctattattatttgtattaattgtttcacagtctaatgcaaagtacaatctcaataataagatgacaataaatgttacagtagatgctagcaagaataaggagttttgtagggttggtgggactgggagcaaggagggtgtgtacacagaaaaatcatgccatcaaagatgtttatttattggggccatcaccacttctttcagtgaattaactgaaaataaaaatcaaatgaataatttttttctcgtgattgtatcagaagtgcagatacatatttagtttacaaaacactcaatgtttaaaaatagttacttaaagcctgtggtacttagtctaaattataaaacttaattcaataatttccacaaagacattattagtgactgtataggctgataattctgatgcttttcaattagtgtaaaggtcatgagttaaaataaaacacagaagtattttagctataataatcgtctctaaattgaatgttttacagctgatttgcttttcttggccaattctaagggcctgaaaacctgaagaggcagaccagttgaatacatggtattcagttgttggaagaaataaagggaacgcacctcctcccaagcccagttacacaaacacacacacacacacacacacacacactttatttaattttatacaaaataacgatgcagaaccttgaaggcttctctgatcacacaaaacagaagtaatttctttatccaactttaattcctatatgtctctgtatctttcttatatcacttaacagattatctgcctcatgttagaattacacatatgtttgtcttctctataataatatgtttctcaaaagcagaggctatgtcttatttactattgtattgccaccaggatctggcacatttgcctacagtgaaacatgtgctgaattagtcaaaagcacaaatatttttcatgagagctgattagcattttacaatagtcataaaaattcagactatacctcaagtaattcacaaacaggttaaatactgtagtctttcaaaaatctggatatggtgtttttgaaggcacactgccatctgcataattaaaaccattctaatacctatctcatgaaatagtacacaaaaaaaatagtagacaatacaaagagaatcaactgactacaggcatataatttactcagtgctttgcataaagagtggttcataatttttaaaatatagaaaatgaaagagatgctcattactatcattaatgaacacctaaaacatttttgacaagttggtgaaaacagaggaaaaaagaatacaagaaaaaagaaaaattgctgaattatcttcctgggtagcacactgttaagaaatttgatgacagaaaggatgctgtcaagcactagcatatactctgagaacatggcaggatatatcatatgtgcttacaaaccattctagaagctacctacaaagcaagaggagcatgtatgcatcaatataattaagaaactggaaatcaccaattatttcttgaattgtttcacagtattaactatgagttctgtggacattaaaccacaccatggaatctgaaaaaataggatactgtctatcatagtcagtctgtgaaacatggacataatgtcactacaacccaactccgctggaccggtacacaaacagaatcccaagtagcacactccactgggctgtgagcaactccaagtgcaggggtactgttttattcttttgtcctctgtgattaacccagtatgtactcagtaaatagcatccattattattgatttcaacaaacgatgattgagcacttcctaggtggcagaaactctcagaagctgcatattaaatatttctaatgctcacaactctgcaagattctaattattatctcaatcttacaaatgaggctcggagagattaaaacaacttacctaaggccacctacctgacaagtagcacagccactattttggtccagaaatgtctggttcattgactcaacaaaaaacatattgagccctgactatgtatactgagcaaggaagaggagatgtattggtgaacaagactgaaaaggcccctgaatttatgggactgacattttactctagagagccacaatgaataaaacaaacagacaagaacactacagattttagaaaatgaaatgaaataaataaggagaaggtggtagggaagaggaacccctgctgacctgacccctgaaggataagatggagcagccaagcaaagggcaggaggaatgaaacattcttagacaaaggaaatagcatatatgaaggcctggaaacaaggaagagtttacatgttcaaggagtaggatggaagtctgtgtggggaagggaagatgggtacaatgtgaggtcagagaacagaagagggtcccactggtcttaattgtaaaaagttgtgctctttatcttttttttgtttttttttttttgttttttttttttttttgagacaggatctccctctggcacccaggctggagtgcagtggtgccatcatagctcactgcagccttgacctcccaggttcaagtgatcctcccacctcagcctccggagtagctgggactacagatgcatagcaccatgcccacctggctaattttttttttttttagagatggggagatggggttttgccatgttgcccaggctggtcttgaactcctgagctcaagtgatctgcctgcctcagcctcccacagtgctggaattacaggcataaaccaccacacccagcctgctcttttctttataacagcaattctcaaactttatactcttaaaaatgatggaggactacaaagagcttttgtttatgcggattatatctattgatattgagtgtatgagatattaaaactgtgtttttaaattcaagaatctacaagcacacacctcctggagactagaaaataccactgcacagttgtgaaaaaataaaggtgaaaaagacaaataatatcttagcgttatgaaaacagttttgcccttggggacccactgaaagagtctcagggacccccagtggtttccagatcacacttcgagaagcattgccacatgccgtggtcatccaagtgtggttctcagactagcagcatctagagactaggaattgtctcttaatcaactttgtttctcccatacattgctcagtgtctggcacatggcaaatatgaaataaagcaataatcacttgttgacttaagtatttatgttttctcttgatatttacgttggtatctccatgaaagtcatgccagatactttgttctgaatcatgtataacagaatcctgggtgcacaggttttcattaagctctttttattgaatatagatatagatttggtaaatagcaacggggataacaaatataattagcaagaaaactctgtgctcttttaattatgtatagaaatacttaaatgaatataaaataagatctattaaaaagattcttacagccaggcatggtggctgacacctgtaataccagcactttaggaggccaaggtgggcagatcacctgaggtcaagagtttgagactagcctggccaacatgatgaaaccccacctctactaaaaatacaaaaattagccgtgcatggtggggggtgcctgtaatcccagctactcaggaggctgaggcaggagaatcgcttgaacccaggaagtggaggttgcagtgagccaagatcacgccactgcactccaatctggtcaacagaacgagaccctgtctcaaaaataaataaataaatgaaaataaaaagattcttacagttcttataattaattgctctctcctataaaatacagaccacactttatgccacccacattttgaagatttaggaacagccatgaaaacatactagcaaacattcattctcaaatcagaaacactagactgtaatttaatcttattatcaactgggtaaagtattagcttttaagtaaaagttgcccatcttcttattagtgagcatggccttgatggtccagttaactttcacctataaaataaggccatttttcatattcaaaatgaaattctgtgttaaacttcttcttccatttataaaattacttacagtctgtgaaaaaaaaaaaaaaagaacatttaggatatctaaagataacaaaagctcacaactggtaccctctgcactcaccaccacccggattaagcaaaaattaattgtcctctttaaagctggatccttttggccctttcccaattctcactgggttaccagatgtcacatgaccatacagttggatagggtacaaaatttattgcaccatgagctgtaaaggtactaactacattcaggtcaggatactgcagatgtctgtctcagttacttagctcaacttggcactaaataactggagattagtttgtgtttttaagtcatactgtcttgttcaaattcatgttttgtcactttctagctattcagttatttagtacttctcttgccttataggtaaaaggtcaataatagtaaaacctgctttatagggctgttatgaaaattacatgagttaatacacataaagtgcttggaaaaatgcctggcacatagtaaggacccaataatgctagttcttatgcctagcagatttcatagatgttatagccccaatctgctttaccaacaggcttgacatttcaactcagacctggttattaggactactcaatcctggtactgttgctggtttttagtttcaatcacttgacttaagcgaaatagaaaaagtaaattcctctgtattagactgttacctcaatgtcaagtatctacttactcaactccagttgagtgggtgagttgatactgaggtaacagtctaaaaaggaagtttttattctctttttaagttaatgtacaagattattattatgatttttttttggagggcagtggcgtgagcccagctcactgcaagttccgcttctcgggttcacgccattctcctgcctcagcctccacagtaggtgggactacaggtgcccgccaccacgcctggctaatttgttttatatttttagtagagacggggtttcactgtgttagccaggatggtctcgatctcctgacctcgtgatccatccgcctcggcctcccaaaatgctgggattacaggcgtgagccactgcgcccggccaagttaatgtacaagattgttttaagtaaaagctagaaagaagactgttcaaaatgcatcctgtgtaccgaaaatactacctagaatatttgttgaatgaatagacaactgactccggttttacgagaacaacccccagtgtacttggaattggaactaaaaaccctcatgagcagcataccacaaactctggcaatagttccacctcatcgccgctactgatttcagattagaaaaatgttttaaaatttttaaatttcttttaactttgcccatccctttttctccctcaaatcacttacactgtttttgtatatgctaagaatcacattgaactccttacatccaaataaattcattagaatctctctcaaattagcatcttttcctaaagcccaattttaaaattttattagtatttatttacttgtttttggctactggtgaataccagtacttttttagtctcacaagtgagaaaatctgggagtcatctattaatgactaacaggatagtatggaagaaagaatgagtgctttgtagtcagatgaagcaatctcttttactatgcaacctagctatgttaattaactcactctgtgcctcaataatctcagccataaattgattctaattctgatttcatagattttctgtaaggattaaaaagagaaaatacatagaaaaaattataagtacaacactctggcaaacaagaggcatacatgcactgaatattttatcaagacttttgtgccagaaactgccattcttttgcttcttattttatttttctttcattcaaactgatactctccatttatccaaataatttgctgatttcttctatagtgtattctccatttctattagcctatttctaattttttggaaatcccatcgcaattaaggtgaatactatataattctgaacttaattgcttgctttctagtaattagaaaggttttacctagatggtaacctctacaagtacactaaatctgtaatcaataactatattcttaaaaaaacagatgtatggccaggcgcggtggctcatgcccgtaatcccaacactttttgggaggccgaggcagacggatcatgaggtcaggagtttgagaccagcctgaccaacatggtgaaaacccgtctctactgaaaaaatacaaaaattagccgggcgtggtggtgcatacctgtaatcccagctactcgggaggctgaggcaggagaatcgcttgaaccggcggagggtgcagtgagccgagatcgtgccactgcactccagcctgggtgacagagcgagactccatctcaaacaaaacaaaacaaacaaaccagccaaacaaacagacatatgagctttgataagtcactttaagtcattggacctagatttttgaatctgttaaaaaaattcagtattttctctaaaatcctttgcatcaaaaacatttggtgattctatgttgagttcttagatcattttcatacagattagaaatcaaagaaaaggagtccttttcggtttattccgtctctctgaatttcgtcagctttttgttcattccattaataacgcactttaccgtattatattaagcacatgtctaccctgctaggtagcaaatcccttgacaatacagtctgtttcaattaataaacttcgtatctgggctacttaagacagtgtgtggcacatggtaggtgttcaatatatgtttgctacattgaaattaattatcttaagtatgagataggaaagattataaggctttataatatataaaggttataattatatattataaagattataagtgctttgcactgacaacaggtattctctttctaaaaccctgtctctcctaactatcctctcactactatcactgtcctgatgctactcaaaatattaaaatatgaggtgaaagaatcattaccacaacaaatgaaaccacttcggtcttatatgctaaaaatggtgaaacaaaagagtcaaattcatcaaagtacaatcaaaccattgagggcttaaatgtccatttagactacataaggaaaaaaggaaatgcttaaattaatttgacaaatacaacttttcccactaattcaatcatctggataattctaacaatttcaaattgacaataacatcattcaagattttctcacagcaattcagttttttaatattaaaaattacaaaacttatttaaagacaataagcagattataatatctaactactatacatatttatttctttcagtaacaaacactaggtttttaattacacagactttacctcctccttaccaggatcctttatttttagattgtataaagatgaaataagtacaaaactattctctcagccctacctttccatcaaaaaacaaattgattctaacttagatagattcctgtaggtatcaactaaaaaatctacatccatttaaaaaaataaagtttgaacccaagaaattttacaagagaaatattcaagagatccaaaaggcatgatatattcgttcatgcttttgtggcagttctaatgatgtgactcacatacatgaagcaggttcatgacaagttagctgagcattcacatttcaatacacctttgtacacctaaatgtcattacatcaatcttgtttaagatttgcagattctgtaaatttcagttaatgtcactaaaatgatgttatgtgctatggagtttattttattggcagaattttctttaacaactttataaataatttactcttgtgtttatagaaaccttaatagtctgaagggtcaaaatggtttttagctatacttcaccagattttatggggaaaataatatgtaattacattttcccatttgcagatacatgaaggtctcaggacaaatctcttgcaaatatcaagggtctactgtaatcgtttccagtctgcccattgaaacttagcaaatgggtaacaccctggcctctccattctgactgtggcttgggttggaaggttaatcaccatgaagagcagaagagctgaaccttaatgttaagatgggcataaatcctaatccacaatgtacgcttttttaaatatatacaccaatagactctttgggttactatgggccaagttatgtccatcatcgtcacacttaacagtgttgggtcctaatttttcacactgttatgaatgctatactgtcaaacagcatgggcatttagggatagattcatgctgatgccttgtgctgactcccatcactgccccctttatcaaatcactttcttataccctctgcttatctaaaagcagatgaaaaggtgtatcaatgtggacaagatttgccatttggggtgtgggtgttggtatggcatatgagtttaatagaattctgtgtgtcgataattaaatagttccataggtgaaagttaattaaatccataattccatataggaaaacagtactacaattttttccttagtacatcagattaaaaaaataaaacattgacaagtatgagctcgattctaatatattaaggctaatttcagaatgggaagcatctcatactgttccaaaatgtaaataccacgttgaaaaaaaatggttattctctcagtaaaagaaggatcattaatttcaaatcaaggaagagtttatatgattaaaccagtatatatttgctcaatttactatctggagattttaaaaacaagattgaaacagactgactatttgaaatttgaaaagggcaatgtccacattgttcccctggtactgtacaatggcaggtcaaacttttgttcctcttgtcctacaaacaattttcaagcccacgctcaataaataaatttggtctcagcactcccaatcagtgctgcacaatcccctcagtagcagacctatgataaatggacttattttcccaaatcaaacacttgaatttaaattcagatgagttaatgcaaaggtcaacattgtaatcagttcttttgatctttatagaatttctggagtaatacataataaatctgaaacaaggcaatttgcagctctgtatgtgtggctggcaataaaaatcttaacgatcacagcctttatgtacttagggaatgttttatcgtaatggctatggtgagggcttcaatgcataggaaacaatggcaatagataaccctgaaagacttgatttcttgattgttttacaatttatttatatatgtatttataaaaaaacttaatgatatacatctatgcttactgtatgtttgaaatagtcactacttttatcataaccacttagttttgagttaataggttggacataaaaattgcctatgataaacatttgcatatcaggttcaacctgaaattttccaatctcagaactgcatttctttagagagtttttacactaaaatgttttggaaggttaggcaatataaaaattaaatactattgttcaattttataactgataaagcacaattaattcattacggcacaatcacaaaggggttctaatggtctttaaactgatatttaaggaaggaaggaaaggaaggagggagggagggagaaaaaccagacagatgaacaggaagtaagacccacagacttgcagctaagtgccccttttgcatctggctgctaggtactattgggtcctatggcttcaggctgttcctgtattttccctgtcttggagccctatgataacaatttatcttaaagtagcagtcccagttattcaacaaaacactgcatgattacgtgtgaaagtaacatgaagttttacattgatagcagtaataaacaatagtcttcttgtgttttcaaaaatataaaatcttttttcttttagtaacatagcagtgattgatcctttcgaaacaataaaaccatttttgtcaactttattacactaaagtacacagtgtttgcacaatagtgctactctttaaaggatcaattctgaaccactttagtggtaaacaggattcaacaagtacctactattcaagataagtcttttaatgaaattataaacatgaaaaaaacatccaaatgtctagcagtgaggaacctagtacacatacatttgaagtaatagccctaggactacgtagctaaaggtgaaaagaataacagcttccaaggtggcatttaatatctgttcccacagtctctctcttcagaacaatcgacccttatttttggctaaaacactgaggctgaaatacggcattgtgcacaaatttattgtaatactgttttctggagactcaatgagagtacataagagccagatgtatcctgtgtacttgtgtgacaaccgtaactccagttgtatccaaacatttcactgaatttggccaaacagccaggaattttagaaacttctgggacaaatatattcatctatagcttctgtattaagttctttcatcggtaggcaagtttggttaaggtccgtgagctccttttgacagagtactacactgatacagcttctatcatcctaagtttgctctctaaagctaaagaaaagcaaaatcattactcatactgaaaattctgtcaatttcttcaaattgtgactttatttctctaataaagccttcataaatctgatatcattgaatgcaacacaattcggcagtagaaatgactgggcacaaggtaataactgctctattcagatgtctgacatgagtctaaatttctatacttcctaagaaaaatcagcaatgtttttgttttctccccctgcagtttcatatttagggtatacagatgtcctgtcacagcagttaaaaagtacagtcttgtgagtcactaggggtctgacaagtagagtctcaaagcccgataattacaaaaagtccttgatttgaaaagagctcatttcatttttttttccagcaatttctacattgttgcctgcattaacaaaagaataaaaatcataaaaattaagcttctatattctgttcagccacataagtatcctaaaaattagcaatagttaaatgcatacatatagtaaaattcaattattttcttaatccatgtgaatacttatttatcatctactatgtgtaagacaatgggttgggtaattcactacctcacataataatctgataggcaagttaacaacacaagccttttagataaatgacaaagtggaagctgagaacacccaaatttagttggaataaaatgttcaagcctctttcacaagctacattttaggtattccatctgggaagattgaagtagagttttttttatagaaagaccaaacatcccagttgtcttattagcatgtcctttggtccaactaagtcactcatgctcataaatgatgtaagaacttgctttttggtaaaaaaattttaaggagggctatataccctgaagtcaaaagggtcgagattatacaatttaagctttgtttcttgaggaatcctgctgggtttaggctgtgatgaacatctgctggttggctgacagtgtctattccttctactaataataacatactgattgtaagtgacagtgtctattccttctaataacaacatcctgattttttccacaggaaaatatccttctcccatccttacggtaggagacgcagtgacacagtctccgattccctggcccaggcctggccattcacagcaccccatgctatgcccattatagttggctcagggatgtggatattccctagtgaaagtcatcaagaatcaattctagaacagttctgaaactactggaaagaaaaaaattcctctttttggggtgggggaaggattccagagataagatataagtttcaagcgctgggagccctccgtctctggaagcgggagagcctggccaagaatggctcaatcccgaggaaaacagccaacagatggaaggcgccagatttaggaccaaagccatcctttaagcctgtggattcaacattttagttctctaagccaataaacatctatttccttttaaaaatgtctcagcataataagactggctgagttgggtttctcttacttaaaacccaaaacgtcttaagaattaatactaaagtcctaaactgaaacctttgcctagggtttaatatcctccagagttgacaagatattttcttccacaggcttttccacttttccttaatctggaagtttttcacctactttgtcactgacatcataaggcagaatagtgtagggacattaaagaaaggcagtcagctgcagctcactaaagagagtaatctatccctgagcttaagatgctggtgcaggtggcatctggggacaagaaagggaactaaaactgctaaacacctgccatgagccaggcacagttctgcctgttttacctacatcagtccacttagccttatttcatatctgcataacactgtgaagaagagacagatgccttagggactaagaaattgctagtcagagaatatagtggatcaacatttagtacagagtagtggctatatgtgttggctccagagtcagttttagatttatgtctcagaggctacatcattgaaaagcatgatgatgcgaacgttttttttttttttttttgagacagagtctcgctctgtcgcccaggctggagtgcagtggcgcaatctcggctcactgcaagctccgcctcccaggttcacgccattctcctgcctcagcctcccgagtagctgggactacaggcgcccaccacctcgcccagctaattttttgtatttttagtagagacggggtttcaacgtgttagccaggatggtctcgatctcctgacctcgtgatctgcccgtctcggcctcccaaagtgttgggattacaggcgtgagccaccacacctggccaggaatgttttaaatctgctccatgcctcagtttcccaacatgattaaaagtcatctttgtctgacttatagggatagtgtgagaataattaagatgttactcatcaaatattttaaaacaatacttggcatattgtaagctgctaatagcaaagcctgaaattaagtcatgataaacacctaaatgttctgagaaagagtgtattaaatgaactgataagaggaaatgaccagtccagcccacagtttcatgggacaagaacagaacaaacaaagaagggcaggaaaagccatagttataaccaaagatgagaaaccaagaagagaatccttcaagaggattctttctcaggctcgcttggctaacagttgtattgcttctgtaatgtgaatggactagaagttaatatcaagatgttaatttatcttatttgtagtgtgtgtatatagttatacttgagttactacctttataaagtcttaaaaaagtttactccagatattcttatattgaacatctgaactgagatatgaaactgcaataacctgggcacagtggctcatgtctgtaatcccagcactttgggaggctgaagcaggcggatcactcgaggtcaagagttcgaaacaagcctggccaacatggcaaaacctgtctttactaaaaatgcaaaaattagccggatgtggtggtacaagcctctaatcccagctgttggggaggctgaggcagcagtcacctgaacccaggaaggcggaggttgcagtgagccaagatcgcaccactgcactccagcctgagcaacagaactagactctgttccaaaaacaaacaaacaaaccaaattatgtgattctcctgcgtccactatcctttccaacccagaggccaacattcttttaaaaaaaaagtttaattccctttgtcagctcttctctccacacaccagcctaagtaaaccctaatcagaagcaaaccaagatttctccacacactaaattatctgccttccatacccaggctgctaactgctattggaaataaaaagccacacaactgagatgaactctatcaatgtatgtgcaagtgggcaatcccaacagtctctagtgatctcgctcttcggttcttcacataaggcatttagaacgttctcaagtccattcaaaccttttcatcacctccctgccatcccccaccttagcaaacaaatttgccttctatcttacaaataaaatataaatgaatactttttcatttcctgccctgaaactgtaaacttaactccaatatacctgccctttatgttccttctagtaaaatgaaagaaatgtctttcctcccatctaaggctaagctctccatctgtatattctggctcctgctgtctttcacttaattaggaacctcattcaatccatcagcccctctccttcttgtttttctcaacatctccctgtctactggagccttctcaattggcagacaggttttaggtcctcctttattaaaaccaaccaaaactctgaacagtgccatttcctttctctctctttcccttgaaagcccaacttcctggaagaacggtcaatatatgcttgtccccactttctcacaggcggctacaatataaaacctggctgaggtagcccagaaatcagagattccaggtgacccttcaattcggaaatgtgagtggagagcgacagtgaagcactgtttattcacagcaggagttccgtcaatggacaagcactaccaagaccatatctcagactctgggaagatgactggctggtaagatcttagagtgaggtcttggcctcttttgtgctaatcctcatcatagagggtatttgggcagcacctagagtctgcgggcataaaggtgcatacttattacttttctcccacagaaagggaaaataaaaggaaaggattttcttaagaaattctcatctttccaatcaaaattgatctgtccttcattgaatgtctaaacactttaacagtaatttgatttaatagctacttgtctacagacctttctcttgattataggcttcttggcagtagactatgtaattgtttttctgtgttgtccatggctccaagcacaagtggtcaaaagaacaagccagggaatcgtgaggtcaaactgggatgatgagaggccctgatgtatagaaaactaaaatgaggtaaaatacataaagggttttataaactacaaagcgtcaaataaagatgaaatgattttacatacagctagatcataacatgtatttgctgagaaaatggataactgttaaacagacatttgtaatgttataaagccaacaaggccatttcaataattttctctgggtaaagtgttagacaatgggtaggatgaactgtgggtttgaatatctgccaactactatgttcttacctgtgaaatgaagattctcttactagtttttatatcacaaagttttaattttttttaataaaatacctaggaatatagctaactagggaggtgaaagatctctacaaggagaactacaaaccactgctcaaagaaataagagatggcacaagcaaatagaaaaacatcccatgctcatgggtaggaagaatcaatatcattaaaatggacataatgcccaagcaatttatagattaaatgctattcctattaaactaccattgagattcttcacagaactagaaaaaaactattgtttaggcaatcctgagcaaaaagaacaaagctggagacatcacactacccaacttcaaagtatactacagggctaccataaccaaaacagcatggtactggtacaaaaacagacacataggccaatggaatataacacagagcccagaaataaggctgcacacctgcaacaatctgatctatgacaaaccagacagaaacaagcaatggtaaaaggattcccttcaataaatggtgctgggataactggctagccatatgtggaagataaaactggaccccttccttacagcatatacaaaaattgtgatggattaaagatttaaatgtaaaacccaaaacataaaaactctggaagacaacctaagcaatactattcaggacatagccatgggcagacttcatgatgaagatgccaaaagcaatggcaaccaaagaaaaagttgacaaatgggatctaactaaagagcttctgtacagacaaagaaactatcaacagagtagacaacctacagaatgtgacaaaatttttgtaaactttgcatctcacaaaggtgtaacacccagcatctgtaaggaacttaaacaaatttacaagaaaaaaacccaaacaaccccattaagaagtgggtaaaggacatgaacagacacttttcaaaagacatacatgcagccaacaatgatatgaaaaaaaaagctcaacatcactgatcattggagaaatgcaaatgaaaaccacaatgagatactatctcacaccagtcagaacagctataagaagtcaagccaggcgtggtggctcacacctgtaattccagcacttagggaggccgaggcaggcagatcacgaggtcaggagttcaagaccaccctggccaacatagtgaaaccctgtctctaccaaaaatacaaaaaattagccaggtgtggtggtgggcacctgtaatcccagctacttgggaagctgaggcaggagaattgtttgaacctgggaggcagaggttgcagtgagcagagatcgcgccactgcactccagcctgggtgacagcgcaaaaaaaaaaagtcaaaaaataacagacgccggcaaggttgtaaagaaaaaggaacacttgtacactgctggcgggagtgtaaattagttcaaccattgtgcgagatagtgtggcaattcctcaaagacttaaagacagaaataccattcgatccagcaatctcattactgcatatatacccaaaggaatataagtcattctattataaagacacatgcatgcgtatgttcactgcagcactattcacaatagcaaagacatggaataaacttaaatgccaatcaataaaccggatttaagaatgtggcacacagacaccatggaatactatgcacccataaaaaagaattagatcatgtcctttacagggacattggtggagctggaggtcattgtccttagcaaactaactgatacggtttggctctgtgtccccacccaaatctcatctcgaattgtaattaccatgtgtcagaggaggtctggcggcgggtgattgaatcatgggggtgaacttccctttgctgttggggaagtgatagtgagttctcaagagatctggttgtctgaaagtgtgtggtacttcccccttagttctcctgtctctctcctgctcctccatggtaaaacgtgcttgccttccttttgccttctgccatgatagttaagtttcctgaggcttcccagtcatgtttcctgttaagcctgtggagctgtgagtcaattaaacctcttttcttcataatttacctagtctcatgtagttctttataccagtgtgaaaacggactaatacgctaatataggaacagaaaaccaaatacttcatgttctcacttataagtgggagctaaatgatgagaacacatggacacacagagaggaaaaacagacactggggcctattggaggttgtggtgggggaagggagagatatcagtaaaaaaaccaatgggtactagatgtaatacctggatgatgaaataatctatacgacaatattcatgacacaagtttacctatgtaacaaacctgcacaggtatgcagttacccctgaaaatgaaagtaatctttttgattacatgtgctacaaatactaagacacctgcttctctcaatcttcgcaaaatcagaaatctcagtcgtgaaaagaatactttgaatattttacaggctttttataatgaattcaatagtttattcagttcacacaatttttataaaactttcttttgtccaaaactgggtgatatggtttggctgtgtccccacccaaatctcatcttgtagttcccataatccccatgtgtcatgggaggaacccagtgggaggtaactgaatcatgggggcagtttcctccatactgttctcatgaaagtgagtgagttctcatgagatctgatggttttataagcatctggcatttcccctgctggcactcattctctcccctgctgccctgtaaagaggtgccttccgccatgattgtaagtttcctgaggcctccccagcaatgtggaactgtgagtcaataaaacctcttttcttatagtatacccagtctcgggtatttcttcacagctgcatgaaaacagactaatacatggggagatatcacagtttgatggtggtgctctattctctttaaaaataaaaatcacctgagaagtggtagttgccaggtgcaaacaaatgtctgtatactgttgcttgttcttttcctccttctatacagctttgtctagcagtatctaaacacattcttttcaaaatagttaagttttggcagctctcatttaaggccacagcctctcagttcaattacaaaaccatttactgagaacatattatgggttagacatcatgggagatatattttaattaatctcaattaatgaccatagaattcataacttagatcaatatgagattttttaagttaattataaacttatatttctcaggatatagacttctccctcatgttccatatatctgttatgtcaggattgtctgttgtagctaatatttgggaaatgaagatggcaaatactgctttgcaatgaaaatgctccagaaacatttaagatattcctgctactgtgtatagaaagattagtatcccatgagaaaagtttatttgatgtagtatcttcttacctctccatctttgcccttatgacacaaacaaatggcccattttatctgaattacatctcacagaagaccattcaaaagtaatgaaatacttagagactcttgtcattcattcattcactcattcaacaagcatttgctgataactcatattccttggtaagatatatctactaagaaccatgtatgagaaaaaacgaagaattgaccaatttagttaaatgaatgaaagactatcaaaacatagaaagacttcctaatcagcaaatcaatccataaactaacaggtcttatgcaaagtcataggaattagaaaaaaagaaaagcctaagactaaaaattttcagtgaatttaggttcacatttagatttgctcttagttgggtgcaaacaccatacttggatgacaattgctttaaattatatacaaacaaaatcatacttcatttccttctcattagttctttaacgggagaactctgtaaggaataactgtctattcaccatttttagtttcctattttcctaaataccaatatctacacttcctaaatactatatatttttctattttatcccacagaatataagactttgaggcagcatgatttagtgatgagactctgggttctatagcagaaagacaagggttcaccacttgttagctgtgacacatggtaggtttctgtaagctcaggttcctctatgattaataatatctaatttttatagggcatgatgaggataaagtatgtacattcttaaccaaagacctaccacatagtaagtgcccaataaaagatcattattattcatttattcgccaaatgcttacagaaacctacctgctcagtgctgagtactgatttgaacttaaggaccttaaggtaaacaaaatagacattcattaccctcaaagttgattctcatgaagggataccaacaataaacatatgaaaaaaaatctaggaatagtgttaaatacaaacggaaattatgctatcatcattaattaaaattatttttagtgaatgacactcgtctataagtgaaagtcaaattttcttgttacctagttggtttaaaaaaaagacatagctaatatctattgacaaaataaaaaatgtttaataacttgcttcaataacagaaacccataaagtaaaatttgtttccaaaaatgaaatagcttactctgtacttatcacaattttaaacacatgattttaaaatcatttttaacttccattagtctgctttacataattttaatgaacaaatattttctctataagcaataaaatatctgtgatattatactacatttttgtaattatatactattataatataattatttaaatacatgtagggaagcaagtaaggcatgcaataattaagataagtaattacatgattagtaagtctaattacatagcatataatcagagactttatgaagaatttttgcttacatggacagatgatttttcatatgcttatgcactataaatctgttaaaaattcataatttgaaataatattttaatcaaaatcattcaagaagctttaaattcttaagaaaatataacaagaattcttcagaaatcatgaaaaaaaaaaacagagagaaacctagaccagtcaggagtgcaaatctggttatgtcagaaacagaaaaagatgtatggtcagtaaacaaagtctttgctctttgtaggcctgcaccggcattctatttgatgcaaatgttactaaacacacaggcaaggtatcatcaattcgttcaattcattctcattgtcatttaagaaagggtctctggagatcagtgttcctaaaaggcatcagtatcaattgggaacttgctagaaatgcaaattctcaaaccctaacaaagacctacagaatcagaaactggaagtggactcagcaactcctaatttaacaagccttccagctgattcttacacatagtacagttgaataccacccaccgctctaggttaatattcaaagaaccaagactgctagtcttctctaataatattttaaccttgaaaacagtgccaaaaaagtctcctttgccagccacattagcaatttcaaccatgaactgagaaatacgaacacagatctcactcactgttgtgtttgttgtatctgaatatttttttaaaactttgtgccatgttaggcagaaatcatgttaagcaatttatatccattaacacaataaaatgctgcaacagaagtacttatcgttaacccagttttcaagggaggaaaccagagtttagaggggttatggaacttgtataaggaaggtcaaatggcatgattgccgatgacaaaataactacatatcatgtaacatcacccattttcatttaaattatttagttttcagttatcatagccttggatgccacagaaaatattctttaacattacaggctaagaactttattaagaaaataagataattttttaaattcttaatcaacctatttttagatgggtaaatttgcaattacctatcagttactaacataacttcaagtagtatatctagttgtgaaatacggggaaaaaatactgactgccttaccaacaaaccaacctgatgtatatgaataaaaccttgtaaacttctcctatgtatatgaataaaacctctctgatgtatatgaataaaaaccttgtaaaacctctcttaacagttactgaagcaacctcaactaaagttcagcctttacatataagaaggcacttcaaatatattcatattcatcagaacttaaacatactcatatggcatatccacatacacacatatactattcagaatgtactcatataatttaatttaataagttacctagttaaaggggtatgtggcctaatacaaattcaatactggtttacctgttccagaagcagtaaaggtagtagtaaaagtagccacaggagggcaaagggagaagagtctatgttcaacagagaatttcagctggacagtgatgaaaagtccatatgttactgtgccaccataaattatgttggaacgaatggtcaggccccaaaggggttccaaaaataggttgaaactgctcacactctgaaaacaaattgcctaaattccaatatgaaaaaacagtgttcttgtcatatattttcatgtggccactactgggtgaagctaggtctacagagatgaaatacaatatgctttggttttgaaattggaagttgttattccatcaagacactgaaatgcaaaaaaatctgcatgagtctagtgcctcaaggcttaaagattcattatgaaggaaagacaaaatgaatgatggcatgtcagttggcctgaaccctggaagtgaacctgcattttggagagatgaaaacctcagaagtcttaccttttaatcatctcaggagtgtgaatttgaattatataattattggtttatctaaattacatatttaagtgataataatgggaaaatcattaatcaaaagcaaaagtactcagagtttcattattattaacaagttcatttttcttaaggggaaacaccaaatctagaatgttaaaaaatagttatacgatcatttcccttaaaagacagaaaatcaacagaaaaaaagtaataaaaaaactaaggggttgcttagtttataatctctattcaagatgtctgtggttaatcaccaggaaaatcagctacctatcagtagctaaatttgcaatatttcattttaagaacctcataatcacaaaatacgtaattataggggcttcataaatgaatactcaacagactctattctgcactttaaaaaatttggtatacatctaagggagaacaataaatccaatcatcacattttattgattaatttcatcacaggactaaaatgttgaaggatcatgtgaatatggctttaagtcaaacaatgttcaattttgacagaactgtcacaggtatatcattattgtaattgtaagaatatgtatactagatatattaacaatagcaaagtatttagggaacattaagtaatattttaagaaaaaattaaagttccaacacaattttttgtatagtctacattattgttttgaaaattaaaagtggtaagttgtataaaggaacaataaatgcattcttattcaacacaaaagcctcacatgattcaaggtttcgattgtgagtcaagttgcattaaaattattttctcatttgagaaatcatttgtcaacaatggaaaatatcattagctcagttttgtgaaatacaatggcatttttacataactgaaaagtaaccaaaagcttccaaacagggtagaaatgttacattgaacaaccaagagagaaccaaacagtgtaaagccatatggtcccacagcatgaagtgatcagatacctgcctaaaatgatggacagctctggcctagtgaacaagcaaaaaaaatcccatttactttcgtccagatgggaccaactggacgcttcagcgcaaacaactcatccttcttcggaccttcttgtccagctcttgagctagctccagctgataatgatgaataccaaggctacagtaaagtgggtgacaacagaagccttgttatagctgccagtctttcgctcttgtcattattacacattgaagatttatttgagtttattgttgtgcacagggtctagccatttgcaattcatcacctactacagaaagttcaagatagtggccaaagctataattgccacctccacctgcttctggaaattatgaggtcactagctagggcaacctcatcctcactgagctctgaaagtcacagcagcatgtagtatgaaataggccctatctgtacttgagcatctcttgagatcacattaataacactacattgcctggcaattgattaacttgtatctatagtacgacaaacactaagaggtgacagtcacaggaaagaaataatgaaactattaaaactgccacaatttgaacattattgttattatcacaaatgctgtagttactatgtgttgattcaggaatatatatacccattgataaggcacattcttttatttaatctgacataatctaatcttccagaagtcaaactagtctaactgtaaatctgttttggaagtaggtggaatgtaaatcctatacaaattatagtaatattttaaaaaacaagtactttgatacttcttatatgttactacactggagtgttagatgagtttgacttagggaaaaaagtgaataataaaaaaccccattctttattttcaaattgtcttttctcccatatttatccattttatttttataaaggtacaaacttttccctgcaaaatagttggaaaattttttgagagcttttgcctgtactattgagcactcaagcttttacagacagtgctacaaagagtaggaactttaaagatttccattcttctaaaatacatgaatcactcatcagtttgctcagtgtacagatggcttgaaaatttatgacacctgaatctttcccttcttggaattatgccattactttgttgccacattctcactgttaatggatttctaaaaccaagatttactgagataggtattttttgttccaggtcctctttttaaaaaccaacgtgaaaagtaatgcagcaaaaggtaagctagcatcataatttaatacaaaaccccaactatttagaaagactgtctatatcttattttattcctcagagtctaatgatgttcaataatttcattttataaggttatagaggaatcaaaattctaagtgggaagtttctgtctgcaaattcttttacaagtggtttcatatacacactattgtagctttctgccacattggctaaaatgtcagcttgagcaggacaatttgctcctgcttgtacgttagggtatgaaggtttagaagttctgatgtaattttactattataggtttggcctcattttgaatctcacttttacttactctcgggagcactgtaaggtaaagaaagaaaaatgtccatgatacttattaatcaaattgtttctcaaaaaacatgacaatgacataactaacataaagcaacatctcaaccaagtattccaggttatcacttggtggaaagctgcagagaattagacactggaagcctttccaacttttcctcctctgctgatcagctccataagaaagtagcatacatttctaacacctacactacacttctccttaaagtttatgaacatctgcacttcaccttaaagtttatgaacttctttcatgtacctatatcatacaatcttatgaggtacggattaatactacacaaattttacggagggagagactaaggctgagacatacaggtcatactccaaattctttactttgtactatacaacaggcagaacaaaatagtcaacttataaatcatttgaactgctctctctttcttaatactgaaaagaggtttgagatatgtaatgaatggaattacatctttataatttatccaagaaagaaattttctttttctttaaaacatgaatctaaaccattaatgggatagaataaaaaatacataagaaaatcctaacatctattgctttgatcctttttaaactctgaaatatagcttgtacagttaagtctgtacaaaaaccacacgaatagtttaaggagcagtaacccaacccaggaactagaatgttaacatactccaagtgtccccattcaccatgccacatttatatcttcccccttctcttcggggggcaaccactactgtgaattctgatttaatcattctctttctattcattagttgttaccactggtgtatgtatccctaaataacattgttccattttgccaatctttaaactttttataaatagaaacaaactgtatgcattattctgcacttgctcatttcttccaatattgtactttgagatttattaacattggtgcatctagctgtagatcatttttactattaatatagtattccactgaatgaatataccacaatttatccattttcctgccaagagacatttatgattttttcatccagttttatactattacaaagattgctactatggatattttttacatgcctcctagcacaaaagtgcagaagtttccctgggaaatatacattgtgggccatcacaaattcgtgagatatgcattctttactggctggtgcctttttccaaaatagataaatcagtgtgtattcccagatacaatgtttcggggaagccaatgatccttaccttgataatcatttgtactgtctgtttttaatttttgccaatctggtgaaatgctatctcactgtgactttaattacagtttcctactttctaattaagttgaacacatatcatgtttatagatcagttgtgtttcttcttttgtgaaatattcgttctttactttcgctcatctttctgctaagtgtttatttttcatttgaaaaagccactcccagtctgtggctcggtatgtgtgtgctgtttctctctctttacatcttttaaaaatgtcaagttggccgggtgcggtggttcacgcctgtaatcccagcactttgggaggccaaggcgggtggatcacctgaggtcaggagtttcagaccagcctggctaacgtggtgaaaccccgtctctactaaaaatacaaaaattggctgggcgtggtggcgggtgcctgcaatcccagctattcaggtagcttgggcaggaatactgcttaaacccaggaggtggaggttgcagtaaggtgagatcacacaccactgtactccagcctgggcaacaagagtgaaaccccatctcaaaaaaaaaaaaaaaaaaaaaaattccgttcattttaatgtggtttaatttaacagtcttttcctctataaacttttttgttctacttaaaaattctttgccttgaggtcatagagttgttctccgatatttgttcaaaaatgttgtagcacatttctgtattaaacccacttggaatcaatttttgtatgtgctatcagatagagattccaacttcatttcaccctacatggataactgattatctcttcatccttgattaaaaagtctatccttttcccactgatctataatattacctttgtcatatgtcagatgacactatttgagtgcttttgctttggactccttgttctgttccacttgtttatttttctatccctgcaccgatactatactgcccattaatgtatctttcataagatgaaattttgaattcctaaaacttttcagtacatgaccatcataccgtaaaataagcagaagtaaactttattgccatttaacaagttaataagctgaagacacaagttaatctgtaaaacgcttctgaatcatgatccacatcttacgattttcaaaccattaatttttttaaccccctgactttttcaaagcattttcatgtaatttcatcaatcttgaatttaaaatgatactaaatttatataatggcttcatattattgtagaaaaaccacatgttttgaaatcacatgcacaaaaaaataattagaaacagggctctaaaaagactggctgcataatcttgaacaaatcattcacctctctgaggctaatgtcacctcatctgtacagtgttgataaccactgtcctgaagggtttctgtgtgtaacagaggtaatatatttaaacacttaacaccatgcttgaaatgtagtgtatactaaataaatattttgacactgaatacatgtgaactcatgtatcttttactaacagggctcttaatctaacattaaacaacaatggaatcaaacacggaaggtacaaatttcatgatcttttgttgtaataaagtgtctcacaaagcctttatgtagactacatgcatccaactgattacgaaaaagtcaagaaccaatctaagaagtccacaagccatcctgccagccaatccctattctttagcatcgaggtgtttaaattaaattctggtacgttccctgtttagacttcctatattccaccccatcaaaactcaaacaagttgtggtcatcattaaaacaaaacaaggcctggagtggtggctcgcacctgtaatcccagcactttgggaggccaaggtgggaggagcacttgaggccaggagttgagagcagcctgggcaacagagtgagacctgttctacaaaaggttttaaaaaataaaataataataataaaacataacaaaagaccacaatgaatcaaagttaaggcaaaagcctagaagtcatccctgactactactcctttttgcttcttccaactatacttggtaggcaacaaatcaagtgggtctaccatactcactaattctccctgcagcaaatatcccccttcaggcccccattatcacttttcaagttcctcacactcaactgaccacacggctctaaatattccccactgcctcaggaatatgtataataatattaatttaaacaaataattaaacaattaattaaaaatggcaccaaatcttctcggatgttacaataaaatcctataaaaacatatttgttttatagctcagaaaagtgaggcatgaagaggttagatggcatgtgtagagctttacgtactagatctagaattcaaaccagatcagctaaggccaaaagatacctctcaaacactatactatgccatggatcacgactcattctaaagcataaacatatcaccccctgcaaaaaaaaaaaatccttcaaaagataccgaggaaagatcagattctagatatcttttcaatatagagccttcaacggcccctccatacctgtgacataaaaaatcaaactcctttttctactactccattgagagctggctacagtcctatttctcactatcacccaccttgccctcttctctccatgcttaacaaaggactatcattaccctcatcttatggcattacaaacatataagctagcttaaggaaatggaaaaaaggaagggtagaaacactgaaaagcaggcaaggtgaaagcaaaagggagggtgatcccaagagagcccaagcctggttgagaatgaatgagaaagagagcaggtgagcctgagagacagcaagtgagccccagcccagttcagggagaaaccagagattgagctgggctaaagacagacaccacaacaagtgagagcccaaaaatgcttgagagagacagcctatgaacccattagcacacacaagaaagagagacagagatcaagagacacaaaaatccagagggagagagagagagagagagagagagaggtctatacccctcactctcccacatcaggctattctaggcttggttcaagcgattctcctgcctcagcctcccaagtagctgggagtacaggcacacgccaccatgcctggctaatttttgtatttttagtggagatggggtttcaccatgttggccaggatggtctcgatctcctgacctcagccactgccttggcctcccaaagtgttgggattacaggtgtgagccaccatgcccggccagaatgccttttattcttcctctccacctcattttcctggttactcgtgtttgttttgcaaggctcagcttaagaagcttgtactccaagagccttgcctacatccaccttgtgagtgcatgctacttgtccttcctcgctatacccacagtatcctattccttgtatgttatcacagctctgagcaaatggttttggaagtcactgtttgactttcttcatcatttaactcctcaggggtatttgttttcctctttgctcatcagtgtcttgcaaatagtggggctcaatacatgttgaatgaatgaaaaaacccagtttttccatttctgcacaaacactttccaaatataataaaatgcagcagccaattctcacctatatatactttcttgaacacattttgccttaaggttatcaaataaaacattaagtgaatatgcaaacttcaaacattcggaatataatggcccaacaattatgaacctccaattctgtaggtgcttcatttacagcagaatttctcaacccctgcatgattgacatctggggccaggttaattctttgctgtgggagactggtgtgtacacaggatgcttagcagcatcccaggactcttccaactggaagttagtagcattcccaaccctgttttaacaacaaagaatgactgtctgtctcccatggcggttatattttcttcaggtactaatcagttaaagttttcatttttcactttctctgtgtaagatggcactattttaagattttaactttaaaagttggcatagacagtggtaagtgttatttaatggggtagggaagaaggatgctcagttagtcctaatttcatttgaaaaggtaagggaatactcaaagtttaaaaataaacagttttgataatgtgagtaattccattcacttctggaaaacaaacagacaaacaaacagacaaaaacaaagaaagaaaagacctctatactatttgtgcattatttacaccttcctgaaatgctgcagttttcaaagtcacttctgcaatacacttggtttttccttgaatgcagaatcaaaccagacatttaaaattacaactcaacatgagggtcaataactgcatctgctacaaaacttaataaaataatcataaacaccattgctttgctgacaggaggagctctggtgtcactaaaactgaagaaaaggtttatctaaaaacatacgcacagcagttactgagataaaatcacacttggagaataaaaaactgaaaaataggtgacacttcaagcagcgagaagatgtatgatgacgtttgtcatcgaggtgtgtgtgtgtatttaatgcattttaggcaagcccaccatattcagtagaaactccttctctttttaactgcacaaaataatcctgtttattcttttcaaactttgatttgtgccaagttcattttcaaaacggtgtcttcacacatcggtatttcctcttctgccaatggtcttttccccactttcctctgagataaatgtggttatctagagcctggctcactgaaagtctgagtgacctacagactttcagaaaccagatcatcaccactgttttcatcccttgacaagtgcaagaagtagaggagaaacatggggtacacagctcacagacactctcctctgcagggtatgattaggtacctgccttgcttctgaacggacccaaaggatctctaacaggcaatggcaagcccttaaggatagaaaaattattctctctggggactggttctagtttgtgttttctcaagcaggtatactggaatttcaaggaagaatatctctcttcaatcaggcatgccaagttctgaacatacctgagcatacaacttttctcctttctaccaccaaagccccgcagtgcaagaaaactatcaccacactagtgccccagcagtcaagatcaaccttagcaattccaaatgatctgaaaagtactccagtgcttggggaggagacaagtggcttagaaatactactgaaattaacacggaatgcccccctcccttttttaaaacacagcattgggtttattaacttcataaacaggtgtaaacagaggtctaggaataatgttacatggagtagagcatattattttgtaactttttcggcaggaaaattttcctaataaaaatcttgcttggaaccttaaggctaagtgaattactatgatggcaggctggattcctatcctcttacccatgccttggcaccttcactaggcctgaggcaacttatgggaatcaagggcttcatggaacacagttggaaaactactaggacagagaaacactgatcaagaaaatatggggcttggttttaaggatagaaagagaaattaacaaagacgagggcaacaacaatgaacctagagtgaaaagatccagatgtgaaccacactgtacatttaccagtggtctaatctgaaacaagttttcggctcactgagcttccatattatcattaataaactggagatagacacatatgttcaaaccacagggtttgcttagtatcatgagtcacttactagcaatgtgatcctgaataactcacttaacatctctgcactttggtttcttcatctgttaaaacgggataatactctctaattcatgcagttgttgtaaaggttaactaagacacttggcacccaaaaaaacagtacagatcagctattcttcctactcttttctagtagtaaactttgaaaactttaacagtactatgaaatattgggcaacacactatttttgttctatgaataaacttctgttgttattgctattgttaatgactttggacaagtttgctaagttgctatggggtttctattcactccaaactacacttggactccaaagtacccagttgtctgatatttattctcaaatttagactatcccacaagtaaaggtaatatccgttcctactagcctagcttaacatccctagcttgaattcctttgcagaattttgcattaagccagaagattctccaatggagcaacaatttatcttgtagttatacagccactattaggtcttttccttgaagtaatgaattgcatctagtatatattcaggaaccttaaaaactacaaaaaatagttatactgctcaacccttcaaacttcaaataaataaaaaatcatactatataaaatgctgcctcctcatggactgagccaaaattaataaaactggttctatggtaaacaaacatctttttttctactgagacctaccatgatagtgagacagaaaaaacctagaggttaatgagttcagtcctatatatccacaagaaagaaatctaagtaagaatttgattgacattgataaagaaataaggtacattttcctattatttgatgctgacatcctattttcaatacctaaaaaagcttaaacttccagaaattaaaacaggagagaaataatttttgacccaacataactataatgctctacaaagtaaaaagaaaacaaatattgctatctctaactacagttatatagacacgtcagaagaatgaagagaaagttttaaagaagtatatgtaggccgggcgcagtggctcacgcctataatcccagcactttgggtagccaaggcgggtggatcacctgaggtaaggagttcgagaccagcctgaccaacatggaggaaccccgtctctactcaaaatacaaaattagccaggcgtggtggcgcatgcctgtaatcccaactactcaggaggctggggcaggacaatcacttgaacccgggaggcggagatagtggtgagctgagatcgcggcattgcactccagcctgcgcaacaacagcaaaactccgtctcgaaaaaaaaaaaaaaaaaaaaaaaaaagaagtatgtataaaaacgataatttattccagaataatttgaagacagaaaggaatgttgtgaattactcaaagagttcaaaaagtttctttaatatcttactcgaagtccgataaaaatcatcactgtaaaaaagggtaacgttatttgcaaattgagcaagaggaccagatgatagccatatataatcagttgtcaccttgcagctcaattagccctcatgtaaaaacgaggcatgtaaggagaaatgaggttttgacattatctctgccagcaagataattacacagccttcatttaacagtagggcaacactactgtagcaacaaattaactcagctccatttgcaattcatggtgtgttttctcatttaataccatttgtcttaccccaagtgaatgtttccattagttttctccggcacggcaaatactccgtttgactccacacattacatcaccgagtcaaggcttaccttccagcaactctttgaaaacatactcaaaatgcaacagaatgtcccatttttttccatttcagctacaactttttttctggtttatggccaaataatacagcaggtgtatgtgtgttgaacaaccaaggacacgaaattccccatggctacaatctatttcagaagtgtctgcttctttcattaagaaaaatcaagaaagaaacaaatatcagtgaaatcctaacttgggtacaaccatatattaagttattaatacatttccataatgcatactttaggaaagacaaaaacgtgctgctggctctaagtgttaagtttttagatatcatagtctaaaaaaaatgactgcgatctcatttatttcctttacaaatattacattaaatacttttgttctgcctctcaaactagacatcattgaggagagttgaaaaagaagaagcagaatgtttaaacagtgctgagcacaaaaaacaggaactggtgggctcctgtgttgtcatgaataggctgatcaacaaattttacattcaactctaaaaggtaatgctaatttgactaatgatttattatttgagattttagtcactgaattattcactactggcaatacaaaaggccctaaatgttctaagaacctcaagtccctggaattcctttagtccaacgcttaaatctatatataaaatactgattttcaaacatgcaaatgtataagggcaagtgcatttatttatagtcaatgtacattaagagaaaaaaagaaaacttaatactttgtatttgtatttgtaactgaatacagaaaaattcctaagtagagaaattcaattttttaaaataaacagttattattctttacgaaatttaaggaaattcctgaaaagaaaaacaatactttccaggagttttatttcacttatcataatagtgatgagcaaaaacaggcatggacaactgtattattttatactcttaaaagaattaggaaaacatacatatgcatgcatttcacacacagattcattgctacatggttactttaacactgtaaactggcaaatgagtatccatgatgtgtgaggtttctttttcttttttgtaactattaagacaattcatcaacatctccacactttcaggtaaccaagtgttctaaggaatatatttaaggcttgaaacttaacgtataaataaaacgtatataaaaaaaagttctatgcttttctgtgcgatccaacctaatatctacagtaagagagatctctaggccaggcgcagtggctcatgcctgtaatcccagcagtttgggaggcccaggcgggtgggtcacctgaggttgggagttcgagaccagcctgaccaaaatggagaaacctcatctctactaaaaatacaaaattagccaggtgtggtggcacatgcctgtaatcccagctactagggaggctgaggcaggagaatcgcttgaacttgggaggcagaggttgtggtgagccgagatcatgccattgcactccagcctgggcaacaagagcaaaactccgtctcaaaaaaaaaaaaaaaaaaaaaaaaaaagatccccaataaaataagatgaaaaagcaaatagtttgcaatttttaccacagcattctgtaagtgcaactttcttataaatatagaaattttagatacttgactagcagttatccagcctcagctgaagcaattcaaatacagaaaaaagatataaaataaagatattgaaaagttaaaacttccttttgtgctcacttgtccttaccaattgaatattcatcctatgctgtgggaagggtaaactccttaatctttagatgttcttctatcattaggtctaaaactgcatatgtatcactattacagatctcctttttgtatactgaattaattcattacacacaaatatgacaggcacagcattattaattttttatatacagttcatacaaatcaatacatgggcaaaagatatgaatgaatatcacatccagtatatgaaaaattaactcatcaatccaattattaatgaaacatatggaaaatatccattcctttgtttactttccttcattattcttctaaccagtttgatcactttgggaaagatcaagaaagcatgcatccaaaagtgacatttaaattaacacttaaaggatgagtacaaattaccttaaaagtatgttaaaatatgcagttgaaatattgagattacatttttgaatttaatacaaaagtagacagttaaaatagaatatagactgttttgctactgtggcagttttactcttaacaaacttcacaattttaaaaatgatattaaaactattgtttcaatgagaaacttgtggttggaaaattaggcttttagactcataataacagttattttcaggcaaacagttaatagtaaaaggtttttttatggctatgagtgtacaactaaaacatcactcagcaaatataacttctggctttttttttttttttttgagacggagttttgctcttgttgcccaggctggagtgcaatggcgcgatcttggctcactgcaacctccacctcctaggttcaagtgattctcgtgcctcagcctcctgagtagctgggattacaggcatgcgccacctcacccagctaattttgtatttttactagagacggggtttctccacgttggtcagactggtcttgaactcccgacctcaggtgatccgcccgcctgggcctcccaaagtgctgggattacaggcatgagccaccgcacccagcctaaatatagctcttacttacatctaccatttgcttaagagtattggcccttcttttctaattcatgattagcattaccattaatgtaatgtcttatacattttgaaaatcatctatgataaagcacaaagccactaaaacaatgcaactgtaaagtacgtgcaagcacactaccttagctggttctcagtgcaaattttgttcccttatatctgatttgctttatgaacacacagacataatgcaggagaaatgcccatatgtaatggtgaggactgtctgatgtttctgtaagagttatctagacaccgttcataaactggtataagccttctggctttaaatatttaagaatatttacagttttcaacaaagtaattctattgaagtaactcatgctaaggaaataattttatacctgtgcatgccttgtgcgtgtctcagaaaggaaaatctcattcaccaaaatgttcatcaaaacattatttatggccaggcgtggtggctcacgcctgtaatcccagcaatttgggaggccaaggtgggcggatcacaaggtcaggagatcgagactatcctggctaacatggtgaaaccccgtctccactaaaaatacaaaaaaattagccgagcacggtggcgggcgcctgcagtcctagctactcaggaggctgaggcaggagaatggtgtgaacccaggaggcggagcttgcagtgagccgagatcgtgccactgcactccagcctgggcgatagagcaagactccgtctcaaaaaacaaaacaaaacaacaacaaaaaaaccccaacattatttataacagtataaaagtgaaaacctaaacaaagaaaatatttatatctacatgatgaaatattatgcaaccattaaaatgtatggttattaatatatacttatatattaagttaaaacgcaggattaaaagctgaatgtacagaatgcatgcattccctcaaacactgaccgagtactatgtgtcaggcacagtgtgctaaggccatgggcacagagctataaacaaaatagataagaatctctgctttcacggagcctatattccactgagaggagacacacaataaaaacacacagaccagataagtactatgggggaaaaaaagcaaaaaagtgaaattgagagtactggggcaagggggttacagtttttaaatagtcagagaatgcctcaaacaggtgaggaagagagccatgcttgcacgcaatggaacaacattacaggctgagggaagagctatcttgggagcatgcaggcaagactgcaaggccagtgttgctagacagaaatgagcaaagagaaaggaagtagaaactcagaaagatggggagaggggctttgatatagggtcttgtcttgtaagctagtacaggattttattttagtgagacaggaggccattcaagagttctgagtataggaatgatgagatggaacttatttgaccatggtcactctagctgttgttttgacaacagaccgtagagagcaaaggcaaagccaatagtttttgtaaacatcagaaaagacatgtagtggtgctagaacaagaaggtggagctgaaggtgataagaagggatgtgattctgaatacatctgcaaatagatccactaggatttactaatgaattaaaatattcattagtaaatgaatgacattagtaaaatattcattagtaaaaggatgacagcaaggtttatagtatgaacaactaaaaagacaatagtgatatttactttaaaaaaaaaaagaactccagaagaaaacaattaatatgagaccagtacagatgacgaaatgggagtagacagatatttggggacacatgtttttaattagttaagtaatacgtttgacttggctgaaaatactagaagaaactatatcataaggaaggatatgttactctcttcaaaattctaaataaaaacaatgaatgttgtcattaagtaagcaagcagagggtggggtggatatgtgtgacccattttatgaagcaagtatttaaggtaataaatcaaataagcccagccaggcacaatggctcacgcctgtaatcacagcactttgggaggctgaggcgggcagatcagctgaggtcagcagttcgagaccagcccggctaacgtggcgaaaccccgcctctagtaaaaatacaaaaattagctaggtgtggtggcatgcacctgtaatcccagctactcgggaggctgaggcgggagaactgcttgaacctgggagatggaggttgcagtgagcgaagactgcaccattgcactacagactgggcgacgagagcaaaactccgcctcaaaaataaataattaaatgaaattaaataaggccaaaggttaaaagaatatgtacacgatatggaatgaagccaaggatgaacataaaacactagcacaaactcatcagaataccacaaggaagacaagagcccaagagcccaaaatgtaaactggagctaatgaaaaatgctaaagacaaaaaagaatgggattctgatttacgtttggcaatgtttgaagccagaaaatgaacagaaaacatggaaattcactatttggagggttggtaggggtgacaaagcctcttcaaatcctcagatttttgagtaaattatttaatctctccaggccccaatataatcagtaaatgtatgggtaacaatatttacattgtaaagatattttgatcaataaatgagataacaaatataacccaaaacatatatatgttttgagacagtctcgctcatgttgcccaggctggagtgcagtggctcaatctcggctgaatgcaacctccgcctcctgggttccagcgattctcctgcctcagtctcctgagtagctgggactagaggtgcacgccaccacgcctggctaattttttgtatttttagtagagatggggtttcaccatgttgaccaggctggtcttgaattcctgaccgcaagtgatccgcccgcctcggcctcccaaagtgctgggattacaggcctgagccaccacacctggccccaaaatatgtatttaaaagggatattcgtgtttgttcctgttttctttcccaactcaaatgctgcttttactataaatctttctataagtatcttgcggcccaagacagagaacattttttttaattagttcaaatttctaggttcatgtagatattcagggataattcaaatataatcctggaattatatttcctttgtagctataaaatttcaagacaccaacaaactaataaccaacaaagcgatggcgagtgaaggtagaattctgcatcatattattaaacagtttatgaagacctaggaacagagacgattaatcactgagagctggcataggttcactaagaataaattctggaaaaagtgtcatttaattttactgaaaaggttactatcctgaaaggatgatggtaagaaatgtcatgtattagaacttcaaaagcgtatctgacagtctttaatggtattatttgcaacagtgaaagtaaactatggctagccaagagtttagttaggtgaaacaatagagatttaagcaaacttaggcaaagaaaactgattaatgaattggaataaatctgtaaagatgtttccaatggcagcctaccaggtgctattcttggctccttcagtttaatcaatcccgcttcaaagtctcagaatgaagaaatagaatgtatacttctcaagtttaattatatcagaccgtgttaggtgacaaaatcaagattcaaaagaaagtcttgacaggctgaaatccagccttcaactaaaaagaagaaatgtaatagggacattaaactggcatttattttaacatacacacactctctctttctctaactgttctagaggaaaggaaaactgacctcaacataagtttgtgtaaattgagttttagttgtaaacccaaacaggtgctcagtataatgttagcctaaatgctaaatgtgatataataagaccctcttcccctcccccaaaatgaagcattgttagactgttttaatataacttgtgttcccagagcaaatgaagaaaaatatgcaataaattcaacagtattttacttctgggcgccacatttgaaagacattaaaaaaaaaaagcatatttaaaggtgagcgattaaaaaggtacaagggtttggaaaagggtgaaaaataactgaaagaaattaggtgatctacacttgaggccagtttgagaccagcctggccaacacagcgaaacccccgtctctacaaaaaatacaaaaattcgcccagcgaagaacaaaaacgaaaccaaaaaaaaaaaaaaaaacaaaaaagaagaaaataagaaaattagctgggcatggtggcacatgcctatagtcccagctacttggaaggctgaggcacgagaatcacttgaacccaggaggtcaagagatggaggttgcagtgggccaagatcacatcactgcactccagcctgggccacaagagattctgagaaacagaaagacagaaagaaagacagacagacaaaagaagaaagaaagaaaagggaggaaggaaggaaggaaggaaagaaagaaagaaggaaggaaggaaggaaagaaggaaggaaggaaggaaggaagggaggtagggagggagggagggagagggagagaaattaggtgatctagcatgaaaaagatataagaaatgtgcaagtatttgtgggacaatcatgtggcaactctattcctttcatttgtctaatatcctgatacctatcttacaggcaaaaagactgaggcttagagaggatacattgatagctagtagaagaattagaacttaaatttaggtcttgtgaaaagggggaatctaacttattctgtgtaactcgagagagtagaactggaccaattacactgtgaagccagatttcaggtcactgtaagaaagaaagaaaaagaaaacaaaagctgaaaaccatattatatgatgatgtccagagtttccataaagcctggacacaaaggcaaatatatacattgtcatcaagaataacttcaatctgtaaaaatgtattatctagttttcaggcttcgtgggcaccctgtgtttgctgaacaaccattaatcattataccaggtgctctataatcccttgatctgcacaacaaccccaatgagaaaacagaatcttattaaagactagcataatttgcccaaggccccaaagtgaatacattaagaaccagaattcaatcacaggtattcctgattcttctaaaattctctcaccctggctgcatagtagaattaccaaatctcttttaaaatgacaatgtctgggttccacccccagaggttatgatttaattgatctaagatgaggccagttgttgagacgagtatatgacttcccaaataactggatatatacatagccacacatatgagagagaaaagctacttttctgggtgaagggagggttaatagtgaaaatataagaagaaatcttagcaaagagtgtttaagcacctttgtaaaagtaatttccaaatgtaatttttgtacctacttaagatacgttaggacaaaatccagatgtcctgcaatccaaaacattagaagtgcaagaagaaaggaagtccgacacaaaagttcataaccccttcatctacaatatgctttttaagcaaataaaatgacactttttaaagtcaaataccgtaaaagattacttgtcttttgcacaagtggcagatctgttatcattctcatcatattgaaagcttatccaacagatgccctctccgtaccctccaatggctctttgtgcactcaaaattaaccccactatcacagtgtttctctgcattaaccaatgtaagacatttgaagagggtctttgttgttgtaaaatgaggaaagttgcattagaagcattaaaataattgtgctcacttggaaaaaaaaaatcaaaatacagtaacagcattttatgtgagccattccttgcaaacaactaacagttttcaactctttaattaaagagacattctttaaaattgggaagaggtgttaagttgaatgtcatcccctttctcctagaatgaatgacctctgataagtatctgaaccatttaaacacaaacacacataaaatgtgattttattaaattcaacaaacatgaactttggaggggctgaagaaaaataacaactgctttctaaatttaattaaacagaaaaagacagagctgacaagcagatgaattgtctaactaaactttacgagtcagatattaagaaaaggagtgtcattttcttattaggagtccaaggtgactgcttatgttttgaacactggttaattctagctggagcacaaatctatcttttcttttagaattaattctcagtgtcagaactgctagatgtccttttcagaatcaacctatcctggccgttaattatactacagaaatatgttcaaataatgttaatgatctgattctattctcacagaacaagctgtaggaaaagctcaattaagactttgctaaatatgtttacttaattattttgcagagaatgagaatggtttgcttggcaaaaatgatatctgagaaaatgatttttaaaaagaaaagcaacgtgcagtcttaacatggataccaaataggaaccactgtttgaatattaagataaataacgattattcttagaagtacctaacagtgagatattatttctttgaaggtttctcaaatgctgagtaaatagaaaaataagagaaatacagtgaccaagaaagtcttttgaaggatagtgacacaaaatgtgccttttttacatttttatatattcagttgcaatgggcttattttcttaatggtctactttgggactatcctagcccgagccccaaagctgccgtggaaatttagattgaaaccaataaactcaaaactacccaaaagaggccttgaagctgacttcagagttgactaggaatctcctagagctctgagactagtttaagtccagggagtgcccttccacttaggcttgcaatgcggaatgacattcagcaactgggttcagttacggggtggtttatctgcctgtggatagctggcatgcaattggtcaaagtgagacaaacaataaaaggaataatcataaacctaaaataagagaaggaaaagaaaaaacatttttgggcacctgtgatggaactgtcatgttgctaagtactttacatatgttatattcattaaacctctcttctcccataaacttttccaggtaaagattactattcccacttgcaaaagtagaaacaaaggtacagagattaagtaaactgtacaaaatcactcagtcaataataagcgacaggtccaaccggatttgagtcctggtctttttggctccaaagagcaagcttatctagcaaactataaagaaaggcagaaaggcaaaatttgagatcaaattcagagataagggaaacataaaattcaatctcatatattcagtacctgaaatatgaaagatcattttttcacttttaattcctgataaatccacacacagggttggaaatgtggcacttatatgatttttcttggtctgagaagtgatttaggtctatggcaacctttccacttaacatcatttataggtcaaaaaataataaaataaaaagcttaaggttccttcagtcatatcaatgaggaataaagacaaaatgctcaaatgtcttgcctaaagtcacaatgctagatttctgcaaagctgggattagatctcaaagctgacctatggtttactgttctttccattacaaagtattgctttattttgtttttccttggccctagaaaaagctggaaactgttagttatcacataagaacatgaaacagccacaggaatgatgttaaaaatcctcttaagattagcacactcaaccattaccttaaaaagcaaaccaatcatctaggtttatgtcaattttgtttcaaatggcattaagaaaaagacaaaaccaggtaagcatacttaatataaaagtttgaatttattggtcaaaattccaagtggctcagatttaaaatacaactgatgtaaaaaatcaatgcatcatgacatgagaaaactgttactgattctttatgtgcttccaatttgattgctttggccttccaaacaaataaatggcagtaccagaaacctattagtatgataataaagcctcgatcctggatgtatacaatctctgtacttggaggataacaaaaaaacaaacaaatatctgtgtaaagacctgctctagatttcaatttaatagaaaaatattagcagaaattataaaatgtaagggtaatcagaatgccttcactttaagtccctataaaagttcatttctgtaagtgttaaaagctaatagcttcattttttagcccattgttcctacttactttttgtgttttttccaaaattctaaatttttaaaaatccaaacctaatagcttcaagttattatcatctattactgtccaagacaccgtgagtgcaatgggtccttttatatacagaaaatagtacagttggtagatatgtattaatcaaggttatgaacaaagaaaatgaatgtacaaaaggcatatattaaaacataggtaaatatatacacacatatgtacacaaacacttacatatccaaacttcaatatctggaatgcttttgcctgattatgtacctcctatcccaaaaaatcaaagtagttttataattcaacaatgcattttcctattatgaatacatatttttcctgtcacatgtaatgaattaaattgaaccagtgatgacacactatctggtagtaacacaatgattaaggccctatttaaagttaaaatatattttcctagaacttaacattattaaatcatccatgtttcattaccacaaagtttataacatcataaaagtaacagtgatagcaaaaagaaaatgcataagtgttttccaattttggttgaacctatgtaacttcaaaaaagaaacacacgtatattactatgcaaatgggttcccaaatttttatacattctatttactccattgtagccagcctcagccacataattcacatgcagaactatcaccctttgaactaaatgaattctgctataacggagagctgagacttgaaaaaattgcttacaattgcacatacaagtgaaaaagattgctaagtctaaattaagatgttggctatgaggtttccaataggaccttgacatgactgttgacctactcatgacatgatcgcaccagtacggatttggaattctattagtattaccagaggaaaaaaagtcaaggagtcatcaagaaaacaaatctatatcttctactccatcagccaattactgttgttaaagtggaattagatgggtattgacaatgcgaaggggataaggattaagcagatgactgaatatattgcaagcactggtgatcatattttggctttttagcattgttttgcttttgctgcatagttttttaaaactctaaaataggaatgtgcaaagcagattaattgctaatatcatgcctgaaaaaatacaatttataatatatttgctaattggataatgcacaaatattttcacataagagtgctattttataccagcaaatattcaacagctaagcaaagatttaatagaaacccgcatctgtctataagtacaggaccactggaaagataataaaaggctttaaaaatttccttaccctaatttaagggagaaaattccccaatcaaattttgaaaatgttatcttttcttaaaaagtaagaataatacaactcaactgattataaaaccaaaacacttttattgtgagaggtggcagtatactgtaatatttaagagcatgatctttgactctatggagacctagtttcaattgtggcctctgccactttctatagctttgtgaccttaaggaaattacttaacctatgtcttcatttcccaatctgtaaaactgagatagagtatccaagttatatggtagtgtgaggttaaatgagcatgtttgtgtaaaaactttgcataatatttaattagtattagcttcagctattataaaatgttatctcaatacatccattgaagtcaggcagctattttgtctacagaaaaaattcagttttgttatatagtgaatggaattcctgaggtactaacaggtcaaagtcaagaaacccataaaagtattggttatcaatgccaaagttcaaagtatcatataaaatctggttttacttattattattattattattgttagtttgagatggaattttgctcctgttgcccaggctggagtgcaatggtgcgatctcagctcatcgcaacctccgcctcccaggttcaagcgtttctcctgcttcagccacccgagtagctgggattgcaggaatgcgccaccacccctggctaattttgtatttttagtagagacggggtttctccatgttggtcaggctggtctcgaactcccaacctcaggtgatccgtcctccttggactcccaaagtgctgggattacaggcatgagccactgcatctggcctggttttattttatactgcaaactccacttcatgggggtggggcggggggcggggatcacaaagtaccaggcaaatttgatttaatggctggggggggattaccagtttaaattgcaagtaataccaccaagacacaaaaaggtagttttgttttgttttgttttaaaaagaaatatttctgccactttttaaaaattttaagaccgggtcttgctctattgcccagattgacgggcagtggcatgatcatagctcactacagcctcaaagaactcctaggcccaagggatcctccaggttcaagggatcctcccacctcagcctccctaagtagctgggaatacaggcacatgccaccaggcccgactaattttttaaaattttttgtagagacaggcctcactatgatgcccagggtggtcctgaactcctggattcaagcaattctcccacctcggtatcctaaagagctgagagtacaggcgtcagcctctgtgcttggtccacctattgatgagttcactaagtcctggctgaggtttctggtaccattttctgccttcttttcttacatcaaagtttttacccatttacaaactgtgttttactgactgaataacaccctcatgtccctcttttcacacaatacacgtattttgatattaagcatacttactacatcttttgtcttttaaagtcaagtttgaattaatggcatatcatgacagatatattgatgccagtctaaaatagctaagtaaaatcataatccaatgagtatatcaatgaacttggagtagcatcacttgatgaatcaagactgccagtattttcttcctagtgtgtgaacatagaatgatcgatactctagtacatcccaaagacttgacaactgatattttgagttagtgaaaatatgcaaataaagttttcacttataacatcaaaggtaaatccttcattcagatgtacactttgatactgtggtgaattatgcctaaatcttttcaacccttgttaaatatttccaatgagctgaggtaattttactttgcagtatgattttttaaaaggtgtaacgcacctaaacacacacacaaaaaggatgcaaagaaatacagcttagttttttaacacaaataaaatccaaacaatgatatatcttacaataatgtaagaatacttaaaatacattgctttaaaaaaacagtggcaaagaatggcaagaatctaataaggaaagcgaaggtttgcaatggcaattcattaaagagagtaatcacactaatcaagaaaaaaaagtagagatgcccaaacacagacaagaaaaaaaaaacaataacaaatctaataaatttaacttgccctgccagatctttttaacttattggaaaattcgcttgacttaatattgacacagagatgtgtaaatcaatacattcagaatgaaagatatattttaatttaaaaatgttcaaactgcagcagtaaatctatgcacttagcacataaaaatctttaagagttcaaatgttcagacataacattggggttgaccaacaacctatagatgaatgccaaatcctaaattctgaccaccaaaatacttactttttatgtcacatataaggcaatctttacaatatttactgaaaaatatttataaatactagacaaatggattttcattgagaatccatcaaagcctgcaaccagggcaccacctatctgctgctgataaaaaagtcctacttttatatattatacaactacaggctattgtgatcttaccaaatgaaatgagaaaagtaaaagaaatgaagctatcctttaatctcagtgactgtctatatggtcaaagcctttagctgtgccatccaatatggtagccactagttatatgtggctattaagatacgttcaaagtattaaacacacaaaagattttgcatttactccaagaaaagtacaaaatatgtcataatttttgctacaataattttattgttacatacacacattttcaggataaaaatcaaataattcgtttcacttaggaatgtattatacaaaaaagtgagacttcaacagacaagcacaagaacttactatagttaaaatttatctccttaaatatttttgatgcacaaatttaacttggtataccacaccataaatctaaactatcttgagtttaaatagattggtagtgtcctcactccccgaccttccatggatggtgacacaaaggatgaaacaaaggatggggaaaaagatgtatatgagatgatgtacagaggatgaaacattagtaattatgatgctgatctctagtaagctaacctttcaacttacaaatcaataaaagctaataggtaaacaattttacttctagaaaaacaaatctgtatcaaacaagaagtgcttatatttactaaagtatatatgattatggtgaaaattttccccgttatctcaaaatggcagcaaagagaactgctcacctcctactataatttttctttataattagtgtacagcattaccttcggtaatctcaatcctttcacttttatcatcctcctcctttaaaatctttcctttccccaactatcttctcaagctttgctacttactaagagtgggtcccaggccagcatcatcagcatcttctgggagcccattagaaaggcagaatctcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgttgaacccgggaagcggagcttgcagtgagccgagattgcgccactgcagtccgcagtccagcctgggcgacagagcgagactccgtctcaaaaaaaaaaaaaaaaaaaaagaaaggcagaatctcaagttcctcccacgacttattaaatcagaattgacattttaacaagatccactcccaccagccccaagatccgctgggagattaaatttaagcatctccgctctacacttggtggaaaggatttctagcctcacggtctgtgtctcttgttcttaccctttatatgttttcattggtcctcaggttaataaggttagtaagcatcttaaaaactattgatttcaaaacttccattttacagataaactagaaataaactttaatgcctagcacaagaccttacaagaaaaggcccttaataaaagacaagttggaagacaaaggcaagatgacagagaagttgaagctaaaagaggttaaggatttagacggtttctatagctaattagttgcatggtgaaactgtgtctcatgttgactccaaagatcaatgctcattccaatatacgatgcaaggcaaagccagagttgctgagtcccacctcccccaacttctcactgggatgtacgtaagagagtatgtccttgtgaataggtgaatgtgcacacatgtgaaaacctaggtctgcccagctctggagtgcttcccaagagaacagtgtgaaatattagaagtttaggccaggtgcggtggctcttgcctgtaattctagcactttgggaggctgaggcgggcagatcacgaggtcaggagttcgagaccagcctggccaacatggtgaaaccccatctctactaaaaatacaaaaattagccagctgcagtaatgggcgcctgtgatcccagctacttgggaggctgaggcaggagaattgcttgaacctgggaggcagaggttgcagtgagccaagattgtgccactgcactccagcctgggtgacagagcaagactccgtctggggggaagaaaagaagtttataatttcctgtactatattctttgatcctcttctcttctactaaaaaatacccgtggtcactggtaggtaggaatcaagaagtaaaaagtaaaagtaatatgagacaactttcaaacatagaaacaactagcctgaattgggttgggaattattacttgattatgcaactgttcactctcccctacttcttttcgtctatacacttctgtcaccctcttcctgtgccattccccgctgcatctcttatttaactgtcacagaaaagacaaagttgaaaagttacttgtacaatccttgttgctctttggaataaaaacactacctaaatcctataattattataaataataacttataattcctagtattttaaaatttttaccaggtattttcataaaaattaccttaaagtcatcataacagcatgtcactgtttttgatagtaacagtgattataaaaagatggacaattattggacatgataaatctatttacattttttcaaataatatcatattataaaaattataaaagcagaaaaagttcaggcaataaacccaaaaaaatgactagcaggaaaagcaacaccacaattttacttttaaaaaagcaaagaatccagtattaaagttggtataaaacattgcagtaatgctcaaaagataatgctttaaaataaaagtattgtggtgctaaatataatggattaaattatgtcttatgaaaagaccagaagaaggtgacaggtatataaacaattcacaataaaactagccagcaggtcagtaaacagagagagctttaatgatttgaatatctgatttgatttcttatatatcagtgccttatgcctatttaacatttgacaataaaatatacttaactatgattaacaggagcacctgagattgcagagtttacactacaacagaaatataactactgaaatacaccattcactgtaagaatccgtattacagctaaccttattacaaaagcatttatcagaattttaagtctcctaaactccatcttggataaaatatagtaacaatatggataaatcaaagactactagcacttcataaataattactgcatgtattagattattcctactaacagaatagattaaacagcagatcagatgaagataaaaagagaattaaataactggagcacagaaccgaagatattacctgtaatgtggcacacacaaaaaaacaatgaaatgaaaactaggagaaaagggctaagagacattaagaataaaatgagaaagtgcaacatatgtctgtctaaaaagatagaagactgagtcgggcggggtggctcatgcctgtattcccagcactttgggaggctgaggtgggtggatcatgaggtcaggagtttgagaccagcctggcaaacatggtgaaaccccgtctctactaaaaatacaaaaattagccgggtggtggtggcacgtgcctgtaatcccagctactcaggaggctgaggcaggagagttgcatgaacctgggaggcagaggttgcagtgagccaagattgagccactgcactccagactgggcatcagagcaagactctgtctcaaaaaaaaaaaaaaaaaaaaagatagaagactaataataaacaagaagctatatttggataagggctgaaatctttttttaagaactgattaaagataggaattctcagatacaggaagcacaacataaaaaaaagcaggataaataaatttatgtctgtatattgtggggaaactacaaaatataaaatacatgtatttttttcttaaaagcagctagggaataaaaataaaatacattatttaccattagtggaacagatatctcagagcaagagtgaatgccagaagatagtacaagagtatctttaaaatgttgagaaaaattatttaacccagaattacataccaagaaaattattcattaaaaaaggtaaaacaaagctagtttcagatttaaaaagtgaaattatctgttttagattttcaccaaaagaacttctaagcataatggaagaaaaatgatcctgcaaagaaagactgaaatataagatgaaaggtgagaaagaatctggtaaatcttatagatctaaataaatgctatacattaataataatgtctaatttataggttgacaaaactaaaagactggaaatcaagacaatattttctgttcaaagaggtgtggtcaaaattaatgttcgaggcctcccgcggtggctcacacctgtaatactagtgggaggccgaggcgggcagatcacttgaggtcaggagtttcaaatcagcctggccaacatggtgaaacctcacctctactaaaaaaaaaaaaaaatatatatatatatatatatacacacacacaaaaattagccaggcatgttggcaggcacccgtaatcccagctacttgggaggctgaggcaggagagttgcttgaacccgggaggcggaggttgcagtgagcctagattgcaccattgcactccagcttgggcgaaagagtgagactccatctcaaagaaaacaaaaaacaaaattattgttctaaagtcctagtattatttagaagaggtttaaatattaacagtagatgttaaaagctgttaaacacacacagcaaaatttcaaagacatcagaggcatggaagcaaccagggtagatacctagcttccaaactagtaaaatggaggagaaaattagaacgaaaaagaaaagagagcaacaagtcaatactagaaggaaaaaaaacttttaaaatgttagaaaaataaaagtatggagttgatataaatacatgtccacatatatcagaaatcacaataatctgaaagcattagttatatggtagacaataacatgttagatttttaaaaatccaaccgtatgctgtctacaaaagatatactaaaacaaaaggacccagaaaggtagaaaaaataaaagggtggaaaaaataataccaggaaaatataaactaaagaaagatgagggcagatatgttaatataatgcataatagaccttatataatattaaaagcattattaaaaataaaacaaaagttaaattaaccaggaaggttaatccacttcaaacactagtgtctttaattttgtctgtttgggtactatttataagaatgggatcttacactatgttttcttctacaatttgctttttttttctctcaatgagactcattcatgttaatgtttgcagttatagttcattccactgctgaattccatagtagaaatatatctattattaatatattctaatattaattggtaaaaagtgaaacaagtgacatgaataagaacagcagtgccgggcgcggtggctcacgcctataatcccagcgctttgggaggccgaggcaggcaaatcacgaggtcgagagattgagaccatcctggccaacatggtgaaaccccatctctactaaaaatacaaaaattagctggtgtggtggcacactcctgtagttccagctactcggtaggctgaggcaggagaatcgcttgaacctgggaggcagaggttgtagttagccgagatcacgccactgcactccagcctggtgacagagcaagagtctctctcaaaaaataataacaatataaaaaaagaacagcaggaatgtttgtaatagccagaaacttgtaacaatacagagactcacaagattgcttagagattgcacaaatatgtagcactaaagccatgcattgcttaacaccagggatacattctgagaaaggcatcgttaggcaatgtcacagtcacacacaaacatcgtagagtatacttacacaaacccagatgatatagcctattataactaggctatatggtatagcctattgcttccaggctacaaacctctacagcatgttactgtattgaataatatatgcaactctaacacaatggtatttgtgtacctagacatatctaaatacagaaaatctataataaaaaatatgatataaatggtatacctgtatagggcacttaccatgaatggagcttgcagtactggaagttgctctgggttagtgagtgagggagaggtgagtgaaagtgaaggcctagaacacttctagacactaatgtagactttataaatattgtacacttaagctacactaaatttattttaaaatatcctctttcttcaataataaattaaccttggtttattgtaacttttaactttatcaacctttaaaattcttcactttttgactcttgtaataacacttagcttaaaacatacattgcacagctgtacaaaactattttcttcctttatattcttgttctataagctttcttctattttataccttttttttttaacttttaaaactttttgttaaaaacaagacacaaacacacacattagcccagtcctacacaaggtgagaatcatcaatatcactgtcttcacccccacatcttgtctcactggaaggtcttcaggggcaataacacacatggagctgccatcctgtgataacaacgtcttctggaatacctttcgaaggacctgtctgaggctgttttacggttacatttttgaaggaggatactctaaaatgatgattaaaagtacactatagtaaacatgtaaacctactaatatagttgtttattatcattatcaactattatgtatggtacatacttgtattgtgtatactttgggagcacagtcatttgtttacaccagaatcaccacaaacatgtgactaatgtactgcactgtgaggttacaatgccacgaggtgacaggaatttttcaactccattataatctcatgggatcaccattgtagaaacagttcattcttgactgaaacagtgttatgcagcacatggccgcatacactgtactataaaaaaaacacaaagctataaataaaggcgaggatatgattaacataaaattcttgatagtagttacttctgggagaagaggtgatataatctggaagtataactaagagccttggaactactgatggtgtatggtgcaggggggaagttctgcaactttggatgattttcttaccctaggatcaatttatctcagatagctagttaaaagcagtaaagagatggaaaactaaatttcctgactacaaacaggttcccaacagcatttccaaatgatagttctaaaaacaaaaagcagggtggagggagaagttcctttaggaaatattacaaatcatatttatctgcaaaagttctacttaaaaagcactgaagtcctaaatttcagaaacttacttaaatggctttaatttggtgtttcccagacaaactgtaccactgaacactccttttccttttccatatcctacaaaatgactacttaaaatccgagattaaatttttaaaaattaaatctcaaagtatggaagcctaagatagaaagagactggcaaaattacacagggccttgaaaccagcaggcaaaggagaaccaatgaaaatttttgagcaaacccaaaccaggccaatgaacagaaccagattttagaaagattacagtaagaataatactctgtatgaacagtagtgtgaaattgtgggggtgctaatcacaaggtcactgttagagtttgagaactcataagaaactggactaaaacagaggtagtacagatggaaaggagagatgcaaatttcaccaacaatatagaaagatttttctggatttgtcaactgactagggaggagtaaggaacaaaaaaagaactaaaatattttcagtaggacgactaaaatacataatttagttaaatcttcacagccagcctattaaataggtattatgaaagactcaaaacttaatttttccaaaagcataaaactagtaaatgatgaagctaagaattgagtatttcagttgaatacctcaaaaataaagaatgcattgaacttatctttggatccacagcccaacactgtttcctttacagcaagaataagactttaagctttctagacaggtgactaggagataatggtattagtgtatatggaatatatattatatatggacatatagaaatcagaggtgctaacttgttggtgaagactctatcttcaattccctccctcccttggataatccatccttcatattcttccaggggactgaaaagacagatcaatgaagaaatgagttacaattcttgcagagaacttaaaagcttttctcagaagcataggaaagactcaactgctaagaactggtagcaattacctaattctgatacctggctagcactgtgtccaaccatggtgcctaagaatgcaataaccagtaaggatctacctactgggaagctatttcaatgggaacaattttttcaactacacagctgtgtttttaagcatgattattatgactatcaggatgatctcttcattagaaaggtcgaagtttcttttttattatttaaataaagcactttacctattaaaacttaattgaaccataagacatcatctagtatatgacattctcagaaaaattccagtcatataattaaatgtccttcaaaatgaaatagagtaaaaaataaaataaatagtgcacaaatcttaaactcagtaatactttctttatggttcttgattccttactcagtatcatcattcatgcaaaccaatgtatttaacaactgaaatggaatatagcctcctaaaataatggattctagaaggtaaccattataaactattgtcagctgacatcagtaagaaaaatctaccccctttccccaagggagataacaatttcatggagagaacaagttaaagaaatatcccactattccactatgaacacataaaacattttaaacacaatttattaagcatgtaactaataacagttatgcagtcatctgcttacgtgaactaggctgcaaacaactttaaaaggacattttttaggacattttcatcgaaggaagcaaactgagcaattatgaacaggccatgacagcagaaagaggtgaaaagtgagccttccaggtggggccgatcatttcaacatctaagaaacaattcactcctgtttggtagtattagaggtggcttctcttatatgtgaaagaatgtgggcccatatgtcatgtcaagtcacttaaaatctcccagaggacctgactgctataatggaactgtccaatctccaggcagaccacggcccgcccatccctcccttttctgcttcatgccatcacctcttccttacattcccctctagaagacaccatgctgctttatgacctaagtgcctgctcatgccctcccctctgcccagagtggctaccctgctattcttcacctggataatgactactacttttccaagactgctctcaagttctatctcctagaaaagtaattcctagactgcagagatggtcatttcacttgtaaatatgataaaaatacaaagagtatagacacactgcggtcttttgggtctttggcttgtatcttactgtttaaccaaatctatattacattctttaaaagatccaagagttaactgtacctaaatctaggttttaaaaatggctcctaacacattggatgagatatatttaaatctctaaagataagaaaatgaagagcacacattttccagatcccagggaaaagaatcattaaatctcaagcactagggttttcttcagccagttgtcaaggatcagaaggaaaagcaattgaatgaaataggcactagactcaaacttattgctctattcagtctgctggagtccaccaatacaaacagacagggaaaataatatctttacagtaaaatgcctgaattctcaattaactataatagtgcttctataaccaactctatttgaaaaggagttaaggcaaaactgtgtgtagtgtatttgctagtgaaaacccagaaagttttcactagaagaccaaagagaaactatggtctgtacaacgtcttttttttttttttttgagacagtctcactctgctacccaggctggagtgtagtggcacgatcttggctcattgaaacctccgccccctgggttcaagcaattctcctgcctcatccttcctagtagctgggattacaggcacgcactaccacacctggctaatttttgtgtttttagtagagacaggggtttcactatgttggccaggctggtcttgaacgcctgacctcaagtgatccacccgcctcagcctcccaaagcgctgggattacaggcatgagccactgtgcccggccctgtaccatgtcttttttaaacctcctgcttgctgatcaggaaaacagctcaaaatgcaaccatctcatttcccacattatatactaaacttcacttactcatttaggtcatccacttacccacctatctctaccaccttaaggttgcattaagtacctgcaacatgcaatgctttgtcggaaagaaatgatacatcttttcagcttaggctaagatagggaagatgatatacacaagggaggagtatttgaccaatcaatggtttttctcccttttatggccatcatagcatctaaagaagttttgaatttaaatatattcgaccagggaatgcactttctagtgtgctgatacatcccctaacaccaagctacttcacacatgtatattatctgcctggccactagaaggcatttgaacttcggactcctgagataaatgagtgataatagttcctttacagttacaaagtcctatcacttacactatttcatcttatcttttattattcctattatagggatgagaaacattaagctcaaaggggtgatttctccaaggtcacacagccagtaaatcatggatctgggagaggttattctgcatcagctagagagaattcaggtatgaaaatggaaagataagtagaagcactagtggcaaaggcctagaattgcaagaaaaatagtttatattttattttgtaaatcaaggaaaggcagtaaacaatttaaattagaactcaaaagggtcaccaagatcatattagaatttgaggagacttgatagtggtacaaaagaaagtagaaaagttaactgttaaacagggagaatagctaggctatgtcaacagccaagagactgaaatggaacatatatatatgatgaacatatacatatgcatatatataatggacatatataaatgcatatatatatgatggacatatatatatgaattttgacttctaatttaaattgtgtgtacgtgtgtgtgtgcgtaagactaatggacctgtttaaaaacattcgttttgcttgaaaatagtaaaatttccctggtaattcctaaaagcctagttaaaagcattgacaaaatttctgtctctaggatgaattcacattcagctagaaagattagcaagacagatgaaggagacagacaaaaggaccagaaataactaaaccctggctaatatcttattatgtgagttacttattctgtccaaatcataacttcctcttttgaaaggtgagtatgataaaactgttgtccttcaaaaaactgagttctaaccatgcaaaggtgacaactgtgacattacagttattgttagtctacactattgacagtaatagagaaaaccctaaaccttagcaatacatgaactctgtattaaccaattctataagataactagaagaaatcaccgaaatctattatcagtattttaaaagaaaggcataagcattttagtttatcattttttatttaaagaaacatgatctgatttacttttatatttaatgtgatgggaaaaacaatcaggaagtacacataagtcagattatttttaaagtttttacagctagctaaatgtattaaaacctataatttgttaatgtagaaattaatttggcaagtccaaatgagtaatatattttatattaaagacttcgtatatcaaaaaaaatgaacaagttcacaacttaaagaaagaactattttttgatgaacaagaaagacttggaattaatttctgatctttgccttagaaaatgtatcttttccttgccatgtacgtagcccaaataattaattctactccgtctattctggctacacaagttatattttttaactgctaacttaatcatatggcatcttgtattatagcaactacatcaatttgccaataagttaccagtttgagtcaaattagttaatgtcactttctactttagaattttaattggtataactcaaaaagtataggcttaacaccaagcctcaaaacacgttgatttcaaacacatttttattaaattggtgggaaagtagatggcttctcactttcatttttaaaatttatataatagcacagaggaggtgaaggtatacaaaaatggataccaatatgacttcactatggaatcagtgaaagtacaaaattaaaataacaagaaccagtgttcaccacatgatattgaaaaaatctaatttaagtaacattaaagagtgtaaagaatgggaaatgttcatgaatcatttatcgaatttttaaaactgagcaccacattttgtacatgtagtgttcatggaaaaccaaactgatttcaatcacttagggtacattataaaaacaacctgaacatgtatatttagagattaaaaatcttattaacctggaggttaataagaagatatttctgtaagacatagagatagaatatagcttccttttaatgccacttttgggttactgctatcaacagaaaataaaagcagactcccattctgatcaatatctgaaacctaattcaaatggttctcttctttgtactacttacatggaatgatagtacaaccccaagtatttcagcccacccctgacttttgattcaaaaatggatctatggtaacagtcatctaacaacctcttaagtgcttgttttatgaatctggcccttactcaagaagtttcattgaaaagtcttttaacctccttctgaaaagaatttacaggactgtatttaagttcaagttcaagggtattaaaatgtacaaaggagggtgaaaaaggtgctaggttatagattttaacttcttaactagaaaaatgactcaaaatagattttctaatttacaatgaatcaaaagagaaaacattagaccatagcagaagtggcacaaatgtatcaaaaaccaaatgaataaacatttgaggagatttattattagaaattgcaataaattttggaaagatgaattgattttagttaaaaggtataactgacaatttattgggcgggaagatgcattattttccaattgttatccatctacagtaaaactgatttgtgtcctattgtattttatggaaaaggagagtgcaactttcagtgatttagattaaatgtattaatcataaccaagcactgtgaactatatatctactattaaagaagatttttgacatttaattctgtagcaatattttggctctgtaccactcttcctaaatccaattcctgctacagttggcagatttctcccttttaattttatgaggcttaaagtagcatttaaccacccatgcggtaaataatgcgggattagaaatatttagtgttttgtttccctttcaagagtggtaatccatcaaatccaaaaatgttctctaaaatttttctatgttttcggcaatctgtaatatatggtattgtaaaaaccataaaattaaataaaatgcattacatagctagaatagatctgcttttgtaaagaactgcgttaacctaaaaaagcaggtaaaattcactttcaaccagaagcatgaatccttattgcaaaacaaaacaaaataaaaattaaagattaaaacaggatatttaattagaatcttttaattttgtttcttcaggtaatgaatcttaaggagtatgcaaataatttctaagcagtttaaccatttaatatctatctaaacaagatactgttacaagtattagaataatacagaacaattatttaacatctagatgctctaggtacgtggctaagtgctccataaatgtaaaactaaattttaaactgaatatatcatatgtgatgcatatttgttcccaagaaacacatttaactcataattttttcacacatgtgaggcacgaggcaaaaatgaattgattcatctacaggagctaatatttctaagtataatttagaacagttacaaaacatttttatatttaacatgtgagcttaaaaataattaacaactgctgtttaaaaaaagtatattttattattaaatcaaaataaccaacagaagtaaaactgactttaaacaaaatcaaattccaacttttaaattttaatttatatgaaatgctaattttggttattaatgattccaaattattataataatcacactgtaacttcatgtggtactttgagatatatcaaagtaataaagtaacctgtcaaatgagtaattatctatatttaatctatatataaaacaaatggcccagaaatgagtaaagtctgtaattcactcaagacacagtgatgctatatattcatggttagaacatctaatttcttcatacatattcatatcttaattcactttttaaaaaattcatgattataattgttataaaaataagtttatgtcctcctaaatgaaatcaaggattacttattagaaataagataatctaaaaagaaagtgtttgtgtgtgcacatgtgtgtaaaggtacctttcccatatataaagtgcctgctttgccctccttgtccttcacagtgctacactgtggagctgggagttatacattgggagaaataggatgaaagaaaacgcatccagtcagctagacagctggcacctttaaggagcatgccaaaggaaagtaaaggcatttcagtaacaaacatatgattacagtaagatgttaaggaaagagggtgactctgagattacattcagtcaaggaatgagttagattaattggtatttcctaaaaacagtcaattccaaaagttgagcaagcacagttttgagaagctatatgaggaagaaggattactgaagaaggaacaggtctgatattagtatatatgaaaggggctaatgccaaatatgtggcttgaattaaattatttatttcaatatcatttataattttaaagagtaaactaaggattcaatagtaaaaaaacccttgaatctttcctcaaaaggggaactcaatcaaattttgagacaggcaacattgaaaaattcacaagtaatgtaaatttcaagtctcagtgttttcaaaagtaacattcaaaaaagcaacatcactatagctctagctgaaaatatggaaaaagcgtattattctgagaattttaatttgcaacagaactggagttcagagatctaactgtgatattttctttttttctttttttttttgatggagtctcacttttgttgcccgggctggagtgcaatgctgcgatctcagctcactgcaatctccgcctcctgggttcaagaaattctcctgcctcagcctcccgagtagctgggattacaggcatgtaccaccacgcttggctaatttttgtatttttagtagagaaagggttttgccatgctggccaggctggtctcgaactcctgacttcaagtgttccacgcatctcagcctcccaaagtgctgggattacaagcatgagccaccgcacccggccgatccttcttaatgtaggtaactctttgaaaatctgtttgtgaacccataaaatggatcctataaacgtgctccttagaaaacattaagtgttattcaaatatttactgttgtcactaacctttaaaatatatatataaaaaagaaaactgacaggtaacagaataatttactttttaataaacttgagaaagaaaaaacctacatgtcacagtaaggaccttttaacataacttaaatcaaaagataccaaagaataggagagaaaacattaagtggggtgaagtggtagaagaaagaattgatagaaggaaggatgaagagtatctttacattatgaaaaatgataacattgaaaaataaaacacacttacagttcaaaagatttaatttcataaaccaaactcagaataatgacttgcccagtatattcattaaattgaccaaaatatctggctgagatatattattttagtaggcaattaggtctatccaatttttaaaaaattaattggaaatatatattttacccttacaaggaattctgtatagcttgatggttaagtccttgggaaattggccacagggtagcgttaaaatcctgtgaccttgaacaagtcatttaaggcatttgtccctcagtttcctggtctataagatggagaggagataatattgacctaattaggctttttgtgaacattaaatgatttgatatacataaaaagattagaataacacctggcaattaataagaactcaataaatgttagctattataatgaatagtaatcaaatatttctgcccttttatattagtttaacacaaaagctgatatgaaaaataataatattctataatgaaatattatactgccaaacgaatgaaaatataggtatgatttagaatctctccgccattttttcgaagtgtaaaaagcaaggttaaagtcacagaagctctatttgtacagatgagtatggaagggactgggcatagggaaggacttcctactggatactttctgtctatctgaattttaaaacctgtgtatttattattttaaaataatgataattaaaagaaaagaacactagctaggacttcccaggaaacataacacattgatcatatatttatttcagcttcctcccaaagcccaattaaaatcaatagaataaaaaggtacaactccacaaggacaaagagaataggaataagataccaatagacaaaatatgtcaacaggccaggtgtggtggctcatacccgtaatcccagcactaaggctaaggcgggaggatcacttaaggccaggagttcgagaacagcatggacaacatagcaagacccctgtccctaccaaaaaaaaaaaaattaaagattagctgggcatggtggtcagtgtctatagtactagctactcaggaggctgaggcaggaggatcacttgagcccaggagttccaggctgcagttagctatgagggaactacgggaactactgcactatagcctgggcaacagagtgagactcttgtctcttaaaaaaaaaaaaaacggcaaaatcacagaagatgaaaatcaaacggatgcgaggctgaccgcccagcttcttctatatgcaacagggtggggagagggtggcaataaaaaacaagctgactgaaacaccagactccagaaaagttcacaaattggaggctctagatacctcttaaacaggcaattcatggatagtctattttttaaaaagttgatctccagatcccatttctcagcccatccagtcatatattacaacttctaccctatatcccaccagaagctcaaaactgattatatgaaaatgttaaactagaaaggggtcattcctacaaagctcatgatacccttttactaaaatcaggaaaattcagtgaaagtctgcacaatgaatgctccctgtccttgtttataacaagaatgttggctagtggactccattctatccccaccccaaataacaaaggcatatcgttctctctgcaacttgtcacagggaaatccctacggatagcaacacatacagatcccccaaccaaaaggtctagcaagccctgcatctgcacactaggcatccaatcatgtttttaatgtgctgtcaactgggactgtatatgctatcatttcatgaagcacataaaagggcaaaattaaaacaatgaaaaccttggaaactaatatttttcagaaagaatgttgttacttaaagttacactggcaatataactagtggcggaaaactgcctataaaacatagggtcggtgggcgcagtggctcacatatgtaatccaagcactttggtaggctgaggtgggaggattacttgaaatcaagagtttaagaccagcctggccaacatatcgaaaccctgactctactaaaaatacaaaaaaattagctaagtgtggtggtgcatgcctgtaatcccagctacttgggaggctgaggcacaagaatcacttgaacctgggaactggaggttgcagcaagccaagatcgcactattgcactcaagccggggccacagagccagattctgtcacgaaaacaaaacaaaacaaaaaaccataaggtcatacccggtaaataaccatcaacattaaaaaaaatttttttttttttgagacagagtctcgctctgttgcccaggctggatggagtgcagtggcgcagtcttggttcactgcaacctctgcctcctgggttcaagcaattctcctgcctcagcctcccaagtagctgggattacaggtgcctgccacaggtacctgccaccacacccggctaattttttgtatttttagtagagatggggtttcaccatgttggccaggctcgtctcaaactcctgatctcgtgatccacctgcctcagcctcccaaagtgctgggattacaggcgtgagccactgcttccagcctaaaaaaatattaaacacatacaatgtgctaatagctcccatcgttggagctactgtatgtgctaacaggactcccatcattgggtagacatagttaaagtaagcagatggttaacagtataaaatactaggttatctgtgaattaattaatgagtggcagagacagaagatataatgccatttcagataacagagtgacctcaaaagtgtgaagagttggggaaggttttgaaaaaaaggtacagaattgaactgatacctgaaggacacgaatctagcaggaagaagtgagggatacactgttgtgaacagaggtgtaaaatacacggatatggttgaatatgagaaggctggagaaagagtgggggcactgagaacataacaccatctggaaaggagtgaagtattataggtcataggtgaagagtgaaaatagaaaagaacaaatccgaattttattaagacggtaatggaaactatttcttggcacaggagtgacatgagcataaccacactttagaaatgtttacttgcagttatgtgtgatatggattacaggcaggaaaatcaaaagacagaccagggaggaggctataaaaatgtaaggctatgagatactacaccagggtagtgacagatgaaattgaaaagaaggggctgctatgacagataaagaaataaggctcagacttgtctagatgtggcaagagtggaggcagacaaagataacacatgaaaccaaatgttacactgaaggaccaaaacccacttaggatcaatgcttcccttaacaaatgttaggtctctttctttgctccccttttctcaattaattttcagttaccaaactgtaaggtacttgaggacaaattttgtatccccagccccttgaacaatgaagacatcctaagtcttcatgacatgtgcttacagctgaaccaaaaactttatagttgaaaacacaattaggcaagacatcaagtttctgagtcaaatgtaacatatacttatttattcatctgacaaatgatataaaatacttttgtgaatttttataaagtatttttgtgaattgaaaaattagaagaatttattaaggatatatgtaaatgagataaaatgagatgaaatctaagtaataaacatttagtttttaaagaacagtttctagattgaatacttcaaaatcgattcaaatctaaaacacctcaaaaaaaccaagtagataccattaaatgttactacatagttacatgtcacttaaagataaacactcctgcaagttcagaattgtatggacctggaatacttcagtagtaaactgtctatgaccaaatatgagatttaaatatgaagttctaagaggaagattaatggcacaagtcattactcctttggtatggaaaaaaaataatcaaattgcccccattaagtactggtcagtgtttcagataattgggactgaacaacaaaaattttacaagttttattggcttaaaacatacataagtacctgttggcatctctggtttatcagaatcccctttcctggatgacagtcaacaaataactggttggcatcctctaactatagtaaagaaaactcctatctagatgatttcattatgaattttcagttcttcaaattcaccttcagttggaggacttgcaggtgacttccgtatagaaagtacttgttaaatattatttggaagtgttctacccatcattgattttgaacttttctgatattagatatctgacatatctgaagggaaagtagaaaaccgaaatttatagaccatcagaataattgtatcagaaacataaaagggagaaaaacagagtaggagcttccaagaaagtaaaatgtttgcagcatttctgtttccctgattttgatttttaaaaaataataataatggggactatggcaatgtcatcaccattttaaaagacaactaaaaaaaggtgttgcatcttcatctgtgaagtcaaatggttacaaatcagcagccttaattttgaaagaaagagcattttaaaacaattttcaaaggtttgttaggatacaaaaaagaaaagttttaaaatgatgatcacagtctaagacgtatttttagaaaaccttacatttgcaaattcaatgtttttaaagacattcattaaaaagtccatagatcacatatatctcgaaaacaaaacagtaaaataagccatttctttactaataaaggaatgacttaagaatttgtatgcaaatactaaagtgagaaaaataaaatgcagaaagcatggtatttcatgcatttttaaaaagctaataaaaagactagttgtactgcataatatttaagtagccatgaaagcagaagagtaaactggtaacctctgtagcgaagttcttacatattaaatttcaggacatacattatgatgaaatctaaagggaacatccaaaatgctatataaatatttagcatctgtaaactttctttaaaaaaaatcattcaaaagttacaaagaaacgatacatgtttgaggtgatggacatcgtaattaatctgatttattacatattgcttacgtgtttcaaaatatcacattaccccataaatatgtataattattactgtctcaattaaaaaaataaacataaaggcaaaaaaaaaaattcagaagcattagtagtaaagctgtacctggtaaacaaaagtgccttttttgctattcgcaggcctatccatactgacatttaaaagctttgggcaatctgatcaggaatcaggagagatggctaaaacccatcccaccaacttcttgaatgaacaggtatgaataatgttcattcaataatgaataatgaacacccttgctcctttccccagttgttaaaagggcaattagaagaaaggcactagactgtccaaggctgtccaaggctgaaaattccagcctgcaaatcatattctctccaatcaacttcatatcctataattctctaacacttaccctgcttaattttctccatgtccatttttatttccttattctcctcccaacctccaccaggtttatttttattcattaaaatgtaagcttcaagagatcgtatctaacttgttcatcactaacacccaaggcccagcagtatctgatactggtattacctagtatcaaaaatctttgttaaacgagtggatgtcatgcaagagttgatcagaatatcaggtccagtaaaaatttaagggttcagtctagtccatggatcctacctactgtagaataggcatggatcttagcctcctgatatagtcttaacttgtagttacctaatgtactctctatactgctgcccatgtaatcttttaaaaaacaaatctgataattcttaaccccttggagattacatgggttcaaatgcattcctgtggaccacaacgtccataagcacctaacccatgcccacattttcagccaaaccctccctgctacacaccactccacacaagcatatcttatatctcagtaatactggattcatggtttcctgaataccccatgctttttcaaacttaatccttgaccatgcctttctgtctgccaatttccctccccatcagttggtaagctctaactcattctcaaagtctcagctaaaaagatcaacctcctttaaaaggctttcccagagttttgctaagttacatgagaaaggaggggaaaggaatataagaaatacagaggatataatcacagctgaactaaaatagcaatgtgacagctatgaggcacattgtaaaacaggttggagagataatgagggaccatggaggtcaggcagggagaacaagctgaaacagagcaagcaagcagaccagaaggtgctagaattagatcagcaaaaaggtactatagactacctgagaaacatacaaagggaagaaagggtgaaaatggaggactgggttccagtgattaatctgatagaagcagtaaaacatttcattatcatttttattatggcacacatcttgattgtgcttgccattcaagatacaaagaatgcttgtgagtatttcaaaaataactcacactttgtaaccaggcattttgtgaccaagaaatgaagactactttatgaagagaatttatttatatttattaatattagcaacatgacagaaatataacttccaaatcgtattaattttggcttgtcaaaggaagaacatgtaataaactgtttaagttgtaaacattaatgtatattatagatatgttaataagattaatgaaaaaatatatataaatagcctgtagaaaagtgtctggcacatagtaagtaagcatcattgtgtctaattaccaaaatactaacattcactttgcaaggttccatatttctgaagcatcacaaacccaaatgacaatgaagtctatgaagtcaagccaattcgaagactaagttatcagagaagcaagaaccaatattttaaatatatggaaaaatatgttgtcaattttggtaacattaaaataccaagattgaacacctgtttatatagtttttcctaaagggttttcaagactaaatatggagaatataatacacattaaaatactgttaattaaatgaacaaatatactactgtattggcactatttaaatttgtaaatatctgctcttttaataaagcataatacaataaaaatatcaagacagacatcatttaatagaactgaatgaaaaattattcaagtcatattttcaaataactatggatattaaatttttatgatatcgaatctacagttgtaaatgacatcaaaatagagaatttatttatttatttatttatttttactttttttgagatggagtctcactctgttgcccagactggagtccagtggcatgatctccgctcactgcaacctccacttcctgagtttaagtgattctcctgcttctgcctccctagtagctgggattacaggcacatatcaccatgccctgctaatttttgtatttttagtagagacggggcttcaccatgttggccaggctggtcttgaactcctgaccttaagtgatccatctgccttggcctcccaaagtgctgtgattataggtgtgagccaccgtgcctggcccaaaatagagaattttgaatcaaagagactgtattaaaatgtcttttgtaaaagaaatatttattataattctattaagttgtacctttctaagatacagaatcaagttatctcaaaataagttatttaaaaaagtgtcagtttctggccgggcacagtggctcacgactgtaatcctagtactttgggagggcgaggtggaaggatcacctgaggtcaggagtttgagatcagcctggccaacatggtgaaactccatctctattaaaaatacaaaaattagcagtgcacagtggcacacaaatgtagtctcagttactagggaggctgaagcaggagaatcacttgaacccgggaggcagaggttgcagtgagccaagatcacaccactgcactccaacctgggtgacagactccatctcaaaaaaaaaaaaaaagtatcagtgtctaatgtgaaatctggatcttaaactgattttgaaataagataaaattaatatatagtaatagatcagaatatacatgacatatatttaaaatataacagtttaaaaacactttcttcttgtattctccaaagtatcccaaaatgtcttatggatacaaacatgtatcagttcacaggggttaaaataaagcattgcactagtgaattccactcaaaaaatgttagataatcagtcatggtcaaattacagttgaggacataggctgtattttttaaaatcattttagatttgctttctatcataaaagttttcctttctcttagactatcaagcgcccttatgtaaattaactgcattttaaatggcccttctggcctagtgtgatggatcatgcctgtaatcccagcactttgggaggccgaggccagtggatcacctgaggttaggagttcgagaccagcctagccaacatggcgaaatcctggctctactaaaaatacaaaaattagctggcgtggtggcaggcacctgtagtcccagctactggggaggctgaggcaggagaatcgcctgaccctgggagacaaaggttgcaatgagctgagatctgccactgcactccagccttggcaacagagcaaggctctgtctcaaaataaaataaaataaaataaaataaatggcccttctgctgtaaaaggctataaagtagactaaatattcctactctagtttcctaacaaaagttgagcaagacatacagagtaaatcattacagtatgattgtcattaacaaaatgccactcatgtcatcctggttttctatgacttcacagaagaaaatacaatattctttttctcctatagaatgaattgactcaagattctaaacagatacaaattattgtgttcagggtttttgtatagtgaatgcaaacagtatgcttatttgtacagcatgataaattggattaagagctaatgttcacatttttttcagatttctgaacttgataaacatgtataaatagtcaattaaatcagattcattttctttggcagaataaccaccaataccagcaccaatgtattcttattccaactgtacagaaaagtggactgaggcaattataaagcttttcaacaaattcctatcacaattgtgtaaaatttctatgtaatatttatgttggccttcaacaactgtgttttaagctgagtcatttatttcctgatctttcaaaagactacacaatttgaatgcggattttcagtagaccaatgtaacacctgttgtaagaccattaattcaaatcaaaaaagaattttaaaaagctctgacctacaaaaaatactgattttttaggatgcataggaataggatatatcttggctatctggaatgtatgcttacataaggttacttggattcactttataggtcctatatcccacacctgattctggcatcattattctgagaaatattattctgaattgagtttaatgcacaaactatggaaatataagagattcgggctgaatctcctggataatagcctccacatatcccttgaaattaatgaccatttgcttcattctcctaaaagtggggaataagagatgctagttagctgggttttaacaaactggtactttactacgatggcaacagtaattcctctcaacacaaaaatctcaggactctgtttgcatgcacatgagcataattaatttaaaaaatcagataggttaaatagatcaggacccaaatctcctgaacagtataggttcaggaatagctattaggccttctccctccatcatttaagctattcatttagcttaaatgatggagggagaaggcctatgtgctctgtggtcaggagaagagtttagagcagtttctcagtttgcaattaagttttgagatttagtggagtggctgtcaacctaaaatttatttgaaactatgattcacagaccatattaaagaaagaggccagttcaaatataaaagaggtataaaagaaacataaaagaatgccatataaagtgctttaaatattaaatgtaaaggcaaattttatataaaatatgaacaagccagttgcggtgcttcacgcctgtaatcccaacactctgagaggcttgagcccaggagtttgataccagcctggacaacatggcaaaaccccatctctactaaaaatataaaaattagccagacatgttggtgcacgcctgtagaccctgctactcaggaggctggggtgggagcattgcttgagcctgggaggtcacggctgcagtgagccttgattgtgccactgcactccagcctgggcaacagagcaagacccatctcaaaaaaaaagaaataccagaaaagtttaaggtccacaattctgcactttgactcatgatacaaatgttctctaagtcccagctattgtgtttaatatatctaataatagtaacaatcatttatttaatatatattatgcaccagagatggtgctgggcccattatgcatacacaatctcatttaaaaacctgacgacacttatgcaaaagtaagtattgttggtattaaacaaaaggagggaaggaggttcaaaatctaactacaactaaaaagaagaatcagagtgtggattcacaaaggtctgacttcaaaatctataaattttctgcaatatcactttgctctctataaaactaaatacagtcaatctcgttcccattgtggattccatatttttaagtcggcctgcctgctaaaatttatttgttaaccccaaaatcaatactcacaatttctgacttttgtagtcattcagtaacatgtacagagcagtgaaaaatgttgagttgcccgacatacacgtgcattcctaccagaggtcagtcaggtgactttcttcctactcgtttaaactatcatactgtaaacatatgtcccttttgtagtctaaattagtaccagatttttttttgaattgttgtgctttttgtgggtgattattctgttttaaatagccccttgtatagtgctgagaaatgccgtctagtgctcctaagtgcaagaaggctgggatgtgccttatagagaaaagacttgataagctttgttcagccgtaagttatagtgctattggccatgagttcgatgttagtaagtcaacaatatatattaaatgtctctaaacacaaacataaacaaaacaaggttatctattgatcagttggtgaaaatgttgtgaccagaggcttccaggaacctaaccctgtctttcccttaggagccatgattcagtattccctaattcaatgttttcagcaagtgtatagaatacagttatggcaaatagtcagaatcaactataatacaactgaaaactttcccccaaaaaatgtttacattgatatttcagtaaaagattcttcctctgtcatttccttcaaagatactacatcattatatttatgcagtcatcattcatctgcttaagaaaccttttgttggccttctgtttaatgggttgcagctccatgtgttttactttgctcagaaaattaatctctcttaaaaacaatctggctttccagtgtgaaagtttaaggcaattaaatttcacttcttattaccagatgtcatggatactgtgtaaagatgactgttttgtgagattatgatttttaaaactagatattatagttatacataatataaacagcataagcaacaacaacaacaatgaaaacttagcaaatgaaatcagagaaatagcagcacaaattggaactcttacctttcttgcccaagtcagagattttattgaaaaaaaaaaattacagtacttaaaaattcaaacaaggacaattcagggttgaaagaaagaaaacccgaaggagtccattgtcttcagtaaagttttaaatacaaaaaacatagaccagaaaaacagcttatggcctaatgcactagttccatgataaacacacatatatagtatgtctccatcaagtgaaacttcatcacctttttacaatttagagagggaaagcagcttttagtatggttaagccatgtatcatcaataccatgaagctagcctatcagttgtaatagcttctataaaataccacagtgagattgcaataagcctagaaaatgggctacaaatcccagctatgctcaagcaagcagtgaaccaaaaataaaaataggtaaaactgaaccaagaactagatagcattcatctagattcatgattgataaggcaaagttcataggccaaggttttaaagtgacttattcagatctaaaagacagtcattatacaaaataaaacaaaagcatttatgtaattcagaaaaaaaacatgaattttcactccaaagacatagcacagaaaagcttacttacaattaccaacaccacactattgtacctttaaatatgcaaaggtaaagagactcaaagttgcattttaccatttttaatctctccaaattagacaagcaatctaaaagaagatgtcacacattcctgtttaatgcatttgctgaaatctttcagactttaaaaactttaggtaaaagcaatggcaacttgaagtttcttttccaatcatatttaagttagccattaaatgctgaattaacaattaatccatacaataatataaaaatacacatattaaatcacattgtttttcattattgaagcttaataaaaatatcattttaatataaccattttgaagaactcaaatggctgaacttattatagtgtctaaattataccatcaatagaaacattacattttccccccagttggtgaaaatgagctcatgcaagtatttctgacactcacagtgacacatatggtctgccattctaaagatgtacaagcagctctcacttttaaacatgacaatatgattcagaatcacacagcatttgttaaaaataccagctttcacatgtttcattaagctctaaaccaaaataataattttgatgtgtttcaggtatcagacaaagcagataatttaaaaggtaaatgattctactagtgcagactagttatcactgtggctaatttaaaacgaggatgatttttgcagtacaatgaaagctatactataaaatacaatgagtttgcaatacaagcagattacccaagtagaaaggaagctgaacaaaatacaaactccagcaaagattatcaaccttacctactactcatcttagcccttgttaaaataccctgagtaaaatgcaaatattttaaataatgctggttatataagacttctctaaaaatgaaccataaatgtcaatgcatcatgatttttatttacaacagtcagatatgtaaaaattaattcttaatcagtcacaatataaacattaaggaatacttgtcgatctggaagtttaaaattttctagctttgttagcattttggcaaagcaagtatacataaatggattcaatgtaaaaaaaaaaccataaaagagaaaaatatataatttacagtagtttctatccaccctgggccaacctaaatccctagaaagcctccccagtcaggttcacttctgactaaaaggaagaataccagtcctccagcaaaaacagccccatcttttcatcaaagaggctctcacttcaatgatattcctccagggaagaggacaggagccaggttccctcgaatgtcattccccagatgttcaaaacgtaactaatttattagcattagaagatttggtttataggggaatctcactggtccagtttgtagcctacaaaaaaatggattatttttaagtttaacattagaatatgaataaaggatgaggatgtggctttttattccatagaaatggaaacatttccaaacatgacaattacacagaaaaagtatgcctaccattgaagttggagtccctccagattttttaatattctttgaagacattccatgaaggcgactgagtctagcttggaaacctgtaaaatcaaagtactcaatttagaagttttctatgatcactgaagcatagaagaagaagaggatcctatcaatagagaaagaaaagtaagttggtggtggcggtgaatgccacgaatattatttgggaaaatgcaaaactcacacttaaaaaaactgaagcaatgcctagcaaagtactaaggcagtcagcacttaactaaccagtgttcaatcactagagtaataaatacccattttcttttttccgaattaacattcttatcatttcaacattttctcaatgagcctagcaagaaagcaagtcaatttttctaataatttgaaagcatgataaatgtagtagctatattagtggccaatatgtttctttacagcatcttgtgtttacattctctaatttccactttatcttatcctccttgaatgaatattcctagactgaccttaaacccattatatctaccagggagccagtgctactgacctcttctgcttgggtgtgacataaggggaaaagaaccagttaagatactttcaaagacaggatctggtacatttttgtctagctcagtaggatcttccttttcccaccagggcacaactccagtgataccacatgctccacctgattccttttcgtagaaccagtcactctgttcatcatcacctgtgcaaatacaagaaacccccccccaccaaagactcagttttatcatccagttacacaattagtcttgtcaggtaataaaaatacaagatggcagttaaatttgaatttgagatcaatgactaacttttaatataagtattatatacttgcactaaatttttggtggaaatatgtctaagtactgcatgggacatacctgtactaaaaaattatgtgttatttacctacaatttaaatgtaattggggatcctatgttttatttgacaactgcatatacaatctataaggaaaactttttattttataccacagcttcacttaagaaatgttatcttaagactctaagaactgccagcaacaaaaacacaaaatattatgttttagaaccaattttaaaatgtgaaaaacaataataaactggttaatcctttggcaaaaactattagaaaatccatttaagttactaccccttccacgttaagaaaaaacaaaccttaatctgctcctgggaattaaaaagtattaaaactgtggaaccctttctttgcagcagatataggtatataattagcttaatttcatgatttgtatggagtgtaaaaggggaaacaatcatgaacagatgtgactaaatgaaattaatccaattaagctcattaagaaatagttttgaaaaagttgattttaaatgaaaagtgacaataccttagagtttatgaagaaactatattaaataatcgagatgtttttgcccaacaaaacattttttgtctgtgagacaaaaacacagaagacagatggcttttaaaagaaagagacacaggccagtcatggtggctcatgtgtgtaatcccagtgctttgagaggccaaagtgggaggatcatttgaggttaggagttccagaccaacctgggcaagaaagcgagaccctgtctctacaaaaagattaaaaattagccgggcatgatgacatgcacctgtagtcctagctactcgggagtctgaggcaggaggatcccttgagcccagcagtttggggttacagtgagctatgattgcaccaccagccctccagcctggaccacagggcgagaccttgtgttaaaaaaaaaagatagagaaaagaaaagaaaaacagaaagaaacaaacagcatttttaagatgatctgcgattcattaaagtctccttcccttgattatgagaagccaccactaattctggtttctaagagggtcgttgtaattgtcataaacttttccctttacagaaagatatttctgatttctaaaatctcttacaacagacatctttaaaggaaaactaaaaatactcttaagcttcagttgaaaattattttatgagaaatagctatatttcaactaagtcacaatggaaaattaaaggcatttcaaaaattagagtcatcagctcgtttctactggggaattaattaaaaaaatttttcaaaacacacaattaacagcacttagatatcaggacttttactgagctttacattaaaattacacagatcaggtttaagcataagaaaaaacagggcctcacttgaaactgactaccatatatctgaattccaacactattacagaaaaataaagttattttatttttgatgtaatacacaactttattcttcaatagggaaatcaaatagtcattgattaagaacttgctctgaaatcagacagaccaattagaattctagtgtctgtaacatcaggaaagttacttcaactctattagagtcagtttcttcattttaaaaacttgggaatctcaaagggattttaagaattaattaaaaacttaaatgcaaggaaaacacttagcaacgtgaaacatagtaagttcacaataaatgctggcatatcattctaagcctttccatacttatcaaagattgacaggcttgtcaaagtttttttttactttttttcatttcattttatttcataaccaatatcagcatttataatacaatcctgagaaaagatctgtattttaatgagaatttaagtatattatcaggatggttacccttgcatttagccccagcattctaacatatttcagcaaagtatcaactttaaagtccatggtctttcaaacagttatgtacctattcatttaggacaaatagtttacaagcaggcaaaaaagaatgatcacttatgttttttgtactgccaaaaggatgaacagactaagaaaaaaagtataggaggctactttgtccttttcttataacatcattaactaaatttataatttaaaatttatattagtgtttttcacttggaacttactgtcttcctctaatgtattcttaagaaaggaagaaaacatttgtgataggtatctgtatgtatgatttgtatggagcgtaaaagggaaacaatcatgagcaggtgtgactaaatgaaattaatcctattaaggattaatcctgctcccttattaaggtttttttaaatttttcatagcttcaaaatactgccatgttacagactgaagcttctggaagtttcaaagatggaaaacatataagttgcaagacatttctgtttaatggtttacaatattgaattcataaaaatcatctaattacttacaaactggatagaatgaataaatgtcacagctgaataaaaatgacaaatgacttggaaatccacctttatgaatgcttaaacagttttaagtacatctggaattagagaatgagaaccagtttctttcaaacttgctaaaagagagaaaatcaaaaaggtacctagagctttctcaaacaagataatccttccttaatattattagctccacatactagcttttggagataatcaattacttaggtcatgaagacaggacaccctccatagcatataaaaaaccagctacgatactaaatcctagttcactaagtaatatgtgtaaggtaaatggattgcagtcatcaacttatgaaataaccagtaataagctccactttagaatgaagaagtttttccaaagagagaaaaaaatatcatttcagtaccttgtcttccctcatcattggtaaacaatccagcatcagtgctgctgagactgctggaatcactgtaataaggaaaaagaaagaaacagatcaaaagaacaattgatctctcagtcgtaaaattttaaagagacatggcagctcagagatggaacttaagcctgacaaagatctgaaagaaaataagatgattttttttttaatcaaactgctaatatcctggttccattcactacagagcatattatttttggcacataaaaccacaggaatctaatgggaccctgacagtaagccagatgtgactgcaacgagatgctgacacaattgatgcattttatcatgtactttcatcaaatgctcactgctcctttcttacgtcatgcaattcagcttgagcctggaacaccactgctcaataaaatgggaaaagtctcaatcaaaagcaggctaagcctttcctcagcacatgaaatacaaaggactaggatgagattacttttcataaccacatttacaaatattctggagaagacattacttaagaattcacaacaactctattagtttgcaaggaataaaaagtttaaaacggtgataatccattatatcgaagttaaggtcacttttaagcaaaaaaaaaaaaaaaataatattacaaatattaaggagggagtgtgtacatatattcccacagaagctccagagtcaaatctaacatacaaataaaacaaatagcagatatttgaataacataaacaaactgttactattctaatagaagtaatgcttatatgacagtctagtttaaaataccaggagaacaaagtcatataatataatgagaggcttagcttttaaagaaaatttagtgatgttctttaaaaattctcatgtattttatttttactgtaattcttaattttaaccaatcaggaaatcatccctttttttaattaaaatactttttccattaatatgtagaattccataatcttattttttaataaggcatcctaacttgttttaaaatatttaaattgagaagtttaggattaaaattatagatgagatctaaattcacatacattttctgaatataatttgtttctgttcgatttcttaaaaaataaatattaatgaagaatataggaatttcttaagaggcacattcttccaaggagttctgaatttagacctctctctagctttcttccaaattaagtgcatgtacaaagctccctatattgtacaattggtaatgaaaaaatattttctaagagcatcacaaccaaattttcttatttacaaatatatatgctcttctatgcactataatgtgagagtgttaaaatcacctcagaaactatctttctgacatttcgctgtctaaactactattgatactttcctctttcctgtgtgccccccattaacacaactcaaatgaagggtctcatatacacctcaggtcacagttccttttctgaaacccttgaggcaaaatgtatttaaaattctgaattactcaaattttagcaaggtatattctaaaatgcctcggaggagtctgggatagtactccataaaacagattaatatatttcttcaattaaatgaatgaatatccacattaagtacaggtcaaattaaatttggccacaagtgaattagtttttcatagcttttcagagttcagatttgcagacaaagcattatgaattgatgtgctattttttctagaccatgatcttctaatctgaattcagatttacccctctctaatctattctacatacagccaggttcatcttttcaaaataaaacaagttgactaaaagtaatgtgatattctgaaaccaaaaaaggacattaaataacagcaaaggaaattctaataaactatgaactttacttacaaatatatcaattttgtttcattaattgtgagagattaaccatagtaatgtacaatattaacaacaggagaaagtggatttgggatatatgggaatgtgatttacatgaactctctgaactatctttacaacttttctgtaaatttacatctattccaaagaaagtagttgataaactatgcacacacacatacacacacgtgtacattatagaacagtcttctatttaaaaatttaaaattacttcaaaacttgttgaattaaatttagatttcaagactttctatggatgggcctccatctaaattcttcttattcccatctctggtccttttgtttatgttcttttcccagtggtatgcctatctccactctcttccctctccacctgtccaagctcttgaagatataaggaaatcagaattccctctcttccagctctgagtccttaatgatccttgtcctactttgaggtatgttggcatgcatgtatacaacatgtttcttgatttacatttcacctcattggtatctagagttgttccgtgtacattatgtacgtgtttctatgttcaataaatcagaacaagaacttaaatagaaacaagccttttattttcagcagctgacagtcattacggcttatctccaaagacaccctttccttggagattcacctttttagagtgaattttataacacggtatttggatgagaatatattccacatatgctggatgaacaaatatatgtacactaatatcaatcacttgccccaatttgttcaattcctatattttccgtagagtcctctttctcattcatcctcccaaatagtcagtcaacctcccatcgattctaactcttaaaattggtctcaaatactctcaaatacttagttctctctgctatcatatcgtaattcacttcccacttaagcatggattggaggtcaaagataaacaaaataccaaaatacagctataaagatcacactatcttgaaaaaatgtaaatcaacttgagtttcttcactgttaaaaattcttcactgatcccattgactataagatgataaaatccaaactatttaccatagcagatagacctctgagaaatgctttttgctgtaattctgatcccactttattgccggtaaaaacaaagtatgtattttcatttcacaattcatgcctttgcacaagctgctccctctctacctatgaatgccatttccctctcttctcttgacttcctcaattcctgaacaagtcttactacttgctttaaagcacagttcccttagcaagtcttccctcactaatactttccactcagcacatttcattttcatcatttgcttgcctggctatcccagactatgcagctgttgagaacagagtctccattattagtccaggtgccaccagtgaagagtaaattgtagttaatcatcaatgtttgttaaatctgacacacacacacagccccccacactgaagtttctcttatttataaatcaaccccaaggaaatataaagctttttgtagtaggaaagctttggaagtagtcttgaaaacgcttatacttgttaccaaaataccttaaatatttagcaatctttgcacagaaggaatttgcacctaacttttaagtgacaacagaaaatagtttataaataagtttcaaatcagagaaaatatattttttaacatttattcaagagtaaaaacatactctgaaaacgtgtacctgggctgtttgtggactgctaggtagcctgttcatgcctagtagatactcaaatactttttacaatgaaaagaaatgaaaaatgagagtttgatctcatatccattaccagttacatgtcctataaaaaagcagatcaataaaaggagaactaaaaaaaagggggggagcttgcacaatgaatccaaaaagcaggtaatctaattgtaaataatccagaattgagtatgttatatcagctgccacatactctccctcccggtaattgagtcagacaattactttcaagtaaggttgaatggtcttaagtcacaatggcctaatacaaataatacttatttccatataagaatgacaattttcttgcaagaaaaacagataccataaacttttcaaagccctctggaaacttttttttttttttttttttgagatagagtcttgctctgtcgcagtggcacgatcttggatgtctgtaatctccgcctcccaggttcaagcaattctcctgcctcagcctcctgagtagctgggactcggcgcacatcaccacactcggctaatttttctatttttgctagagacggggtttcaccatactggtctggctggtctcaaactcctgacctcaggtgatccaccagcctcagcctaccaaagtgctgggagtaaaggcatgagccgccatgctcagccacaattttttaatgtaagtaatttttacttctttagaaaaattatatgactagcacaccatgtctaataaaaggataattccataaacttttaccaggtcccactcatttacaagcaaaaaaaccccaaaaaaacaaaataaaaaataaaaaccaaataaaagattgatagctcaccacaattcacatgattaaaatgatcccagcccttgggaggccaaggtgggtggatcacttgaggtcaggggttgaagaccagcctggccaacatggtgaaaccccgtctctactaaaaatacaaaaaaaattcgccaggcatggtggtgcacacaggtaatcccagctactccggaggctgaggcaggagaatcacctgaacccaggaagtggaggttgcaatgagctgagatcacacccttgcactccagcctgggaaacagagtgagtctctatctcgaaaaaaaaaaaaagatagcagccctataaattaaaaatcaattactctttctcaggccatatttacagactgtttttttctggctcatagttcagcattcggttttgcggacccatgcctaaaaggaaaaagtgttaatacattctcatttcttgcaagtagcatcacttcatcatttcagtataaaagaaaaatgatcacttaccttttgatgctgtcaaaatagtacttaacaattattgacagattagatttactaccacaggaccattgtttttcctatttttctaatgacaaaaccaggtgtttctagactataaattgggttttaaaattcataagtgatcagaattcctagaaagctccagattttttatgtcaagccacagacatgtcgaagtggtataaacttttgatgttcaagaatcaggatagattaatgaattgtgacactctataaagtaccaaaagctaaaggtctataattaaacatataattatatatccaattctgagttacaaacgtgctgttattcaaaagcacattcttttccactgaaaatccatttcctttcctccttgtagctgaaaattgagtcattataatacaatcaaaagactttgtgtaaatcaaacaagcaattttgctttgtgctaaacatcataaagtataaggaaatataaccatagctaaacagtaatatcactatcattattacaatttataattattttaaaatagaattaattaaaatataaaacattcaaccacaaacactggagataaatatttttatatttagagaatataaaagtcacctttcactcatgagctcatctgagactttttgctcttcacattccattttgtccttattggtctggttcgtttcctcactttctaaaactactccttcatcttggatttttggtccttgtctgattattttcaactttctttttttgactttgttcttggtaaattcttgatactggtaggctctatcactgtccatgtcctgatctctacaaccctcaggtggctgggtcattgtccgtttgttagagatgtcctgtgggagatctactgccatgcgttttacctttctcctcctgcgcagagttctattcccaacattgtccacagcaaaatcagactcatgccatagaggtcttttccctcgaacattattatttaagtttgatgacggcctgcgctttgctactaacatttggtcatcagagtcactgtgatcttttttattattattgtgattctctctatagtccttgcttggttcttctaaactagaatcagagccttcacttaagcagtgaccagtctcccacgggtgatgcacattatacgacctccgttttctccctctccttttccttgcctggcgtttcagagggcaagatatacttcgagaatggtctcctgtttcagcaaatccacctcgagcttgctctgagctctcttccaatgctgagacaaggtcatgaaccagctcctccatggttctactgaaatgccttcattttttagagaaagaaaaaagaaaatagtcagtcttaaccacagtaacctcattttctataacagacaattcattctaaattcgacaaaaattaatgattacaaaatgtttcaaagctaattttcctatccaagatattacagttttaaatattgattcattttaggcctcttcttatataagttcttttattaaacataggaattacttccaagatagaataagcttatgagcaatgaaagatcccagtatttttatatttttctgtataattatggaaaagttctgtttaaatccctatccgctggcccactcctaccccttttctagagccagttttcctacagcagatacagaaagaactttctcagtcccctcttcgcccactaatctctaagtaaaaaaagaaacatgaaatcttctattcaccacgtgccctaaccagtcactgtcatataagaggcagttagaaagacagacaggtagtttcaggattagtaatatacgtgaaagtttaaccaacaccatgcatttatttaggccacactaatctcttaacccagtgaagcacaaactacattcgcattcaaattggagcctcactggtttcaaagggcccatcattacttcattctgaagcaatctcttaggctttccttttttaagagcattaaactatattaccagtatgaaaattatccagtagtcagcaagaataagcataagcattctttgggaatttttataaattatacctgtccttttaaaacccaattcccaaagattttaaattagttggggtgacatacagccaaggtatctggttttattttttaaacatcacaggcaattcagatttgcacccgtcttatgaagaccacaggcaatcatttctaaaatcgagatctagaggcacctagggattgaaatattctcaacagtcatacagagcttctagagcctacagcaggagtaggcttttatgtaactggcctgctagtaaatattctaggctttgcaggccattgggtctcccaaaactactcaacttgccactataatgcaaaaatagccacaagcaatacataaataaatgggtatggctgtgttctaataaagttttatttatagaatcaggttatagctggttatagtttgctgacccatagtctatatagtctctacaatcatgtatagtctccaacagtcaataatttcaggcttttgcaagttccttataacagctttcaacttttgtcgtttcattttaataacctaaaaacaacacacattgtgattcaactggatttgccatttataatgtgatgcatacaaacagcttctaacatttgcgcatttactatttgccaggctcatttctaagtgttttacatatattatttcatttcattctcacacaacaaccctatgaggtgggagatgaaatacacaaaggccgaaagatctctgtcacaatgtgatgcgtctaagtagtggagacaggattcaaactccagcaatcaggttccagagctccaatgttcaccaaactacagccaagatcagctacacgatcccagtggccagtttgtatttttgtttatgattaatttagcaccaggtagtattactgtaatcctcaagacagatttaatatacatctatgtaaaacccaaatgactcgtaggtagctattacatggttttgaatagaaaaaagaagtgaaagacctgaatcaacacaagggacagggtggcatagctggtgaaagtaaactgagctcaaagaaccaaccctgtactggttagtaaaatgtacactgtgagcaactaagtaacatggcattgcggtttggttaatgtgaatttgtattttctagaattatttccatgggcattctgaatgtatttaatataaacaaaaaatctaatgcatacagcttttttaaaaatgtggtgattcaaatatctattttaaataaactctggagggccactgagatttgatttttcctttctaagggtactatatacaactcagggtttttttgtttgtttgagacggagtctcgctctgttacccaggctgaagtgcagtggcatgatctcggctcactgcaacttctgcctcccgggttcaagtgattctcctgccttaacctcccgagtagctgggattacaggcgcacgccaccatgcccggctaatttttgtattttttagtagagacagggtttcactgtgttggccaggctgatctcaaactcctgacttcaagtgatccacccgccacgcttctcagtgctggaattataggcgtgagccaccacgcccagccccacaaatcaggatttagaacattgaatttgattaaaagaactgtgtatcacataggaattagcattcggccaaacaaaacagaggctacaactttgactacactgataagccaagtgaatcttttttctattatctatgttatcaaatgcccttttcccttaaaacaatgaatattttgttcttttcctgtgacattatttaattaaaagaaatatagtctgaaagacctattgtctctgaatataatattgcaccttaaaaaacattcacttgaaaaaaatacactttaacatgtattaaaatcaatatcctctctctctattatctggttctggagtaacttactcttggaagacagttttcttatcaatgggtgaatggccagttcaaaataataaaacatgaaattaactcgatgtatgaatataatatcaaattaaagtcagtttagtttggatattacaatttagtgctttactgcagcacagaacatttatagtactaacattagaaagaggttaacacatctgattcaatccattgtaatctgatactcttcaattaattttgtttaaaaagtattgctgtaaccaatagagtttaataaaatataactgctaatattactaagaatgaaatttcttagtaatagaaatttcattcttagtaatattagcagttatatatgcaaaatttccctagaatctcatgaaaactgtgtcagccttatttgactttatgttgcttctctcaagagaaaataaaacttatttttaggctgggggcggtggctcacgcctgtaatcccagcactttgggaggctaaggcgggcagatcacctgaggtcaggaatttgagaccagcttggccaacatggtgaaaccccatccctactaagaatacaaaaattaggctggcgtgctggtgggtgcctgtaatcctagcgactcgggaggctgaggcagaagaatcacttgaacccaggaggcggaggttgcagtgagctgagatcgcaacattgcactccagcctgggcgaaaagagcaaaactccatctcaaaaaacaaaagaaaaaacaaacaaacaaaaaccatattttaaaaaacactgtaattagcagaatccaatttattccatgatgtcactcaaatatgaatcaactacatattacttttaaaagcttttttgaaaaaatcctataaaaacccagaaaaaatacagacttaacaagtcctactcagagttcaaattatctttttccccttcagtttcaaataactacactctcctccaagtcaataccaaccaaaacccatgctaatgagccagtaatattatagtcaattaacgtcaagctgcttcactaacatccctcagttaaaactggcatcggcagggcacagtgtctcacgcctgtaatcccagcactttgggaggctgaggcggcaggatcacttgagaccaggagttcaagaccagcttggccaacaagctgaaaccccgtctctactaaatatacaaaaattagccatgcacagtggcagatgcctgtaatctcagctactcaggaggctgaggcaggagaatcacttgaaccaggaggcggaggctgtagtgagccaagatcatgccactgtactccagcccgggaggcagagagactcttgtctcctactggcccatcaaaaacaaagtgatcctaagagaccatcacatgaccaacagctcttttatttcctttgccttggcagtttacactgatgcatcagaagaccaatgtattaaaacactttatcctagagatagtttcttaaataagaatttcctattaaaggggaaacctggaaatatagcacttttctatacaaatctgtacttactgaacaaccagttttaaagtttgaattatactaaattcagtgaatgtaccacttaactaatttgagatttttatattcataattgtaagagccatttttcttcatttggaactcatttggaaatgaaatcttctgggaacagttaatattgggtaatatctaagataacaatagttcatcaatagttttattaaaatagtccgaatgaacagaataccccaaaacaaaattatggccccaacatctacataaagttggattttatgaaaggaaatgatttgggcagatgagtactttgttttttcgggtggtattggattatgctgagcaatataaaatgtatgatcaatccaagatttgatatgcaagctttatttaaaaatgttaggccaaaggtcaagtttgtttgtttcgcttcctctaccaaatacccagtaaatgagtgaactattatccttgggttcctgatctattctaataaattcaggctctaataaattcagaaaaaggccttcctaaaagtggaatccgtttaagaataagaccaatcaatgtagaaaacagagtttagtgtttttctttcaaatatttctggttcaaggaagaagaatcaggaagatgctttagtcctaacttattgcttaatctaccctaagaactgggagttgattgatggcccatgagctcttaaatgtcagttagcaatatattaatataagtgggaatagcaagagtgaagaaagccccaaaaacagattccccgagaaataaacagtcaactatttttacaatgactattgctttttgaagcctctgttaccaataattgctattcctaatagtgaaaaataaagtatatatagaaaagttagtcagggaataatttccttgcctagatgctgataaaaactgtgtaacaagaggatatgcatgtgtgtctactaaataaacccaagttcatattaaaaacaaaaactggccggaagcagtgatcatgcctgtaatcccagcattctgggaggtcgaagtgggtggatcacctgaggtcaggcattcaagaccagcctggccaacatggcgaaactccatctctactaaaaaatacaaaaattagctggccgtggtggtgcacacctgtaatcccagctacccgggaggctgaggcaggagaattgctccaacccaggaggcagaggttgcagtgagtcaagatcacgccactgcactccagtttggatgacagagagactctgtctcaaaaaaaaaccttccggatagaactcaaggataactgattatagctattaggtatctaattaaggaagaggaaagtaaatattgtttatcacctagtactgggtaaaactctcatctttacttctctaaaacatggattatcagttcttcaaagttaagtaattttgggaatgcagtgctaaaagtaagttacctggtgttaagtacatctgcttaattggcttacaaaaatgtaagggaataaataatcattaatgtattagtttctgtataaataaaaattcagtgtgtacaaaaacactgtactaacacacagtacatagtcaaggactatgctgctgaatgttataaactactcacaaacttaacacaaagatagtcttgtacttatacgcctccattatcatattagcttttatttaagatagaaaatgttggttggtcctaaaagtatgcagcaaacagctgaaccaagcagattaaaagtaatgcataatagtgtagactatgaaaatgagtgactaaacatgcaaatggtgagccttcaagatgccacatcaaggctaaatgactaatgactttatgactaatttaacaccatacgatccctaagaattatcttaagatttctgctgcttatgggaatttatatatttccctcctcaatgggaatattattcatcaaataagtccttatctcaacctaggaatctattaagagactatgtcttcaattttctccttttatatatatgtgagggagtgggcaggcattatcttaggaaaattatcaataaccctaacactaaatgtcgacacttatgctagtttagaaaatccttgactcacctatttaaattattaatcaaaagtaaattttttctctctttttgaaaaaggtagggtgggatagggaagaattatcttattctgaaacatgtaaatgattaattacaactttacattaatattaggcaataaataggaaacaccattctctagggaaaaaaaaaaggctgggagaaaactacagagaacatgagcttagaaatcaaggctatgaatttggtagctaattccagttatattcattagctataggacattggacaaattacctatcttctgattctgtttattcatcataaaaatctgcataatttctaccttgaaaagatttttctgaggatgagtgggtacttaatgttcaaggtaagttatttcatgtttcaacgacctctacccacaaataagagaaactggtcaccaaaagatcccaaataattctgcttttaagatataaccatactgggaatcttgagggtattatagttaaaggccttcaatctttctgaggtcatgaagcactctgaatgtcgggaaaaggaaggctagcagacatatataaattgctgcatacaatttcagtaagttcatggactccttgaagactctatggagctaaaaaaaaattttaaatcccaaattaaaaaaaattaatgctatgtatctgacctatttccaccttaaaaatatacatatgtaaagttaaaaagattaaataatccttccccgttaaaactggaaaggaagcaaaagctccactaacttgtattcaatcacgggtgctcctggcagcttctactttgtcacctttgttaccataggaactttcaggaagttttctttcctctttaccatggtttgctcaaaatcaaaccgtgaatggctttaagaaaaaaaaagtctaaccctagtttccaaattagtgatttaataaggcaagctcatttattattaaatctgaagaccatgcttctgatttttttgctacttcatttaatgacttcatgagtcattcaaacttttccttacattctaattgctttcaaaatgtaaactattaaaaagctgcctataggaaataaagtcagtttaaaacaaaacaaaaaatttagaatctaataagtaattcattatagctcttgtcaatatgcatatattcaaatgcattaggcaaacagtaagtaggaaatgagtcttatttaatgtttatattaacatacagtaactgttcaataaaaatttactgaacatataacctgaattcctataacaggaatgagaatgaagacaactgaatattaattagaagcatactgcttgacacataacagattttaaaaaataatctgccagatgagcaaaccaatgaatgactaaatgactgaacaaaaaacaaaagaaaaacataatgactaaaacttttagacaatccatattccaaattttctgctacattaacaagccagacactctaggcttttagctaagtaaatgtgaagttaaggaaaaattatcaaagacaacgtaaaggcttccagcttgacataaatatggatgctaagaagctataacaaatttaatgaattacttgaacaaaatcatactgtttattgctttgattcttaattgttgaaacaaaaacctgactcaaacctgccagtatgcaactaagttcaagactaacaaactccaaaaaacaagcaattcaaaaaaatgcacaccatttactatgcagttttctggatttcaataaaatcaaaatacctaataggaatgaaaatgcagaaacaaaagtccagagtcaatatagtttattttaatggcttttttttaagcaaagccacataataaagttaaaaaaaaaaaaaaaagaataccatagttgaatacagaaattatccacatttacccatttggtgcctaaaaattgaaacagcaacgtccacactggagaagttgaaaaagtcaagatgggagctaaataagtcagaaaatccagactggttaacaaatttgggcatctaactgctaggttacatattccttgagatattatatctcattcagacacataggcaacatataaaagtggttaagaattttgggggggtatactggaatcatcctgcaaatatgatacttaggccagttacttaaaccatctttgcttctgtgtcaccttatctaaaatgcaaagaatgatacacctacctcaaaagatttacatgagatgacacatatttgtaaaacctggcacctaattaactgcttagtagcagtattcccagtgggactggaatttattactgggatcaaacatacttatatagtaaatatctgttcaattaatgaagaagaaaattccattaagaaatctggaatttttacattccagatagtcatacagatagtcatacagatagactagaaaataaagatccagttttctggaacatattcattctgacagaacaggaatgactttagaatttcattcaaaaatactaagtgctaccactttgttatactctggtgccataagaaatggtgagttgtatgacaagcgagcctttaaagagaattgaaggaggtttctctcagtacctaaccatgattttaaaggtaaaagaagttgagagaatcaatcacattctgatgtagtcacctaccctacaaatcaatagcaccctaggaagagcagaccaatctacataggacattttgtctccctgacttaaccaagataatgaacagtgaaacattaagacaggtatccttgagagggaactgtggggtgatggacaaatccattatcttgttttgtgtggtgtttacataagtatatgcaattgccaaaactaataaaattaagcctgtaaaaattgtgcatttcattctatgctagttataccattaaaaactggttcatttaaaaaatgctccctacttttctcactggaaaatgtaataatttacaaatagtataatcaaatctatattcactataaaattaactacaggatgatcaggtccaactagaaatattttggataaggtattcttttaacttttcagtgataggtgatggaaaagcaattatctgagatcacagactactagaattcctcatgttctaatttttgcagaatctaggaatgaacacgcaccatttagccacatttctttcacctgttggtcagaactttatgtttgaggattttcaatgggaaattgcttgtttgtgtcactggttgtcttatgttatgtttggaggaaaagggcttgggagaaaaacaggacagataatacagagtgttcaactagaaatccccaaatcaggattctagctctaggattaaaatgtacagggcaactttggacacggtacttgaattttctgtgcttgtgatattctgctatcacaaggctgtcataggataaagtgtattaatttgtggaaatactttgaaaagtcaaagcaatatattattctaacatgataccatagacatagtcaagccccaaacttaatcctgacagttataggttcttggaaagcccccatacatatctcactttaacttgaatagaatgttcaagagggtggaaacaggtaggttaccctctctctttaaaaaagggggtgagagggtgatgtgttttccacgattgaacttccagaactctagatttctggaatttatcttccaaaagacttggtataatctggtaaatattgaaagaggagtggggaataaggcccggattaagataaattcttcctgtccctagtgttgtcaacaatcaatgaggagatgaattgctcctggagtacaggaagcttgacttctaaaatattgttaaacaagcaatcagaaaacatttactgtattctttcacaaatctttggcacacacccaagagctccctcaaactgcgtgcatcccaggaatgagtgagagcaaggcctagatgtcttcagatcatccatcacagctccctcccgcctccattccaggtccagcggagcggcctcgggcaatcacacccttccctgacctccccctccccagggccgccagcctcaccagctgttcccggctgctggagctccgatcggttggcgcccggcggccccgaacattaacgacacccgggagcctggcctcgaagctcaggcccgtgaacagactccaactacaacagcaccggcgacttccaaagagcagttcagcatttt

SEQ ID NO: 200 - DNA, 41961 bp, Homo sapiens
ccggtcttatgatccggcggatcctcctggggaggccgggccggggagagggcgcgggcgccgagtggcgggggcagcgggcgggcgcggcgaccggggccggggcggggatccgggcggcgaccgcggcggcggcagcgccccgggcccgccgccccctcccctcctgcgaggggagccgctgcatggggccgggggggcggccctgcggcgcggagcggcggcgacggcggcggaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcaggtaagcctcggaactgctgactaaggggccgctccccgggccgggaactttggagcaactttggcggagccccctcgccgcctccccagagcgcactcctctcccctcccccgccgcgccctctgccaggcggccggccccacccccgaagcttcgctcctggcaacccctcgcccgctgatccaccccctctcccacccgccccctacgcggctcctgctccccgcacttcctacccctcggcgccctgggccgtcctccttgaccttcccacatcccctttcctactgccccaaggccccgggggaaatattcgaggggaccgagcgagacgtggctacgggacttgggagaagggggtggacggctggggaccacatcacaccccggccctttgccggttcacagtgagctggccgcacgggaaaagggggtgacatctcgcggggagcgcccccacgcctctagctgggttgggagaggagggtccgggtggggagcgaaattgccccagagcccaggtcactgtgagcttctctccccgcccccacttctgtccttgcagtcagcgtcaccgtggggggcaagcagtacctcctaggactctatgacacggccggacaggtgagtgtcttggcctctggccgacgcccccctcctgttccccagttctttgtggctgcgaagggcctttggaaaccgaggtgtctaggtgggagggtgtgtctgcgacgggcttcccctggattaggtctttatttcttgtaacaagtcagcaaattaggaaaacaaacaaaacaaacagagccggataagccccccccatgtgaacccctgggctgtgaaagtttttgcctgtgtgggtcgttctgtgtggcgcctggtgtgtgggtcccaactcctgttgcaaagtggcagcagccaatcatgaagcgcccttatttttagttgcagatgaccaggtctcccccccacagcctctgtctggtccctcattggtgagtggtctgcctgcccaaggagcctgattggtgggaaatggcatcatctaatatgatgggaaggcatttggtcctggttatgtttattacaacatcattgcactctgggactccagtccctgaaaacgtaatttgtggtgttaccaaaggaccacagggaaaaaagaaaagaaacaacaaccatgtagccactccctggggtggggaggaagggttaggagtttagagtgaatcttggaggaggaggggttccccccggccctacttcagaagggccaggtgactttgtctgggttttctttgggagagattaattgtgcagaaagaagatgcacactttgccctgcagcctctggccagggtttgcacatcagaggtggccaggctgtgcttctaaagggccaaggtcttctctctgtctccctgtcccagcttcagcctcttcccaaacccacttttgctctggggataagttgtgtgtgatgaattttgtagaatccagcactatgattagagttgaagactctggcagaagtttccacatgtcatacagacttacatccttgagaacacaggagcagctgaaagtcttagagaatgtctttgggggaagtccagtagtagaatttccttatctgcaaaatggggtttaaaaaaataagatgatcccctggtgcagatattgtatggcaaatgtttagcattgaacctggcacacactaggtgctcaataaagggagtgatgtactttgaagcttgtctagatttggatttcagaactgtgattagagtttaggttggattctgaaacatgccttattgagggggagtgccttgatgtgacctctggtttctaaactgttagaggaacgtctgaagatagagaactgctggcagttcaaggtccctgagaccaccccctttcaccaaaatggcccaggtcagtacagccagttctcagctctcctgggcccccattggttgcctgccctgtagtcgttattccttctaccttcattggaggatgtggagggcaaggggcagagcttgctcaatcaactaagactgacttttaagtcgtattattgataaacaagaggttgaccttattggttgaaaagaggaagcttttaaaaaatcgcctctaatttgaacttctcactaccttcctttctcttatctcctttacttgtgaccatgataatttttgaccgcactccctgttcaacaggatgtgtgtagtcagagctgttctgagtatgtttaaaccctgctagtatttactgagttttttcctacatatggggccagaggcagacacatgcaaatattattttatttagtccataaaacaaccccatgagataggtggtatttcatctttgcggtgaggaaacaggctcagagaagctaggttgcttgcctgaggtcacacagctactgaggggtgttgctaggattgggacaggggtctgaatctgctccagtttgaagtagttatacacacaggacaccatgggaatgctgagatgccacggggttgattggattgtttgtgcatccatagttgtggtacctgtaatcttcacagccattctctgagtgggtgttggatggcacctctacagaggagagaacttagatccagagtcacttgaagttgaccccacttacaaaaccagggctttccatatatggccgtaattactctttttagtggaggatcataagatatagaccaagcaggatgaacatattagtaaggctcaaatactactgttttcacccaatgctggacaccattggtggggcctagatgtgtgttaggccccattggtgtttttcccagtgtctagacttttgtttttgcatcaaagctagtaatatttcatctcccagcatttgagggtttattactaataagcaacttagcaatgatgagaccaaatggcaagtgcctgctgtgtacctggtactatgtccaggtacttttgcacctggggagtgcaaaggaatgaatttaaaatggggatctaccacagctgatgtcagcaaagggagaaatgtctgtctcgggtctctgttcatgtgttacataggagatctctacattgcacttggtcattaagacctcaggcttctaggaatccatatcagatttgtcttacaataataacaatgataaataaacatgtaaataaaaagtaaataaaaaacattaagggtttatatatatatatatgtatccgtatacacatatacatatatatatatatatatatatgtgtatatatatatatatatatatatatatatatatatgtatatacatatatatatatacacaaatccttaagcctagtgggcagcagagaaaggtccatgggctttggaacaaaacaggcctgggctcagatctccaccttagctagtcatgtgattctagctaaattatttacctttgtgatctagtaaaaacgtgaataattagaatctgcattacaaggtcataggctggcttaaactctttaacatatttaaaagcagctgatactttgtgcatagtgggtgagtgacaaatagtacaggaaattattatattccactatggggagttttgtggggagaaaggttcacagagtggaagagaacagtatattgtgcctggagttgatagaaattccactagaatgccagatcctagaaccttttcaaccaaggtgtgcaacagctttgcgcattgtaattcccatagtccctattgtgggatccatggttccaagcccagtgctccctgccgtaaatgccctgttgtatcagatggttttctgtcttaagcagagcccgtatccccattgatagaagagaaatagcttagagttccatgcagaatttgacagacaagtagggtatgtaggcttcagttggttctactttcagagagttaagatggaatgaggcagctcatggcactacaggtcagttgccttctctccaaaatgttcactcatgcatgtgggcactcattgtatttgaataacagcaacagtgcctccctcagtttggaacctctagtccacttgctcactcatggtccctgccttaaccccagtcaagttcaaagccataggcatcatttgtccgactgacatattagggcatctaccagtcaaagggtgattgttgtagatgacctttggccttctagagcaggctgctttccacttgacctctgctgctattagcagacaaagagagagaatgggagagagagtgtattggacttcagtccccatcatgtgcactgcctggggacatcccagcacactcagagcaccactgccaaagggaacacttcccctctgttggccaagcccatgggtggtccaggagcagctgtcacattttgactgccaagcattttggagtggaagttgaccgaggcatcttccttctcactaggggccttgcgtgtgttttgggggtgaggggttggcttcctgcctgggcctctgtggagcttctcctttcttgcccagccttcaggacttcagtgtaggctctgcagcaaccccattgtctgctcaaggagggactggagagatgggattttccctcctgctactgcactgtttggagcgatgggaagtggaaagagctctccctctctgtccagacaggccagtggggagctgcctggcaagctgctctctagctgtgggctctaggctgatctcttaatccttggcaggaaggcagaacttgataccctggagagggaaggactgaagcccagtttattcaggtcccagaatatccacactcaggaggatgtgtgttgggggtgaatttgggatccctagagttccagatttagccactgtctcagtgtgtggaagtcaatttgtgtgctttgggatgtattgtttctatgtctgttaacttaaacacacaagttcagggaagcgtccatgacagctataaatatcttttactctggtgtcccttggtgttgctttttcaatgacaagtgagatttgttttacacttgatataacccagcagctgtggctgccctgcatgccctctgggtgcccacaaggcacttcccctacagaagggaatctccaccggaggcaggcttggcatgccccaccttctgcattttagcagaagggcctggcatgatgagaaaagggaaggagaaagggccatgggatcaccactcaccaggctcctcccacctccaggcaagtcatcctcacaacacccttcaaggtagacttctcccagatgaggaaattgggaacaagtgggcttatgggaaccagacagagatgtgattaggaaaaaggttttctactttggagaaggcctgcagggaacattagtagggtttaggaaatgccactcacaacatcagactctgggtccttgtagccccgtgttccatccttgctcagcccggtgagcagagcctgggaggagccccagggttccttccaggcatcagctgcaacaggtgagatgctggcactgagcatcctggtttcccttagtaacctactgtagatttgtcatgtgtgcattttgctaacctttttagaagctatttatatctctagcccacaccgcatcacacgggaatgctggtttcctcctctgcgttgggaaggtggatagcctttgttgactccaaagcctttgctgtgttcgctccaaagtctgaatgccctgtgttcccctccttgggactctgatgtgggtttgggttatgccagcttagactgtgggctggcaggcagggactttagggtgggggcagtccccaccagctctcgttggtctacaattatgcctcataatcgggcacataatctgtgccccatccccatcctggacctttgatctgtttggcttctccacttccatcatgattctcctgaggtttggtgacattcccacgctttgaacgacagcttccccgcaggtatctcaagcatgagtgttacaggtgtgctgagatgccaagctctcatctctgaggggccgggggagtgacagcctaagggggttgagcatgtattgtcagttgctgtgggtgctgtgatgtgaaaaaggtgggaagcattgctttaagcccctcggggtcagaggccccatggagaattgggcttttgcggttttgttgtgcagtttggggtttcaagagattagatctaatggtatgaaaacaaagccaacaaagtagctctccacgggggtgtccgtttccagaaagagcacatgtgttggcagctgtgggtgctacagaggcctcagacacaacagcaatgcttcagcaggagagggacgcagttacaaagaaacaagatggaagaccatgtgtggctcttaaaaattaaaattcctgattctcagctgtatttcctttctctctgacaggcttggctttgccctaatttggcacacttgggtcagagagcagctttccttgccctcagcaatttgtcattcctcttttggtttctgagcacagctgctttgcatgtacggaggctgggctgtctgagctctcaggggtcccccggctccctgggtagaacgctctcctgcccagtgccggccaggacctcctggatgcgttcttgctctcttcaagaacagtgtctttctctaccatgttgcagtgctcagcccagtgcctgctaccttgtaggcatgcaacaaatacatcttaaggggattcatggccaggcagggtggcatgttcttgtctgtaatctcagtactttgggaggccaaggctggaggatcatttgaggtcaggagttcaagacgagcctggacaacacaacaagacccccaattctactaaatttttttttttaattagccagatgtggtaatgcatgcctctgtagtcccagctactcaggaggctgaggtgggaggatcacttgagtgcaggaattcaaagctgcagtgagctataatacaaggcttcattgcactccagcctaggcattagagcgagaccgtgtttatttaaaaaaaaaaaaaaagaattgattctcatttgactgtcagcttgtttctgctaaaaggttaaccaaggactaaagtcatagctgctaaataatagcatcagcacaaccccttttccaggaaagcttcactaatacagtagaagtctttaaggttcaaaggagaaacaggcacataggtatggggcaggccatcagttttgtctttacacaggcccaggggccttagtgatcaccagtgggtctgtctgtcccccaacactctgtctcagactccggcctttgcatgtttcctgagacctcttgctcccagatcccctgaggaggagacaggttggcagtggaaagagtgtgggttttggagcctccagatgaacttcgaatcctagttctacctctttgtagctgtgagacatcggccagccggctcacttctgtgagcctctcttccttctgtgtgaagtgtggagataatttataccctgcagcatagctgtaaggattagaaatgatgtatgtcgttaccctgtagggcttggtgctgagagtgcgggcccaggctagctctgggggcttcacactggctcagttcggttggtgttgattcaatgcctggtgtgtgttcccaccttccacaggagaaggtgggggatcgggccacagaaaggtccactacacaactgggcaagttcatcgtgtgaaattgagtgctgcagggtcccacacaggaagaggtgacagggaggagctttttggaagatctaggcttgcaggaagagatgggggccagtagagtactggttgccagtgtggacccccacactggactcccagggcccaacttcagctctgccacttcccagcaaggggcttaaccttcggaaacctgtttccttatctgtcagatggagattatgatagtacctccttgtggggttgttagatatgttggagcttcccagctcccagataagggatttcctcagccctcagggcagctgggtagggcctgggacaagccatggctcaggttgtcctagcttgagcagtctcacctcaggcatgcagcagtggctcctctactccacccgatgtgtgctgaacacatcatctcattttctctgtgtgccatgaggtgaagatttgggaagcattgacctaaatgagttccagcaggcagaggggtgtggagagctcatattctgagtgggaagaatagtgtagggaggaacggcagagggggtgaccccaaagcgtctttttatggaccccagatccctgctatcagtgtcaacatgtggagcagggttgataactaaattatggagtttttcacctggtgactgacaacttggtaattaaagagatattaatctggtgctgtgttgctggttgattttaatagaaagaaaagaatgtggggaaaggggtctttattgctgtctctgttcctttttgagtgaatggtgagagcactgaagcagccgcctctccagatccctagattttcctgctctactcaggctcagggtagactgaggggcttaaaagtggcaggctcatcatcaaatgacatttttacagcacataaagcatgtcgcacctggtaccgccttgagttccctcacctgctctgtgagtaaaggaagccagtggtggctgtctcattttgcagatctggggaggttaaatgactcgctccaggccacacggttggtaaaaggcaaagccgagatcaccaggcaggctgtcggactttaagccctgggttcttgatgttaagtcactctccctaatcatctggcccatgttaaatgcctcttttatcacatgcactgttgttcagcgtttcatgtaaaaggtacattccaagcgtatcgcttttctagctagaagagatggtggaacattgtgtataggtggaacacgtagggacggctgctaaaacggctcctacaaagacttctgccccacgtgacgttacgggtgttttgtcactttgtccctaaaccaccatgcttcctcaaaaaggagcaggcccgaggtggcgctgatggccccattgctcaagtacgtgtggaagaagctcatgccatttgcctaaagctgtggccccttcccagaagagagggacagggaaatgctgtttggggggctgccaggcgggccagctttagcctgcaaatgacgggtgtcgtttgtgtcccatgggggctacctcaggcctttcctttctcccttcaaggattttcttattcaggggaagcctacctctgcaaaactgtttgtccctccttcatctgaatattctctaaatatggcgcaaaacttcctctgccacctgctgctcatattgtttgccctcttgggccatccccattgccaccacctctgcatgggctcccaaatcctgcctggctgcttcctgtggtggctggcaagcctagaagagaacattcatccagtcagtcaacatacatttcctgagcaccagatctgggccaggggcaggtgttagaagatctgtcaggcacaggcctggcccccagaggcacagtgttttgaagggtaggtcaaccatgagtggtgggagggcagtggggcctatttattgggggcacagaggaggaaggcttatccttccaaggaggtgaaatgctagtaagagttaagttgagtaaggttgtttccacgaaagttgttttttagctggagaaagtgatcagtttggattcttacacgtactagatgctcagcgaggccttgaatggtggcactggttctcaaagtgtgatcctcaaaccaacatggatttcctgggaacttgttagacatccaaattcttaggctctatcccaaatcctctgaatgaaaaactaagaaatctcttttataaaagcccttcaggtgattgtgacgcaggctaaactttcagagtcactgaattaatgactgtgcacttctgtacctgctctttgcaacccatctccaccccctgccccctccctccctaccacatccaccgctgtcttacatacacactgtccctggagtgcagagaacatgacttattttattcttttttttattttttcaatttttaaaaaaatgttgtgggtgtatagtaggcgtaaacatttgtggggcacatgaaatgtttagatacaggcatgcaatgtgaaataagcacatcatggagaatagggtatccatcccctcaagcagttactctttgtgctacaaacaatccaattacagtctttgagttatttttaaatgtacagttgcattattattgactatagtcaccctgttgtgccatcaaatagtgtcatgtctttttcgaacttttttttttttttgagacagagtctcgctctatcgcccaggctggagtgcagtggcacggtcttggctcactcaacctccacctcctgggttcaagcaattctcctgtctcagcctcccaagtagctgggactacaggtgcccgccaccatgcccagctaattttggtattttagtagagacagggtttcaccatattggccaggctggtcccgaacttctgaccttgtgatccgcccacttcagcctcccaaagtgctgggattacaggcgtgagccaccgtgcctggccctaactatttttttgtacccattaaccatccctacctcccgccaaacccccaactacacatcccagcctctggtacccatccttctactccctatgtccatgagttcaattgttttgatttttaagatcctacaaataagtgagaatacgtgatgtttgtctttctgttgctggcttattttacttaatcatctccagttctatccatgttgttgcaaatgacaggatctcattgtgtgtgtgtgttttttttttttaatttataaatttttaaacccccagccccacaaaacacacccccatataccctcatttctagttctttacacatggttgagattatccgtaattactggaatgaattgaatgattcagccatgggtgctccctatccagttcacctggtggagaagggccgcagtgctatcaggagaaaaaaaatggaagcagaattttttgtggggtgccttggctccattagtgtgctatgtggcctagggctgtgcgcccagtaggctctgcaggtatttcttgatgcggcctaaacaccaagctatttctctcccgcatattaaggggctcgatagacaggacgcctggacagggctctgttcattgtggctgaggttagcactcctctgggtggtgacagaccctgtccctgagaaggatggcagcttggtttgtgctaaattagttccaaagcatcagatgggcaatgacgtcctttctgtgttaacattccccaggcgggtcacaaggagtggctgaagggagaggaagggctgtgttactcaaacacccatcttgccagtaattacttctttcctggctgacctctgctttctgtgcaagtgttctcccctccctttattctcctgcgcctgctcttttacatttttttctttctttctttttttttttttttcaaatttgttccaatctagaaaacccatcctctttcaaatggcataatggttgggattataaatgagttggctcaaagtgtgccccctctaggagcagccactgagagagcatttaattttgagcatccagttcaattaaaattccatttaatccagcttacttttcacagagttgtcttccccagtgagctgattacctggaggtgtttccaccagcctccttggccctggaggaatggggaagggactggacacgaggagggacagagcaggcagatgggggctctgcttccttcggacagggacttcgtccaacaggcgagagctttgggtattcatccactgcagaaagtgagaagtccaactgaggctgaggcaccccatgacctcctcacctctgactccggccctctagtggtcgagtccctccttagaatttccactaagtgaattgtctccaggctgcactctagcatttggttttattcatgtgtaaatctttgctccccatgcagattgtaaactcttccccttgccgtccctgcaggactgcacgtagcacatagcactttgcacaagtgttgggggccccagtaggaactaggtgtgtgttaaatttaggggagtctggtggtaagattattatggaaagaacctttcccatcactttatatcatatccatattggctttcctatcagctcatttgagaggaaattctgacctgtctggacattattgagtggctttaaagcaggttataggtggcgatttgaatacattgaccatttaagcaaagtgggactcatttctggactcacagagctcattaagcagacaggctgccaggtctgtttggatgaaatactggctatgcgcatgtactgttctccagcaagtctagacctgtaggagtccttcactgggctttatgtcaggtgtgcttccagagtggcctgtggccctctgtgataagtcggtaggagggggacatggtgaggatgctgacctgctcacttgtgtcttgactgggagaccggaatgcctcctgttgtctgaacaagctagtatggaagtagcatctaggcaagctggtgttaagacgcaagtaattactcagagaaattgctggtgtgtcaaactgcttgatatgtaagtttcctcctctttcctttgttttattttttgaggcataattcagagaacactttcatcaccccagaacgaaaccccatacccaccgacagtcactccccaccattcctcctcccccgtctcctggcaaccactaatctgtctttctgtttctatggatttacctattctggacatttcatattaatggaatcctgcaatgtttgccctttgtgtctggcttctttcacttagcataacgttttctaaggttcatccatgttgtagaaggtatcaacattccattcctttttatggctctgtgatctttctctttccattttattcctgcccccgctctttttcagttgttcttccatggccattctttcccgggctctggggactattttcagggtttcaaggtacaaagtgaagttctgctagttgtgcacttgtggtgctgccttcgcccctggctcaggtagaggcgagggctgatctcttctctacccttctgatattctttttcttaaaaaatttttttaatttttttttttttgttccttttaatgcttgggtctggaccttccagtgttcttgttttctctgtgcctctgttcatatactctcccaccccaaccacaccctaatagctttatttatcaaacatataaatatccattaaacataagagtgaggtgaggaacacaaaattccatccgatcgggttcttcccccgtaggagtttacagtccagttggaagatgaatagagctggccagaatgcaagtagaaaatgggatgtgcatataaatcatgaaatgtgagtgaggagtgttagaaaggtgcccaactacccggctgtttgacctgagcttcccagataggcaaggtttctgtggggccgtttagattcagaaacaattttattggggctttcaaggaccatcaggtacatgggtctgatttatgttaactcgtaagagatcagcctataaatgaggttgccaaagagttaatctaccatgtagccccagtggaaaaatggacaagacataaaccaatagctcacaagagaagaaaaacaaatagccaatgaaaacacactctgtaaagacatgtgaataaaaactttgtttttcaacctatcaagttgaaaaggagaaaggaaagtaaatactctctgccccatttttgggaatgaaaactgaaacaaccagtttggaggttaatttgccaaagactctttggtttgcagtgatctgattttatgaatttatgcctagaaaacattcagtgtacccagagatttacataaaatgatattcttcacaatgttatttataatagtgataaattataaacacattgatgcatagtaaaaagggagttgctaaatcacagaatgatttatattagaataatcacagccattaaaaactgccttcaacaaatatttaaagaaatgtgaaaaggctaatgatgtgttaagtgtgaaaaagcaggaatcaaaaccatatatatatgtatagtatgattaaaactttaaagaaaatgcacatgtataatatgcagaggaaaaatcagaacaaaatagtcaaaatgttaaagtggttggttctaggtggtgaccatgaataattttagaaatttacttctttatactttattgtgttccctaatttttttaaaaaaactcatttttatcaaacttctatatgcagatggtttaaagagtcagcagttctggaaggagttattatgaagaaataaaatattcctctttacttctcctgcagaaaagacatttcccactaccctgagacaaccactttcaactctgctgtttattttgataacaaatattctctgttgaattcacatgatgactgatgaggcctgagctccctttcacacatatcttccacttcctatccacctttctgtaggagctatattgtaatttcagtttgaccactgatcagtgtttatatttttatgactattcacagctgagccatgtagtgtactatgattatattttttttcttgtaccactttctgtttctcaagtgaacaattatcttgttgcttctcttacttggttttcactgtatgtctcagctatttcatgcaaaattcaccctcccatgcagcaagtcatatcaagtattctgtcagtttcttcttttgcagccatccctcctgcaccttctaacctgctgtagctgggctggtgcctcttgcctgctgcacagctgttatcctgggatttcccttcaggtttattaggattctctttgcctctatctcttgtattagatccctgtttccaggatctcaggtcttactggtttatttcctcactttggtggaatgtatattttattagtttcctgagaaaagagtcattgtaggcaacttttgggatacctagtatgtttgaaaatgtttttattccttcataccggactgatactttgaaaatagattatattttttctccctttggaatttttaaggcattgtcccattgtctttcagcttctatttaagttgtttagaagtcccctgccaacctgatccctgatccattgtcaggaacccatttttcctctctgaaacttaggatctgccattttaacctcctgaaatttcacaatcataggctttggggtagggcctggctgggtacccacaatctggaaactcatatcttccagttctaacaaattttcctggattatttctttggtttatttagtttcagtcagtctcttttgttaccctggaacttccactattcagatgctggagttgctggaatgatcctctaattatcttacatttcctttctgtcttttttctttattttggggagaaatagaaacttcctcaagtttatcatctaccccttctattctgtttttgaaatgtgattctatttttaaagtgccttttcctgttgtctggatgttctttttttctttagcatcttctaagcggtttaggttttgttttgttttgtttgagacaggctctcactctgttgcccaggctggagtgcagtggtgtgatctaggctcactgcaacctccacctcccaggttcaagtgatcctcccacctcagcttcctgagtagttgggactatagctgcatgccaccacttctggctagttttttgtttgtttgtttctttggtttctttttgttgttgttgttgttgttgtttggtagagaggaagttttgccatgttgtccaagctggtcttgaactcctgtgctcaagtgatccacctgcctcggcctctcaaagttttggaattataggcatgagccactgtacctgtctagtttgttttttgatggtatatcatctctgatttctctgaggatattaatgatagtgtttcaaattttttgtctctctgtgtaatctctaattttgatctctttcaggtagttcctcaaatgtctatctgtgtttacaagagtggcattgagcacatgagaaagcatgtatgggcagggctggttgactctgagcttccctgttggtcagggtttctcagcttcagtactgttgacattgaaggctggattgtttgttgtgggggggctgtcttgtgcactgtaggttgtttagcagcatccccagccttttccccctagatgccagcagcatccctcctccattgatggcaaacagaaatgtctccagatattgccagatgttctcctggggcaacaccagtcctcacttaccccacccccagttgagaaccactgttgtagggtgatctgttggggtctttttattggggaacctgtagggttagtaggtattggtcttcccccttgggctagtcatataaaccaggaaagaatcttctactcttctgcccgagggattcatcctgggaggcgagtgaaagaagcagagtgttggaggggggtctcaattttctttgtaccgtggccttgtgtgcttcgactgggcctggtgtctcccattcgggaagcctagttctgcccttaccagagaataagtatcatctgcctttcaccaggattggggagcatttatcatgatagggaaggggaaaaggtattaaaaagcaaactcgttccaccctcttgcttgtggctccgcgttcagtccagctgcagaagcaggcgctcttctggttcccatagcttcagaccctcagggaggtctgctgtgcagtccggtgtttaactggcacctcattgctcgctccgaatttggctccgtgggcctgttaagtaagttccacttgtttttttgccttttagcttctaaattttgttattgttatttcttttcctatttcttttgtccttgtggctttatgttttttaaaacaattactgtacatgttagaggattttggagaggtcaaagataaatgcatacgttcagttggctgggacttaactgaagtcttctctttttttatagttagaaacataaatatgaagaacaaagttatagtggtggatattctgttcagggccaggctcctgatgaattaataaagaagttgcttggcatacaggctttgcagcaaagcgagttggatttctgggaggagatttctgtttcatctggatcctggggtcacgtgatcacgttttccttccatacgagagcatgggtttccagtggccaggatctgttgtgtccactagctccagcatccgctgtcttactgttggacagaggtagatagtcactaatattctcattatgcaatttctactttgctagactttgcgtagagtctgtatagaccatgacttttcagttaacatatttttcagataggccaaaacatactccattaggttatagctttctttagttacattgcagtcaccttgattagatttgggtgttttgaagtgtctcagtcatctgaatataaaccgtattacagatgactaataacaattacaaattgattttcattaacttaattttcaaaatgtagccctatctcaaatgcatagagtgtcctactatagaccccataaacacacacacacacacacacacacacacacacacacacacaaaacctgtatatagacatatatctctctaatatattagtatatatatgtatatacaggtatgtgtgtgtgcgcacgtttatatgtctgtgtgtgtgtgtatatatatatacacctttgatatatatgtgtgtgtatatatatatgtgtatatatgtacatatgtatatatacctttgatacaggtatcaaagacattggccaggcaggaagagtacggtgaggggagggtctggacagttttcctaagtgagtagctggtatgtgtgtatggtttggggtggcaagggggcccaggcaagacagagtattccaggccaagaaaagagcacagaaagagtcatgtgggagaagctggggtggatggggaggtgtgggagcagcctatgttcattttggctacagagtagtcgttcatcggagaagccattaaatctaaggtgggaagaggagtttgatgactgcatggccaaccttgaactctgagctacatagtttggacttctaaagggcacggtcttctgaagatgggtgccttgatggagagattaacagagaacatccagtaatacctatttttccatgtagccttttctgtttgtcaagggcagatgtattctctccactctgaatccctgtggcacttagcatcaatggctcttggctcttgtattcatctgtgcctacatttgaggcttccttggacccgtttatcccatttagccctaacaatgacattaagaggtaggtcatactgtctacccctccctctgcaccgcatttttttagtggatgaggaaatagggtcagagatagggaaatgacttgaacaagattacatacatggccagtgagaggccaccctggacctcgggccaggccctctgactccagatctgcattccactgttctcatgacatccccttgctgccagtgtctcactggttgcttaactaagccagtggctctttgaagggagactcacacgatttgattttccaggcagcacataacacaggcccaaacgatggagcacaggctctgacaagactcacttatcggcagcacagggtggggatgagaacagggacctagccggttcctatgcaatttcaccagactgtagggtctatacctctaagtttgaaactccctcatccccactgctgccagcccaactgctccagtgatagttttccaccacttcaccgagagcctgggctcagctgctgccctcactgccctggagaaagagaggaatgacaccacctgtcccgttgctgactctaaggcttttatgagaatacacaaaagagaatagatacttgaaaccactggaatgacagtttatctggtgattttcttataaagttctattgttactagtttcctcctctatctgtactgttgcttctctttgattttgtctcactggctcttgctttgcttcagaaatggcactcctccctagccaggtcctttagagtaggaaatcaagaagttgagctgctagattgtctgaacttcttggaacacagaggatgctagtgtagacatgtgtgcattattgtacagggagccactgaaacctgcctgctgtgtgcaaagtgggccgagaggactccgtggccacatcaaagcccatgtgcatttgactcttttcccttcccagcctttgattttttttgaaaaacgtatttgagatatatcagtttagctattttctcagtattttaataaaatacctgactttagtccttgcctgccatgtaaacctacacacttatttaaaccagcaaaatttctcagtgcgtttgtgctgaagttaatttcacattcagttctcattttctgcctatttattactctgccccaaatctgctgaaactgaatggaaaaggaacactattcggtggacatggttataaattagcagccagcacatgtgttaagtgcctttcataccttagctcatttcttttcccagtgtttaagaggaggctccattagtagtccattttataaataaaagaaacagaaaaggtaagtaacttgtgcccagggccacacagctaggaagcctgactcagagactcaggaggtctgtgtctgaaaccccatgatagactacctggttgaaacaaagaggggttgtgtgggagagggtcctacactcgtggttaggagaattgcattcctgcttcactcctacccacctctccgtgtgactctggacaggtggtgagcttctttgatcctatttcctcatcagtgaggtggcagctgacctatctcctaggctgatggtgaagagtcagtgggtagcctgggttgctgtgaaggcatgagcaggcactcttctgggctgtaaagttacataggctgtagtaatgtcatgaggctatttgttttgtgataggccgggaagagcccccacggggaaccgtctgtagtataaaagggccagagctggtgggaagaagataaagggaagtaatacagaataggcaggggaggggagggcatcaaacccgtgcaaggaggataagctgtgctcagtggtgatggatgcatattgtgaagaattgatgtcaacacatcaactcttggcctccagggacttcttgcagggtaattctgcaagaattttctgaattttcaaagaaatctaggtgagtgtgcatgtgtgcatacacacgcatgtgtgtctgggtacctgtaaggcaagatcatacctttgcacacttgtggacctgtgtgtatttctttcctctttttttctctttttcttaatggagacagggtctccctatgttgcccaggctggtctcaaactgggctcaagggatcctcctgccttggcttcccaaagtgctaggattataggcgtgggccaccacgcccagcccctgtgtgtattttttttaaattgaggtgaaatttacacgacataaatttaaccatttttaagtatataatcaggctggatgcagtagctcatgcctataatcctagcactttgggaggccaaggcaggaggattgcttgagctcaggagttcaagaccagcctaggcaacacagtgagacccccatctctacaaaaaataaaaaattggccagatgtggtagcacgtacctgtagtcccagctacttggaagactgaggcaggaagattgcttaagcccaggagtttgactctgtattgagccacgatcgcaccactgcacaccagcctgggtgacagaatgagatcctgtctcctgtctctaaaagaaaaattaaaaaataaagtatacaatccagtggcatttagtacattcactgtgttgtacaaccaccagctctgccagttccaaaacattttcatctcctcctcagaaattgtgtgtgtttttgaaagggcctgttctgtgcaagcatgtctgtgagggcatcctgatttcgcctgccgggaagccatcctcgtcctcagatggcagattgcactgtatgcgtttatttggccagcagagtggggctcaagtattcacattccacatgggtttgttggtcatggcttaactcctctgtgcactctggctgcctcatctggacatagaggaaggcagcactgcagccttcatctgagtgtagttaccagggtcttctctttgctgcttggctgcgtgttgcctttgtctattaaaaggatgtgtgtaagtatgtatgtcaactggggacttcagcctctgtaggccaagtgttgaaaagggtgagagggctgctctggtagaagtgtcagagctgggatgtctgtacacctccctctccatagctagtcctggagataagtaagagcagattctgggactgagctgtcgcatacaccctggtggtgataacagcaaacacagcaatgggctatgtagagggagccctgaataatctccatgagctgcagagatagggccagtgagtggcaaatccttttatagtgtggaggagaggaggtggggagcagctgcaggagaaggtggggagcagctgcagaaggagaaggtggagcaggagctacgttggacaagccagtgaatactttgctctgattggacaacccagatcatgtgcccaccaaaaaccagcgacttagtgggaggggcaggagtggggaatgaaactcaatgattggcttaatccaaccagggactctctatatagctaagtatggggccagggtccccaggggcatgtgtctgagtgtagaaggggtggtgggtcctgcactgaatcagagttttcgaaagaaggaggaagtaggagaagaatgctggatagacagtcaactgtattctccatacctagataagacaaatgtcaagacaatgcagaaaaagttgtggtgaaaagcagcaggaactaaaatgcttaaagcatcactcagtctgaggctctcctattaagagctcacattcagggaggtgggttggacccattggtgtgccacagaaaaatggccctgctcacaggaggcaatttgacatctggccgaaagtgacatcagcagcctgagaaattaacctgttactggagagaattcaggtatttgatccactttctcaagctttgtagctggtgaaggaggtgcagctagcactgtgcaagctacctgcacaatgactgcagctgacttttctcacttcaccttcccatgagctaccgtcattgattcagcgggaatgtaataagctgcgaccatgagccaggccttgagcaatagtcccctgccctcagggagtcctgatgcagaaggggaagatgcagatcagaagaggcaatcgtattacagtataaacaaacaggatgacaggagaagcttgtggtgccacagaagtgtggagcatggcaatgcttaagctgaactgggggttcagagaagatctgctggatgaagtgatttccagactcaagcctggaagatgagtaggagctcccaggtgaagaaatacggagagagagaagaaacagggaaactcactgggcaggtgactgctttagtgtgtgtatttgtgttaggggttgatcctgagaactttcaggtttctggcttgtgcaccctgattgagtggtgatatcttctagtgagatggtgaatacaggaggagttgcagttttgattgggaagaaatgaatttagttcagaaatgttgaatttgagatgcttctggttcagctaaaaggaggtacatagtaataagctagttctggaactcagaggcagagacctcctctgaccacctgcttgacatctcaagcttaacacgtcccaaactgtcctcttgagttctctccctatggtgcttctctaccctaccctcagttttcttcatccctctaaaagatgccatatcatctagatatatccagaatatatctagaatccaccatttctctagctgtcaactgctgtcccttagtctaagcttccatcttctctcagctgaattactataataacctctccccttataagcctgactgcctaattcattcttctcaaagtagcctggattatcgttttcaaattttgtgacttttttgcgggggtcgggggctcaccttttaatgactttccattgcaggtgggccctgcagaggggtccaagctgactccctctccagccccacctgtcacctggcctttccctgtggtcttcagtatgtcagggcttttctgccttgggacgtttgcatacattgtcttgttgtctgtctccttaagcggtccctcaggtctcaggttgaacatcacccctgcagagaggtctttcttgcctgcgcagactgaaactcatcttcctggttattctctctcccagaacctggctcttttccttcatagcacctgtcccaatttgcatttatagtcatttttgtcccaatttgttcaatgcctgatttgatacctcaattttatcagacccatctcccatttttataacaaatacttcctttttacttatcctcaaatgaaatctatagataatataacctccctatacatgtaattttaaatcagtataacatcctggcagtgatataaaggagaaataaaaaggaaagtaattcatcataaaactatttatttcagtgttaaattcctaaactcccaaggctgactactccagaaatcataatgaagtaatcaggcctgcacctattaggtaaaatgaccacgaatgcaacagttacaaatattggctaacatagttattttttattagtgactcagatactaacagcaatgtagccagtggcatgtggttttctgtgatggtaagtaaatcctgtgatgtttgttttttctttttcttcttttttttttttctttgagacagggtgtcgttctgtcacccaggctggagtgcagtggcatgatctcagctcactgcagcctcaatctcccaggctcaagtgatcttcccacctcagcctgccaagtagctgggactataggcacacaccatcacacctggctcattttttatttttgtagagatcgtgttttgccatgttgcccacactggtcttgaactcctggactcaagcaatccacctgtctcagcctcgcagagtgctgtgattacaggcataagccactgcacccagcctcctgtgatgtttcaaacaaaataaagttcaatctttctccttcaatgtggactgaaattaccttcctagaaaattcattaaagtctgagggccgtggctcatgcctataatcccaacattttagggggctgaggcaggataattgcttgagcccaggagttcgatactagcccaggcaacagagcaagacccctgtctctacaaaaaaaaaataaaataaaaaaatttctgactagctgggcatggtggcatatgcccgtagtatcaactactcgggaggctgaggtggaggctagagcccaggaggtcaaggctgtagcaatctgtgatcatgctactgcactccagcctgggtgacggagtaaaaccctgctcaaaaaagaaaaagtttaaaatatgcactaaagttatgccaaaaaactttatttttttatatatgcagcaggatcaggtcctagattcatgcgattataaaaggtgttccatggtgagcaggtctatgcaaacctaccttcaaaggccaagggagctgagaggctgaagaaagagactgacaaatccagtttctcagaaagaaatatttaatagagacttagaaacagaaacgatgtctaggtaggccaagagatggtggattctcacaaccaacctccagaaagtatcctttatatagcaagcttttagggtaaagacacaggaagctcatcatccctgacttcctttagaaactcatgaccacggggaggttgtgagggcttatctgtgctactggaccaccttgaattgtaggcgtcaaacattggtcatcatggcagttttacttcaagatggatcactcttgctatgcaacaggctgttttcccacaaaagagtttttcatgtttatgaatgtctagcagtacactcactagtcatgcgggcctggagctggttttcctcatacaggtcattgtggcaccacggctcccacccttaaatgctagcagagtttccccattcattttggcaattgacagcacctcccaaatgtccgaaatgccccccagacatagggtggtactgccctagctgagagccctgtgcctactcctctgctgtcctctacacagaatgagggcagggtctgtgttgtgttcactcgtctatacacagcactcagcacctacttgccagatatttgtggagtgaatgaatgttctatcaacatgaaatttgtgccaaaaagttaggaaaggagtataccacatggaaatgtgaccagacatttaccttctttcagcatgctttaggccagctgacctctgttttagtgcaagagacttgtaattatagctccagacaatatggaatttcagctctaaatcctttacaactggggaagtcacctcaccatgcacagaagaaatagcactggctccgaagttgtggtttgtctttttttggaaagtcaggcttgtctgccaaagagctcgaaacacttgaccagctctctcatttatcttaacatgtgtatttattctcccttcacagatggggaagtgaagcttgcctgagggctgtatttagctaagtcttgatcctctgccttgtggtggtcagcttagataaaatggaatcctaaaacttgatttttatcccgtagtgtgaacctcctcccacattaaatctgctagtagggctgctcacaagggtaagaagtgttagtttgagtgtttttcatcatgtgacgtggcggtcttctagttcagggccctgcttttagagatgaggaagtgccagttcgtcacaacacagttagataatgacaaggccagtcctctagctggtttctttatgctccaccagatgtaaattttctctccgtttcctccagccaacctaaacaggagttacaatcagtcaggtggccaaaaggaaagcacaatggaaaagaagcccaagatctagttctctagctcctaaataattggtatattaattaggaggctgacttattataaatcaaaacatatgaagatgacagtagctaaaagtaagaagctaaacctttaatttcaagaattcttttactaagcgctaatcaggccagtgacatataaataccatttcacaactgaactgaaaattaaaaaagaaaagaaaacaccagatgtttgcaaagtttttgaaaaacagtgacctcttaagaatttatagcacctaaaaaaacctttctcttccccaaaattttctttagtccaagagtgctgggaggtagtaggaagtggtaggcaaattcagtaaactcatcactggtgagttttgaaccaaacttaccaaagtgttttcaaaaaggacccaacccagcttccttgaaaaacagagttatttttaaagaggtaaaaactgatattttcatttcacaaagttaaatataaaatgaactcaaaagtgtcaaaatgactgcacaatagaaatgaggtttcaggccaggcgtggtggctcatgcctgtaatcccagcactttgggaggccaagggaggcggatcacagggtcaagagattgagaccctcctggctaacacggtgaacacccgtttctactaaaaatacaaaaaattagccagccatggtggcaggcacctgtaatcccagctactcaggaggcagaggcatgagaattgcttgaatccgggaggcagaggtggcagtgagccgagattgtgctattgcactctagtctgggctataagagtgagacttcatctcaaaaaataaaaaaaaaaaaagaaatgaggtttcataggctactctgaccaagcattaccatagacatgttgtgatatataagttagatgtaggagaaaacagttgcattctcagaagctggcttcatgacatgtgtcctctggacttctgtgtagcaccctttgaagggtggagggtttcaagagctcgatgcctgttttggacttctcgctagaaacagatgttgtagatgaagattactactgtgtgccttggaagtgacacagagaattgctactgcacagaccacaaagccaccacttttcagggatattcttacttagttgtcatatgttttatgtctctcttcacgtagtcagaagctgctttagatttgggaaggctggggcttatctgttaccccttgttctaggttgtttctcattctaggttgttacagaggaaaactctagtaggttttgataaatgactatttcttacatcaaagtactatcctgcattatttgggattgtaatacattcctatagtactttatggtcttcaaagcatttgtcactgataagtctcccgtttttcagacagagaaactaaggccctaaggaataagggactggactaaagtcgcattcctagcatgttggatacgttcaagttctctccattctgtaaggaccaactcaagtgcctcttccaagaggtcttttcttagtgtcccctcattactactttttatatttaccacattctaacttgtaatatcatgttcacatacatcttatctaccttaccatgaacttcctaagatcgaaagctgttatgcatttgtgtgtatctcctcacctatcagaattgttcttcttgggtgctaacctgatgcacgttcccacaccagcctgcagtttcctcttctaggctgtggcttggaggtctgcaaggcgctggagtggtgtccaggcacattgtgggcactgctgcacattcaagtgcattgccttatttttaacatatagatacttaatgagagagctttgtaaatgtttataaggtgttttacaaatagatgttatttgaatctcatccttccctcctttatttattgcagttagcactgttctgggcacatagtaggtgcttagtaatgtttgttaagcatttctatattcacttgctccagcttacacttttattccctcctattgttgtatatgactgtctttttatatgtttatatcttgaattcccaactaaactgcaagctccagagggctatagtctcaataaatctttgctgattgcttttaaataatacatgatagcataccagctaacaaagcatggcacaaggtaaatcgtccaatgtgagtgtttttatttaagaaatgttttggatatgtattttaaaatagacatacacatcccaaaaacatatattttaaacagagatcactaaggtaggagggaacacccaggtccacatgaaggggacaaagaatagtgcagaagtaaggctcatgggcactgctggctgagctgcacacagaaaggggtctccagctgatggccattggctacatttctctgtggcattggaagagcttttgtttcctctcagagcgcatttctttagttttttgtttgcagattcttatcaggtggtaagtgtgtgtttttttttttttttttttttttttttgagacagggtctcactctgtcacccaggcatgttcatggctcactgcaggcccaacctcttgagctcaactgatccacccacctgagcctcctgagtagctgggactgcaggcatgtgccaccatgcccagctaatttttgtatttttagtagagacaggatttcaccacattgggaagactggtcttgaactcctggactcaagcaatctccccacctcggcctcccaaagtgctgggattacaggtgtgagccaccgcacctggccatgtgtgatatttttaaagtaaggttgtcattatcacatatcgaggactcttcaacaagggacagcctgaacactaagctgccagaacacacttaaaaacttgatacttctggtacttagccaattggtaagaagctaaagagtctgccatgcagtccaacagccatgctgactaaactcaccagttctttcattgttttgatgttgaacagctgtctttaatacacttttctgtactcctgagaatgttctagttaccatgctgaaatgtttaaatacctacattttaaaattagaactaaaatataatgggtttgttaattaggaggacactggagagttggctgtgagaagttgtgactttgataagtcgatcttttaaaagtaagggcagttgctctacatttgacttctttgtgttctcaaatttaaaatatatggctgaagatgaaagattctgcacacctccacttattcattcccaaatcccacatttcatattaaattcacacaggatactatgtgatgcatatgaaccattttatatgatgcagggtacagtatgcacaggggataatttattttctaaatttgctattattagacttctaattactcagctggatagaagcagaaaggtctcattcttgtactaactgccgattttttttttttttttgagacggagtttagctctgttgcccaggctgtagtgcagtggtacaatctctgctcactgcagcctccacctcctgggttcaagtgattctcctgcctcagccttccgaatagctgggattacaggtgtgcaccaccacggccagataatttttgtatttttagtagagatggtgtttcaccacattggccaggctgatcttggactcctgacctcaagagtcccacctcggcctcccaaagtgctgggattacaggtgtgggccatcatgcccggccactaactgccaattatttagccagagatgacaggcagaaggaattcattttagattgttcagacttaagaagtaacatttctttccaaggaggtctaaacatatgtgtgttttattttttaatagccccagttcttcacattttaattaatcaaacaaaacctgcaatttaagaaatatctagaaatgattggtccaattgtcctcctttgtgctcacgtctctcatggaggaaagtcaggattcactgtggttatgaaaggaatctgtacaatatatttaccttctgtaaaatacttggattaatattgttaagcatctctagggaacatggcattcaattagtttttatttcttgtcatctctcactagagaaagagcgcacacttctgtttccctgaggaggtaaacttgcttgaaaagtaaaatttccattaaaatctctaatttggctttcttaaatataaatctatttttgttacattttaaatagtcttaaggctaagtgactaatgagtacagtaataatatatcattctcttttattcatctgaaaattatactgtctcgagagacctgagttttgtgtgttttgattttatttcttactaaaagacttctctgtgattggagggagctgcaaagctgaggcaagtgtgggactcaggggaccctgcgtggatttgcagaggaataagagacttggtttcccatgggatagagaatttatgtttaagcattgaaagagttcttcgatgtgcgaggtgttatgcggagtgctttagttgcactatttcatttattcctcataatcctaagggatagtatccccattcctatttctgtgaaaattggaaatctaaatatggatgaggagtgctttttaatgagaacaccccatttcccggccatgacaactgcatgtttgctcagaagtgtggagttgctgggtgggatgctaagatgacatactgtttcttttttttttttttcttttatggacttgcagtttgaaacaggcagtagagcccagaaagtacatataaggcactcaattgtactgtttaacacaagctgatttttaaaaagttaaattttcaagaagtcttcctctagtaactgtctgggggtataacgtgtttcatacccaccctatttgatctcttcattgtgaatttcttaacaccagggcactgctttaatcaaaaccatttagaggcgttcactttaaaaaataaaagttgcagaagattgggggtggcatttcccctgtcgtcatgtgatagcgaacacctgagaaatcttttaatgcccacagctctagattataggtgtgcccttcaaaagcatcacagaaaaacaaaagggttacccaccagtcaagggtttgggacattaacatgctttagttgaaagttatattatgaaaaatgtcagaaaaatgcatgaaaggaaaattgttccatgagggaaatactactgctgaaactccaagtggaagatgatgtttttaatattcccttagttccacatttgtgtagttctgtagtgaaacgagtcatttaagaggggaggtggcccaggctaaaaataaagtttctttgaaaccagatgagagtctagctatgccaaaaatggaatccggactctgttcactctcgagaatgtaaataagtagaattttgtgtcacataaaatagtctatgcaaaaaaggatattcactgccttttgtgatagagactaaaataaccatcaggagtatagctgttctggggactctgaagcaacagtgtaaaatgatatggtagtctaacgtattctgatttagaaagatgtccaagacaaagaaagtgcagaacaacaagtactgcatgatttcattttatgtacagatgtatgaatatgtgcagttactggtatattcatgcatagaaaaagaactggaagaataaacatgaaaatattaagtagagggaatgaaagttggagagtaaaggaggattttggtgggtttactgtgtatgtttctctttaaatcttcacacacacacacacacacacacacacacacacacacacacacaattaataaaactatagaaacaaggaaagcaaagcttgaaggtctcagtgaagctgtatagtggttaagagtatagactctggagtaaaaactgccaggatttgaatctcagctccttgacttactggctacacatccttacgcaagtaatttaacttctgtgcttcagtttactcaaatgaaagtcaggattaagggtacttgtgtcatattgttgttacaaggattaaataagtaatccatgagagagcatatagactagtgcctgacacatagtaaatatttagcatgtattaattattataaattataatacttaggcaatgtctagctatattcaattctttgtgcaaactttttagttaaaaatgtttttagtgacagcgttagtgatcataatgtatttttccaaagttttcattgtcattgttaatgatattgtcatttttttttacctcatgggtgttcagaacttcacaaagaagaataacaaaaacagagttatctgattttacttagagtgccatacattccactagtggagtactcctgaatttgcatctttgaccatgtaatctaatgtacatattactagtaaacaatagaaatgtaaatacataatgaggcttttctttgttcctcaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcaggtatgtctggtttgattttctgcattttagaataagctctttggtctgtcgtagaggctgctctcagacaaacagtcccaaagctgagcaaatgatgtaagtgtttaatctcagctgcaagttaatgagttctatcatatttttggaaaaaattgtgccaaaagaaagcaattattttcctggtttttaaaaattaagttcttttgtttaatctttttttggtatgtgggaattaagtgggattacatgctttgatttttctttaaagatttgtaatattatgggacattattgacctttcttaattagattgatctccgagatgaccccaaaactttagcaagactgaatgatatgaaagaaaaacctatatgtgtggaacaaggacagaaactagcaaaagaggtaatggaacactcacagaatttaagcatgaatgtaaaagatgctaagataacaatagaagctaattttattgtgtatttactgtgtgccaggtggagtgctttacatgcattatctcatttaatccttgcatgaactcagtgaggtaggtctgtttcccctgttacacagaagagacagtggaggctgggagatgtcagataattcgcccaagatcctgcaggtaataaatggcagagttgggtttcagtccaaagcctgactcctgggccgagactcttacacctttgctacattgccagtgatattttcctaaaaagtcacatatggaaaaaagcatcggaaacacgtgtcactactttcaacccttcttcattacttaaacagttgcactgtgccaaatcagctctgtcttaagactcattgagttagacagtggagccacctaggatgacagtttaaatttgtggttaaaaccaaaaaatgatgactaggtttgaaaagaaatgtgttgaaatttctccaatctttttatgaaaagaggatagaaaatacaaaaattctaaaaatatatgtaacagtgatgcatgcaataccttgtagcttatcttccttcgtgccccaaagataggtttactttttccccttttttcccatttggccttaacattattggattctattttttaaatgttgtgatttcaataggacttttgtggaaacagaatccatatatggtctttttttttttttttttttttgagacggagtcccactctgtggcccaggttggagtgcagtgacgggatctcagctcactgcaagctctgcctcccgtgttcatgccattctcctgcctcagcctcccaagtagctgggactacaggtgcctgccaccacacccggctattttttttttttttttttttttttcatttttagtggagatggggttttaccatgttagccaggatggtctcgacctcctggcctcatgatctgcccacctcatcctcccaaagtgctaggattacaggcatgagccaccgcgcccggcccatatatagtcttttaaaatgtagtatcaggaggcaaaagaaagcaagaaaactttctggaggacagtttttcctaaagcaaaaaataaatggctttactaacaaatcacttcagaaattccatgtattcagttttgtaatcttggggagagaaggaatttctaaatgtcataaagataaaagccataaatgaaaatattaatgatttcactgcataaaaacttaataccacatcaaatgccagaaataaaatgaaaagtcatataacctgagatggatggcagaaaaatgggttaacatccttagtatacaggaacctcttgcatatgagttaatcagaagcagccacagataccaatagaaaaatgggctaacaatgaaaaattcaccccccaaaatgcagattgccattgaagataggaaatatgttcaaacttattagtagtcaaatgtaagctcaatttgcacctatagaattggcaaaaaatgagaaattaattataatacccgtgtagtaaaatggacactctgttgtactattggtcattgaatcaaagcagtcttgacagtatgcaaaatccttaaaatcatggacacttttgatcaagcaattccatatgtaagagtttatcctaagcaaatcattaggatgttggtcaaagtgtacagtgttaggaggaatacattttttgagataacactgcacaacatggtaactacagttaataatggtggtgctgggcacggtggctcacacctgtaatccccgcaccttggaaggctgaggtgggtggatcgtttgagcccaggaattcgagaccagcctgggcaacatggtgaaaccccatctctaccaaaaaaaaaaaaaaaaaaaaaaaaaaaaaaaaaaaaattagctgagcatgatggtgcatacctgtagtcccagctacttggggggctgaggaaggaggatcacttgagcccaggaggtggaggttgcagtgagccgagatagtgccattgcactccagcctggatgacagagtgagaccctgtctcaaaataaatgaataaataaataatggtggactgcgtatttccaaattgctaaaagagtaaattttaaatgttctcaccacacaaaatgataagtatttaaggtgatagatgttaattatgttgatttaatcatttcactcgtgtgtgtgtgtgtatatgtatatatagagagaaaatattgctttgtaccttatataaaattataatttgtccatttataatatttaataataaaagtaaattattagggacgtacttagagctacaaagatgctgaattgtttataatggcaaaaattccctgcatctattaaaacttcatactatctgttaagatttcatatttattatgtagctaaagggaaaaaagtagttgcaaaacagtatgatctcatttctagactcatcagcatttggcacagttgcgtccttcctgaaactttcttcagttggactctcttggtttttctcccctctcattggactctgctccatctctttacctccttggtccctggttggagggccccagtgatgagcactcagctttgtggatgtcttcttctatagctacactccctaggcctaaatgagcttctgtcagtcttgtagcttgcacagtctacaaccaaagattcctggatttccatctccagcctggacctctttcctaaattctcaatttggttatccagctgtttactcaacaagtccatctacatggctgagtatctcaaaattaacatgtctaagatatgattcttcttttaccctccaagcctgtcctcccagttactcaggtcagaagccctcagctgggtgcagtggctcacacctgtaatcccagcactttgggagcccgaggcgggcagaattacctgaggttgggagttggagaccaccctgaccaacatggagaaaccccatctctactaatacaaaattagctgggtgtggtggcacatgcctgtaatcccagctagtcaggaatctgaggcagaaccgcttgaacccagaaggcagaggttgtgatgagccaagatcgaaccatagtactccagcctgggcaacaagagtgaaactgtctcaaaaaaaaaaaaaagccctgaagtcgtacttgaccttgctctttctcccataccacacatctagccttcggcacaacataccttcagaacatatccagaatccagacacttttttctaactcttccctctatcacctggttcagacctcctccatctctggcctgctttactggaatagcttccaactcacctttctgcttctgtctatgccccatggtcatctgttctcaacacagcagccagagtaagtcttaaaaatgtaagcgcaatcatgtcactgctctgctcagaatcctccagtgggtccccagctcagactaaacgccaaagtccgcacagtggcctacaagcctctgttccctctctgccttactcattgttccccaggcctcctggtctcctttgttgttccctcaaagttctacctgagaacctttgtacttttgttgttccctctgcctggaatgttcttccctatggacatgattcattctttcactcttttcaggtctctgctcaaataccacatcctcagtgtgatcttgttccttgactgctccaggcatgctcctgcatcaggatctatctgcctggagctcttcccctaggtatccctcactgctcaaacttccccattgagaagcctccccggacccccactaccattgtcctcagcactccccgcctccctcactctgctttttccccacagcatttgcaaccatctgctctgtattccctcccctgtgcctcttacccagcagatgtcagcacatgtggacgccacacagcagggactctgctctttcgttcagttcactgacatatccccaggacctaaacagtgcttgacatatagtagatacccagtaaatatgtggtgagtgaaataatttttcatagaaagtctggaaggacatatactagtattttaaaatcccctctggggttatgaacatggatgatgaatgtattctttttgcatagctgtattttataattttctttataatgatgtgtttatgtcatgccaattgtataaacatgatcttatatatttgtgattttttttctccctcccagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaattttttttttttaattcccactttggctgtgtacatcaaatgaaatgagaagtgtgtatgctgaccaaaccacaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttgaaaaaaaaaagaaaaaaaagttggaggaaaattttcatgttcttctgtgaagcttatttggtacactggagccatttctaatctttctctggggggaacaggccacagaactgtgttagaggtgaaccatcttaattactagttctattacctaattcagcttccttgtttggtctgctgtggatctgccttattgcatatgccatgcatcagataatggatgcatcagataatggtgttagacaaagcttcattgtgaacaacctaatgcattttagagaaacaatctcatcacattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgcttatttttagataaaattgaaaggaattgtataaatcaattaacatattagctgagttgtccaacacatggtataaacgaattacaacagtaaactattacacatttccaacttgcctttggggatttatgaggattttttttggtggggggagggggctccaattcatatctctgaaacccttcacacttggtttactaattcaaagttagaagtctagaatttgccctgccctaacagaaacagattaggaatttgtctacacaaactggtgtcacctgtttcttgactgggatttggtttcctcattataaatatgggaggtagaacagagatctccaacgtctctcccatttatcacagtaattttcttattcacagtaatcattgttggatgttaccttttcagcttcacattctcaagatggtaaaaatcatgtatatagattatcagaactctaagcaaagatgactgtcacatctgaagctgaggtgccttaggtactctactgaccttgatgggtttggagttccccattgcttatcaagagctttttaattgctttggttctttagtttttctttttgcaaaaatccttcctgtcactttaactaaaaaccaaagatttgttttctattgataagcagactagagaaaaactgccttattttcagaagcatgtcttcattcaaagcttaggcttcaatagaaattcagactaatcactgaaatgactatttcaaactagtgaaatatctgggaaataaactgcttcaaaaatattttactgacatgaattttgctagtgaatacaaatacactgcctcaaataaggccatgtatgaatgaacttacaagatatttgagttaatcagtgtttgcatatagagaattagttctaaagttcttaaaaataaatttaggggctccctgaaattttatttaatactttgctaacttacactcttgttttatctccacaggtacattttaggttagctcatggtgaattctatttacaataagtggagcttggattaatgggttttgttatgaattatcttagtgactttagacactgtttccatttgatttttaactatttaaaataccaaattaaataccagtttgttggttgttacttttaaatgattgttactttaacagtgtcccttcttaacacatggggttacaaataaaatactatgcatagtttactatctacgtaaagcactgaactttttaccttagtagtttttatttattaccctatgtaaacatttaggataatactctttcctctatttatgctgagagtctactaatcattggcaaagtatgagtccctatactctgttaaaaaaagctcactgttaaagtatagggagaatagtaatccctcatgaatcccagctagattccaatttgggttactaaattgtattttaatcattttgtaatttcagtatggctctttgttctcaaacacatacataccaccacgcacattcttttaaacagctgccacacctcacctccaacagaatgccaaaaatgaaatgttaaaaaattttgtctaatgaagggttacggcttggaacacttggttattcatgttatgtaaatcaagaagtgcatgccatcagcaaattaaaatgtggactggctttgaagactgttaa

SEQ ID NO: 201 - DNA, 59848 bp, Homo sapiens
aagtgtagaaagcaaataaatttaatctttcattttcaattaatctttaatatttcagaagtatatcaacattgcctaacatgctattttacacacaatagatatataatcaatgtttattgacttaaaaatctttggtttagccagataaatttgtaatattttatgaactagttaaccctgagtcatgaatttaccttttttttttttttttctggagacggagtcttgctctgtcgcccaggctggagtgcaatggcgcaatctcggctcactgcaacctccatttcccaggctcaagtgattctcctgcctcagcctcccgagtagctaggattacaggtgcctgccaccatgcccagctaatttttgtatttttagtagagatggggttttaccgtgttggccaggctggtcttgaattcctgacctcatgtaatccacccgcctcggcctcccaaagtgctggaattacaggcatgagcttctgtgcccaccatttttttttttgagatggagttttactctttttgcccaggctggagtgcagtggtgcgatctcagctcactgccacctctgcctcccaggttcaagagattctcctgcctcagcctcctgagtagctgggattacaggcgcccgccaccacacccagctaatttttgtatttttagtagagatggggtttcaccatgttggccaggctggtctcgaactcctgacctcaggtgatctacccgccttgacctcccaaagtgttgggattacaggtgtgagccaccatgcctggccagatatacctacatttttataagatttaaaattttttttagagataagagtcctgctatgttgcccaggctggagtacagtagctattcacaggtatgattgttgcacactacagtgtcgaacttctgggctctagtgaccttcccacttcagccttccaagtagctgggactacaggcacgtaccactgagtccagtgtatttttataagattttaaaaaagattacacattctaaattatgacgtccacataccatttacttttctgtggaattataaggtgatattttaaatgatgggaatgaacaacttgacatgtgtatcagtaacctctaaacatctatttcaaacatctattaaccgaaagtcatgatccttcagctcttatactaagaacttccatacattagagcaatacacatattcaaattgacctagttcaatttgataagtaaacaattttttttttttttttgagacggagttttgctcttgttgcctgagctggagtgcaatggcgcaatctcggctcactacaacctccacctcctgggttgaagtgattcttctgcctcagcctcctgagtagctaggattacaggcatgcgccaccacgcccggctaatttttgcacttttagtagagacggggtttcaccgtgttagccaggatggtctcgatctcctgatctcatgatccgcctgccttagccaataatctttctgtttaggtaaatttgaaaaatatacatcattactaccacattcatcctagttagaatctcatttatatttattccactctgtttatgatttggtaactaatttgaaaggcattatattatcaaaagtgtatcagattagctccctcaactcactatatctgttaacagttctgaagaaataggcactggctttgaatatggcctgttccagtttgtgaaccgttgtaggcaagtaaagttgttgggcacagaggtgacctgtaggatgactgaaggtaaactgtcactactgtatacaaagaagaaaaataagatgtaggaagagatctgttataataacatatgacatattctatctaagtttttcatatatttcagaattgtaaaaacaaaactatgtaattttttctaagatgtataaatgacttacttttaataataaatatttcttgatttataatgtaaatacaattaaacaaatatgggttactcgaattaaaaaaatggcacatgtaaatgagcattttagtacaaataattaaaatgtatttatattatatagaaatctacacaatggaagatactactaaaatgttgctctacagcacatcaccctagacaaaatagaattctagaattctctttaaaaaaaaaaatcactgagaattagatgatgactgtgaaataggttctcccattacaatactacttctgtcattcaaagttctgaccacggttgtagctggcgactgaagcacttttcgagaaagcctcattcttccatcggctgggtcacgtccaaagtatttcacctgtgttaaagaaacagatcttcctttaaagttacagcacattgagtgacatctaaactaatagacatttaaatttacatggtccaaataaggcaatgattgtttttacttgttcactgaaagcattgttcagtgctaagtggacgtatacacttaacacatataagtagtcattataaaagagaaaagagacggggcagttagttgttcaactataatctgccgctgaactcatctgtgcctttttattctcaccaggccaagtccttatactgggggaacagtcacaggcatagtgaatgatcctagacaagggctttgagagcctaattgtgttatatactatagaggattatgcttaggtcacttggattttcactactgctcaaaggaccaacacattagtgtttatttggcttcaccttggaaaatgaaagtcaggggcaaatgcaaaggtttaaagttccttctgatgtgaaaacaacaacaacaacaacaacaacaaataaaccaaaaaatcaaccttatacagagatactatatcttagcactcatcttcccctggaggctacttggacaataagactacacattgggaataaaccagaagccttagttactcaggtcatgcgtattagcgtaagtgaaagacaatgtggtggagcccgaaaaaacagactggcaatgacttctttcatccactcataaaggactacaaagaaagggccaattttgttatatgaattctaggcctgaataacatggctcttaccaagctcaaaaactttaagtagtggagaaacaaagtctcacctcctcaaagatgacattcaaagactttaacaagttaccttatcacagttcttacgtcagtgcccaaatcatggagtctgcatagctaacactaacatgctcatgtattttttaaacgaactaagggtgactaccattttggccaagctgcaagctccttgagggaaagaattgtgtcttaaatccttaatgagtctgttcaagcaattctaagattaaaaatgaagtactgcatacaaataaaaaacttcatagatggtgactcttctttcaactttttgaaaaaaacaatggaagcttcaagaacaatttacaacttcaaggctaaaaggtggaatacaaatacctgaatttcttggccaacttctaatcctagggcagtaggatgtttaatctggaaaaaaaaatgttaatctattagttgttgtgcataattatgtagtgtccatggaagtacacattttttcctcaagctttattagtttttctgattaaaaaaatcagttagcggctgggcgcagtggctcaagcctgtaattccagcactttgggaggcagaagcgggcagatcaagaggtcaggagattgagaccatctctggaggtcaggagagtgaaaccccatctctgctaaaaatgcaaaaaattagccgggcatggtggcgggcgcctgtagtcccagctactcaggaggctgaggcaggagaatggcgtgaacccaggaggtggagcttgcagtgagccgagaccacgccattgcactccagcctgggtgacagagagagaatccgtctcaaaaaaaaaaaaaaaaaatcagctgggcatggtggctcacggctgtaatcccagaactttgggaggctggggcaggcagatcacttgagctccggagttcgaaaccagtctgaccaacatggtgaaaccctatctctactaaaaatacaaaaactagctgggtgtcgtggcacacgcctgtagtcccagctacttgggaggctgaggcaggagaattgcctgaatctgggaggcagaggttgcagtaagctgagattatgccactgcattccagcctgggcgacagagtcagactctgtctcagaaaaaaaaaaaaaaatcagttaattataaagatttaaaatacagatgtattaagaacataaaaattatccaaaacaggctgggtacagtggctcacacctgtagtcccagaactttgggaggccgaggtggaaggactgcttaaaccagactgggcaacgtgaagaaaccccatctctacaaaaaatccaaaaaaattagccgggtgtagcggtttgtgcctggggacccagcttctccagaggctaaggtgggagaatcacttgagcctgggaggctgaggctgcagtgagctgtgatcatgccactatactccagcctgggtgacagagcaagaccctgtctcaaaaccctctcaagttgtagataactactgctaacattccaatgagtatcccttcagatgtctacttagtgtatgtgtacggcatttataaaaatggaccctctgtgcttactgtatatcttaaggacatctttttttttttttgagatggagtctcgctctgtcatccgggctggagtacagtagcatgatatccgctcactgcaacctcttcctcccaggttcaagagattctcctgcctcagcctccagagtagctgggattacaggtgcacgccatcatgcccagctaattttttctatgtttagtagacacgggggtttgccatgttggccatgctggtctcaaactcctgacctaaagtgatccgtccaccttggcctcccaaagtgctgggcttacaggcgtgagccactgcacctggcccaaggacatcttttcatatcaataaattaagaattaccgttaagtttcaaactatatagtttatttaaacaatcacctaaagacaataaattgctttaaattccagtgttgcaaatgttaatgactgatgaatataggagaaagatatatgagggtttagtgtatcattctttcaacttctttgtacattaaaaacttttcaaaataataaggtgaaaaaaaataagttgcagtgtagcacaaatcatgaattcatctactctaattatcctctccaaataaaatcctacaatgtctaggtccatagacatttaccaaacaccctctaaaaagtttgtcccaattcacacccccatcaacagtgtatgaaaatgtccatcttttctcttatacacactgagaattttaaactatctgaaagttaaaactgatatcttaatttcatttgcatttcaaaaattgctgttgatattaaatatcttggttggctttttataaaaataatttgttcatgttctttacttatttttctattgatattcatcattcttacggatttataaaagccctttgtaaattaagcttctgcatataagcatttttactttaggttgctgattatctcttaaccttattgaaatttttgccatataattaaaaaattatggggtcaaattttgtaagtttatttacttttttggctttgatatcatgttgaggagttctccactactaatcttattaaaacatccaattttcttctagtaaaccctcctgccccaacaagattatcttttcctaccaccttttttaaaaagcacatttagctctttgatccagacaggatttaggtataaaaatgagtagagatcctgttttaagataaccagctgtaccaatataatttattaaataatctttattcactgactataatacaacttctagcgtatattataatcccatgtatattatttctagtttttgttttcttgttgcatggattatctatttctgggccggtaatatactattttattgtctatggctttataatatattttaatatatggtaaaacagacactcttttttttttgagacaaagtctcactctgtcgccagactggagtgcagtggcacaatcttggctcaccgcatcctccgcctcccgggttcaagcgattctccttcctcagcctcccgagtagctaagactacatgcgcacgccaccacgcccagctaatttttgtatttttagtacacactgggtttcaccatgttggtcaggatggtctccatttcttgaccttgtgattcacccgcctcggacttccagagtgctgggattacaggcatgagccaccctgcccagccaatttttctttatgctaaacaatgtaaaactttttgccagcagcatctctgccacttgttttctctgtttaggctagtagtaggcaaagtgtataattcttaccaacctaggtaatttcaatacagtgtttcaaggcagttataaaaataataacaataacatctgtctttttacctttcgttgatcaagttgtgtgttatgaagcagtaccgcagtcatatttggatataattttaccattacaccagtatctctacaaaaaaataaatagtaagcctggttaaaataataagtatctgtatatccattgacaaataaaacattgttttcatatgaggaaaaagtaaaaaacgaaaagaaacaattctagcacgtttttagaactataaaaagtatacttttcaactgaaaatataccctataaataaatatgtgtgaatcaaagaatgaagaaaagataaagaaaaaacatgcaatagaaaagcttttagagccaggtgcggtggctcacacctgtaatcccagcactttgggaggccaaggtgagcagatcacgaggtcaagagatcaactccaccctggccaacatggtgaaaccccgtctctactaaaaatataaaaattagctgggcctggtggcgcgcacctgtaatcccagctactcaggagggtgaggcaggagaattgtttgaacccgaaaggcggaggtggcagtgagccgagatcgtgccactacactccaacctggcaacagagtgagactccgtctcaacaaaaaaaacttttagaatatatgttcttctgtatttctcttaacaatttccaaaaacatttttttttttttttttttttgccacccaggctggagtgcagtggtgccatctgggctcactgcaacctccgcctcccaggttcaagtcattctcatgcctcagtctcccaagcagctgggattacaggcatgtgccaccatgaccagctaatttttgtatttttagtagagatggggtttcacgaagttggccaggctggtctcgattttccaaaaattttcgaaatgacattaaatattttaaaaatagtatagaatctcatatgattaacctgtaaggtaaggatttaaggaaggtggtcaggtaaaatggaatacttatttcattaaaaaactaatcttcccttttttctctaatctatgaaaataagccatcccatttcttatttttcacctgcaatattaaacaaattatctccttgccttttattttatttcaaatagctttgaacatttttgctacatttgataatttcctttttcttaaaagagggattttcttatcctaaaaaaacaagctcttctagctggtcaaaaaaaatgctttgagactgaaattggctttttttttttttgagatggagtctcgctctgtcgcccaggctggagtgcagtggtgcgatctcatctcactgcaacctctgcctcccggcttcaagcgattctcctgcctcagcctcctgagtagctgggattacaggcatgcaccaccatgcctggctaacttttgtatttttagtagacatggggtttcaccatgttggtcaggctgctctcgaaccccccacttcctgatccacctgccttggcctcccaaagagctgggattacaggcgtgagccaccatgcacagccgaaattggatttaaaaatatgtgccaattaagcattcagatatgtttaaaataagccatcaaaagaaaaaaaaagaaataaagaaatattgctaagtctattttgggcctatttaatatttactgggaaaattaatttggggtttcaccaattactagtagaaaatttggttaaagaattcagttggccgggcgcggtggctcaagcctgtaatcccagtactttgggaggccgaggggggcggatcacaaggtcaggagatcgagaccatcctggctaacaaggtaaaaccccgtctctactaaaaatacaaaaaataattagctaggcgtggtggcgggcacctgcagtcccagctaccggggaggatgaggcagaatggcgtgaacccgggaggcagagcttgcagtgagctgagatcgcaccactgcactccagcctgggtgacagagcgagactctgtcccaaaaaaaaaaaaaaaaaaaaaaaagaattcagttaagagaacctatcataattagaaccacagaactgctactttaattttataaaatgatatagaaaacaaaatatactataccttaaaaaataatgattatatggcaattggcatgtaatctaaacaccttatgatttcaaagtaaatgtaaaattaaattgggattataataggaatctgttaaaaaccaaaacagggctgggcacggtggctcatgcctgtaatcctggcactttgggaggctgaggcaggaggatggcttgaggccaggagtttaagaccaacctgggcaacatagtgagaccatgtctttacaaaaaaattaaaaaatcagccacgtgtggtggtgtgtgcttgtagtcctaaataggaggctgaggtgggagaactgcctgatcccaggagttcaaggcagctgtgaggtacaatggcaccactgtatcccactgtgggtggcagggtgagaccctgtctctaaagaaaggaaaatgctcagcatagtatattacttgatattacctgatttcagttattgtggcggtatatactgctccaaattctaattgctgctcctgctgtaagtgcaaaataagccataagattcataaagaaaacatcaacaaaaagtagaaaaaacaaatatagctatatgatacgtaattaatatgatctatacttacatcatccttgcagatttcagtaatgaagtctcttgcctcatgcatagcactgggtgttggtgcaaatacagaaaacgtttcttcatccacctgactaatagttacaccttttaaaaacaaaatgtaacatattaaagttaacttggctgggcatagtgggtcacatctgtaatcccagcactctggggggctgaggtgggaggatcacttgagctcaggagttcaaggccagcctgggcaacatagggagagcctgttactacaaaaaataaattcaaaaattagctggacctggtagcatgtgcccacctacttgggactcacagtcgggaggatcacttgatcccaggggtcaaggctggagttagctgtgattgtgtactgcactccagtctgggtgacagagcaaggccccatctcaaaaaaaaaaaaagttaacttgctcattccagtggaaactcgtcttaaaaatagatgtgagaataggagggacctattagtagctgggtggagttatgctgtatttaatcattactttaggaatgaaggaattcattcatcaacaaatacactctgcatacttgctaggtacctggcattatactaggtaggccctggggatacaatggtgagccaatatgcttgatttcttgaaattcaccatctagtgaaatcaaatatatctatacaaattttggagagtctggttctgctctcttaattacgagtagaaactataatagaaccctttccttactttttttctttctcccgcttactcttacgaggggtgaataaatgaataagggacaaaatcacatcagtttctcagtgttagcaaatggctaaggtgacagtgcttctcactctcttgcagtaacctcaaaccttgaagtacgaggtaattcaaacattgcttcaggaaaaataaattaaagcttttttttatatactctttaaataaaagagttaaaataaaactaagtgaaagtagcagaataaaaagaaataactaagtaataattcctctaaagttaaaaactaaaaattattctagatgttcaactataaaatgttgcaaaaaagtcctgatgaattctttgtaatccttcttgaatttagttaagaatgaccatttgctaatttattaataggcacacagaaaactcacagtcaagacacgtcatatccttttctcctggtctttctctcatttctcaaataaatatatatttaaagcaacatactagagatgaaatagcaaacttttatggtctagcatttaattaaaaaaccccaaacttcatacaactcttacctgtttcagcctgaagtttttttaagttatagccaccaggtccaacaaattttgctcgttttgataatggaacctgaacagtttctggaacgtaatacagacaaatatataaacaattcaactacatacatgaacctaaaacatgccatggtcacttgagattttttttttttttgacctagacacatgtaaaaatattttactataaaacagaaaagtagatgattaaaattactgaaaactgttaaagaatattccctaaaatttaaagcattttaactacaaaagtatttaaaatattttcgttttgtgcactgggtaaaaacaatttaaaagcagtaatattcattcatatattaatgtttatcttaccatgatcactaaaatttttttttttttttttttgagacggagtctcactttgtcgcccaggctggagtgcagtggcgcgatctcggctcactgcaagctccgcctcccgggttcatgccattctcctgcctcagcctcccgagtagctgggactacaggcgcccgccaccacgcccggctaattttttgtattttttagtagagacagggtttcaccgtgttagccaggatggtctcgatctcctgaccttgtgatccgctcgcctcggcctcccaaagtgctgggattacaggcgtgagccaccgcgcccagccgatcactaaaattttaatgtattacctacaacaggtccattttcttttctagatgctcgaggttttgaaatagttttgttcatgatctgtaatatctccttttttgccactagaagagaaaaacacaaaaattataactacataaaacaaatatgatctgaaatactgtactcttagttttcacggtatacaatctaaaccctgtagcttaataattgaagctttccacatccctattaccttgaaaattcactcatattctcttctccaaaaatcccatcttaaatagagttgtttaatttgtaaaaattgaaatttcactggtaacccactttggcgtgtattcatgtgtcccaaaaacttagttgtgcttcttctttttttaaaatagatatgggatctcactacgttgcccaggctggtcttgaactcctggggctcaagcaatcttcctgccttggcctcccaaagtgctaggatgagccaccatgccatgcctggctacttagtacttctttttttttgagacattttccctctgtcacccaggctggcgcgcaatggcatgatctcggctcactgtaacctctgcctcctgggctcaagcgattctcttgtctcagcctcctgagtagctgggattacaggtatgcaccaccatgcccggctaatttttgtacttttagtagagacagggtttcaccatgttggccaggctggtctcgaactcctgacctgaagtgatctgcctgcctcggcctctcaaagtgctgggattacagacatgagccaccacacctggccagtacttcttgatctaagttatatgaaattccactttttaaagcaatattttataataagcctaatgagaactatagttcccattagcaaagtggaaaagaatgaagggagaatcaagcacactagctcacctgaagcttgttgaatagcctccatcacaatttttattggtattccaggtaatttaatatcagcctaatatggaaaagtcaaacaattatataaatattgactcatggcattatttaaatgttacaaaaatgaaacaaaatgggttttaaaaatacctgtaatgcagttattcctttattagtgccagctattttgaagtccatgtcaccattgtaatcttcaattcccttcaggaatttaaaaagttatgacatagttttaaacaaaaacaaaagtcaacatattcactgtagaaacatttcaaaaaacagctttagaagtaaaccatatcctaagtccaaacacaaagcaatgttttctacattaactaccacttccaatttgtgactttttaagctacaattattttcaccagaaacatcattttatttttagatcattcctttccctcataaatgcctgagaatgaatttatgctcatcctaaagtgagtcattatgaatacttacactgtgtaagtattactgcaatacttaagggtaagtattactatttttttaaagtaatcattttattttattttattttacttattttgagacacagtcttgctctgttgcccaggatggagtgcagtggcacgatcttggctcactgcaacctctgcctcccgggttcaagcaattctgcctcagcctgccaagtagatgggattacaggtgtgtgccaccatgcccaggctaatttttgtatttttagtagagatggagttttgccacattagccagactggtctggaactcctgacttcccaaagtgctgggattacaggcatgagtcactgtgcctggcctattactattaatataatatctattttaaattcatatcctataagatacaaggtgaacatgcagaggaggaagggaagaacaagtacctgttcttcaaatactagcattcttctaagcatacgctaggtgcaaagtacatatagtcttcaccattatttgtttttatcttttaatttttatttatttatttttagtcttcattattaaatatttgaaaccgagaatatacttgccaaaatatctgtcagcaaacgataatcttctatttcacccttctcaggatcggttttggtgaccaatcctattgctacgcctgcaacagcagatgaaattggaacccctataattgggaaaaagaacaactgtgggtaatgtgtacatgagcctaaaacaaatatttatctatcaatttttttttttttttgagagggagtctcggtctgttgcccagactggagtgcagtggcatgatcttggctcactgtagcctctgcttcctgggttcaagcaatcctcccacctcagcctcccctatagctgggattataggcacccgccaacacgcctagctaatttgcttgtatttttagtggagatggggtttcaaccatgttggccctgttggtcttgaactcctgacctcaggtgatctgccagcctcagcctcccaaagcgctgggattacaagcgtgagccaccgcgcccagcagacatttacttttaatgtaagtggatattgttgcctaaattgacaatcaccgaagctgagttggaagtcttaagaggtcatctgactacttcgtttgtttttgaacatataataaagttccctaaaacaatgtaaacaagtactatatccagcaaaaacttctctaacaatagcaaactttataacttttaaattatccgttggtttgcttttttgcttcaggtgtcttattttctttttgttggaaagtaagcatctatttggtaaattcttccagcctgaactcctcagtttacctccccatggcagctaacattagtgtatcctcctagaaaatttctgtgcacaagtataaatgtaaatataatcttttgttttctttactcgtggcggcagactgtatgcatttactgttctgcaccttgcctttttcacttaataacatgtcttggatattgacacataccaccacacaaagctctactttattcctttgaatagttttagtactccctgtatgttttacaagtcacacacagaagtgcgattgctgagtcaaaaggtatgtgcatttacgtttgttagactgtcaaactgccttctaaagacatagcattttaaacttttaccagtggtgtaagaaggtatatgctactctatattcttattaattcttgtcaaatcttttgatttttctcaatttaaagtgtaaaaaatggttattttaaatctgacttgttttttatgactgaggttgaaaactatttcatgttcataaacctatttatatgtcttattttgagaactccctgttcatggccttcaacacttttctacttggttggcagtctttttattactgattttctttcaatatggacagagctttattaaaatgtaaagataaaatattatgtttaataacatataaataaaatattttatttcctagttcgttgactttgcttatggtcattagttttctgtgtaggatttttagtttacgtaatcatggtttctgggttttgcttagcagagcttttcttctccaagattttgataaaacctaccatctttcatttgtttaaaaatgtttaagttttgatcacttggaatttactttggtataaaggagtgtggatctcatttcattttctctaagcaacctcatctatacttacgattttaaccaccatctataatgttgatgacttaaaaatctatccctcctgtccagctatctgtgccaaaccctggacctgtattagtaaactccctgtcagacatctccagctaaatgtccccaaagcaccttaaatatatattcaaaattgagccaggcccagtggctcatgcttgtaatcccaacgctttggcaggccaagatgggaggatcacttgaactcaggaatttgagaccagcctgggcaatatattgagacctcatctctataaataataataatgatgatgatgaaagaaatacatatatgttcaaaattgaatcactgtcaaaaaatccttttcctcctgcattctttggttgaaagcaactaagacactcatgccagaatcaacatttctttcctcatttcctatatcccatcaagtcacaaagatctgtttatttttttagaaagctgtcctttaccctaaatattaaaatacctattgtaactttttagtctgagtccatatcatttcttgccctggcaacaatctccctgtctggcttcccagattttactttctctctttgcttcttagtctctcccatctcattccgcagggctattcatcacttaagctgggaaaaactgtttggaaaaaacaaaagcagattcaaatcatgccactgttttccataaaatccttcaagttccccattgcctactttcaggaaatttttgtacatattctgtggtcaaataaatttggaaaaatattacatgtcctattcctagagagtcagtattcggattagcttattaaagtctatttaatccatattaaataaacctgcttaaccctgctgaaacttaactttagaacagaataaactttttcatggtatacaataatcaatgtcctgtggaacactattccatggaatactgaattggaaaaatgctggctttaagtccaaactccttagcgtaacaataaccttcagattgtacaatgtgtggctttcttgaggcactgcctctcgagtccctacctcaaactccacttcaaataggagattttatgttggggaaagaaggattggtaaagaattcttacttaaaaaaaatcctgccctctctccctctctccacctctacctctacctctacctctacctctacccacggtctccctctccctctctccatggtttccctctgatgccgagctgaagctggacggtactgctgcctgattctcctgcctcagcctgccgactgcctgcgattgcaggcgcgcgccgccacgcctgactggttttcgtatttttttggtggagacggggtttcgctgtgttggctgggctggtctccagctcctaactgcgagtgatccgctagcctcggcatcctgaggtgccgggattgcagacggagtctcgttcactccatgctcaatggtgcccaggctggagtgcagtggcgtgatctcagctcgctacaaccttcacctcccagcagcctgccttggcctcccaaagtgccgagattgcagcctctgcccggccgccaccccgtctaggaagtgaggagcgcctcttcccggccgccatcccatctgggaagtgaggagcgtctctgcccggccgcccatcgtctgagatgtggggagcacctctgccctgccgccccgtccgggatgtgaggagcgtctctgcccggccgccccgtctgagaagtgaggagaccctccgcccggcaaccgcccagtctgagaagtgaggagcccctccgcccggcagccgcgccgtctgagaagtgagaagcccctccgcccagcagccaccccgtctgggaagtgaggagcgtctctgcccggcagccacctcgtccggcagggaggtgggggggtcagccccccgcccggccagccgccccgtccgggagggaggtggggggatcagccccccgcccggccagccgccccgtccgggaggtgaggggcgcctctgcccggccgcccctactgggaagtgaggagcccctctgcctggccggccgccccgtccaggagggaggtgggggggtcagcccccccgcccagccagccgccccgtccgggaggtgaggggcgcctctgcccggccgcccctactgggaagtgaggagcccctctgcccggccagccgccccgtctgggaggtgaggggcgcctctgcccggccgcccctactgggaagtgaggagcccctctgcccggccaccaccccgtctgggaggtgtgcccaacagctcattgagaacgggccatgatgacaatggcggttttgtggaatagaaaggggggaaaggtggggaaaagattgagaaatcggatggttgccgtgtctgtgtagaaagaggtagacgtgggagacttttcattttgttctgtactaagaaaaattcttctgccttgggatcctgttgatctgtgaccttacccccaaccctgtgctctctgaaacatgtgctgtgtccactcagggttgaatagattaagggcggtgcaagatgtgctttgttaaacagacgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgtgagaaacacccaagaatgatcaatttaaaaaaaaaaaaaaaattaaaaaaaaaaaatcctatttctgtataaagctatccttcctctgactagaaacaactaggaaataaagagaagacaaagataaaaaggaaagtcaaaaaaaaaaaaaaaaaaacaataaccttcaacatatggttctactttattaccttaacacctctttcgagtagattcctgaaacacactacactgtaacttcttaactttgcacatgctggtcctttcatgtgaaatacaggccctgctcctaatatgcccagtcaacaattactcagcctttaaaatcagatgaaatgtagcagtctctctcagccaattatgctcagcctagttcaacaatcacccttacacatatttgtattattacctcttcaatctattagtatctttttgttttcaaacctttaagctttttcaaaaactgggtacaatttgcatccctggggcataggacagtgcctgacttagggcagggcaagccctactctagcaattcaaattcatatttgaattgaactgcataccttgtatcggcccatcccacaggacttgacattcattcttatcaaatttaatttttttgaggtttttggctttaacgcttcaaatttaatttttaaactattaagctccatatttttttatcctgctcaattttgtcagtcacccattccttttaatcagtatttttattggcagtatttttactggcaggccagtgttctcagtcaagtcaacattgaaagagacagggctgaaataagcatcctcacgtcttcaacttgagatcattctctgacctgttgatcagattaagcagtccctttgctcatcccttaaccagtatgaatggtgcacctattatttagtctaaatttctgcatcatttacacaagatatcataaagatatcataaaccgtaaagctgaattatagatatatcacaccaacagcaataccctctactgcaaatgcagtaatttcttcaaaacagaaagtgaattaactatggcatgacttattttagagaagtcccttctggcttctttctgtagtccctttccttttttgttttcttgagacagagtcactctgttacccaggctggagtgcagtggcacgatcttggctcactgcagcctccgcctcctgggttaaagtgattctcttgactcagcctcccaagtagctgggattacaggcgtgggccaccacacccggctaatttttgtatttttagtagagacggggtttcactatgttggccaggcaggcctcaaactcctgacctcaagtgatccacccacctcaggctcccaaagtgctgcaattacaggaatgagccactgtgcctggcccctttcctttctaaactacttataaaccattctttttttaagttcttaagagtcttgttgagggtcacgatcaagttcattgggttatactttatagaaaatacttttcttctcttccaataataagaacgttttctgtccttgggatactagtctccacgatttctcaatgactgccatcatacttcagtaatctaatcctgaagttctcattatagtcaaggatgagtttttgtctagaccaaaagatctgaattcatttaaaaatggcaggtaaagactcccctatgatgtcatcttttatttttcagtttacttttttcaagatttgttcagtgttttccagtatgagatttggaagactgagaaacacaagtgccatgaagtctaagactgttttgttcatcaccatgtcctaacaacttagatcagtgcttggcacataggtgccacaaagtaaagatttgtagagtgaaagaatgaagatgaaaatagtagcagcagtattttaccagctaccttaaatatcagattatgttttcctttattgaataaattacaaaagtaccttttgcattttttgctttggcctgtttttagtttcaatttttctagataatattattatatattcaaaccatgttttcatttaatcctttgttattcacggccctcttttctatctttcatgccagtactgtaaatgtgttaagttatcagagaaatccttttgtggcctctttagtgtctttaggttccttctctctttcttctcgaatagcagcattcatgacagtttggcacgaattggttttaagaatctcctagcggccaggtgtggtggctcatgcctgtaatcccagcactttgggagggcaaggtgggtggatcacgaggtcaggagttcgaggtcagcctggccaatatggtgaaaccccgtctcgactaaaaatacaaaaattagccaggcgtggtagcacgcacctgtaattccagctactcaggaggctgaggcagaagaatcacttgaacctgggaggcggaggttgcagtgagccgagactgcaccactgcacttcagcctggacaacagagcgagactctgtctcaaaaaaaaaaaaaaaaaaaatctcctagcataatgctttcgtttttggcgtttcagacctggggattataatgaaacatttgtagtccgccttcctaaaattgtgtgtacacgcctgagtggcattgttctcttggcttgtataaatcgactgaaagattacagttgctttctcttatgattcctaatagtacttactaatcaaaacttccttggtgattggaatcaattctggagctctctaccttttggaaggaaataaagtttactgggtcaccaatgcaaataaaaatttttcagtgtactgcttttagctaaaaataagaattccagcagatatctggatatctgaagctctacttttcagccatcttgcctctggcttgatttggccatctgtaatctgactttgagttttactaaaacccaaatttaaagaaatcttatattttatactaacaggtgtgtataaaaggttagcatttttttttaatcttttttgtagagatgaggtcttgctatgttgcccaggctggtcttgaactcccagcctcaagtgagcctcctgccttggcctcccaaggctcatgcctgggattacaggcatgagcaatatcagcagttttgagacataattcttttacctgaatccattaatgctaaacttccgccacatgcagatgccatagaagatgaccctatagaaagaaaaataactgctttatattaaactgatttttttaatgtagaaaagtgttactattggttatttccttataaatattcagttacaatacaaatattcaatagtctcttctttttaaaagcaactaaggcaaggtcttttaagctataaactatggggctgcaaggtccaatatggtagacattagccataagtggtgacttaaagttaaatcaattaaaataaatttaattcttcaactagataggacagataaagaggatttctatcatcacaaaaagttttattttactattattttttgagatggagtctcagcctgccaccacgcccagctaattttttgtatttttagtacagacagagtttcaccaagttagaccctttggaccttatgatccacccgccttggcctcccaaagtgctgggattacaggtgtgagccaccaagcccagcctatcacaaaaagttctattgcatagtattgctacagatattctaatagacttcctagtgcatatcttttgtcttgcttatcagaagtagttaaagatatagggctttggctctctcattctcataagcccattaatttagtcacacccagtagagaaccacaaagtctttagttaaaattctgagtttaccttggtattttttcctcaaaatctgtgactatctgatttacgtctgttacacctttaagaactccatgacctttctgcctttaatgactgcaccgtaccttgacccatggacaaattttttatttaaatgtgacctcttggcctagactccctctgtgatgtacacttattattcatgtggatatgtgacaggtatctcctgcctaatgatcactctattttggcccttcctctctctgttaaccttgttctgtggtttgtttgtaaaaataaagaaacaagccaaactggatctactataacagataaagaaaaacatttgttttatattgctttcaaaacaactcattagctaagaacagagattaagacaagtatttgattaactcaatacatttttctcttgcaacaaacttgggttctgtagtaataaacaaaatgtaacattacatttgaaaacttaataatagaatagggaatatggtcttttctactatgaaagaagtatttcaataccataccatttgactctaggacttcagatgtaactcttatggtgaaaggaaaatctcggggaataacaggatacaaagctttctcagcaagagcacctaaattagaatagaaaacaataagtaaaaaatgtattaagtctctgtaagaataccgtattaagtttacagacctgtacttaccatgcccaagttctcttctatttaaaccagtgactttgccaatttcattagttgcataaggaggaaacttaaaaaaaaaaaaacacaaacacacatatacaattgacatagaaagatgtccaagttatattaccaaaataataaaacaacttatagaacagtagaatctcatttttgttttttaaaaaagtacattcataaatatacagaaaacgtatgatataaatttaacatacataccaaatggttaaaagtagctatttcaagtgtgtacatggattaggatgtgggaactggatgggtatggggatttacaccataaatttccattacatttaaattattaacaataacgttatatttttgtaataagtaaaaatatgtacatatttaaaaagtacacattgaagaatcacagatttttttccatagcaaagcccacatttatttcactaaattgaaatttaatttacactgatactttttagagttatctctctccactaactttttcagatatgaaacaaaatacatgaatgggaaagttgcatattttgaagtatttctcaagcaaaacacaatgacaaaaatgtatggaggaaacagctcttttccataagggttttattttagccagtggttgcaaactgttttatttggtggatatgttaccttgaaggaatatgaattagttgtgatcatttgacaataggaagacttcccataaaaatctgtaatttcaggccgggcgcagtggctcatgcctgtaatcccagcactttgggaggccaaggcaggcagctcacttgagctcaggagtttgaaactagcctggccaacatggtgagaccctgtatctactaaaaatagaaaaatcagcagggcgtggtggcgcatgcctgtaatcccagctactcatgaggctgaggcacaagaattgcttgaacccaggaggtggaggttgcagtaagccgagactgcaccactgcacttcagcctgtggaacagagaccctttttttaaaacagaaaaaaaaaattcccccaaatatctgtaattccagattaacaagaattttttttttgttttttctttttttttaagacagagttctgctcttgttgcccaggctggcgtgcaatggtgcaatctcggctcactgcaacctctgcttctgggttcaagcgattctcctgcctcagcctcccaagtagctgggattacaggcatgcaccaccatgcccagctaattttgtacttttagtaggacagagtttcaccatgttggtcaggctggtcttgaactcctgacctcaggtgatccgcccgcctcggcctcccaaagtgctgggattacaggcatgagccaccgctcttaaatgcagtggatggagcaggaatctgattaaacctctggatctagcggtcaatttgcaggaaatagagaggggggaggaacatgttgaattgcaccatgagtgtacaatcagcaacacccagactgtgggagactataagtcaaatggctatggggcttcaatagatagactgcaaaaaaaaaaaaaaaaaaaaaaaaaaaaaaaaaaaaaaaaaaaaaaagaatgtaatggaggagaaatgtatagatttaaaaagacttaaagaaatatcaggccgggcatagtggcttatgtctgtaatcccagcactttgggaggctgaggcaggcagactgcttgagcccaggagtttgagaccagcctggacaacatggcaaaaccccattttgtaaaaaatctaaaaattagcggggtgtggtggtgcctgtagtcccagctacttgggggactgaggcaggaggatcacttaagcctgggagatggaggttgcagtgagccaagatggtgccactgcactccagcctgagtgacagagtgagactctgtctcaaataaactaaaacaaaaaaggaaataccaaatgttttaaagaaaaaaacaaaactaaactatagtatctaaaaatggagccaggaaatccaagatgattactgtaaaacttaggagagtagttacctacttttaagagacgacgggtattgagattgggatgaagaacatggaggggcttttgaggtggctggcaatgttaaatttcctgacttgggtggtggttacaaggatatttgccttataaaaatgtattaagccatcctttgttttatacagttttcagtacctatgctttattttataataaagagattcacaaaaataaaatatggcaataatggcccatatccttctccagctccctccccaacccccttacccaataatcagctagacctccattttgcacagctgcccttttaagactgccatgtgctctccagctcatgacaaagaacctgctttactcaattataattcctttctggcttctgtagcaccaggctatatccagaacaggatatttataagggattcaagacctgtatgaatcttgatgtttatggatattctgtagcatataatttctacaaaaaaatgttctctattgattacagcagattcagcaagagtgaaatgctgagactctgggcagccaacaagggttacacaaaaacgaaatgacttgctactttacataagtctctcatgttgtattctttttctttttattttttgagacagggtctcactctgttgcccaggctgaagtgcggcggagtgataatggcttgctgcattctcagcctcctgggctcaagcaatcctcccatctcagcctcccgagtagctgggactataggcacatgccaccatgcttggctaatttttagatcttcttgtagagacaggatctcactatgttgcccaagctggtcttgaatttctgggctcagcaatcctccctcctcagcctcccaaagtgctgggattacaggtatgagctaccatgccctgctctccatgtacattcttcaaataataaaattaaaagtactttatattaggtctggtcccttaggatttgttgtgaataaagtcaatcacaaactcaattatctataatcatctcatataaagtaacttaatactaaacgtctcatcttttactactaatcaactgagtataaatatgaacatttcaatgagcaaacagaaggtgatttgggagttgaggtatttaaaaaactctacttttgtttgacagacgtgtatacaggcatgacttttttttttttaacctaaaacgatattgtctgctatactttaacttttacgtatgacttagaacaggaagttgttgattagaaaaataccacttatctctctaaagtacttatctcttatctctctaaagtagtactttagagagtgctaaatactctctaaaaatactacttacatctctctctacttatcattctacacaaagcttgccatgccttctgtaagcaataaaatagtagccccaaattgaccttaatagatatatgataaaactagaaaagtaaaatattattggtaaaacccaggtagtggatatatggatagtcactgtaaagttctttcaactttactgtatcctggaagtttttaaaaataaaatgttccagcctgagcaacatggcaaaaccccatctctagaaaaaaatagaaaaattagccaattgtggttgcacaagcctgtaatcccagctacttgggaggctgaggcgggaggatgtcttgagcctgggagggagaggttgcagtgagctgagactgcaccactccactccagcctggacaacagggtgagacctcgtctcacaaaaatttattaatttattaataaaattttgaggaaaaaaattcaccttacctcgtagtgcagcatgaaatttttatcttttatcccactaaaaataaaaggcataatattaaaaacatcatagggaaaaaacatatttatttcaaaacacaactaaaacagatttaaggggattttacaaaagaactaggtgttaatgaaaaatcagactgaaactgaaaaccaaagaattaattagaaggatgattgtgagatgatattttcttctggggcttatgaatgaattgtacagatttaggaaaccaattttactttaaatataagtccttaaatatccagatttgaacactaagacaatagatgtatttttaagcattaatgactactgagagaatcctaaatgctatacccacgttagttaaatctcagagctacaatgcttctcccagtcaatatgtgaaacgaagaaaaagtcctgggatggggcagaatctgcatgatcataaactgtagctttggaaaaagaaatctaaaaaccaaactccttcagaggactaaaggaatcacagatttggtgagccagagaggattatagcaggtcactggcccagttcatttgataagaaatagaaaccaaaggccagtgtggctgagtgatgatgtgtgcccctttatttacacaggttatagacctaagactagaatatatggaggtaccctgaccaagcccagtgttctgcattccaccttcacacacacagctgcactgtcgattctatcagatacatggaaaacaattacagtggctactaggaattatcctcatcagttgggcatcaggaaaaggagggccgagccttgtggtcttctgagacccttaaccaggaacaggaagtagccctactaggcactgaggaaaataaagaactggctatgagagtcaagactctatgcaataatgctggtgaggactgcaatagagattcttttttttttttttttttttttttgagacagagtctcgctctgtcgtccaggctggagcgcagtggtgtgatctcactgcaacctccacctcctgggttcacgccattctcctgcctcagcttcccgagtagctgggactacaggtgcccaccatcacgcccagctaatttttgcattttcagtagggacggaatttcaccgttttagccaggatagtcttggtctcctgacttcaggatccacccacctcggcctcccaagtgctgggattacaggccaggcgtgagccaccacgcccggcctgcaataaagattcttatcatcagaattgatttggcctgcaataaagattcttatcatcggaattgattagcatgattttactgttgactttttaggggcagaggaggacagccaagtatttctgaacacaaaatcacaacgtggcttgggattcgacaaggcttttcattaacgaggtttttcattaacagcctccagattattttcagcaatgggagctttcgtgtattcatttgctctcgtttctaatagaaaaaccaatccattcaagattaccaaggaagcctgtcctaagaaatcattctagagacagagaacaaactaaatatactcacattaaagaattaaatgctttactaatatttgttccaaatcagtgatttagaagacaatctagcacacacacaaaatcctttgaaatcatgatgatgtaaacagaaaaatgaagtacaaaaacacaggttaaaaaaagtaacaataattaataatataccacataagctttaattatataatagaacatcataaaacgtaacaaacatcttaaaaacataacttactttatagctgttataacttgatctgacttaataccagattctaatgaatcaaatgtaacggtacaaagcacctaaaaaagaaaaagaattcctcaggctttaatatactaaccacaaagatgaaaactaaaaatacttgaagaatccaactaactcttaaaaaaatgagataagtacatcctacacaaagcttgccatgctactaactgcattaaacacttatttattctataaatattcatactatgtgtaaacctcaataatccaaagttctaacatcacatagactacatatgtaaagcactgctctaggagtgctggggaaggaaggcaggaagagaaagcaatgtttttaagaactatgtaggagagtacgctgaggaagccttaatacaggttcagccaatacaactgcctgcttaaaattaaaaaaaaatcaggccaggcgtggtggcccacacctgtaatcccagcactttgggaggctgaggcgggcagatcacaaggtcaggaattcgagatcagcctggccgatacggtgaaaccctgtctctactaaaaatacaaaaattagctgggcatggtggcatgtgcctgtagtcccagctgcttgggaggctgaggcagaagaatagctcgaatccaacaggcgaggttgcagtgagccaagatgacaccactgcactccagcctgggcaacagagcgagactctgtctcagaaaaagaagaaaagaaaaataaattaagaaaatcagtcttctttgtagagacataacataatccagacactctacaatgtatcattcacaacatccagaaaacaacctacaatgaaacaggaaacagggcccattctcaagaataaagaccaggaatggaggctgattctgagttgattaagatggtggattagcagacaaaagatttttttttttttttttggagacggaatctcactctgtcacccaggctggagtacagtggcacgatctcggctcactgcaacctccatctcctgggttcagacgattctcctacctcagcctcctgagtaagtagctgggactacaggtgcgtgccaccacgcccagctaattttttgtatttttagtagagatggggtttcactgtgttagccagtatggtctcgatctcctgacctcgtgatccatctgccttggcctcccaaagtgctgggattacaggcgtgagccaccacgcccggcgacaaaagatttttaacagctattataactatactcaaaggacataaaaaagaataagtggaaattctagaattgaaaactttaatatctcataatggaggggagatggcaagagtcagtgagcatgaagatgaatgaacagaaattgcccaatttgcagaagagaggaaagagaacatagttgcagtgacctatgggacagtatcaaaaggataacatatgtgcagttgcaattctagaagaagagagagaatgaggcatgaaaaaatatttgaagaaataatcgatgaaaattctcaagtttggtgaaagacatcaatgtacagatttaggctcaggacacttttagcaggataaactcaaaggaaaccacacctttcaatcataatgctgaaaaccaaagatgaggtgcaaatcttgaaagcacccacatgaaaaaaataatagataaggaacaatgatttgaatgggtccttttcatcagaaaaacatggagaacaaaaaacactgaaacggctgggtgcggtggctcatgcctgtaatcccagcactttaggaggctgaggcaggtgaatcacgaggtcaggagatagagaccatcctggctaacatggtgaaaccccgtctctactaaaaaatacaaaaaaaaaattagccgggcgtggtggcagccgcctatagtcccagctacttgggaggctgaggcaggagaatggcaggggcatgaacccaggaggcggagcttgccgtgagccgagatcacaccactgcactccagcctgggcgacagaaggagactccatcccaaaaaaagaaaactcataggatgatattaaaggaagtcttgtcagaatgaagggaaatgatactggatccatacttggatcttcagaaaggaataaaaagcaccagaaatggtaaatatgtgggccaatataaaagcctatctttttcttattacttctttaaaatacatgattgtatgaaagttataacaccaccttgtgggggtttatgacacatgtagatgtaactgataagacaactgcaatataaaggatagaaggggcaggaaatgcacctaaatggttgcgaagtttcttcattttatgttaagtggtacaaaattaattctaaaaagactgtgagggtcttatgcctgtaataccagcaccttgggaggcgaaggtaggaggactgcgggagcccgggaattcaagactagcctgggcaatatggcgaaaccctgactctacaaaaattttttacaatatataaataaaaagttgtgagaagttatggatgtatactgttatttctatagtaatcactggaaaataactcagaagtacagctaaaaaataaataggcaaattaaattaaaattctaaaaacaattcaattcattcaaaaagaaggctgaaagtaaaaaatagagaaacaaaaaacagaagggcaaaagaaaaacaaataataaaatgacggtaaattcaatcacatcaatgattaaatttaacatgaatggactaagtactacagttacaaagccagagattgtcacaatggataacaaaagtatgcagaacatcttaataaaggcattttaaaaacttgactaaagagcataaaagaaaacctgaatcaaaggtgacactgactctattcattgtagactataacttaaattgtaaaagtatgattcttctctcagattaatataaaaatttagtataattataattataaatcctagaaggatattttgagaacttgatataatactaaaattcaaataaaggaacaaatgtatctaaattttaagataattttgaggggattgaacaaacagggaagatgacttgcttctcagatattaaaatatacccctaaatcataataattaaaatagtttgacagtggcccagaaaattcacgtaacaatgaaaaaggatatagtttaacatgcatttataaactttgactatcatatggtgacatcacaagtcattgagaaaaataaagtattagtaaataatgtataattggctcactatggaggtcttcctttcatacaacgtgtaggaataaattcaaagatcgactaatggtctacattcgacagctaaaactagaaagctaatagaaaaagtaggtgagtaactttgtgactttgaggtacagaagaatttatatcagaactaagttttcaggtttactctaaacatagcagactaccacaggcaaagttaaaaggcaataaataaagaaggagacatatatatataaagtttgttaccaaaaggaattaatatttaaaacacttcagaaattactacaaaatagcaggtaaaacacagtaaaccatattaaaaaaagaaaaactggccaaaggatatggacagaaaattcataaaagggcaaacctgaggcaaggccaccacactgcacaactctaggggacaacattcatgtggaaatagtgccctggaggtgtgcagttccccagggcatggtttatgcagtgaccatgttgactggctgttatataaataatgctgagcctcactagtaatcaggaaaataaaattaaagcaaaaagttactacttggtgcctatcagattgatagaattaaagaaacaattaatgtgggaaaggagtataaagcataatatggtacacagaacaatgaatacagatgtaggtaaatattaataaacgaaaagaaggagaaccagaaggctacctgttaaatacaagagtgggtgcctatgtaaagaataaagaatagaaaaagaatagaactgtacaggctaaatggagaaaacaaatgagggccttgaacaggtcaacaatcacaatatgccataaactagagtctgagttactcaattttgtatacccaatattaaaagaaagatacaacagaaataccagataattctagaaaatgcaaactaatttatagtgacaaaagcagatcagtagtctcctgaggaggtggggggcaggaagaaggcattacaaaaaggcatgaggaaactcttggaggtaactgatatgttcattatctttttcatttttaaattttttaagagacagggtctggcttggtagtccaggctggagtgcaatggcatgaccatagattattgcaacctcgaactcctggcctcaagcaatcctccctcctgggcctcccaaagtgctggaattacaagagtgagctaccatgcctggcctgttcattatcttgctggtttctcagttgcatacttgtgaaaagttaccaaatcatacattttaaacagcatagtttattgaacagcaattatacctcaaaaaaactgttaaaattacataaaaaacacaccaaaggccaggcgtggtggctcatgcctgtatcccagaacaccaggaggctgtggtaggaggattgcttgaggccaagagtttgagaccagcttgggcaacatagtaagaccttgtctctacaaaaaaaagtttttaattaaccaggcatagtggcacacgcctgtagtcccagctactcaggaagccgaggtgggaggatcgcctgagtccaggagttagaggtttcaatgagctatgattgtgccactgcactggagcctgagtgacaaacaagaacctgtctcaaacaaaacaaacaagaaccgccagatattaatttaaataaataatatacaccatatgacaaaacctacagcatctactaatgtacttctattagatctaattaaacaatcttaatttagcaaataattagagctttttatataaattacctgtgtttgtcctctttgaaataatgctgatccatgaagggttttaaacatatctacctcacaacttacattcctaagtgaagtcaaatcccgaccatcgcacctatagtgatataggaaataagtacattaagtaacgctggaaacagaaaaatcacatgtctttatctctcccaggaagttctcaacctcagttgtgtatcataatcccctgtggaactttaaaaaataatagatacttgagcactatcctgaatatcactgaatcagaatgtctgaagttgaacctatattcctgtgttgttaaaaaactctacaggtaggccgggcgcggtggctcatgcctataattccagcacttttggagtccgaggcaggcggatcacgaggtcaggagatcgagaccatcctggctaacacggtgaaaccccgtctctactaaaaatacaaaaaattagctgggcatggtggtgggcacctgtagtcccagctactcgggaggctgaggcaggagaatgacgtgaacccggaaggcggagcttgcagtgagccgagattgcactccagcctgggtgacagagcgagactctgtctcaaaaaaaaaaaacaaaaaacaaacaaacaaaaaactctacaggtaatcctgaagtgcagtcagggctggcaggcaccgctttatacaccaggcccaagacagatggtcacatatcatgtactttttcttcaataggtgtccatttatatagcaaatattataattctttactgttcacttgaaaaaaaacaaactttctttgatcaagtttccattttcaaggcaacttgcagagacagtgcatacttcaatttcaacaaaaaagggtatgtttaccttttgtattcattcaaaacaatacttctaaaaacttcctttgcaacaacattgaaggattctattatttcatatggatcggcttctggaaatttttctatagaaaaaagacaaaccaaaacaaagatttttacttttttaggagataggatttctctaaagttcatagcataatatcaactaactacgggaatcaaccaagggagatgactctgaacgtttagtcctcaggcaaacaaagtagataaattaaatgttctcaaccaaatgtgacacatcaagtaccaagtactacaactgtgttgttattgtgaacttagtttgttttctacctaaatgactgaatgacagtgctttgaaatcagttcccttttctttctttcttttcttttggagacaaagtctcactctgttgtccaggctggagtgcaacgccgcaatcttggctcactgcaacctctgtctcctgggttcaagcaattctcctgccttagcattctgagtagctgggactacaggcgtgtaccaccatgcctggctaatttttttgtattttagtggagacggggttttaccatgtggcccaggctgctcttgaactcctgaagtcaggcaatctgtctgccttggcctcgcaaagtgctaggattacaggcgtgagccaatgcgcccggcccatcagttcccttttctattatgttaccagaagaatccagtcagcctttatggaaaaggtctgacagtcttttttttttgagacggagttttgctcttgttgcccaggctagagtgcaatggcatgatctcagctcaccgcaaccatcgcctcctgggttcaagcaattctcctgcctcagcctccctagtagctgggattataggcatgtgccaacacacctggctaatttgtgtatctttagtagagacggggtttctccacgttggtcaggctgggctcgaactcctgacctcaggtgatccgcctgccttggcctcccaaagtgctgggattacaggcgtgagccactgtgcccggcctaactgacagttttaagagtagacaccctcactcttttgcctttaatctaaatctgcaaattggggaaaaattttaaaaatatattagaaatccctacaaactgttttctatctaatatttgtcaaatgctttcatgagccaggcactttattggttttttaatgcttttaactttcataataacttatgaactaaattttatgattcccattctacagaagaaaaaactgaggcttaaaggggtgaagtactgtgtaagagataaccactgagtttaaaaaaaaacataaataaaaaataaagaggtggagtaaactgcctgagaccacacaggtagtaactgatacagctgtgacctgaataaagatctgtcagcctcaaaggcttatggttttattttattttatttttagcttagggtttagatgttaagctattctaccctatcaattaatttatgccaagttttaagtactattctctcatgtgtatggtttattaaacataacttcaaagtaaccaaaacacaagaaatggtcacagaaagatatattagattgtatcttcttcagaaaagaataatttttaatattagactttaatatcttttctgcttaactgagttgtacttggaaaggaaaacaatcagtaccaaaatgtttaaaatatcctatcaacccagagggtcgtgaagatattctactatgtataatacaaacaaaaagtcactattcttttaaaataagacaatattcgctataaaatttctttcttaccaaataggatgaaatgtagtgagaaaggactaaacatattcaatgacagttacaattaatggccttaatatcaatgctaacagcacttttttttttttttttgagatggagtcttgctctattgcccaggctggagtgcagtggcggtctcagctcactacaacctctgcctaacaggttcaagtgattctcatgcctcagcctcccaagtagctgggattacaggagcctgccaccatgcccgcctaatttttgtatttttggtagagatggggtttcaccatattggccaggctggtcttgaactcctgatctcaagtgatccacccactttggcttcccaaagtgctgggattacaggcatgagccaccacgcctggccagttttttatcttaaaataaatattcatgtgagagtatatttgtctattagaaaaattaacaaaaactatgtcatacttcatttatattcagtttgtgtgaggttggtattattactattatttttatttatttatttatttttttgagacagagtctcgctccgttgcccaagctggagtgcagtggcgcgatctcgactcgctgcaagctccacctcctgggttcacgccattctcctgcctcagcctcctgggtagctgggaccacaggtgcccgccaccacgcccggctaactttttgtatttttagtagagacagggtttcaccgtattagccaggatggtctcgatctcttgacctcgtgatctgtctgcctcggccgcccaaagtgctgggattacaggcgtgagccaccgcgcctggccagaggttgatattatacagtaagatcctttgcttaataatttctggagagctaaattacctaagttctgtatcttatgattccactaggtattaagaatagcatcagttaacatttattgaacacttacggtgtggcaggcacagatgtaaatgattcactcatttaatccccataaaccaggtattattaacactgcaatttcacagatcaagaactcaagaattttaaagaatatatttgggttttcaaatgataagataccaggttacatttcttgtatggtaggagtttgattcagaaaagatcaggaacattcacattcaacatttactaggtacctactctgcatcaaatgtagtgctagctacattcatagaagttaatttagcagtaaccttgtgagctatcattattacaagtttattgaaaataaagctgagaagcaatgagagtaacatttatttgagatcttcaactaaagttaaaaaaaaaaaaagtctattatttcttttaatgcttttaaaattaaaaaatacatagtaatagcggttctgtgcaaaggggactttctctttccccgaaacagttcggggaagctttggagaagaggtggcatttgaaccttgggttagaagaagaccacctgctatgagagagcattctaggtctagggaacagcagctgtaaagttgaaagtcctttgaattcttcttttcctacagatgtgatgcctttcctctttgacctttaatcccaagaagcaagagtcaggccatgccttattaaagctgccctcagcaaaaaaataaaataaaataaaataaaatttaccttttagttgttcctccgtatctaatcttattttgttaacagcttcatctctggaaacctaaaagaaagttgaggttcagttattacatatacatgacaacatttaatatttctgttttctaattattatacaatgaacacattgtgaattactctgatttctttaatattctttaaaatattggaattggttcttgatttatgacaaatactacatgttaattcattcaaatacatttgtacactcccctaaaacttatattaaaaagaaaagaactttgggtggccaaggtgggcagatcacttgaggccaggagtttgagaccagcctggccaacatggccgtctctactaaaaatacaaaagatagctgagtgtggtggcgtgcacctgtaatcccagctacttgggaggctgaggcatgagaatcgctggaaggcgaaagttgcagtgagctgagatcatgccactgcacaccagcctgggcgacagagagagactctgtctcaaaaacaaaacaaaacaaaagaatggagaaacaattaggcttttgttagtttttcatttagagatttttaataaaaataggactagcattcataaagaaaattacatgagttatgacaaaaatgtattcctagggcaattatggaagacaaaactcaggtatacctactttgtcatgctcgtaatctgtaaaaactgcatagagtctctccatagcaagtctatttaagcagaaaataaatgttagcataataatatctggaaacaagaggcagtttctattataaacaaaactgaaatatttaataataatcagctaaaactttaataaatacttcagaaagaattgaaaatttatattgctatttatcattgctaatctgtttactatttatggtatagaacacaaatttctttctcccaccctcccaggggaaaccacatgtagtatcctgttcttttcttcttaattgttcaattaatttcacctttcatatattctttttaacctcttcctttcttcattctacccattttggctccattatcacatgaaactcttttgctagaaagagttaatttaatttccaactcatggctgtgcaactgacattaagggaaagtattaaccttttcaattttttcaaataaaataattttccagtgattcatttacatttactgagtgtctgcctaacgttctaagcactgggcatgtaacagtgattacctctgatttctttttgagaattccaacagtttccttagatattcaaatatcttaacgttttattctttttcctagacgtggagagatgtggtgcttacctgaatcttgaccaataaacacactctttcatttgagattcaaagttaggtcttacaagagtgatgtgggcttatcctttttaagggagtaagcagatatttatgggaatgactcttaaaacagaaaagtgctatttatgaagtaatgcatgggcagtgcttccatgggaagtttctctcccacgaggaaattaaatctgatgacaatttcatattttcatttgcacagatgttcttacttatgagtatatttcacaatctctggcgaaggggtaaataacttctgaggtgtcctcttggtaacaccagtttcttttaccaactgctgaatgccctgaattatttgttgggtatatttcactcccactttgatagcatggcaaaagtcctgctgtaaaatgttctctgcagaggcttccaacatgactatttaaaggaaaaagaaaaaaaaaatgactgccatcgaagctcttagtaatataacattttcaaataccatgacatgacataaatattatggatcaattttacttcttagtgatagatccaccttgatttctttcctcagaatcaacatacttccaaaatgtaagcagcggtaaatgaataaagacaccttgatatctgtatttaggtttacattctccttaagtttaaggagggatttcccataaaaaatgaaacagaaaaaaaaaagaaatcatgcacatattttaaaaataagttttattgagctataagtcacataaaataaaaattaaatcttttaaagtatacaagtgcatttgtttttaatactttttttttttttttgagacagagtctcactctgttgaccacgctggagtgcagtggcgcaatctcggctcactgccagctctgcctcccaggttcacaccattgtcctgcctcagcctcccgagtagctgggactacaggcgcccgccaccatgcccagctaattttttgtatttttagtagacatggggtttcactgtgttagccaggatggtctcaatctcctgaccttgtgatctgcctgcctcagcctcccaaagtgctgggattagacgtgagccactgtgcctggcatctttttatatttttaaaaggccatatgtatgtccttttctgtgaactgtttatattatttgccaaagtgactttaggtgatctgcctgccttggccttccaaagtgctggggattacaggcgtgagccactacatccagctaatttttgtagttttagtagggacggggttttgccatgttgcccaggctgctctcgaactcctgacctcaggtgattaacccgcctcagcctcctaaagtgctgggattacaggcgtgagccaccgctcctggcaatacatattttaaataaaatgtaaaaatatgtaacacaataggaatctaataaatatttcctgtttaacaattaattctcacattgtctaattcttgcacagatggggaaatctctgcagtgatcctgtttcaagtaagccaactaaaggactgaataatagaattttttctattgcattagaaatagctaaaggaagttttctaaacagaaatgaaaaaataagagaagacatcgtggactgttagaaaggaaagaaaatcagtatgcaaactaagaataaatatagaggctgagcgtggtggctcacacctgtaatcccagcactttgggaggctaaagtgggcagatcacctgaagtcagagttcaagaccagcctgggcaacatagcgaggtcctgtctctataaaaaatgaaagaattagccaggcatagtggcgtgcacctgtagtcccagctactcaggaggctgaggcatgagaatcacttgaacccaggaggtggaggttgcagtgagctgagatcacgccactgcactctagcctgggcgacagaatgaggctccatctcaaaaaaataaataaataaatagagaaaaagagtaaatacagagcaataagcttttctttccctcttgagttttctaaattatgtttgacagttgaagcaaaagcaaaaattgtaacactgcctgatatggttctaactgtagaagaaaatgataacaattgcattccaaatgggagagggtaaagggaaataaggtttccatattttgcaccaggcctgaagaaatttcttctgataccatgatactgagatggctatattctttttctcatctgtatttccaagatatcctctcactttgacaggattaatccggagatttttaaaaattcatttaatgggtataaattatatctcaataaattgcttttaaaaataaaatatgtggccaggtgtgatggctcatgcctattgtcccagtactttgggaggccaaggtgggaggattatttgaggccaggagtctgggaccaggctgagcaacacagcaaggtcctgtccctaaaaagataacaactagaagataaaaaactcagctgcggtggtgtgcctgtaatcctagctattctagaggctgaggcaggatgatcacttgaggccagcagtttcaggctaggctacagtgagccatgatcacgccactatactcatactctagtctggacaatagagttgaggagagttgagaaccagattcaaaaaaaaaaaaaatatggctgggcatggggctcatgcttgtaattccagtgctatgggaggccaggacaggaggattgcttgaggccaggagattagcctgggcaatataatgagatgctatatctaataaaaataatggtaaaatttaaaaaatagaatatgacaaagaaaaatggataccccccaaataaactttgttttcactcattaaactttaatgcaattccttttaaaaaatactttctaagaaaatttctttagccaggtgtggtgacatgtgcctggattcccagctactcaggaggctgaggacataggatcgtttgaaccccacagtttgaggctgtagtgatgtataatcacaccattgcattccagcttggcaacagagtgagactgtcttaaaaaaagaaagaaagaaagaaagaacactccttacagttgagtctacagagctgtgctgtccaatatggtaactactagccacatatggctacttgcatttaaattatttaaaattagacaaaattaaaattttggttcctcagttactctagccacatctgaagtgctaagtagccacatgatcagatataaaacattcccttcactgcagagttctactggacaacactgctatcgatgctaaaaatttaaacataaaagcttgtcaaaatgattgctataggcccagcgtggtggctcacgcttgtaatcccagcactttgggaagctgaggcaggtggatcacctgagttcaggagtttgagaccagcctggccaacatgttgaaaccccatctctactaaaaataaaaaattagccaggtgtggtggtgcacgcctgtagtcccagctacttgggaggccgagtcaagagaatcgcttgaacctggagatggaggttgcagtgagccgagattgcgccactgcactccagcctgggcgacagagtaagactccatctcaaccaaaaaaaaaaaaaaaaaaaaaagaagattgctataaactgtcaaccattttagcagttgaagatgaaggagttttgagattagctgaagctataaattctagacccaaaatatcttctaaaaacatgttactggtatactttttcctgaccgatatcttctcacacacagaaatattagtgatattaaatataccagttgaaaacaaacatctaaatggtacggttcagaatgttggtgttgaagtaacccagcagctgacagcatggagtaactattcttgccgtgtaagattatactctaaagatctggatgactgcccgggagtggtggcccatgcctgcaatcccggcacttcgggaggctgaggcaggtggatcacctgaggtcaggagtttgagaccagcctgacaaacatggtgaaaccctgtctctactaaaaacacaaaaattagccaggtgtggtggtgcacgcctgtaatcccagctactcaggaggctgagtcaagagaatcacttgaacctgggaggcggaagttgcactgagccaagatcatgccactgtactccagcctcggcaacagagagagacctggtctccaaaaaaaaaaaaaaagatttggatgactaaatgactaaatattttaataatgaaatagtagcaattacttttttgtatttttgtatcacagaagttccatgatggtggtatttcacttggacccgatgttaactttaacaggtaaacaaggggttaaaatgcatatttgatgcatctttatgaaagcagagagagctggctgaatagctgcatggaaatagtgatgcaaaagtcataaaatggaggctggtaattcctaaaaaccatccccttacaggttggttctgaatcactctcagcctccctctacccaagactactctctgaaatttatgcgctctagagtctcattcttccctcctgtgagcaacaggtgagaagagccagctggaagttggcctgtggggtttctgtggcatgccacatgtgcagcaaagattccttggttctgctgggtgcagtggctcacgcctataatcccagcacttttggtggccgaagcgggcagatcacttgaggccaggaattagagaccagcctagccaacatggcaaaaccccatctctactaaaaatacaaaaattagctgggcatggcggtgcacgcctataatcccagctacttgggagactgaggcaggagaatcacttgaacctgggaggcggaggttgcagtgagctgagatcgcactgctgcactcctccaccctgggcaacagagcgagactatgtctcaaaaaaaaaaaaaaaaaaaaaaaaaagattattagttcattcctctaatgtctacttaacaattagaagggttcaaactctaaggtagatagtggctatatgaccaattagcagcaggtttacttctgtgtcttttttgtttgtttgcttgtttgttttttgagacagagtctcgctctgttgcccaggctggagtgcagtggtgtgatctcggctcactgcaagctctgcctcccgggttcacgccattctcctgcctcagcctcccagtagctgggactacaggcgcccgccaacacgcccggctaatttttttttgtatttttagtagagacagggtttcactgtgttagccaggatggtctcgatctcctgacctcgtgatctgcctgcctcggcctcccaaagtgctgggattacaggcgtgagccactatgcccggccatttctgtgtcttaatgataatagcaggtattaactgtatgcttattaggtaacatgctgggcactttgcaaatcttgactcttatcttcataactaccctgtaaagtaatgagactagtttactaacagcgaataaacaaacgctgtaactttcagcaaaaattccaatgcagatgaacaggaaaccaatactttgctcaaggctccgagatgctcaaacatgaggtagacatcatctattattcatggcttccccattctttggaatatcctctctacattttgatagttactcacagtacgaatcccaccttctgcaggcagaatacaaaaatcatttccttgcctcacttgcagtcgaggctatagtcatgtgccacagttctgctcaatgaggtgtaaatagaaactactgtgtggggatttctgggaaaggtgcttaaaacgcaggttgacttactcaactgccacacacctttttgctgttcccttcttttttcttcctcctgcctgtaagtcagataagttggccagagctcttcatgccagttcataagcatgaagacgaggccacatcttgaggatagcagaggagaaagctaaaaggaatctagatttcttaagatgtcatgtaaccactatcactgtcctagatttaccacctctgaatttcttttacctgagagaaaaataaagtttccatcttgtttaagtcttgtttatttggttcgacaacacaacccccaactaatatgtggggatttttctaacttatagaacctaattttaacttcatcactggctaacaaaccagaagaagctggaaatgagatgtttcacatattacttgtacaaaaaagcagtaaaagttgaatagtttgtttcatcaaaatgttcccacatcagaagaccctatgtcaaaaagtcacacacatcaaacatcacatagtagaataaaccaacaataaaagcccttaaataatctgtccaagatcacatgattatagtggcagagacaggtttcaaatccaggtcattctgactgctaaagcccattttccttccacagaacaaggacctgattttcgttcatgcaagtatgacatttctgtcacaaggagtaagtgaaaatggcccatggtcaatgcatttcttctattttattaccagttttccacctagtagaaatgggtcacttctcaagaggataccaagcagacttagaatgaaatagctaaattataatgtttaaactaataaaatggttactaccagacttagaacttctatttttaaaataagttatttagactaataacttattagtctaaacataattattgaaattatttttagactaaaaattagtcataattttaataattaaaatttagtctaaaaataattactgaaatgatcttggtaaatatttttgtatattctaaataaaattgaataaaatcctgtaattttaggaatcatttgatatgaagcaagagcacaaaaataggacagagataaaacatgacaaaaatttttatggctaccgacaaaacatacacacagagtttaaattcagtttaagaagccagaacttgtaagtaaaatccagaacaaatgtggtatttaaaacaacttaccaatctgacttttaggtgctccagcaaccactaaatttaaagtactagaagacatttcttttcttgttgggttaacaacatattctccatcaattattcctattcgtactgcccctaaaatgtattagaatattggcaactgtttaatggaaatacccagttttcaagacattattccagtcatggcttcaaccccatctttgattgtgaccacagaataaaatccatgtttctacacggtatttaagacccacagaacatcctaccccaccctaccttctgtcctcactggatcactctgaattgctgaaatataccacttcttccacacctctgggattatgctcatgtttgtcccctggtctagccagtcagtattctctctaacgcaaatgcttaacactagatcctactaaggttcagcttacacaaatgactactctgaggagccctccttgacaacctgaccacacaaaatcaaatctgctcttctctatcatattcttagcactttgactatgtctttataataacactgatcataagtaattatctgtctcctttatgcagagatcaagaactgcatctttcattgttgtattgctagggcctgctctgcctaggacacttgataattatttactcactgagccatttttatattgcatgattatgaacttataacagccgtaagttacattaatttcatcctgaaggagtatatactctgataatttcccagttaaaaaaaaaaaaaaaaaagaagtcctctaacagaaagagacaattatgaagtcaaaatatctagggacataaaatctgtaataccgtaacatatgctattagaaacagaacccaagacaaggatgaaaatgtctgaaagacctgaaaggagacttagaacgtcatctagttcaattcatgaagaggtaataaatcagagccatatgccattgctgtaacatggtcactactacttactgaaaaaaaaaatacacatatgatttcttacttttaaatcctaacttaccaacaggtccattccaaggaatatctgataatgagagggctacggaagcttaaaaaaggagaaaaatcagggccgaaattaaaatttcattgctttaaaaaaatttttaatctgataattttaatctctacttttatacttaccgccattaattgctaggacatcaggctcatttacaccatctactgctaacagattacacagaacctggtaaaagggaaaaaatttgatttggaagggttatcatttaggttaacatcctgacctaaaatacaagagcactatatggctaaaagcaggggctttgtagccaaacctcttaattttggctgtcattaaacgaaatgcttgacattggataaattacttaaattaaacctcaaaagcttcctcatctttaaaagggaaaaacaggccaggcgtggtggctcacgcctgtaatctcagcactttgggaggctgaggagggcggatcacctgaggtcaagagtttgagactagtctgaccaacatggtgaaactctgtcgctactaaaaagacaaaaattagccgggtgtagtggccggtgcctgtagtcccaactaatcaggaggctgaggcagaagaatctcttcaacccaggaggcagaggttgcagtgagctgagatcacgccattgcactccagcctgggtgccagagtgagaatctgtctctaaataaataaataaacgggaaaaataatggcctcttcccaaagggttcctatgagaatcagataaatacggtaggtaaagcacttatcacagtcctcgcatgttgcaagtattcagtaaatgttagctatttctatcatataaaaatattttctaggccaggcatggtggctcacgcctgtaatctcaacattttgggaggccgaggcaggtggatcacttgaggtcgggagttcaagaccagcctggccaacatggcaaaaccctgtctctactaaaaatacaaaaattagccgtgcgtggtagtgcacgcctataatcccagctactagggaggctgaggcaggagaatcacttgaacccggaggcagaggtttcagtgagctgagatcgcgccattggtctccagcctgggcaacaagagtgaaactccatttcaaaaaaaaaaaaaaaggctgggcgcggtggctcacgcctgtaatcccagcatgttgggaggctgaggcgggcagatcacggggtcaggagatcaagaccatcctgcctaacacggtgaaaccccgtctctactaaaaaaatacaaaaaattagccaggcatgttggcaggtgcctgtagtcccagctactcaggtggctgaggcaggataatggtgtgaacctgggaggcggagcttgcagtgagccgagatcgcgccactgtactccagcctggtcgacagagcgagattccatctcaaaaaacaaacaaacaaaccaataaaaaatttctgttggccaggtgcagtggctcaggcctataccagcactttgagaggctgaggcagcggatcacttgaggtcacgagttcaagaccagtctggccaacatggcaaaaccccatctctattaaaaacagaaaaaaattagccaggtgtggtggcagacacctgtaatcccagctactcaggaggctgaggcagggagaatggtttgaacctgggaggcagagattgcagtgagccgagattgcgccattgcactccagcctgggtgacagagggagactctgtctcaaaaaaaaaaaatttctgtttataagcatagatgaaacaaactttatactgcaataacgtgcccatgtcatgcacttaaaaaagttctttttataagcatagattaaacaaactttatactgcaataatgtgcctatgtcatgcacttcagaaaaaaacttcagtgaccgggtgtggtggctcatgtctgtaataccagcagtttgggaggctgaggcaggaggatcgcttgagagcaggagttcaagaccagcctggcttacatagtgaaaccccctctctacaaaaaacaaaaaaacttagctgggtatggtggtttgtgcctgtagtcccagctacttaggaggctaaattgggaggatcacttgggctcaggagtttgaggctgcagtgaggcataatcatgccaactgtactccagcctgggcaacagaggtcctgactcaaaacaaaacaagacacaaaaaaaacttcctgaggctaaggctgtgatattcttgcaaaggcatatttgcaaggtgtatttatttatttcaaatgaatgaaatggttacttaagtatatgtgtcattatcctgaaagaaagtattattcaggaagtattaaaatataataaagtagaggttcagaggatccagcaataaaattaggtaataaaaattagttacgttagttgtcctattcccagcctgatttggtctccactcactgtagtcacgctgatcttctttttaaactcattaatttctttcctgcctctgggctttcaatgcttccctgacacaccttggttggctaactcctactgaaattcaggtgtcaactcaaacagacactgaataaatgttagctttttaaaagcactatcttttggccaggcacagtggctcacgcctgtaatcctagcactttgggaggccgaggggggcggatcacaaggtcaggagttcaagaccagcctgaccaacatggtgaaaactggtctctattaaaaatacaaaaattagtcgggcatggtggtgcgtgcctgtaatcccagctactcaggaggctgaggcaggagaatcacttgaacctgggagattgaggttgcagtgagctgagatcgtgccattgcactccagcctgggcgacaaagtgagactctgtctcaaaaaaaaaaaaaaaaaaagtactatcttttttcaaaaacgtaatgtaaaatataacagtatcataaaaaattcttatgttctttataatgtttactctaggaaatattacagagattcattaagtaatttttgattgatctggcaactaaaaaacctaaagcagaatctacctgtgtatcatagaagtagccagctggaaagagcggtctaattgaacgatctgccaaaagaaaaaaaaacacattaaaccgtactgacagagttgctttacagttcaaaacgtttgaactaatatagatagccattcaatatgttttcaagaaaaatccccttggactgatttactaagagggacacagataaatgtcagtgcttccattattacataccatgccctaacaacaaaaaacaaacacagaagaagcacattaacaataaagattggggagcaatttttcattctggttccacaggcaacagttacatatataagcagagcaaagagacttaagaccaatagcagaccaaaagaaaatgcttccttgctactttgtgtctgaagactgtatataaatatacataaaatagcaatttctggccgagcacagtggttcacgcctgcaatcccagcacttgggaggctgaggcgggtggatcacgaggtcaggagttcaagaccagcctgaccaaaatggagaaaccccatcttgactaaaaatacaaaaatcagccaggcatggtggtgggcacctgtaatcccaatcacttgaacccgggaggtagaggttgcagtgagccgagatcgtgccactgcactccagcctgggtgacagagcaagactctgtctcaaaaaaaagcaatttctgggtagaagagctataaattacatatgatcccacaatatgtagggatgttaaagatttgaaagattatggacatatttcagtagctgatgaacataatgtttaggaattactattctgaacatgaaaaaatgtactaggaatagattcaacaaagtagaggcatgggccaaaaaattcatatgctcaatagagatttactcatttagtcaacaaatatttattgaatgcctattctgtgctaagcagtataacaggtactagggattcaaccctgaagaaataaaagttttttctttcacagtgcccacatttgagtgagggaagagaaggagtgaataatcttaggtggtgttaatgctatgaaggaaaacttaagacttattgtagaacacagatgcaagagaagagatgctaacataggcataccagagaagatgaacgcctctatgttaatatcttacctattattcgacttgttagaatttctttatcagaagtaccaatctctcttctcagatagtttgtgggaattctacctgctgcagcagctttttgtctgtagtcaacctgaagcagcaataaaaaaaagttcatataattctttttgcagaaacaaactatactgtatgaatgctaattctcctgaggttgctaacaacacagtctagactcagagtagaaaatgttatttacttagcattttgtatcttttggggagaggaaagttgatagaaatgtttctgcaaagtgattttaaaaaacgttcaggtgcagtggctcacgcctgtaatcccagcactttgggaggccaaagcaggaggaccacttgaggccagggttttagaactgcctgggtaacacagaaagaccttgtctctacccccaacaaaaaaaaaattagttgggcacaatggcctgtgcccatagtcctagctactcagaaggctgaggtgggaggattgcttaagcccaggagtttgaggctgcagtgaactatgatcacaccactgaacaactctagcctgggtgacagagcaagaccctgtctcttaaaaaaaaaaaagtcttctactcaacagtaaaagtggaagaagactcactatttgccacagatgctcattctgatcaagtcaaacattgcttttttttggtatcaactctgttaaatataattgtacaccccttttcataatagaagggagctataaaattctcatgagctcattactaaatatacacagttgtctcttggtatccctgggggattggttctaggacctcttgcagatatcaaaatccatggatgctcaaatccttgatgtaaaacaccatagtatttgtttataacttacgtatatcctctcatatactttaaatcatctctagattacatataatccttaatacaatgtaaattctacataaatagtttttataccgtattgcgtagggaatgacaagaaaaaaagtctgtacatattcagtacagatgcaatttttcccccaatattttcgatccatggttggttgaatccatggatgcaaaacccaaggacatggagggctgactgtacttgcagagtcatactgaagggaaactatgagggcaatgaattcattgcttattcaatgtcaaagtactcatgcacttccaatcttcttgtcaacttacgcacctggacgttccaaattctaaagtatgcttaatcctagtatttgtttatgaagcagtttatactcttttaatgaatcagtatcaaaaaactaggaaaaattctttgttgtgcaagtttgtattttccactcactagacactggacaaaaatattatacattctacactttactcagaccatattacagttcagataaatcagcaaatacttaccaccaaaggcataaactgggaaggggaaggttttgttttactgaccgctgtgaccattactgcagtgtcacctgacttaaacataaagaacaacgctggtaagttcctttgaaatcagatattagcatctaagtagcaactgaataaatccttactccaattaaactcaagaaaagatatctaattctacgacacgattatgaaataaaaaatattcacaagtagtccaatcttgatctctgagcttttcaaaagctatggaatcaaaataaggaaagattaacaggtaatttagtcatattcaatgaattgaatagtattctctacttcttatgtggctatacataaggaaaaattccccaattattactatagaagaaaataccaaaatcactttctctagaaaagcacaacagaatttattaacgcataaaacagaagcccaagtttggaaaggatgttaaacgtcacttaatacggctgggcacggtcgctcacacttgtaattgcagcactttgcgggggcaaggcaggtggatcacgaggtcaagagattgagaccaggccaggcgcggtggctcacgtctgtaatcccagcactttgggaggctgaggcaggcggatcacgaggtcaggagatcaacaccatcctggctaacacggtgaaacctcgactctactaaaaatacaaaaaattagctgggcgtggtggcaggtgcctgtggtcccagctactaaggaggctgaggcaggagaatggcgtgaacctgggaggcggaggttgcagtgaaccgagatcgcgccgctgcactccagcctgggcaacagagtgagactccatctcaaaaaaaaaaaaaaaaaagagatcgagaccatcctggccaacatggtgaaaccccgtctctactaaaaatacaaaaattagctgggtgtggtggtgcacgcctgtagtcccagctactcgggaggctgaggcaaaagaatcgcttgaacccaggaggcagaggttgcagtgtgccaaaatcgcaccactgcactccggcctggagatggagcaagagtccacctcaaaaaaaaaaataggtcacttaatacatgcagtgctctggactctggttgtctggaatgattcttgcagtagaaattatcttagtagtatctgaattaatttccagtaccaaaattctaagtagttacacgatgttgtagttacacatttagtatgagtctccgtaaccatttttaagatgaattttaaaaatctggactttttacctgtactacagcagagccatctgcaaatctggccagctttccagaagatatttctaatttcctgtttaaaaataaaaatgcaatacaagaagacttaggtcatctgtacaattcctgcttagtataaaataataaaagattctaagggaagattctaacccccaacccacccactccaccaacaaaaaggggcagaatccatgatcattatcaaaagtaaaagtggaatttaagagtggcttaaagaagaatacggaaaccaaggcacaggattgatctgaacaggaaagtcttttggaggttcagaagttaactgcttccctaaatgttaattcccatgtaccatctattttttttttgaggtggggggtggtctttgtgccttgtatcttctttttcttttctttttttttttttgagacagggtcttgctctgttgcccaggctggaatgcagtggcacaattacagctcactgcaacctagaacacctaggctcaagcgatcctccaactcagcttcctgagtagttgggactacatgtgcacaccactacacttggctaattttagtttttgtatggatgagttcttactatattgtttaggctggtcttgaactcctggcctcaagcaattctcctgccttggcctcccaaagtgctgggattacaggtatgagccactgtgcctggctccatttaccatcttagtacagtctcttatcatctctcaccttgttgactacagtaatgttttaacatacaaacaggattgtttccctacttaaaaatcctttagccaggcgtggtgtctcccacctgtaatcccaggactttgaaaggctgaggcaggcctgatcacccgaggtcaggagttcaagaccagcctggccaacatggtgaaatcccatctctacaaaaaatatcaaaattagctgggcatggtgttgcgtgtctataatcccagctaccaaggaggccgaggcaagagaactgcttgaacccaggagggggaggttacagtgagccgagattgtgccaatgcagtccagcctgggtgacagagtgagactctgtaacaaaaacaaaacaaaacaaaacaacaacaacaacaacaacaacaaaaaactttagaatttctcccaatgcttttaggacaaaatataaactcctaaatattgcctataaggaccttcatgttcaacagaaggggaaagaacaattttcaattcaatgaggaaagagtagccttttgaggcaatagtggacaactggatgcaaaaaagaatgaatcttcataaattaagtcaaaatggatcctagacccaaacgtaagagctaaaacaataaaagttttagaaacaaaacacaggagtaaatcttcagagacttgggccacacaaagtcttaaatatgacatcaaaagcataaatgacaaaagaaaaaaataggtaagctgatttcatcaaaatttaaaactttaattaagaaagtaaaagaaacaccatagattaagagaaaaatatttgcaaaccatgtatctgataagggacttgtgttaatatctagaatatttaaagaatgcttacaattcaacaataaagacaactgaattttaaaacttggcaaaggatttgaatagccatgtctccaaaaaagacatacaaatggccagtaagtacataaaaatatgctcaatatcattaactatcagggaaatacaaatccaaatcacagtgaataccacttgacagctgttatgaatgttccttgtagcattattcataatagttcccaaatggaaacaacccaaatgtccatcaactgatgaatggataagctaaatgtggtataatccatacaactgattattattcagcgataaaaaggaacaaagtactaatacatgtcacaacatggataaaccctgacaacattatgttaagtgaaagaagacagtcaccaaagactatgtttccatgtaagaaatattcataataggcaaatccacagcgatggaaagtagattagtggttacctggggctggggagaaacgctaagtgactactactaatgaatttctttttagggtgatagaagtgttctaaaattgatggtggtaatggctgcaaaactttgaatatactaatatccattgaactgtacactttatttatctgtatttacttattttgagatagggtcttgctctgttgcccaggctggagtgccgtggtgccatctcagctcatctcagccttgacctcccaggctcaagtgatcctcccatctcagcctcccgagtagctcgaaatacaggtgtgcaccaccatgctgggctaatttttaaattttttgtagagatgaggtctcactatgttacccaggctggtctcaaactcctggactcaagcaatcctcctgccttggcctctcaaagtgctaggattacaaatataagccactgctcccagacgagttgtacactttaaattaactgtatggtatgtgaattatatcttaataaaggtgtcttatatacatgaaataggcagcactattagccttattccctagtttcagcagagaatgcaaaaagaggttactgatgtcttgaaacagaccagcaaaacttgtcaaagagctcaagattcatcaaaaggtgttttgagatgaaaccaagtcagtgacccctgaagatacagagaaagagaaagatgttgtgtcacatgaactcagtttcggcaacattctatcatagtctggtgctgaaaatgcacaaaccaaacacaagcatgtagacaggcccaatgccctaccccaagtaagattattctgtctttcacataccaaggagatgaaggaacaacccttaatattttcacctgttaaatacctttgccagaagcctgagttaatgaaaagcatatttatctattcagttagactcattttgttaagtttgaaagtcagaacaaagtatgtacatttaatatatgttaataaatacaatgattttgtagtatcaaattcttgactctgaaatattagtttttttttaaaatcagggaatatttgagaaattctagttgggtttctatttattcaacacagatgttataatgatgaaagcctacaataaaatgggtctcctgtgactaatgggaatgaggtacagagaggctgatgctggattagtatgttgagtagatggaaggaatgagatactcaaaaccagtcacactgtgtagtatcacagacctgcaacaacctatagctgaaatcagtattaagtaatggtttcatgaggcaaatgtaaatctgacatcttgaaattttgtttaaccctgagtaacatgccaccagtacttctcaaaacttaccaggaactggcattctgtctaccaatgtaaattctgaatacctaagtgatctctgtgaaggggagtggaggatctttaactagacagaagtgggcccaaaacacagggaagaaaaactgtgaaagctacagttctactctactaacggggctactgccttagcattttgcccactgtggcatattctgttgaatatcctcagtgatttgatacatagtagatgctcaataaaagcttgctgaaatgaaaattaaacacctgcctccaaggttactgtaagcattaaatatactatctgaaaaacacctacaataattatataatcttccagaatgcagtaaagaatatatatgataacaaatataatgtgcctggtacatagtagtcactcaataaatgttgccaatggcaaacaagacaaaaatgaaagaatttatccagcaggtatgatattttattagtctagttatttcaacacatgacacgagtttaaaaagaactacctacaaaagaggaacaggttgattaataaatgaaagagtcaaagtagattatttatggaaaatatggagggcagcagctgcatcttgttttcagtatctaatgcctatctcacagtatgtgtctgttgaatgaaatgttctgggcatttctttgaagcatgtgtagtccttgaagaatggaagagatgtccacttccctcaaaaatcagaattaatgaatgctgggagtggaataagccttagagataacctagtctaggggtgaccaaactacagcttgtggcctatttctatattactcttcaattaaaaatgtttatatatatatatatatatatatatatatattttttttttttttttttttttttgagacaaaagtttcactcttatcacccaggctggagtgcaatggcacgatctctgccactgcaacctctgcctcctgggttcaaccgattctcctgcctcagcctcccaggtaaatggaattacaggtgcttgccaccacgcccagctaattttgtatttttagtaaagacggggtttcaccattgtagccaggctggtctcgaactcctgacctcaggagatccacccacctcagcctcccaaagtgctcggattacaggtgttagccactgtgctcggccgttttttaaaatatttctaaagggtttgtaaacacatacacacagtgtgtaccccaaaaagcctaatatatatattatctggtcctttatagaaaagtttgcagacccttgatggaatccactctccacactttgcacaagaaaatggtgaattaacctgttcaatgtcaactacttatcaaagttagagtgcgagacctggattcaaaatgatttttttgctttttgtatgaactggggtccaaattttttcaaagtacacgtaaaaaatttagatatatgaagtttgcattagcaattccatttattctaagaacgattaaagcaaactttttttttaaaaagcggtcccctaaaaaaaagtatgggctttgtaagcaaaaaacagaaattcaaaaaccacctagtcccataatactaacttttttatagactcttagaaagttatctaaccttttttgagcctctgtagtcttaactataaaatgagggtaatagtacctttacgacaggtttaaaaagattgcgaggatcatataactggcgttcaaaaaactgacttttccttttcctcctaacccagggtcatagtggtcacactttaggcaatcaattagattggatgacatgatatcttgtactcctaacttcaagtcatccttccgtcttagcctcccaaagtgctgggattacaggtgtgagcgcctgaccttttgccatctctttgcatcgatctttgcttttgtttctctctgtgtgtctccttgcctctctccctgtcactgtctctctctctcccctgcctccctcttggtctcttttttttgctgtctctttctgatgaccttgttcccatctctgtgcgtgtgtggctctctccctgtccatctcttaccatctctgccttcctctcccaggtcttaaacgaatatttccacaatgtctgtgaactggacctggtgttcaacttctacaaggtaggctcctggtgaagaggaggctgaaggagcccgaggagtgggacgtgggggacccgtggtgcactagccacccggagcctctgctgaggtctgtgtcccagctcgaggggcatcagagccccagcttccagggtccgggccagcatcccggggggcctcgtctcacccacgtcaactcgttattcctaggtggaatgtttcccacttaagagcccagtggtcccggaaagtaaagagatcggaagtcaggtggacggacagagtcggatggagcaaagaagcccggcacacaccaacagagagaacgacatagcgcgggaaggagggtccgaggagacacattccaaacccggaaagggaaatttggaatttaggtttagggtaaggagagattaaatagagctgggataccgggtttctaccctgggagatgaatacgctcaagctggctggacaagacaccttatgacaatacagtgaacgcacgtcactccttacctgttgcctaagtccacggccacagctcgagaccctgcgctactccatagtgctcgcacttgcaactgggtgagtgcccgatcccgccgtggcagaaggaaaggaccatcgctcaggggccggagccggaggcacgagcagcagtacctgcaggccgccatgacacccggcacgcggtcaacgcaggctgtgccctgattggctcactccgcagaccgtggggcggagcctgatggagtttcgtttcc

SEQ ID NO: 202 - DNA, 20589 bp, Homo sapiens
ttaccccattgtagaagaggaataatttatttctatatgattttaataatgttccctaagtaattagtaatcaagattttcttcaaattcaaattaacaaatatgtttgttaatctaaataatatacatatttatgtatttatatatgtatatattttaatctttctgtaattcagtctttaactgtgaacttttacatgatggaagcagtgaaggactcaatgtcatagtacattttgatagtatttgataggctttttcaggtcaattaatttagttgcttgcaaatataaatcaagcttgctccagttccacaaggactccaccacagtctttaggatggagaaaaatcactggttttccatgtgctcctattttgacctcttcacttagactgcggatcttcttttttttcaaatccatcacagctgcattaatattatccaccttaagaaagggaaataaattgaacacatttgagatcataaaaataccaacttatagtatcataagacttagaaaaaactttgagagctcatgcagtctatctcctctgcctgtgggcaggaccattcttaaatcatcataaaaaataagcttaaaattttcagagaagtaagagaagttactaaatttttctaggtaagcaaccacaatgctcagaattttcaccattagtaaatgtttcttcttataatctaaatcatgtatgatatactttataatagtttattctggcagtactattagtgagattgaagacattgctttttcctgagaaccctgggtcctcatctataacaggcaaatgaggtctaccacataaattgactacagattaaaatgaggtaacagataaaaagctttcagtacagtttatggcataataggtacttagcaaatatgagtgtttccctgatccccaaaacttgccctgccaaaacacctggttattacctttgacattatcaagacacacatgaaaatcactattaaattgccatcaaaatgttattccccacccaaaaaaatttcaaactttaatgtttttgcagcctcttctaagttatttctattttcttcatacttatggacactctaggaggagcagatgtgtctctctatacttgacggagaaatgatctgcctctatcttggaaagtcacccacttagactgggaacctaagaaatggatgaaaaggtatgatatgaatggccacattcctaggcagtcataaatcactagtttaattaaaatcactagtttaattaaaaaaaacacacaaaagcacagagactagtttaacacccatgtacctaccattcagatctaataaatattagtatttatacaattttatttccaaagagccaaggattatatgctgaattctaaaaccagtcaaacagctaatgaggatactaaatgttacataaataagctatgatttcttcatatggcacatattctacttgtattcctgatatttcttttttaaacctcatagatatgtcaaagtcacacgtgcctagattctgaacacagctcatttcatgacatcttgcactgtagctggttaattctcatctttttcagaatagaacatgcactagaagctcgtggcaggaacggctcgacccacttagtgaggaaaattggtcctcactgatgtcagacattgtcaattttatcttatttttaaattcatatcaatattattaagcttttcttctgctgcgttaggtgggattggagcagcttttagtctaggactaattttcctcactaccaagccaaagcccttctgagtactcttcccaatgttacggaaattactatgactagtaagaaaaaactatccccacctctgtgtgtggattattccctctaatcctttcaaggggttctattctagcttcctaacatgcgtgcaatactcgaagctccgatgaagacatgaaaggtactacagatctttagagttcactctctgtgcagctctcctttccaggagagagctgtgaactctagcaccatggcctcctcagacttccaactcctatctccgcaactcagggagaccactaagttccacgtggattcccccttcctgcactgcagtctggaaactctctacagccagtaaactgggtaattgtagggctcatcttgtttgtttaccctctctcagaaatcaattcctgtgctgcctgatgtccaatgccagaaatccattatgtcatgtattttgtctaggttgcttgtttgtttcagggaggataaactgatctcttttacaccaacttggccggaatcagatttctaaattggcaggttttttctgtcagcaactaaaaagtgtcattacatgtcattctataatatgtcttttttactttgattgcttttaagattttcttgtcatctttgattttcagtttgactatggtgtgcttaggtgtggttttctttcttttgagacagagtctcactctgtcacccaggctggagtgtagtagtgcgatctcagctcactgcaacccctgcctccagggttcaagcaattctcctgcctcagcctccagagtagctgggactacaggcacacgccaccatgcccagctaatttttatatttttagtagagaaggggtttcaccatgttggccaggatggtctcgatctcttgaccttgtgatgtgcccgcctctgactcccaaagtgctgggattacaggcgtgagccactgcacctgccttttttttttttttttttttgagacagagtctcactctgtcacctaggctggagtgcaatggcatgatcttggcttactgcagcctctgcctcctgggttcaagcgattctcctgcctcagcctcctgagtagctaggattataggcatgtgccaccatgcctggctaatttttgtatttttagtagagactgggtttcaccatgttggccaggctggtctcgaactcctgaactcaagtgatctgcccgacttggcctcccacaatgctgggattacaggcgtgagccactgttgcccggcctggtgtagttttctgtttgccctacttggggttgctgactttcttgaaaccatagagtgatgttttacatcagattggtagtgtccttgtcaactattttttcaattactgcttctgttctattttctctctcttccttttctgggactccaactatattctgctagaacttttgaccatgtcctacatctgtcttatgctctattctgttttctttttcttccatattttttacctcttgattttggaattctagtttctagaactgtgaaaagaataatttctgttttaagccactaagtttgtgatcatttattatagcagccctagaagacaaatataactaccacacatcataccgaaattgaacaacgaagtagatggatggctgatagtgggagctaagtttctcactgttggaatgagaagataaaggctagtgtggtctatgtggtaatggattagagctggagacgtcagtatgctctgaggagtttatgacatttcatgaattctataatatagttatatacagaaatgtgtatagatatgtgtatatatacagtatacacacatatatatctccctgttgtcctggctcagtagggcaagaaccaatgacacacccagtagcaataagcacacttagaacctagatcttggcttctaataccattctccagtagtaggaaccagggctcctagatgaaatgtctaattatatggctagggcaaagagtaaagaagatgaatttggagcatctcatatagaagatgaatttggagtatcttacagtgccagaaaaagaaaggaagtgcttaaaaaacaaacacaaaacacaaaaccaaaaatgatcggggtatgtcaaagggacataagaatcaactgaaagagctcctaatggccaaagctggaacaatctgaggggaaaaaaagtagtattagattgtaatgcaagtcataaaataaatatccacaagtccatactgatataactctctattccttaagtgtgggccttgcataatgacttccttccaaaagaggatagtatggaggagaaaaaaagaacagctttccagtggagaaacctgacaacacctcctcacctgggagatcaaggttaatatcaacagtagtaagtcatgttgatagtatgaatccttgatatgatgtgatgaaaatgacactttacctctatggtcttcccaaaatcaataacatgagtctaataagaaaaatatcacacaaatctcaactgagggacagtttacaaaataactgaacagtaatcttcaaaagtgttaaggtcatcagaaacaaggaaaggagatcctagaaaaaggttagaaaacaaaacaaaacaaaaaaacaaggaaagtttgagaaactgccacatgcaagaggagcctcagcagatacgatgactaaatgtgatgtgctaggggtggaggagtgggggaagggagagcatcaggataaatagctaatgcatacaaggcttaatatctaggtaatgcattgtcaggtgcagcaaaccaccatggcatacgtttacctatgtagcaaacctgcatgtcctacacttgtatcctggaacttaaaataaaattaaaaaaaaaaaatgtgatgtgaaatcctagatgggatcctggaatagaaaagggacactgggtaagaactaaaggaatcagaataaagtacagactttagctaataacaatgaattggtattggttcactaattgtgataaatgtatcaaactattataagatgttcataatttttttaaagcatctgatgagattaaccactgtttataatgagtggatcttgtttttatcctgattagagcaaatcaactataaaaagacatttgtaaatcaatctgggaaatttaatttatgagctgtgtatagatggtgccaaaagatttccctttaattttgactgaagtgccagaaaataaagatgatgtcaccgtggttatttttgtatttcttagagacccaaactgagtaagggtaaaatgacatgttgttcatttaaaataatttaaggaaaaaagaaaaaaagatgacgtgtagcaagagcttgaaaactgttgaacctgggtgatgaaagtactgacatgattttttttctacttctcatatgtttgaacaatttcatgatataatcatgactttttccatagtgcccttttgataactcctatgctacatgtgattatgaatattttcatttatggaacattctatccaagtacaagtatctataattttgacattgcaacccaatgttttagtatactccttcttcaatatccctcaatcatgaattacttcaagcctgggcacagtgtttcatgctgggcacagtggttcatgcctataatcccagcacttaggtggggccaaggtgggaggatggcttgaacccaggagtttgacaccagcctgggaaacatagtgaagccccatctctataatcaatcaatcagtcaggtgtggtggcacacacctgtagtcttagctactcaggaggctgagatgagaggactgcttgagcccaggttgaggctgaagtgagctatgatggtgccactgcactccagcctgggtaacagagtgagaccctgtctcaaaaaactaataaatgtctaaatgacattgcactagcatctacttctacttctgttactatttctatcactaacttcaattttaaagctcttttaccatatttatccttctgttagtgttgctatacattttatgattcttttaagagtactcctaatgctttgtttggcagtaataaaaagaataaaattaaaatgtcttaattttctgaattgaaagtagatgcaatagttgtaagaaatgcagagcaatttgatttgggaaattaaatcagtccctctaagtaaggatgaaagtaacacagtcagtaataacccatcttttaaaaaaagggaggttttcaaacactgcatgttctcactcataagtgggagttgaagaatgagaacacatggacacagggtggggagtcatataccggggcctgttggggggtgggggaaagggggggataacagtaagagaaatatctaatgtagacgacgggttaatgggtgcagcaaaccactatggcacatgtgtaccttatgtaacaaacctgcacgttctgcacatgtatcccagaacttaaagtattaatttaaaaaaggggggggttatggttttttaaaactgcttttatagtccttcaaacaattacagagtgtaccatatagttctggaagactttgcataccactagtgaaaatcggggctatttacttttcttttttttgagatggagtcttgctctgtggcccaggctggagtgcagtggtgcaatctcagctcactgcaagctctgcctcccgggttcatgccgttctcctgcctcagcctcccaagtagtaggtgcccgccaccacgcctggctaatttttttgtatttttagtagagacagggtttcaccgtgttagccaggatggtctcgatctcctgacctcgtgatccacccgcctcggcctcccaaaagtgctgggattacaggcgtgagccaccatgcccggccctttacttttcacttcaacttcttaccagctatttcctttttctttctttctttcttttttttggtatttatctgtatctgagagtttatcttgattctgccccttcacctgcaaattaagagtgacaataacccgaataaaaaatgtttggattgtcacaatcagaattcaaaactttttttttttttttttgagatggagtctcgctctgttaccaggctagaatgcagtggtgcgatctcagttcactgcaacctccgcctcccaggctcaaggaattctcctgcctcggcctcccgagtaactgggattacaggcgcgtgccaccatggctaatttttatatttttagtagagataggtttcaccatgttggccaagctggtctccaactcctgacctcaggtgatcctgcctcggcctcccaaagtgctgggattacaggcgtgagccactgcacccggccagaattcacaatcttcaggtacatctcataacctctttggtcctcagcttccccatctgaaaatggcaatacaatcttgtttatttcaagccaagtaattgggctaaataactctaaccttaaggtatgtaatcctcaatgaccaaattttatgaaaaagtaataatgtacccctcttaactatacatgacatttggacagatttaacaaacataagctttaattttatatacagttgtaatggtgctgatataatgaatgacttcaatcctcaaattggtataaatccatgaaagttaaagtgaaaagtctggattaagtatttgttgtatttgttccaactgtatctcctcaaaagctaaaagctgagtgaattatgcaagcctaacactgtctcactttacatagggttcagatggttccagtcttcttggatttatttcagaagagcacatgttacctaagcttccacaatgactatatagtctagtgggggctatgtggagtatccatcaaatgcttgtctctgctgaaattttcacagtggatagtaaaatatttttttaattccctagtttattgtgaaaagccaaaatgagaataaaattttttaaaaaggagaatattttcctttcttgattgaagaacaaacattacccagtatgtaggaaatgagttacctcactagcctgttactttgaagttataaattttttctttcctaaggaatatatgctgtcaaaaaagatctgcaaaacatataaaagcacaaacaagaaaatgagtcatctattgtctaatcactcagaaaataaaactgctataattgctgcatttctctaccttttgtcttagtttttaaatactattaatatttttctcatgtgcttttccccagcagcctgcaacagtaatttcaagattaccttgaaatcaaatccaacatctctgtctgccactgggaagccaggctcccatgatccttactacctactcatctaaccagccccttctctgtcaccggtccctatgattctgcagcccctccctcagcctcagcactgcactcatcaccctccatgtgctccaaccgtggggctgccctcttcatcccatctgagctcccactcacaattccaggccacaccacccctgcacagaggcctgttaccccatgtgagctgggccactccctgtgctgcagtcctccttgccttttgtgggattcaacatcccgcccggaagcgtcccagtggatacacatcctcctcaccctgtgtggctctgactccccatacctgccccctaccccatgtgaacatctgcctcacccttctcaggccctgctcccataccaggccactccctgcgaggacacccagcttatcccacctgggcttcaactccccacattagtcaccattttcccctgcaacgatgcactccccacaggaccagccctggccctccatgctgggcgtgccctccccacagtgtcggtgcccctaccctgctctggctctcccactccttgctgccgctgcccctcaggtggacgctcttctcaacatccttgggctccagctccctgctctgagctgtgtctcagtccattcgggctgttagaacaaaatacctaaactaggtggctcagaaaaaacagaaatttgtcagtttgagagcctgggaagtccaagatctaagtgctggcagattcaacatctggtgggggattggtggttcacagacagcaccttctcactgtcctcccgtagcggaaggggcaacgggtgtctctgaggcctcttttataaggacactaatcccattcatgagggataggcctactgctcatgaatgaggcctcaggaatcatctccctaaggccccacctcctaacaccatcactttggggttatgatttcgacatatgaattttgaggggacataagcatttagttctaagctggcctcccatgctgatgccctcctcactctgacactgcaagtcaagatgctcccttgggcacaaacgcacaaaccctgctcagactcggacaccttgcactggaactccccatgcatgggcactcagtctctggcttccccggggcaggcagctctcactcatggatgccctcctcaccttgccaggatcccaacaccctgctttaggccagtctggttctccccatcaacaaaaatgactcttctgctctgtcctacctgaagtcttcaggaagggaaggaatggggaggagtcataggtactcaatactgtttatttccttttttgtttttggtaagtagaaagaaatacagtcatgtgtcacttgatgggtacgagtcctgagaaatgcatcactaggcaatttcattgttgtgcgaacatcaccacacctggatggtggcgcctactacacacctaggctacagggtacagtctattcctccttggctacaaacctgtacagcatgttactgaaaactgtaggcaagtgtaacacaatggtgtctaaacacatttcaacacagacaaagtacaataaaaatacagtgtataaccttatgggacctcatgtggactcatcactgactgaaacattgttatgcggtgtgggactgtatttggctaaactagtaaggtatgctaatcatcccttatatttcctctttgttgcaactagcactattacttctgtttatccttttgtactttgtaggctgtgttttagtcagtcacctttaatcctctctggaaaatgaggagcatgtgtgaataaatgaagcaagcaggcaagctctgggtagacaggaactttctgcttgttcagccacatatccccagcatcttgtacagtgaaggacagagtgataccaaaaatacttaacaatcaggaaaatacaaagatactaatcagatagaattgtgcggctgagcatggtggttcatgcctgtaatcccagtgctttggaagggctgaggtagaaggattgcttgagccaagagtttgagaccagcctgggcaatatagcaagaatttgtctcttaaaaaaaaaaaaattagctgggcatgatggtgtgctgcctgtagccgtagctactcaggaggctgaggtaggagggtcgcttgagctcaggagttccaggttgcagtgcgtaatgattgtgccactgcactccagcatgggtgacacagtgagaccctctctctgaaggaaaaaaattgtagagggagaagggtgtctgaagggtcccagaaaagggtccttctggaaaaggaatgttactcaggtgttacagagcagcagctgtttaccaaccaacacggaagcatttaaatatttttacaaactcaatacaaatttgagtaagtatttctggtggcccttaaagtcttcactgtgacacactgtgctgtctggctaagttctccagagaaagcacggccagctttgtctcctcaagcagaggcacgcagaaggcagggaaggtgacccccctcttgccatcgcaggcagcagttaggagcacaaacacaagctgtgccagaaaacagtgggtgattcagtccatacttgagcaagagaagagatgggacaagatgccctctaaaattcctctagtgagaggcaaagacacacaagaaatatgagtaaacctcacaagaaaaagtagaaaccaactcaacctcgacagaaaaatgctaattaactattgagatcgtaatccacatgtgagaaaggaacatttcgtcaagtgagtcaacaaaaaccatggagcatgcaccaacagatatatgctaagtcagaggttttataagatcctggtgaaaaaggacagaaagtagccctgtgattacagaggggaaagccaattctctgatgagtggttcaacattttttttttttttcctgagatggagtcttgctctgttgcccaggctggagtgaagtggcatgatcttggctcactgcaacctctgcctcccaggttcaaacgattctcctgcctcagcctcccaagtagctggaattacaggtgtgcgccgccacgtccagctaatttttgtattttagtagagatggggtttcaccgtgttgcccaggctggtctcaaactcctgagctcaggcaatctgcccacctcggcctcccaaagtgctgtaataagcatgagccaccatgcccaggtgacacaccactttttaaaaatcaccaagcgtggcatccattgatggcctccagtacctttctccttttcctccttttaattacagcaacccccaagcttcagcagggcacataactgcctagctagagactacattccccagcctcccttgcagagaagtgtgtcatgtaactaagcttgggccaatgggataaggacagaagtgatcctagagcatctccttaaagccacttgccaggtattcccactccaccttcccttcccttccctctggctggcaaatggtgatgcctggagcaaccttgtaagtcatgtgtcatggacagcagagctgcccatcagcctgggatagctaatattagactgaaaacagaaaaataaaatcttgttaagccacttaatttttttgtggagggcagagaatgatgatgggggtattatactaaaatagcacctaactaaccactgttcacaccttctcctcttacctaccttcattttatatccaatacatttgcatgtcccccttataatctctgcttttgaatctgccattactgaacttccactattccttacttaactgaactaaatcacatagctgaactcctttgaaagcatgggctctcttgatggaatactgatagtgcagtgtgggagaggggggagtggattcaaaggtcctgcttctcatcctggggggtggggtagggcttagacaaacactcaggtccactgacaaagacctgcagccaaaagtaactccctaaaaataaaataaaggctaatattaggacttgtttagttccctgcttaaggtcttatagcttccccaccgcaaatttaaaactcagttaatataatgaaggcaactggcatcatgggtaagagtgcagaccctggaatcagaaccaatctgggattcagccccatacctgctattgatatgaccatgggcaaattaactactctgtctcagtttcctttcctgtcaaatggggataatagggccctcacagggtagctatgaaaattcaagaaaatagtatgtgttgagttactttgtagacatactactagaggactcactaaatgttagttcttttttttgagacagggtctcgctctttcattcaggctagagtgcagtggtgtgatcacggctcactacaacctccacctcagcacttcctgggctcaagtgatgctcccacatcagcctcccaagtagctgggactacaggtgcataccaccacacctgactagctttttgtatttttagtagagacacggttttgccatttggcccaggctggtctcaaactcctgggctcgagcaatctgcccaccttggcctcccaaagtgctaagattacaggtgtgtattagtccattttcacgctattgataaagacatacccgagactgggcaatttacaaaagaaacaggtttaatgatttacagttccacgtggctggggaggcctcacactcatggcagaaggcaaggaggagcaagtcacatcttacatggatggcagcaggcaaagagagacagattgggcagggaaaatcccccttataaaactgtcagatcttgtgaaacttattcactatcacaagaacagcacggaaagacctgcccccatgattcaattacctcccactggtccctcccacaacatgtgggaattcaagatgagatttgggtggggacacagccaagccatgtcgaggcataagccaccacacccagccactaagtgttagctgttatgataactctatgcctttccacatgcaattccctctgcctgaaataactttctccttttgttcacctagggaattccttcacattcattgtaacttatgctctgtgaggccttcccagcaactcaatctgccaggagcaatcaatctccttcatctgtgctactgcaaagtcacatatatcaattctacttatcatagtatattgcacttgggtgtttaaatttctgaccctcctcactatggacatgactcatgtcttattcactgctaaatcccaagtacttggcagaatacacattatagggtctcatacatgtttgcaataatgaactgaatacatccttgaattcactctagaatcaaatgacctctcctctgtattagaaatttggcctaacaggccaggcaaggtggctcacgcctataatcccagcactttgagaggctgacgtaggtgaatcacctgaggtcaggagtttgagaccagcctgaccaacatggtgaaacctcatctctactaaaaatacacaattagccgggcatggtggcgcatgcctgtaatcccagctacctggtaggctgaggcaggagaatcacttgaacccaggaggcagaggttgcagtgagccgagatcacgccacactgcacttcagcctgggcgacagagtaagactccgtctcaaaaaaaaaaaaaaaaagaaaagaaaaagaaatttggcttaacaattatgtcattctttctataaaaagaattgtcctagcaaattaaatcgatgcataattgtcattgctgatattctaaaaggcagttatctgaacatgaacatctatagaaatgttctctaatggacttttcttgtctaacatttcttcacattcctttaaaaattgttggcaggtgcaattcagaagatcttaaaaattacagtaattgaaaatgtattgactttgtaataacgaagaagttattagcattttaaagagagaaaagagttataaagaatacttagcatgtacactgaaagctttaaagtcttttcatttgtttctcctaattgccttatgacagtgaaaacagctgtattcctgttacatgggaggtcaaacatgatcaattctaaagcagactctacattgtggctaactttggtggcacttacagtggtcactgaatccagacttcaaaaaaatacattaatattatatgttagaattttctaaagggaaaagaaatgtatgtaaggatccacctttgaggaggatgaatattatcattctccttaaagaactttacaaaagtttctaatgacagtgaccataaatagacttaaaaagtagaagacattttttaaaagagagatttaaaataccaggcattaaaataattaaaatacctcgatgcagatgtgatgcattcctccagccttgtttttctgcagaaaacctgcaattggactgtcacgtcccaatggatgaagcagttccatcttggtatttcccaggttgacaaaaacaacagatactccatgttcaggaagagggaccgcttcacttacctgggcccccagaatattcttataaaatgctgcagccttttccaaatctggcactgctatggctacatggttgagtcgacccaggttccacacagaacctgtcacttgatccaagggctgtgatgtggaagaagctcttactgttggaatgggagcttgaagtctggaaaaaagccctgaaaaattgaacagccattgatatccttcttttgagaattaacgcacttctaaattgaattttaaaaactaaacaaataatgcatgcaaaaattcattatttatatatctgttctttttaattattgaaatgaaaccaggagataaatggaaaaacttacatcagaattactctgctctgcccattcaaataactgactggaataaaaaagctaattctgagctgcagttagatttaaaacacaggataacattttttcataacaattcatatttactggtaacacttaaatagtggcatattaagcattacttgctattctctgcatttcacaatgaaacaacatatatttaataagagcaagcaatttctctacctgtacccaattttttgtcttatattttgtaataagttcattaaaggtataaatatacattaaaagagtacatacagtactctttaatgctctgttgcccaggccggagtgctggagtgcaacagtgcgatctcagctcactgcaacctctgcctcctgggttcaagtgattcactggcctcagcctcccaagtagctgggattacaggtgcctgtcaccatacccagctaatttgtgtgtgtgtgtatgtgtgtgtatatatataaatatatatatatatatatatatatttttttttttttttgagacggagtctcactatttcgcccagaatggagtgaagtggcgcgatctgggctcactgcaacctccgccccccaggttcaagcgattctcctgcctcagcctcccgagtagctggaattacaggcacctgccacatgcccggctaatgttgtatttttagtagagatggggtttcgcctcattggccaggctggtctcgaactcctgacctcaggtgatccacccacctcggcctcccaaagtgataggattagagatgtgagccactgtgcccaccctaatttttgcatttttagtagagatggggtttcaccatgttggtcaggctggtctcaaactcctgacctcaggtgatccacccacctcggtctcccaaagtgctgggattataggtgtaagccaccattccagtcagtttttagcatttttaaaattcactgtcgctgtgtcctcatcagatagtttcttgatctccacagataactctgcattccattcatttagcaaacagtcattgcatgtcattaacaacaagaatggcctgaatttactgtgcacctactgtctggcactgtatttatttttttacaccaactatctaatattcacaacaaaccaagttagaaacttagtaagtttcattgttatcatgaaatccaagtggattacaaccgagtacacatatacataaatgtacaattgaaactaaattgcaaaaaaagaataccttccacctcagcctcctgagtagctggaaccataggcatgagccaccatgcctggctaatttttgtacgttttgtagagatggggtttcaccatgttgcccaggctgcccatgttgctcctgggctcaagcgatcctccgaccttggcttcccaaagtgctgggactacagatgtgagtcacagcactaggccagtgaaaatgttttgaaatagacaaatgtgatagttgcactaacccagtgaatgtaataattactgttaaactgtactttattatttatttattttgagacgaactcttgctctttcacccaggctggagtgcaatagtgtgatctcggctcactgcaacctccaccttccgggttcaagcgattctcctgcctcagtctcctgaataattggtattacaggcgcatgccaccgcacccggctaatttttgtatttttagtagagacagggtttcaccatgttggccaggctggtctcgaactcctgacctcgtgatccgcccacctcggcctcccaaagtgccgggatcacaggcatgagctactgtgcccagcctaaactgtacatttttaaagggttttgttatgtacattttaccaaaaaaaaaaaaaaaaaaaaaaaagatccaacaataaaaatccaaaggtgaaattgtgtagaccaagcaaactgggtagagaacactgaataaaggagttaaaaagagacagagctttatatttaataaaaatgtgttcctgaaaagtttgttgtgaattgaactcttaattattatatttctcctttgacttgtagaaacttttttccagcttgaggtatgatgactaatagaaacggtgtatctttaaggtatacaatgtgatgttttaataaatgcataaattatgaaaatgattaccaacactgaagctacctttttaaagctatttttatttcaggttgccctccaactagcaggaattcacagctctttagttttagatttctctgcctcccatttcagaatagtgcagcagaattgcattattttgaattctgcaatgtttaatttgtgattattccaataaaggttgctttgcatgaatatactacagtgtaaaaccatgtgcaaataaatgcataagatatttaaaaacagaagtgttaataaaaaacgcatgtaaagatgaatacagattaaagaaactattttcacatgtcaggaagctggtatacaagtaaaagatcaaaatcggatgtgtatgttaactctcattccaatcttcctttcaatatcaattctcgttaatcacttttagtgtcctgacttaaaaacaacattgcatttctttcagttcagattttgcatttatttcagatcacactttttagacactgtccctgaatacataaaggtttagctgcaaggatctatactcaaatgcattaagagtacttactatttaaagacattagatgttaaatttgtataaaaagtactataaaagtgaataatcacttgtaataggttttttaacagctttatctcttaatagtttttaaacagacttaaaatttatataccataaagttcacccatttgaagtgtacaattcatttctttgcatctttgcaaagttgtgcgaccttcacataatctaattttagaacacgtaataagtttgtttgtttttttgaaacgagtctggctctgtagcccaggctggagtgcaatggcgcaatcttggctcagtgcaacctctgcttcccaggttcaagcaattctcctgcctcagcctccggagtagccgggattacaggagcgcgccaccacgcccggttaatttttgtatttttagtagagatgggttttgccatgttggccaggctggtcttgaactcctgacctcaggtgatccaccttcctcagcctcccaaagtgctgggattacaggcgtgagtcaccgcgcctggccgaacataagtctgaattttcactgaatatctggtttgaggaaacatacgtatttagaaagtcattcattagaagtgctttcaagttagtctggtaagttttctcttaaacatttgaccagttaatttcacagcaccatatatatatcttcaacttgtttcaaactatgatcaattttttttattcattacagtaagtaaacagattacatttctgttagcccatttacagacgattaatgaaagtaaacctatgcagtcatgtaagttggtcattcttgtctcccacctaacaggttcaatttccattttcagaacttttctacgtgttcactctgatttttctgtgcttttgtttttcggcgaagttttatgttccttaaaagaggggccataacatagaattaccatgtaatccagcaattccacttatgagtatacacacccccaaagaagcgggaattcagaagtatttgtacacccacgttcatagctgtattacaatagccaaaaggtggggataacccaaatgtctatcaagagacgaatggataaacaaaatgtggtatacacacacaatggaatattattcagtcttaaaaagcaattttttttttttttctgagacggagtttcgctttggttgcccaggctggagtgcagtggcgcgatcttggctcacgccaacctccgcctcccgggttcaagcgattatcctgcctcagcctcccgagtacccgggataacaggcgtgtgctaccacgcccggctaatttttgtatttttagtagagacgggctcacgcctgtaatcccagcactttgggaagacgaggtgggcagatcacctgaggccaggagttccaaaccagcctggccaacatggtgaaatctcgtctccactaaaaatgcaaaaaattagccgggcgtggtgccgggtgcctgtaatcccagctactcgggaggctgaggcggaagaatggcttgaacctgggaggcagaggttgcagtgagctaacgccactgcactccagcctgggcgacagagtgagactctgtctcaaaaaaaaaaaaaaaggtaaattttactttatgtatattcaaccacacacacacacacacaagtggagacattaagcttcaagtatcttaataggacaaatcaaaggcaatctttggaatacactgtcttcatttttcctttatgccaagatgtgtatgtaagtacaaaacaaacatgcacctttatctgtattgagttcttgcagtatgtatatgacctgttggaagtcatactttttcccaaactgtcaatcattaaagtgtgcagttctaaaaatagacataaaaatgccttttcccaaatattcatttatttatagttttacgttcctatcttgtgtatcacctaagaggaaggtatgccttacggttaagaatgtgggctctggtgctagaaggatttatcacgaatgtcccggagtaactctggggcattaccacttggcaccttcttcctaatagggaatctcagattaagggaaatacttgccctctcataaaaggaggaagagaaaaaaaaaaaggataaaaagaggagaaagtgagtcagaaaacgtgacaattattacagttatttctgtcataactgattctatgtacatattttaaaaaaaatgaagggggagagaactcaagaaagtttccaaatccacatgcttttatctgtgtacgcgataaatatattagtgcacgtggaaaaaccactccttttgtattctttacaccactgacctttgagtgttcccaacagaaagctggtcacgcttggagttcggccgactagtagttgttgtttttacggaacgtgctctcctttctggtttctccccagtctctttattggtgcgcggtaaaataacttaccgatccgcttctatttacttctgtccctgccctgcctgacctgccgggcaagttccctcgactctcccgcccacatactggaaggtgcagagcccaaggcgcacagctctcggatggaaatgggactcatgcacaaggcaatccccgctactaagcggtggcgcttctggaaggcaccctctgcctaagtgacagcagctgctgtggaacgcgcccccgggggaggacattagatcaaggtgctttggccacgccgaggcctcctccgcccccgaccgccgttcccacgctccctgtcccatggcgaaggtcgccggtgcccggtattcacctacggcattcgcggctgcagccttcagcacccgcgccattttggaaagcaacccgccacgtcaagactagccacggaggttgag

SEQ ID NO: 203 - DNA, 60700 bp, Homo sapiens
tggattatgatttttgtttatttttcctgtttatccatatattatttttcaacaatgagtattgattacttatataataattttaaggctgtacacattgcagacagcaccccactgtttgaaaaactcctcctcagtagaacatggcagaccttcatcttccttccctgaaccttttccaaccttaggcttgccattctccaccagtgctaatgtcatgtctcttgaaatctgtattgaagtcagtatttcattcttgccagtttccactgtgtgtttaaatttggagtctggtgtctagcattagctggggttggagcttccactcctctcagcattggtaagcctcctcacccaccccatcccatgtccaagatcacccagttacacacttaccatctacccagttcattcacatcatcagtcccagagctgcagagatgctctttttctacctcctacttctctggctcttagagaggcagcatgggataatggggcaagcgaatagggccttaaagtagagggacaagggttctcttccctatctgccacttattagctatgtgacctcgtgtaagtctcttttctttttgagacagggtctccctctgtcacctaggctggagtacagtggtatgatcatagctcactgcagcctcgaactcctgggctcaagctatccttccaccttagccttctgagcagcagggactacaggcacatgccaccatgtccggctgatttatttatttttatttgggaagatgggggtctcactatgtcgcccaggctggtcatgaactcctggtctcaagcaaccctccaaccttggactcccaaagtgctgggattacaggtgtgagccctggccttgcctcaatttcctcatctgtaaaacggggttagtgaaactcacatcctatcagtggttttgaggatgggccgactcttgtattgcctgctctagtacaatcagcagctaaggcggctcactttccggccgtgctacaataggtaagaactaggatgctttagacgtgtgactgggcagtgggagcccctcacatgatcccgagatgccagacagtgtctctccgcacagggcgtgtgctggtccagaggcccgtttttccagtcgccccacaccccgggtccgcgatcacgctccccccacccatagccgagcctgacgcggcggtggctcatgcgcctttccgtcccagcctttagccacggaccacacgtcccatctcaggcgccccgcccctcccccgccccccgcccccggcgcgcctccccaggctgccggctccggtgtctgagcggccgcgcccgcgagccgtgagcgatgattggctgcgccacggcggcgggcggtccgtgggcgcacacaccctccccgcgcagccaatgggcgtgcgcacgtcactgatccggaggcccgcgggccggcagcccctcaataagccacattgttgcatgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggtaagtcagcgcgggcggggcggcaggctgggctctggcaaagtggtctggcctccatcagtctcttcctcgaccctgcggggacccgcttcctccctactccgggcctgggagcggaaaaagtttgggcagccgggacactcctgggcgccaggagccacgtccgctaagcacagccggcgagtgcgcgcgggcggggagccgaggtcgcgctccgccgggcgccctccctccctgagctccggcacgcgctcacgctctctcccccagtccctttttccctgttactggaggggcgggtcaccccgcaggtagtcagggattgctgcgcccacgtgggagggagcccccttctgcagcgcgagttccggcgagagcacgtggagagaatcgtggctgcgggaggctgctccgctgccgcgtggggccgccgggggccgtccgcgctcgcggaccgcgtgtaggagacgagcggttcccttctccttccccgcggccctgcgggggtgggctcgaggagaagctgacccgggaaggagtaggaaaggggcagaggaactccgcccgccgcgccccctccccggaactgtggcgcccggaactgaggctcggcgaggggcgtcccccattaacccccgcccctccaaatcagcctcgggaccgcccagcctcgtgtcctcaggatctgcctctgagtaaggggaggactttggttgttactttctggtttgccctaaaagttactcggagaggccaacgcgccgcgttcctggattacttgagattcttgagatttatgtccttccgaaaacgagcttttttttccttaagcctcgacctgtctgttcccacctggctccgcagctccctatggctgagcgctcaccgcggccgggtcatttacataagaaagagcctcaggccaagccgggaagctctcattccccgcctcggggtatgggggtggggatggggccggggccggggacgggcagggccaggggcgcgctcagaattgagtttctgaaatgcccgggattaggggattggctcctggcccgggcctgggctacgatttgaggtaggggacaagttgggaggggattagctggagggaggttgttttaagagctgtgaggcaacggagcgttgctcagttacatacttggaatttcaatatctgatgggaacacatttttgggaaaatgtcttgccattaccgttctgtgcgacaacctgctcatattcccattctggcggtcccgagggcataggaggcatattaatgtagtgatggcgcgtgaacctccaagaaaagcagaagttacccagcctcaagtctggaggagcgagcagaggcggttgatttacttgggttttactgtttgtaaatggctgttattctctaattcctgggatgtggctctgcaccttgattcagtttacttaaaaacgtgcctttgatttgagctggcaggatcttggtaacttctcaacttctaagaactcttggggaaggctatcatctcttggcaagtcctaaaatacacagtggagcgtcattaatctcagggagttctcctttgggtattaccccaggacatttgaatccttgcataaatttactcttcctcaatccagaggagggcaccagggttggaaccccgttggagttataccactctcaatcttggaatgggggtcatctctcttcccccagagtggaacgggaattaaccagggtatctggaaatgagttgtaatctctgtcttgtggtttattaaccatagcaccctgagcctctttggacagcccgtttctctttgtgaaatgcaataataacagtaggcttgtccactttatggagttgcgattattaagcgctgcagtgtgcaactgtcattcctgtaggttttctctacccttgcagccacctgtcagtttgagaagtgtccctgaagacccttgggtgtatttcctctaaactaccaataggggcagaattgaatcaggcctttaactcagtaattgtcagaacctgggatttgactcccagcttaggtgagcgaagctgtttgattccagtggcagttacatagaaagcagagactcagagtatcttggaaccatctttctgagctgccattggaaagaagaattaagagagaagaatgaaaatttagtataactttagagtcttttgaaaagaccttttgatttggacccttctgaaatccccttgtgataagataatcttacatattctgggttgtagtctgaggacgtggaaggcttgggttcacctgcccaacgaggtcacttgtcgtctcctgatggacaagcccagtgttttggggcattagagatgagaatcagggttatttcctcacttttgccaattggaactcaggagcgactgcagagcacctactgtgtacctggcactgttctaagctcttaggtatgtcagcttattaacattcaaatcagccccatgaggtgaagactgattgttattagcatccctgtttaactgaggcccaggggtaacttgcccaaggtctccagcttttctgtacgagctgggaatcgaagccatgcatttggctttagagcaccatgctcttgagcacatacttgcctgtctctggggaatgtgagcgggctcctggcccgggcctctgcccactcctggctgctggtagcacccccacccatcatgaccacagatggaactagctcttctgttggtttgatcagtggcaccagtaccctctggctactccagctgagagtcctggattcattttcatcaactctctaactctgtcaactggtctcttggttactttggaggcctgctaagggtgtccctaaaactctttctggagccagactggatcatttcaggagctctctacagctcttaattgcctcccgcttctaccccccagcttagcctcatcttcctctccatcctttcattcctctgtcctgcctgttcacactaggtccttttgcccttgtcttttttttttttttttttttttgagacacagtttcactctgtcaccaggctggagtgcagtggcgctatctctgcttagtgcaacctctgcctcccaggttcaagcgattctcctgcctcagcctcctgagtagttgggattacaggcgtgcgccaccatgcccagctattttttgtatttttagtagagacagggtttcaccatgttggccaggatggtctcgatctccttaccttgtgatccacctgcctcagcctcccgtagtgttgggattacaggcgtgagccaccgcacgaggcctgcccttgccatttttgtggccctgaactctgcttggcttctttccacttaaccccttccagctcaaatgcagtttactgtcttaattttctttctgcttccttctccccctcctgtgtgccaacattagtgtgtttgaaccttgcatgacatttgtttcattccaccatctgttagagttgatggttttcagtttgggttccttcctcagggcagggagaatcttggctgttaggtttgtcgctgcagttcctggccactggtgaggtgctcagtgagtacaagagtaaaggaggagacctttctggagaaagaagctaaaccagggctgcaggaagtggaggagctgggcagggccagctagtcttaggctaaagggatggtatatgggtggacacttggaggggtagttcgcagttatctcttcatccaaagcatgacctgaggccaaagcatgacctgaggccggtcctgaggagggagagagaaagggaggagagtttcctgtccttcagcaatcaagactgtgtgtcctgcctatggagagatggaagattctttctatttttttttttttttttttgagacggagtctcgctctgtcgcccaggctggagtgcagtggcgcaatctcagctcactgcaaactccacctcccgggttcacgccattctcctgcctcagcctcccgagtagctgggactacaggcgcctgccaccatgcccgggtatttttttgtatttttagtagagacgaggtttcaccgtgttatccaggatggtctcaatctcctgacctcgtgatctgcctgactccgcctcccaaagtggtgggattacaggagtgagccaccgcgcctggctgattctttctattgattgagataagttagtatacaagatgcaggattttgtcatttaagaatggagaatcagggttaaccatagagataaaatgaagtatatactcctttctctgaccattgaccaaattgttttaatacgcatagactggtgacatttgcactggaatcctgtaatagacatagctcatgtagattccttgttgtatgagcaaggggtgaccttcaatgctgggcttgagaggaatatcttggaagcgaaaagattgaacagagaccccaagagtcaagaaagccaagaattttaatgtttttttaagaacctacagtgagtgcaaggccctctgagtgtgatatgggagacagaaacccagatacttttcagttgtctagagagatatggctgctaggtcaaaagagtgaattaccatgggtggggctggagttagagcctcaaggaaccttggcacattttggacacctaccacgtgccattagtccgcacgtatgggattagagtatcaagagtaaattgctgattgaaaccttaataatattatttttgtctatgttaattttgattggacaaactgacattgacaggtacaattcactccatttgttcaatatgtaacatcttggtaacctaactctgtccctttctctgctcagaagacaactgatggtagttaggaatactttgtagcttttgttaaccatccgtttgttttatattgccaaacttacatttcagagagagctaagaagcactttttcctctacctttgaatgaattaactcccctgagctcagccaaagtcaatttttttttttttttgtgagacagagtttcgctctgtcaccaggctggagtgcagtggcacaatcttggctcactgcaacctccacctcctgggttcaagtgattctcctacctcagtctcccaagtagctgggactacaggtgcgcaccaccatgcccagctaatttttttttagtagagatggggtttcaccatgttgaccaggatggtctcgatctcttgacctcgtgatctgcccactttggcctcccaaagtgctgggattacaggcgtgagccactgcgcctggccttttttttttttttttttttttgagatggagtctcactctgtcgcccaggctggagtacagtggcgtgatctcagctcactgcaacctcggcctcctgggttcctgccgttcgcctgcctcagcctcccgagtagctgggactacaggcgcccaccaccatgtccggttaatttttttatatctttagtagagatggggtttttcactgtgttagccaggatggtcttatctcctgacctcatgatccacctgcctaggcctcccaaagtactgggattactttggcgtgagccaccgcgccaggcattttttttttttttttaaacatcacttttcaaagttgaacttttccagtactctggggagtttggggcaattggaggtccttttccaaggggggaatcagagcaacacaaaccacagttggcaatgggagtaaggagatctgatgaactgaaagaacttggagccccagaaaactggcttcctttgttcagatacttccggtttaaaagaccacatcttgataagacgttcctcattatcatcgttgagctttgaagtcagcaggtttggtttgttttccaacactgtacgtagtctgtctttgccttttcaaagctgtgggggttatgccgggcgcggtggctcacgcctgtaatcccagcactttgagaggccaaggcgggcggatcacgaggtcaggatatcaagaccatcctggctaacacggtgaaaccccgtctctactaaaaatacaaaaaaaaaaaaaaaaaattagccgggcgtggtggcaggcacctgtagtcccagctacttgggaggctgaggcaggagaatcagttgagcccgggaggtggagcttgcagtgagctgagatcgcaccaatgcactccagcctgggcgacagagcaagactctgtctcaaaaaaaaaaaaaaaaaaaaaaaaaagctgtgggggttgggatgtggcaaattaaatccccatagctcactggacacgtcttcatatcacactctgtggatcacacaccatgcttccttgtgctggagtggctctttctgcttatctttaaagcagttttctcagccttggtgctattgacattttgggacagatacgttttttgtgaggggctatcccagcctatcataaagagcaagaatttccaccttactcaaatttccagagacaaagcctatctttttaaaattcttcatttagagcagtagttttcaagtaggagtgattttataccccagtggactttggcaatgtctggagacatttttggttgtcacaaaggtttgggtgagtgtgtgttactgacatctagtaagcagaggcaggtttgggtgagtgtgtgttactgatatctagtaagcagaggctaggaatgttgctgaatattccaccatgcacaagatagctccccacaacaaaaaattacctggcccaaaatgtctacagtgtcaaatttgagaaactgctttagaagaacatggtccatccctgccacccccttcagttttcaggtgtattgctgatggtcatacagcaagttagtagccctagttgggatcagagccctgagttgtcaacagtgtgccatgtcttgtgaccgtcatggtgggaaatgggcttctacaaaagacgaacttaagatgaggtctacagttcacagcagtctgcagatgcccacagttccttgctggggggcaggtttccagggaacgggagctagttgctgtttctgtattctcaaccagagaaatgtgggcaatacaagtgctccagaaagccagcaagaggagtttagtcagttgcccttggaagatgctcaccctggtgctgctgtagtttccatggaggctgggcatgagccaggcttcccaacaagacaggcatgtgagctggtgtaatggaaattcagaaggcacttgagctggggagcagaggaggtaggccagtgacatccactgagggacagcctgacagttactgggagaggctgtttgatgagctggagtcaggctccctggggttgaactctggctttctgcataacacgcagtgtgagcttgggtcagttactctacctgtctaggcctcagtttcttttccctataaaatgcaaagattgtttggataacactttaattgagtagttgtaagaatgaaagagaaagagggttaacaggtgtcaagctctgagaactgtgcctgacatatagtcaatgctttatgtattaagtattggtacttaacaatggttcaacttgatttttttttgacttcacaatggcacaaaagtgatacgcattcagtagaacctgtactttcagtatttatataaccattatgttttgcactttcagtacagtattcaataaattacatgagatattcaacactttattgtaaaataggctttgtgttcgatggtaggttaggtgtacgaaatgcatttttgacttactaatcgggacataacctcattgtaagtcggagcatctgtacatagggagagacacagtcttagatgtcccactgcaccgtccgcctggacaggagcaaaaagaggccctgctttaccctggataactcccaagagcttcttttagagtaagtggtttcaggtccatttgtgtctctgtgtgacgttggattgaatcagaggacagagaagtcagaaggatggaaagttcctgaagccagggaagaaggatgcgtccaccgtgcttctaaaaccttctctttcctgggcgtaggagatccatccttaagctcttcctctaaattgcttttcttctggtcctctacagaggtggctcccccattcgaggtctctgggatgcctgggacattagtgcacttcaggttgaagcatccttgcgatgtcgcaggagacacagttgtgctgaatgatcacagggttagttccagctccttttccctaacctctgtctccccggtaactaacccagagaagagcagaggcttcagagggcattgtggaggctgcttacttgggatttcatattcttctgctgtggagtttgtcagttaaatacttgctcactcatcctcacatctctcccagacctggctttccacaggggaaatcatttgcagtgccctgtgctgaagagtcacaggacccgccatgataggtttggccccaccgacccctggaatttcacagaagggaatggccattctcacattctttcggcagattgggtgaggttccctgggcatcctgggatttggcagtcagctctttgcccctcatatacagaccctgggctgttgagtgtgttccttcctgctgagcccagggtgccctgggttcttcacgaagcccagggggattctgcatgtgcaacccataccctccatcccacctcttgaacagccgttgccttatccacgtcaggagtcaggagtcttggccctgttcctgtgaacagagaatctcatttcccctaaaatgctgccctcttttaggggtggtcactcattttgtttgcagatggatctctaagcatttcccggacattctttcctgccttggttaaatcttatctcagcgttaaccaggagagtgagtcaggctctgagaaactggctctggaagcccttggggcccacccacctcctgcccactcagccttcctgcctttccaccatttctgccctggatgcttggaggtggtccatgttcttaaaaggcctttttcccaatcccttccttctggcatctccatattgtctgaaggaataaagccagatgaaccatctgacagctttaattagggttaaatgagggcattcgaaactgccacttttccttctttcccatttgagggacttcctcttcctgcttcctgtttcctcccaaacttttctgtctcagtcccctccatgaagtcctgtagcctcttcccatcagctctgtgtgtagtaactcaggccaccctcaagctgccctccaggtaggtcctgttattatctattattcaaatgaagagaccaggcacaaaataggatagtaccttgccccagggcaagccagaatccagacccaggcaatgtgactccagagccagtgcccttaacccccagcacaaagctgctgggacaactatgtttcagtttcacttatgtttcagtttcatggggttatgagtcaggtatcagctgggaagggacctttgggaccatgtagtctaaacaaacccttcattttacagttaaggaaaccagatgttgtgtactaagggaccagcccaagctcacataggataagccccagatctggaacccagtttcttgatccccatcatgtttttttaaaacacagtttgtgcagcatgaactcttatcattttaggtgtcagtttcccaagatcaaaggcaggatttacttagctgtatctagggggatgccctaattgtccaaactgggccgcttttgaaaatggaggaaagcactatcagtagttatgccatgaccacaggtgtaaactgagattgtcttgggtaagcagggaagtgtgggtaccttgcctgtggtgggtgtgatcttggggtggatggggcagactgggacagacccagaggtatttgatccagcaagtggaccgctggcagcagacaggagtggggagttcagatgccactgtggggcaagaggctcagaggcagattctggtccctggcctggggctgtcgaggggtaggcagagtctgacttctagggacctagcatcctaggcagggcagacaggtggactgggaggaaaccatgctgctgcggggatcccatgcagtgtgggcgccagcctgaagagcaaggcccgacacagagcacctggtcagtcgggagtagccagctcttccccttcaccaagttacttgtcaacttttctctttggtgttcccatagccccttgtgtataactataacaaaggtttcttgagcacctattatatcctagtattgagatagctgctgctatgactgcagagaggccatttatgctgggctatggagggtcagtgggagtttgttagacaaggggaggggacattttgggcagtgaggccaacacatacacatttctaaccatttcaagacaaacactcctcagattcacattgatgtatgtgatttaagtgattgtaaatccatattttattaatgtaaaggaaactgcctactgttctgcccttcctgtcagtttgtaattacttgttaatgtatctgtcttctgccaatagactcagccccttcctggcagaggctggtgtctcctttatcccagtatcctcagtgcccagccctggcacactcaacttggcactcagtcaatatctgttggcaggtgaactgtgccagggtcacatgcatctgggacataatccccctttgctctgctgctccgcagtcagaacagaatgtctgaggacaggaggaccctgggccgggtgtcccaaatgcccatctcctggaccctggacaggtgctgctgcctaaggtctgtctggctgtaacttgatgcagctgagactgagaactggaagaacaggaagccctgtgactcacaaccgctgcaacaggatcctggaggagtggcccgtatgcctccctggtcagctctgcgcttacccgctgcctcgggtttgtgagtctgcagtgtgtcagagctggcattggcctgaggtggcatggctgccctggcgaggacaagttccttgtcccatctgaagaagtggcataggagatctgagtttcggttcatgggctttcagaggacaggagacttacagaatccatgttctgctgtgtgtcttccccccggctcatctttttttcttttatcagaaacatctggccctgccctggcaactttgtagaataaacttgctgctctttgtacagcctcagccttcccaggaggagtctgtgagggcattattattaatgaggtcactgacagcagttgcttggctttcccagggtgggcacacctgtgccctaggttagggcactcggctggtcactggatgctatgggtcttcagggactaggcctgtgatttggggaggcttctccaagtcttggtttccttgtcagagagttgtggtaaaacactggcaaaggaataatgcaaaaatatgaaattcttttgaaattaagttgcaagcatgtgtcagcacagagtcactggaagtctttgtgtggccagatttaaatgatggatctctctttgtttggcctcttttgacctctttaatcttctttggctctttgactgtgtatagtgggtaaacttgggccaagtcagtgcaacctgccttttttttccagcgtcttttgaattgaagtataatgcacatgggaaactgaaagcagcaggtaaccaccatccagatccagtaacagatcattacctgaaccagccccgtgttctcctacccaccaccaccatcaagtgtaatcactgtcctgactaacagcataggtctgtttttgtacttaatataaatagactcatacaggatataaaagatgccatttgtgtctggcatttttcagccagtgttttactgtattttgagattcatctatgtggttgcatgtagtggtaggtggtgcattcttgttgctgtatactatctcttgcaccactctggcttgtttttgtttttaagagacagggtcttgcactgttgcccaggctgagtgcagcagcgtgatcatggctcactacagccttgacctcctggcttcaaatgatcctcctcagccaaagtattaggattactggtgtgagccactgtgcccatcccaccaccctgttttgactgtggttgatttaaagcagacgaaagtagtcataataaggcccctgacttccagaaggtatggtcctttctaagtttctgtcaaaggggccaaataggagtgttgacctaatatatagatgacccgattgtatcttcaggacaagaacatgcatgttaagaaaggtgaagttcaatcagttggtcttctagggtctagaaactaaaaggtaggatttttagctgtggtcatctagggcacctggagagacggttctagataatcaattagaaatatcccaagactggggagacaaagttcagctgtgccacaggcatcctgcatcctttgctttgatgcttctatgcttgtggagtaactttcttatcctatgtgatcacttgaattcagccctctaccaggagggtgtgccctgcagacacaagtgatgaacatttgcttattcatgtattatgtattttctgcttgcttactaaaaggatttagtgatttggttcagctttcagtaaaaagatttctagaacgagagtcatcaaactggcgagatgattactgaaaaacttgacaggccaggtgtggtggctcatgcttgtaatcccagcactttgggaggccaagatggaaggattgcttaaggccaggagtttgagaccagtctggacaacgcagtgagactctgtctctacagaaaaaataaaattaaaaaaatcagctgggtacgagggtgcatacctatagtcttagctacttgggaggctgcagtggaaggatcatgagcccaggagtttaaggctgcagcctaggagtttgaggctgcagtgaaccatgattgcgtcattgcactccagcctgggcagccgagcaagactctgtctctaaagttaaacaaacttgacgaagctccaagcttcctgacagtcaaggcaaaaaggatagttagttctctttgagtcagtcgttttcatcccatcggcctataacaggtagcacagtgtgtctgggcagccagactttctcctgacactaacccttactggggactgaatggctagggaagcattagtgaaagacacagcagctttacctggtgcagtggtctttatagtctttcctgtgagcccttgattaaaagtgatagaactaaacctatgaagcatttcatggggagctaatgtaatgttgtgaaggtgaggagctttctgttcctggaattggtaatttcccagggtcttaggggcttgcccatgcctcctgagccttttcacactgctgtctctaggtaagcatttatctgctaaggtggctgagctccaaaagtatcccctttgattgccagtctctcaggccacttaaatctgtgacacttcccatgggctgccttgtattgtgcccgacattcttattagacaagactcatctctccacgcattctagagacactcattgatctataatatgagccagcttctttgatataaagtcctagagagcagggctgttgatttcttaaaatttttaagaattgtaataaaatattaatcacaaaatttaccattttaaccattttaagtgtacaatttagtggcattaagtgtgttattcacattgctgtgcaactaccaccactattcatttccagaattaatttcttgtaaaattatgtttctgtacactagtgctttgtatttaatagctgttccataaatgccataacatggaagatgctggggttgcaacagtagtcaggattcagggattgaatgatacggatcttacagacttagacattgaaatttaaggtttcgtttcgtctacacttcccttttaaaacccttgagtaccttactcaaggtaggatctgtagtacttcatataaaaactgtcaaaattggaatattgctgtcttctggatgtaaataatttgatcaaggccaggttcccacagggaccagatggggtgggctcaggatccaggcagtggcaccagtctttcagttgcattgggcctgcagaatgagatgggcgcttctgggccagaagggttgacattcatccaggtgatccagattctagtttcaactgtgtgacctgggtcgaggctgctccccgatgggcctggtttctctgagatccctttcttgcagtcacctccaggcctttccttcctgggcttccccatacctggccaggactgtgtatggcccaccctgcacactgcatacttcgaagtggagcctccatgaatgtccccttttgttctctccatttgttgctttgtgacagtgacacaatttcctctccttttttaagtgctggtctggaggaaaatgcaggtacttaaggggatgggtgttaatggcttcccattttgggtattatcttatttcctagagagtatggggttaatttgtctttagggcttcccctgacaccaaccccaattctgtagaggaagtgggcatgtcagactggtatgttatgggaaaaactgaaactgaccaaaattacccaatgaggaagctctgatctaacccttgctgaagaaatatcaactaacagtgctatctctgtctaacacgccctcgcttcctgggctggcagcttggcaggcagacgggaaggtaacccgttcttcagccaggctttgctctggcctgcctccgattccccagcctggaatgccccctcctcctttcctcctctcccagatagagatttaaagagaagcagccttgtccatgcccatcacagaaagagaaggaatagtttggggaaacagcctctgctttgtgactaaggagggttgagaaatgtctgtgattgcctgaaggtgaccctgggtggagagaagctttagaagaaagaaggggtggaaggaaagggggggtgatagagaactcttttgtccccacagttatgctaatgactctgtcatgtggggctattcatcctgttttgtggcaaggaagctggggttcagatgaagagtcctctaatgtcgcacacctgtacgaacgctaccactaggatttgcatactggtgtttctgatgccagagcactcctttcaccaccaccagctacaaatcaagggttgacctgaatgagtctgctttgatagtatccagaaacttacatctcttaaaaacaaatgcagagtttgtcttcccaactcccagcaggctggatcaacacaggattacttcacagggtcacacctggcctaatatcttaaccaccgactctcaaagattccaggcagaaaagtgatatgcagtgttgatcagaacagggccaaccacgatcacgttattggcatattggaaacctcccagaggagaggggaaggtgtttgagccccagccttagaggtgtcatttggttagtctggaatggatccttggaattcttactgttttctttaaaagctcctcatgtgattctgatgtgcagcaagtttggaaactcttatcacaagtgacagaatggagattaggcagaagtatcagaaagcagatttatctttgattgaggaaactctttgaaacaagtagagctgttcaaaaatggaatttagagaaatagcgagcctctcaggcttggaagtattcaaacctaggccacatgactatcaattgggtggagagagacaaactagataaattcgaatactatgtttagtgggattttcgaactagttaccctaagggcctttcctttctatggatgaatacttttcagctgcagtcccactgctgtgtgtacatctgctatcacctgcttggctttctcctttgactttgggcctggtgctccctcccactgatggcactgtgggtgaaagttggcaagattctgaaaattgcattcatctccttctcaatccaggaaaatcatctttgtatggtggctgcttcttgtttctgacttctgcttcccttggctaccaacacagcagtgcctaccagggctgggtgggctccactggtgtgtttaggaaactgtggcattaagtgattattaattatcccttcctgagtggccctaataagctgagtggacacatcatcatgccctggtgccatctgttctcaagttttgagagttcaaagagctctgatgtgaaagaggggaagtttgggccaagctactggcctggacatttttcactgtttcatatccacagctgtttcatatcttctctcttagtctcctcatgtgatggagaggaaaataaggtcccagggtcatccaagaaaccacagggcaggctgggagtgcccatccacactaagaggggcccacaggacaggcgagggtggctgtcctgacggcctggcagtggggccagacagacctctgtggaatcccatctctgcccctcattacccaagtgatctataaaacggaggtgcagaagttttacgaagacaatggagaacaggtcaggaaagccggaagtgcctgacaggtgagaaatgcttgaggaatgcttagccgctgtaaccatcaccccattactgttttcatctgtcattgaacatgtggaagatggttatctatggggcaaaaggcaacgtggataaagggtgactgtttaactcgattcttcaagggttgaggatgagaagtgtctgactggatttccaacatgtcttgaaacagtttaaacatcgaagataaactaagattggctgtcgtagaatttgcttttttgtgtgcataacctcatgcttctggacatgatgataggaccatttaatgaggtggaacaggctcagctcctcagtgcaggaactcctgtgccctttgcaaacacctgaagccttccatagagggtggaggtggggcgggggcaccaagaagcttctgggcctctcttctctttgggaaagtagtgaggtgagagtgtctttgtcaggtgtcaccctcatgacaatgttcagagacatgtctgctgccccagacctgctcagtcacctctgtgtgcctcactctccactgcgtgctgttcatgtctgcattgggaggtgactggaatagaagatggccttttaatggatatggacagcctgcattccctgcaatgctgtttgacctgtatagaccctgctgtatccaggcaggcagggggcagtcatctagcagagtggacaagagcacagaccagccaaacttctctatcaagccaaacgtggcccctcgtgtctgtgtgacttcccctctctgtagaatagagatgctggcacttcctacctcagagggctgttctaaggatgaaatgaactaatgggagcaaacccggagaataggatctggcacaaagcaggagccacgtgagggcttgccattattacagttgcccatgaggacatctcaggcttttcctggatgtggcctcgcattggcttctggtctgggtagccccagactttgcacattagccctgagatgtgaaagttgtaatgtagcattcctgggccagtcagtgtctcattggatctggagtgggaagcctccagggtggtcagagttacccttgaactagggtcactggagatggctagagatttgtctgacacttcactgaaaagaaaggggccttgtctagtgtcaggctgaagctgcaccctttttcctcctggggagcctcaaatgtccttgttggggaggcccaggcctcctcaggagcaccttggttcccagatattgtaggaaccagagatcagagacccagcttgtgggatggagggtggggggctagtgccccacagccctggaggttgtggtagattccaggagttggaaacaagctgggcaatatagcaagaccctgtctcaaaaataacaattaaaagattaaaaaaaaaaaacaacaaaaaacgagtgagagttatctgatgcttctcattctcctggtattaaatctgggaaaagttcatgtgaatttatgtgggaaacaggatcagtgaaagaactagggagagttgcctccgcatgagcacagaggctgcattatcatttacatagagcctctccattgtgccaggcaccgtgccagcctccaggtatgcaaaggtgaacaagcagacattgttctagcctttggtacttatgatttggaccctaataaatatttagttccaaattgtggatagtgttgcgaagggaaaagctcaagttcttagaataacagggaggcctggctgttgtgatctggaggatgagaagaggcctctacagagagaggcctgaaggagtggtagcagatcgtcagggcatgtacctggagggcctgtgtgtgtgagctccaaggcagggatgggcaagttggggaagttggggaactgaaccagggagagaatctacacaaagagtccagaccttaccataagattaggaggtggggccgggtgtggtggctcgctcctttaatcccagcactttgggaggccgaggcaggtggatagcttgagtccaggagtttgagaccagcctagacaacatggtgaaaccctgtctctgctaaaaatacaaaaattagctgggtgtggtggtgcaccgctgtaatcccagctactcgggaggctgaggcactagaattgcttgaacccgggaggcagaggttgcagtgagtcgagattgcgccactctactccagcctgggtgacagggtgagactcagcctcaaaacaacaacaacaacaacaacaacaacaacaacaacaacaacaacaaaattagccagacatggtggcacgtgcctgaaagtcccagctgctcaggaggctgaggtgggaggatcacctgaggctggctgagatctcatcactgcactccagcctggacaactggagcgataccctgtcaaaaaaaaaaaagataaaaagattaggaggtggctagaggcccgatcatgtggggccctgaaaggattttgagctttgttccaatggaaagccctgaaagccggggatcagcggagtctggctgggtgtggaaagtggatggaagaggtaaaagcggaactggggattgtaggcgtccgggaaaaaggtgatggctacctggcctagggtgaggggcaatgggattgctgtgactggccatgtcaggtgctgggggaacaagagatgagggtaatgaaccctggctccagtgatgttgtcacaggccttccgactcaaccattctgaaaagaactctcctctgtcctaataggcctttcctcaggtatgcaccagttctccaaaaattaggtctatttttataattttaattttttggttttttttttttaagacaaagtcctgtcaaatcggttcctactaatggtctttaataataactttctgtacataacagattttgttcttttgaagagctgagtggtgttccatgacgtacacctatgccataatttatttaaccagtggtttctgctcttgtcttcctcctttttcaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacaggtactgcatctgggggatggctctagctgctgcgttactcaggggtgatttagttggctttgctcagggacccaaataactcaaaagcctcagaaaccaaccctggctaagggaagcatccagggaattgaatggaaggctgtgtgacggatggacaggaagcttgggaaaagctggcagtcctggcagttaagggagggcacctttgtcagccctactgtggcatcactgttggccatttgttttctacctgtgtgctgagaaaggctgcttggctcagtttggcattttatggtcccactgagattgcacgcagtgatggtgatgaactacaacaaacgtacctcacgtggccacaactgtaggccgtgggagccgctctgtggctcacctgtgcatgctctaactgggacgccggacgccgtgtaggcatgtgggagggacagtgtagtgcagattgacctagatttttttcttgagccccatgtaaaaagtactagaaatccaaatagacttggacaaagtatggagcgtcacagtgcatatatatatatttttttgagacagtttcactcttgttgcccaggctggcgtgcaatgatgcgatctcggctcaccgcaacctccgcctcctgggttcaagtgattctcctgcctcaccctctggagtagctgggattacaggcatgtgccaccaagcccggctaattttgtatttttagtagagatggggtttctcatgttggtcaggttggtctcgaactcctgacctcaggtgatccgcccgcttcagcctcccaaagtgctaggattacagctaccgcgcccgctgccacagtgcatattaaggaattaaaggctcagaagtcctgcaatacaaacctattaagctttgtttaatcatcttatttggatacagagtacttttttttgagatggagtctcgctctgtcacccaggctagagcgcagtggcgtgatctccattagccagaatggtctatatcttttgacctcgtacccgcccacctcggcctcccaaagtgctgggattacaggcgtggctaccgcacccagcccagaatccttattttatggtacaccacccagcaagtgatttaatcaggcaggggaaaaaggatcacggtggagattcaagttggaaaggtccagtggattagggctaggtcactgaaggccttgaatgcaagcctaaaacatttaatctctgcagtagcattggggagtaaatgcaaggttttgaggggtgtcttggtaatgttacatcattggcagtataggtagagtggagggggagcgaggcccagctggtagagcacaagacatggctctggtgggtgggcaaaaagagtattcaagggtggggcccggctgttgagcccagctgcctgggaatggcaacatcccagagaaggggaccgaacaaagttgtgtcagagcttttatttaatcctcataataggtgcctccattttagagatgaggtgcttgtgaggcccatgacgggtggtgggtggggggtaggtactcacatctagaggacaggagagagaacccaaggggcagctgccagggcagaggaagaaccaggaggcacagtgtccaagaatctaagggggacgagatctccaggaagctggcaggtcgctggtgaggcatctacaggggcgttgttgggaggggagtaggggcagggcgtgggtcagggcttgttaatgccacgcgcctgtgctgtttccagcacatgtgtgtccttgaggctcatctccctaagtgcctctagggacctggttcgtctgagactgtatcgttcccaaaataagtaagtgtttgctgaagccttgggacccagcctggacccagtgctgagggtatgaccttgcttaggattgtttcctgagtgtgtttcttggcccttcaaagagcccctcgaggtgaggggcctcttatctcttccatgtcctctagattggcatgtttacctaccactccctctgactggaaaccacacccacttctgagatttttatttgacattcagataaatgtacacactccggaaggccagggccttgtctttatttcacccagcactaacactaagtaagtaccctaaatcttttctaaatacatatgggctaaggactcttttgggcacctcaatgtattaactcatttacttttcaaaaacctttatggtaagtacaaattttatccacaatttttagatgaggaatttgaggttcaaatgtcaaacaagttgtccaaaatcctacagccagtgggaggccgagttaggaatcaagcttgtgtaagccaaagttcaggcatcggtactgcacgtgatgtgttatatgtgttcatgtatgtgttagcctgtgcacttggcgctggagcacactgcaaatgctcaactaaaatttttttggaacggagttgggactgattgtttggactgtattataggcaggtgaattaagtttgttggggagaactaattatggggcaagctttcaaaattctcattgctttcctgaagctggaggctccaagacctcccatgcaccttgaagcttgcactgtttgcagcacatactggaatgtcttactcactgaaacaaaggaagtggcccctggaataatggagaccagattgcaggaaacccacacctaatccctccctccgcatttgcagggggtccataggttagctcctcacctccatactctctgggactcagcctttgcttttgtaaagtaaagaggttggacctagcagttctagtctgttctgcacatctactagaactattgtgctagtctattcacacaaacacttctgagatcctgtaatgggagataaacccttggtgttcattggatggtgtcttagttcatttttgtgttgctgtaaagtgggacatatgtatatatgacaactcagcaattccacttccaactatatgccctgaacagactcctgtatgaatccaaggagacatggctgaataatgttcattacagtgttgcttaatcgcacctataatcccagctactcaggaggccgaggcagagagaatcaatcacctgaacctgggagatggaggttgcagtgagccgaagttgcgccactgcactccagcctgggtgacagcatgagactctgtctcaaaaaacaaacaaaaatagataaatttaaaaaaaataaagtggtcagcatcagggctctcaagttttgctttgtcagttgggggtatgagttatggaatatggcagtgaaaataggtgactcctaagttgatacagactatcaaaaatgaaaattctctattgtcagcaccccagtgaagtgctgcgaggaaaggccgaggtgaagttgtgttagcgattccccccatgtggtcgcacacagcctgggtgcctgccgctgctgctgggggtgaagctgcatccctctcccacagaaggctcgaggccttttctccaggggcacctgttcagtgccacctttctcagaacattcgtttctcagcccgttcatggctagtattcttttcaaacctgagaaaccaaaccccagatctagagggagccaatttttaaatccatagctttctaacttttctgggctatatcttcacagcaagaaacacatgcatataaatatttatatgaaaggaaataaatttggggaccagaatttattcttaaacatgatgaagttgggtttgtcttctattctttaagaaagttgctagtcagaacctgctaaatgtttttcactttgcagtttgaaagccactgccttaaatgatccttggcccagtttgattctagatgagcatttcctttcttgctggcacgaaatatgtagtttcaggacagtgtggggtgagaggtgagaatcagaattataggttcaaatgggtttgaattcaagctgtgtgcttcagagcgatttatgatgtgatcctctatttcctcatttgtgaaaaggggaaacttcagggggatcggttttctgagaattaagggagaatcagatatgtgactttctcacatgtgttacaaacactcctgcagccacaaaccaccactgcaaaaggcactctcattgccaaatttactaagaaaaggtgtgtaagactcccaggttttaattttggaagattggcatcaagggagcaggtgtgagggttcatccccatcaccaggggccctgcattttggagtgaagaccaggccccagctcttataccagctccaattatctaattgtaatcaaagtcctattagaaaatgtggagaaaccagaaagtttcaggccatttatttgtggtggaggcctccccatcacggcttatgggctcttgtgtgagaaggcagggaatgtcagtagccactgaaccccgtaggggtgaaatgttcaaggtaaatcgtgaagtacctgtgcttcataggttgtgtggcctacacagtgtgaagaaacacagttggcataattaaaagtgcaatagacataaacggtccaggaatgtcttactcaatgactgaatttggtgtcagccagaatacattaaaaatggtctctatttgtcgttttgcttctttcccaaacagttttaagaagttgaaagaattctatagtggtcatctatattttacttggtttgctttatcaaccccccaatccttctatccatcagtccagcttgttataattgatgcattacaaaacataaattgctgagaaagtatagtaaatactaatactgaactctagttactatgtatgctgaagttttagggttcagacgtatacttacatagtaactagagttcaatatttgctgtattttcttgtgatgtaagatctagatgaagtgaaataaatcttaagagtattatctgataaaaaaataaatagaaggccgggcatggtgtctcatgcctgcaatcccagcactttgggaggctgaggcgggcagatcacaaggtcaggagatcgagatcatcctggctaacacggtgaaaccctgtctctactaaaaatacaaaaaattagccaggcgtggtggcaggcggctgaagcaggaagaatggtgtgaacccgggaggcagagcattccagcctgggccacagagcgagactccatctcaaaaaaaaagagtattatctgatgaattgacaaatacacctgtttaatacaacctccatcagaaaagggaatgcttatacactgttggtgggaatgtaaataagtacatcctctatggaaaacagtatggagatttctcaaagaactaaaaatagaactgccattccatccagcaatctcactattgagtatctacccaaaggaaaagaaatcataccaaaaagatgcctgcacttgtatgtttatcacagcaccattcacaatagcaaagatgtggagtcgatgcccatcaatggacagatgattggataaagaaactgtggtatatatacataatagaatactgttcagtcttaaaatagaatgaaataatgtattttgcagcatcatggatggaactggaggctgttattttaagtgaaacagctccaaaacagacaaataccgcacgttttcacttataagtgggagctaaacagtgtgtccacatggacatagaaagtggaatgatagaccatggagacttggaagggtgagggtaggagggtggggggcatgagggtaggagggtggggggtggtgtggatgatgagaaattacttaacggatgtagtgggtgttggatacactaaaagccctcacttcaccattgtgcagtatatccatgtaacaaaattatgtttgcacctcataaatttaaacaactaaaaaaaacctccatcaagatacagaacattaccatcaccccagaaagttaccttgagccccttcccagtcaatccctgtacctgatccccccagaggcaatcacattctactattttccacatatgtgagttttgcctgttccagaacttcacatataaatcgactcacacagtatttgttttttatgcaagtctttttttatttgtcataatgtgggatttatctgtgttgtgtctatcagtgtctcgttccttttggctgctgattccatggtatgattagaatctgatatgaatattgatggacacccgggcagtttccagtttttggctatttgagtaaagctgctatgaacattattgcacaagcccttttgtggacacgtttttagttccttgtataaacaactaggagtggaattactgggtcattcatagaatttggtatatgtttaatttttagaaactgccagacatttcccccaaattgttgaaccatttatactcccactaataatgtatgagagctctgcctgctccatatcctcaatagcatttgttgtctgtatgtccttgtttctttttttcagtggagagttaattaaagaaagcattcatttgcgtttgctaggaaacacaccatcttgacctctctgtaggcagccctaatctgtgccacaaccctgcgtgtgactgtggtaccagccctaacgcagttctgtcaggggccccaccacacacataggggccacacataggggcctggctttcagaggacagttccattttaaaagggaatgcaggggtcgggcacggtggcttacgcctgtaatcctaacactttgggaggccaaggtgggtggatcacttgaggtcaggaccagcctggccaacatgttgaaaccccatctctactaaaaatataaaaaattagccggttgtggtggcatggacctgtaatcccagctactggggggctgagacacgagaatcgcttgaatctgggaggcagaggttgcagtgagctgagatcatgctgctgcactccagcctgggcgacagagtgagactccgaaaaaaaaaaaaagggaatgcaggaagaattgatagcatttaatgagcacccatggtgtctgtactaggccatttacataaatctgttttactctccacaaaaactttacaagagagtcattctcactttaaaaatgaggcaaccaaggctaaaaaaggattgatggctgccaaggtcacctgtgggcagatggtgacagttgggatgtaagcatagatagtcctgactccacggccataagattcacagtttacattggcttgtactgctgaaccaaagtttctagggaaaatcagatgattatctttttaaatggatcctaaatacgagttggctttgtatcattccaataagaagctcaagtacaacccaactgaaaatgtgccagccgcatgttctaacttagaaatgaagtaactgtggtgcctttatcacccttgtcttggcaagatcgtttggttataactatgccttatgagacagagtgagggtaaggcagtgtcagatcgatcatttgactcttcttcacctcggaattgtgaattatgttcacaggtaagtatacctccatcctctagccagacttaaaccctctagagagcagggaaccatgatgctgatggtgacggtgatgatgatgatgataaaaattgtagacatcgttagtgccaggtactgtgctgaacgctgtgtttgagctatctcatcatttcttacagtcatccagtggtaggtacgctgaacttcactttacagaaaaaggcaatagatttggagcaattaggcaacttgcccaaagtcacagtgagcaagtggcagcattgggattggaacttggccagccaaattgctaatgcctgggcttttaagcacaccaccagtggcacattggtgctgtgctgctagcacaatgtgtggattcttctcttactaacctaggcctagctgttcagctcattcaacagtcctctccgaggcttggtcctctgtgcagcagcagtgtgctaagctgcctcgtgccctttaaagagtgaaagttgtgctggggagataaggcccatgtagacaaaacaattagagatatcgggccatataatgcaagcacatgatgtgataaagggagaccgggctggtgatacgttgcatggaagctggttaaacctgaaggaagcccttatcttggttgctctgcattatattaacaactgtacagcggagacatacatccagagctagcacacagcaagttaattggggtacttacgtagtccaggcgatataaattgaagattgtactgatagatagcctcagtacagcagatggcacttacattgtcaggcgttgtgccaaacgccttacacttccttgcactgaatcttgacaaggtgcgtgtgtgtatgtgtgcgtgtatatgtgtgtgttttcctgtgttcttgttctgggttgtggagggaggtgctgactagaaggaggttatcgttacccttttaaaacagatgatgaaatctgagtgtcagatttctaataaattgcccaaagccacatggctaatgcatgttagagtgggatttgaacccaggtctgcctgcctaaaaagctgaacatgctcagagcttacacaatattgaaacataatcatgttttaaccctttgaagagtggtttcacatctgtggggctaattacacctctctgtgactggcacgtattttgagcttaagaaacacttcctgggtaaaaagagcaccagagtggtgcattccaagaggtgtcctaggagctttagggtgccagtcatgtgttttacgtgttccacacccctcccttcagttggagcagctctgtttttctctattttacgttgtggcatttggcccaccaattttatttggaaataagcattctgttgcttaaaatggtttgaaaacaaatgatgtagaagatcagatcactccattcctagtctgtaccagacaccagcgttaactgtgattcagtgcctttaatgacacggagtattgaatacttctgtatggctgagctcttgaatggtggccggcattgcattgtaatggagtaattggaatcctggggtttaaaaagaggctgccaggtgtggtagtgatcatggcgattccgggtacatggaaaatacgtgccttgagacctgtgtcttgctacattacctgcttaggacttggagatgtatcttttcggtcctcgtttcatttggagtatatgccatacattctcagagcagtccactgttgtgtgctagcaggtgcttgaaaactaaaggaaaaaaacaagatcccctcaacccagagtcaccccatagaggatgattggaatgttcagtgcagttacctggggccactggaaatgatattgtagggcagaaagggcaggtccctttaggggcattaagttataaatatagggctggttcaggaactgaatgtgaaagtatgcgtttgtgactttgacccacctccaagtttacggctgcatgcctcaggcattgagtgacaaggaagagccagaggctctaaggttggatcaaatacagtccagtgttctgatttgcctgagcctctcccagttttggcattgaaagtcccatgtcataggaaacccctccatcctgggcaaactgggatggttggccaccctacatggccctggagctcatgccctcactgctgctcagctcaactgtggcagcagcccttgagctgcttccttgtgctatcccagccctccacagtgccactagagccactagagcccttttggaaacagatctgaccttcttaagaacgaaagaaagtccttggcaatggtatttgctgtgcgtttatagccatgtcacgtgagccctatgttgtagctactctggacatgccattttttggcacccacaaattaatgccaacttatagttataccaaacctctgtcctgccttactggacaccagagcatgccacaaacctccatggccttgacagggagaaagggaacaagtaccttgataggatctattaacggaggaataatttactgtgtttcttctttgttgttgttgtcatttgtttgttttttttttgagacagagtctggctctattgcccaggctggggtacagtggcgagatctcagttcactgcaacctccacttcctgggttctagtgattctcttgcctcagcctcccaagtaactgggattacagggctacgccaccatgcccggcaaatttttgtattattagtagagacagggtttcaccatgttgaccaggctggtctcaaactccagacctcaagtaatctgcccgccttggcctcccaaagtgctgggaatacaagcatgagccaccacacccagcctgtgtgtttctatatgttcacatacaacatagtccatgtttcacgtaagcatcacaaccgctgggagatgtcagcattatgaatcctgttctacaggtgaggtgacatgctcagagagccctgtgatgtgcccacaccacacaggtagtgaagctgctgagctggaattcaaaatgaggcctgcctacctgtctaaggtccagtgcctaaccactgctctggcatgggcacgtaaccatgcgtgggcgttacgagagggcccgtctcaggattgccgagtcacagtgctaggcctgcctcagattccggacttggaaggaatgcagtcattggctatggtggttgtggcttcctatgtgtgtggaggagggctgcagggaggaggggtgtcagggaatgtgtgttccagaggagtcctgtaagcaaagcaagagaggacctccttcctgggaacaggttcatcagcaatactttattatttgtgttttcccttcagtccatcagaaaatcctgcacaccacccgttcttggtggagctgtggcctctgagtccagctgggctggcctcggatgatgacccaccaggggcagcctcgccacctcggtcccctgtggtcactgattcagcggatcgcgtgtatcctggacttgagagtgctgatgaggcatttcatctttgatatccctttcatccctcatgacagccaccacgttgtgtttcctagaatttggctgagttcccactaccagggaaggctcagagctggagtgtctggaaaagccacccatggccatgaggcaggcaggctaaccccagatgagggcgatgttgctgtagctagcccgcagctgtagctagtggtggggccacctctagtcactgggcaggaaatggaaaattagtgcccctaaggaggaatgctgccgtcactggagccaattccagtgacttttcttggacaggtttctgcaatcccttctgctttcgttggcctggaagagtcaagtgaggctgtgggacagggtctgcctagagcccggagagagagtacctagtacttactgagtgtgtcctgagttcttggtcctgcaccacacttgtgtgtctaatttttcccctcacagcaacccaatgagatgcaatgttcccattttagagatgaagcagctgaggctcagaggctcaggaacttgcctctgctaaatagtggccggggttctggagcaggtgatgtgggctccagagccagtctccgtgtgtcacatcgcctgacacacttctggttgtgtggtctctggtggatgatgtctaccgttttccctcttgggaccctagggactgtgggtggtgttctcagggagctggtcagatgtgacttttctcagggcctaagtgctggaggtgctgagtgcacctgggtgtaaaacaaacattcttgggttattgagtcagagcatctccctgacctctgacccattccgcttcacttcagtgctgttctcccaccaggaaaggggttgagtgttgacaaacatgccaataagtgaaccccccaggaaattgccttgtatccttgtatcctttgagaaggttgtggcagggcagcagaagactggcggtgctgctcgcagttggggcagtcacctgcggatgcgccttgcctgctccgccagcccctgccctgctgcaggttccgcgcctcttcagcactttcattctgtgccacacaatggggcccttccccatagtcggtggtattatcacccaggatctggatgtttcctgtctacactgctgtttcctggagggtaggaactgcaccttcccagtgacacatgacagtcttcacccatctgtgtctgtggctcctttctggagtctcactcatcctctttcctgctcccccacagcttttctgttgcttcagtggcctgactcttgtcgtacatacatgctctggggtcagcattctcttgcattctgataagcctgagatcctttgagggggcacctgcttgccttattcaccaggcctcaatgtgttggtcctcattccactccatcacatgacccctctggtcttgctgcaggacatggccctcataatatgcaaacattagaaagtaaatttagtactgcaattgcaatatgcaaacataatatgcaaacattagaaagtaaatttaataccgtgcttgcaatttggtgttctgggggtatgaggaacaggatggaggcatgcacccctggcatggggcttgctgaaagcactgaggaggtagtcggctctcaggagggggtgagcacatcgttggatgcgaaactgtcttatattgttgattgaattataaaagtaatgtatatgcgacagaatactacttagccataaaaaggaacaaattaatggcattcgtagcaacctggatgggattggagaccattattctaagtgaagtaactctggaatggaaaaccaaacatcatatgttctcactcataattgggaactaagctatgaggatgcaaaagcataagaataatacaattgactttggagactcagaggaaaggatgggaagggagtgagggattaaaaaaaaaacagccctgtgagtttccagttttaataaagctctgagaattaaaaaaataataatgtaaaggtgtatagcatgaaattagactatatgtaatgtctgtagaggagtgaatcccactggccgccccttacccacagatattcctggagggacttggagttttaagtctcggttggttcctggaagaattttgcccaaaattaatagtggcccttcctttctctgcagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccaggtatgacccttctctcagggcagcccctggtgacaaaaaacttccttggcatgttctttctgtactttctccagccgctcccagcgtgtggataggcagtcacccaagacactcatggatgccagcacagctgtaagggctccctctcagccggagctcaggctgttctggttgtattttatacccaacatgtactcagtattaaaaggagtgactagagaagaagcatgaaatccaagtaagacgctgttcagtgttgtcacatctcgggcctcagggcttggaagaggtcaagccctctgattcgtggtcggctgttccctctcccacacaaggctccctcctgggaaaggaatttctgaccatgagtagaacacgctggggagatatttttagactcattatttgtctttggggtggccttgaggtaaacctgctttccttgttatcatgctggggttggagaagggaggctgcatccctagggctgtgggcatttgagctttaccgaagttgtcacgtggctccagtataacgtcaggagggacacagagggtagcggcccttccactgccactcctatgcctgcaccaagctgaggtattaaagagattgggtcctgtattcaggcactctagctgtgtgattctgggcaagtgatagacctcagtttattcatctgtaaaaagggatgatagtgtacggattgtggtgtagattagaggagatgatacctgttaagtatttggcatagtgctggtgcataatctagtactcttcgtgtttttttcacaggggtttttgtctgtttatctaattgcttcttgtgctgtcactttctgtggctagtaattgcattgttccctgttgtgggggatgtggttgccttttcttcccgttgcctcgatctcctgccttgggccacatcccccagatgataaatgtttaagaaccaagtaaactagataagacaaaacaaaacaaacaaaataacatctaaagtttggctgtgattatgtaaaagacttgtaacgtgatggtgacttgttaggtggatttttaagttttacaagaacaacaccctccctgttgcttgtatcctgacaacatgcaggggccaggcaccttgcagtccctgcagcgtcatccctagagcctggcaaggacaatgaagtgcgtctctgccaattgagaaaaaaaatccattttaaacattcaagatgtgagtgaagttcttcttgaaaaaagcttaaaattgctcagaccacctagttagagggtatcaagaaaacctactctccatgcaatatataagaaaaacagtatagtccggattaaaaaaaaaaacaactatgagacccaccttgaagagcattaaaactgttgagatattagaaagattttaagtaagtgaaaaatgctatttaaaaatgaaaaggaaagaaagctagaagaaaatataggtatctttgatcctaaggaataggaagactgctgtgtacctaaaagcagcagaaaacacttggaaaaaaggctgaaaggaagttcattgtggctattttagtggtggaattactggtgctatttttcccatattttcccccttttttggtacttggtatcagtattttacttaaaggaaaacaaatggattgtaaatatacactttggttaagaacaaatcttggaatcccaaacttgcaaaggtttttgaagaattgtgaacctgggcaatgggggtccttcggtaaagtctgtcttccggcacattaacttctcctgaagagcagtggattgcaaacctgaatggcagccactttaagattttaaacgtatatctcgtggaaagggaagtgagcagattttcagaccagtaaggaaaaggaaaccattttaacttcataaaatgatgccctttgagcctttttatgacaggaacgtgttagctctttctctgcatcttacccatagatcctcctcaaagagaacgagattgtcttccaattcaaggaagcagaaggtctcctcttcccacttgagaaaagatgtaggttctttgaacccagccctagccagtggaacttcttgcagcaatggaactgtctcctatcttccctgtgcaatatgataggcactgaccctgtggcatcgagcccttgaagtgtggctggtgtgacggaggaactgaatttttaaggtcttttttcttttcttttcttttttttttttttttttgagacagtctcactctgtcacccaagcgtgacacccaagagtgcggtggcaccatcccggctctctgcaatttctgccccccaggttcaagcgattctccttcctcagcctcccgagtagctgggactacaggtgtgcaccaccaggcccggctaattttttgaatttttagtagagacagctaattttttgaatcaccatgttggctttgagcttctgacctcaagtgatctgcccgtcttcgcctcccgaagtgctgggattacaggcaggagccactgcgccggcctgttttaaaaattctaattaattgacatagccacagatggccagtggctactatattgggcagggcagtatttaatgcttcttcacggtctatttttctctaccttcctatgttaggagcgcaactggaaagaaagcagtgatcagagctgggggaggagaaaccattttgcttttcccccttctaacccccacctccagtctttgatgattggccttatctctttgcacaacttctgcatctccctttttttttttttttttttttgggataaaaactatttgtactaaagatcattttgactagagtgccaggaagaaggtgctgggaatttgtttaatatacgtatcatataattcatctctagtcaccttcccgacagaacagaatttgctgaatatatccctattttcatgttaaaatacttgaactctgttcaagggagttggctcacctgcactggtgatccccatggcaagagagccttgtcctccccagcctttgctcttgaaaatgttttggtttggaggtcgaaggttcagcctcagctgttgttaactttgcatgggatcagacagagggacagacagaatggatgtgggaagtttagttagatctggccatcttccagattggggtggccttgtcttcctgggtccctcctgctgaccataccctaggcatcaggagatccaacaggtctgtcagtttccctctcccaacctctcagttcctttataaatgtaagaactttctgtggtttggcatagtggttctcaacctactgctccaggatcacctggagggcggaaggcttgctaacagatggctgggccccacccccagagtttctgctatagtcggtctgtgggggcgggcctagaccctagaatgtacatttctaacatgttcccaggttaagggagtgaggttgctgttccaggagcacactttgaaaagccatggtttagtcgaatcttcttgcaccttcctggataggaaaaggatagttgacctcttatccaccttggcttttagattttgccacgtagtcaacctggcccttggaatctgcccagcctctttggcctctgcttactttttacacctgaatgcctctagtctcagccttcacctaaagggtcagcagcttctctttgagcgtgtagggtggggcaagaaggacgccaggggattgtgggctttggggctgattgaaagcctggcttattatgaatacagcttttttaaggcttaggagctctgggtcctgcacagtgagtgcgtgcggtcacggttgtgaggctgctcacccacaaaatgtgatttatttctcagcgctcttcatggacttactggatgttctgtttagaaagttagaaaacaaagataacttctttgaattgccctcaggagattagttttctagaatggagaaaaaaatataaaaattacttgtttttgttaagttggttcatagaatgccaacagagaatgctgtccctgcaaaccaccccccaccccatcaccagagacagggatactaaaatacttcttggcagcaagatgggctggcctttggtatgatcgtcaactgggcttccatgtcaatgggtttctgacagggccaccaaagaatgttctgttccccgggcatgaagtgactttctgattaatgttggccatgatttcccctacctcacagggttatcttgacagcagtttagaaaaatggcttaagtagaggacaatatttagtgggcaaaaactaatgttaagcctttatgtattgactcatgtactccttttcataactccatgaggacaggtccagttataattccctttttgtaggtgagcaaatgaagatatcagaggagatatgggttttgcacacattcagctagttacgtgctgagcctgaagtgcatgcccttaatctctatgctgttcgacctctctgctcaccaccctgtgtcatgtatccttagctgtttgaccacattgccgaatgcctggctaacttcatggataagctacaaatcaaagacaagaagctcccactgggttttaccttctcgttcccctgccaccagactaaactagacgaggtaagatgggctcctcagacacttgttgcttcactcttggggctgggagggctgagagggacttctgagccacctgctgtggtggtggtggtagcactggaggattgtggagatgaagttctgcctttctgggtgactgtgtatgtcgatgggggggctggtgaagaaatctggggggttgggagtgccctttatcaccctctctcccacacacattgcacagtatccttatcccctccacagaaacaggaatgagaaatcaggaactccccagtctaaagtgttatgataaagacccttggaagaaagatacttggagagttaatgatgtaaggacacaagtacagtcatgtattgcataacaatggggatatgttctgagaaatgctttattaggtgatttcacttatgtataaacatcatagagtgcacttacacaaacctagatggtatagactactacacacctaggctgtatgggacagcctgttaactcctaggccacaaatctgtatagcatgttactgtactgaatgctataggcaattgtaacacagtgatatctgtgtatctaactaggcaataggaacttttcagctctattataatcttgttaccaccgcagtatacacaatctgtcactgactgaaacattgttatgcggcacatgactgtgtcttatagtgccagttgtcctgagtttctttttcctaggctagccaggaagtaacacacaaattcaatcatgactttaccccagtggcagaggtctctgctaatgacggaggtttgaggggtgtggtgtgagtttcagttttagtgggaaatcaatattcacttcttggtccctttccagagtttcctggtctcatggaccaagggattcaagtccagtggagtggaaggcagagacgttgtggctctgatccggaaggccatccagaggagaggggtgagtggggtggcaggagcttggggtctgtgggcttttctgggtccaccctgaagactccctgagtgtccttgactcatcattgtttgcttacgtggagcttaaggagagttctcttttccctgacacatgtactcaataattttgtatgcgatctgctgctttgggggtttttagattatcaaatggataaataatcttagccttggcacaagaaaagctctttagttcttaacctgaagaagacttgaatgtgatttccaagtaagaaagttggaatgatgttgacatgggagtggaatggctcagagagagaatgaattaaaagtcttatcacaggaggagttatggggagggaggggggagagagagagaaggaggaggaggaggaggaggagtgatatatagctggtgttaggaaagtcgccctctgtgatgatgaaggtcagagccctcccatttgtctccacaggactttgatatcgacattgtggctgtggtgaatgacacagttgggaccatgatgacctgtggttatgatgaccacaactgtgagattggtctcattgtgggtgagtgaacaccgtgcatgaagggcccgtgctggccaagggatgggggtgtgggctggaaagggagaaggggcccatgggctgggtgttcctttgtagttcatattagaagataatggtccagtcactttggagagccgagcagggactcatggagttgggggtggcagaagattagaccatgtattgtgatgcccccagagtctgcagtgagaaatcccagccatcctggccgggcagtctcgggacagtagtataagagggaagaggggtgggaaggggccggagcaggcgtgtgcatagccgtcccttgttttggcaggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtgagtaggcccttcctgtgcgagtgggcttggcgggggcctggagctgagtctggggctggtcggggccagggggttgtttctttacagtcttacatccccaaagcttgccaaggtggccactggtcataggaatgtctgtgactataaattgctgagaggatctaaaacagagagcaagcggatataccagattatagctaataatgtgtttccttcacaggagtcattttggaaggttctattctgagtgtaagtgggtggccctgctctttctttccaccttctatttgtaaattgtccatgggaactgtgagccacctaaggaaagttgtgttgaggtggccaagattggggtctctgaaagctcctttcatagctccaactccatcaccacccagaggacaggctgacagctggctgctcattgctgctccctggggtcccagggcctcctgctgcagctgcaggcagacccatggcccctggagacattggctgaggagcttccttggcctccttcacttggaccttggcccaactatgtcctgggatggattggaggaggggcgtctagcattttggatcctgaatattgtattctccagcctggcctgcctttgtttttagttgcttttatctcttacaaaaccttatttcaccctcacaaacatttgccaaatgtgcgtgtgaaagatcttgaaacagggattgcttcaaggtctgaagcagttgcaaaatattttgagcaatacagatcatctctggtcttgtgactgttgtagaaaagcttttcgtgcagatctctacttggacaggaaaattgaaccctataaatcaagtcagtggtgggtaacccaggagagtccttgctttcgtttttttttttttttttttgagacagagtctctctctgttgcccaggctggtgtgcaatggcgcaatcttggctcaccgcaatctctgcctcccgggttcaagcgattctcctacctcagcttcctgagtagctgggattacaggcgcctgccaccacgcccagctaatttttgtatttttattagagacagggtttcaccatgctggccagactggtctcgaactcccgacctcaggcggtccgccctcctcggcctcccaaagtgctgggattacaggcgtgagccaccgcgcccggcctgagagtccttgctttgtcaaagcatggtttatttatctaagtcacaagcttgtttcacatgttgaaatgagtcctttacttgaaatttctgaggatcatactggttgtgtctgccatggctgatgagaggtttatgagctgaaaagtcactcagtgcctgcctccatgaatgaggcacacccaagtcattccgaggaactaaaggccctttcaaatgtcaaaagacaaatttgccagccagaccatgacagcacacccccggcttatcctttgacacccaccaaattgtcatccatggtagccctgaagtcactacagacaatttttgtcccctctaatatatttccaagtaagtatcttccaaatgttgactggaacaaagtgtttttaaaaactagaataaaaacttagcaacacggagttccttactgttgaagccaggctcccatccacgctggtttccttctcctgaagctctgcctgtgtgggtgcactaacatttaaaatgcgcgctgtcatcttcacaattttgccagctctcagttagccctgatgctgctgtactcggccttgggtcttgagcaggctgcttcctggaggcctgggtttcctctcggaaaggtaaccttggaatcccttccacatctcagtcctgggcctcctcctcgctggggctcatcctagttagtggcagcaggcccatgtgcctcctctaagacacaggttctttctcaaacacccagaaatgggccttttgtcaaaaagaattatcaccagggcttggtttcctctcagttctagtcagaaagaccaattatgaaagaaaacagtgccacctagtgttaaaattaaatcaccggaccgcactgctggtttgggggccgtcccctgcctttctaaaacatcttgtcacctgcctgcttagaagcctgtttcactcccagacccctgagacctgtcatttagagctcggagcccagtgcagattcctctatcccaacctgcctttataatgttgccccatcatcccctgccccaggtggttttcacaccattttctctggagcccatgaacggcttgcaggggtggacagtatgagctgatgagtttctaggcctgtgctacatatctaatcagatcgccttttttctcttgtaaataaatattgggctatgtaagatattaattttaaaaatgatttcctggctagagaagaattttaaagattaccaccctacgcataactttacctaaaatacaggctgttccagaatgttccatactccctgtgtgtttcatttggctgcttaagtttcatttattcttctccataggtcaaggcccatcagcctgcagggacaacccaagccagcccctctgagccgtcacctctccacgtatcttactcctgggccgtgctgcacacattaacccttagttgtgaagttgcacgtgtgcgcatcttgcttcaacagggaagctatgagtacatgggcagtggggactttatgtttttggtttgtgtcttccggcaggtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaagggtgagcttctggccagccccctctatttgctggatcaccacacgagttgacgggtagttggggaatgaggagggggctgtaccttttgactcttcaagtatagactgcaagagggtctcacatgacgtggaccatggcgggcctgtggcttcacttcacttaccagtctccactcttgtcgatttcgattgtgattgctaccagtgactcatggtactgggaacggtggttggcctccatatgcagggacttgggctgttgcactgggtttaaagctggaggaccccagagggcccccgaaagacttagctgcatctgcctccttttccttctcctgaagctctgacatctgattccctattggcaattctcaaaaaggactctgtcatgacccctgcttcataatagaaagctaggtctttgaattggccagagatatagctacccaattaattctaataagcagagctggggcctgcattttcacagcccagcaggggcaagagtgaggatggcttgatttttgttgttgttaacaatatcccaagagtcaggcgggcctcgtttactgttcttgagatttccacttgtagattgaagaagtcctggtgtttcagggaccagatggtggagaggaggtgtctttggagccaaatggagcagtggaacagtgccaatgactttgttttaaggggaaactcttgaaggaatggggcctacttgttgctataccccaaggtgatgcaagtaccccaaggtgatgcaagatttagttcccttgagaagggtgctaaggttatagcactagccccttaccaaccatctttagacacaagctaaagcagtgccaagtccatggtgaaatgcaatagactcctactgctttagagagagaaaccaggtgggcatcaccgcagggttcacatgttgagagtggctgacagcagagacactgtctgtctcccctaacacaagcagatgtaacacaaactctcacacacacaacttggtggtaaagcaccaagaacagggccttgtttttacatagcacatgcataagaaatacttgtgtttctcaactccgtgtgtctctgtgtgtgtgtgtgtgtgtgtgtgtgcgcacgcacatgcgtgtgcgtgtgtgtgtggtgtctgggagaggagcctcagggtggctgtgctatattttgcacccccttcctcctcctcctgcccctgcacaggtggactaagcaatgaagagggattctgtccccactgggtggtgaatttgctggaactaaagggcttccttgccaccccccgacacacacactggccacagtgggtcagacacaggcccacatgctatctttctgtttcccagggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccagtgagtcagtgtgcagggcctggagatgcggagttcctggagtacctggggctgagtgactcctcatgccagctccattttgcatttcaggggtggtgtggagggaccatagagctgagggtcttggtggaatgaaagttcccacctgggcaagggggaatgggaggaagtcatatctggtgtgggtggaggtgatttctgaaggctactgatgactcgggctctccgcagagctcctctggctgctggacactctctttgccaccctcttgtatgcgttattgttcctgtctttactcttagaattcttggtgattcctgcaggtgctatgtcctctgccagggaccaccccagcccagtgagggttaccagcttctctggctgaccttggtattaaattgatcctgccctgtccacattttgatccctcaggtcataggtaccagaatattcacatgtcagctgagacctggaagatgtctctttattgtgcctacttatttccccatcattttcacctaataagaatgccaggtcaatgtgcctttgttttcttaacttgtcggtgcaggaggcctcagccctgagattccctcttcctacccagtgttgcaaaaactcgagtgtgcacgtgaatcacatggggatcttgctaagaggcagattctgatcagaaggtctggggtgagtctgagatcccgcatctctaacagcccccagtaggctgcagcctactcctgcacttggagtaggaaggccctggagaccatggctccaagtggccactacccagagagttcctggctgaacacgttgtctttagctgtgcagacacctttgggatcattggcagaaactggcaaaagagaggctaaagtccagaagagcatctctagcttttaattttgggtctttcccagacagcagctagtgaaatgagtgatagaacaagacagataggtggcatcagaaccacctaataccacagggctgctccagcaaagaggctgatggtaccatgttgggcaagggagcagtggccagggggccttcttcagtgaggaagaggaggtcttgtgtggctgcatgtaggggacagtggcttattaaaaggtcttttcctttcattggcgggggtgaaccaatcctgggtggtcatagttgatatggttcttgtagtggttcctaacttgggacagtggagagaggatgtttagggcagcacccactcctgcaggtgccttttggcatttggattaaggcggtgggcaactgtctaactatttgcaccattgaccctaaccatggacacctgtctcttacccgccctggggaactgcagttttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacaggtacacggcagggttgccacctggctcacatggtgggcctttgtcctggtgttgataccctgggagggatcccttagcattagcattggacatttgaaccagaacacgtttcttcagccgtattactagggagttctagtctttgataaactcaaacaaggtgctcctctgcaaacagtagtaatggtcaacacttattgaatgcttactgtgtgtcaaagcactttatgtgtatgagctcatttaatctttgttaactgttaaaaaatattagcagttaattttatgtattcacctatgtttgacagaaaactgaggcgcagagaagttaagacacctgcctaaattcacacaactagaaaatgtcggagctgggattcaaacccaggaattcaggttctagaatctgctcttgcaatcaccacattggtctgagtcagggttggcaaactatggcccatgggctgaatctggcccaccacctgtttttgtacataaggttttattacacagccatgcccatgcgtctgcacgttgcttatggttgttttgcactgtcttggcaaagttgagtggtggcagcaaagactgcatgacccacagggcctaaaacgtttgctgtctgggcctttacagaaaaagatttctgacccctgctgtaagtcttgtaacctcagaaatggtggtcttattccaattcagagaagacagtcgatgagcaggccagtgtagcacagttgttacaggttccagagacagactgggatttggtccctgctctaccctgtcctggtcgtatggccccgggcaagtgatttaactatcagccagatcccaatcatccttaagagaggaatgcagtgtctccctcacagggctgcctaagggttgaacgaggactgtgtgtgaagcatgtggcacactgtaattgtccaacaagggagggttttctcagtttaaaagatttcccttcagcttccttcagggagctggactcttctgttccttctgtattctagaatgtaatataaagtggcatttgatggaacaggaatggtgtatttggatcgttttaagtgtactgtctccacattccccatgttctgccccaacttatcacttccctgggcttattttccagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgaggtgagcagggcggcgccttcaggagggggcccctggtggacgtcacctcttgccttcgaggacagtgctttctctgctcatctgtgaccctggggagggctagctggacccagggctgcagcctggtcttgactcaggtttgtgcctgagcctgcatttcttctgggtggaaagaaacattgatgttgtgcgcaggccctactgggggcagcctgccctgcccagggcccctccctcagtgtcctaacttctccctgcagctctttgaccacattgtccagtgcatcgcggacttcctcgagtacatgggcatgaagggcgtgtccctgcctctgggttttaccttctccttcccctgccagcagaacagcctggacgaggtaacagcaccttcctggagggctctcctgtgggctttattgactctaaacaaaaccagccaggtatggagcaggggagaaagttgagctaagactaaggaaaggagggcgtgagttaccagtagtggggaggggctccttgatgggaatgagtaagttgaggctggtggaggttaagtaggttagctcagctgtgacagcctttgggacaacgatgatgatgctactcaatgttaacaactgccgggtgtggtgactcatacctgtaatctcagcactttgggaggctgaggcaggaggattacttgaggccaggatttcaagactagcctaggcaacataggaagaccccatctctattgaacttatatatatatatatagcatttttaagcacttactgtgtgccaggtactatgttaggtttcttacctgcattatctcgtttaaccctcacagcaaccatataagagatatgtttgaatacccattctacagaaaggaagataagccccacagaggtgctgggtgtcttgctccaggtcataatagcttgggactggccaagccaagatttggattctgggttcctgatgcctgagcctgtgctgtcagttatgctgtggggctcctgaggcccttgttatgggctcagggcattttcatgccatatcctgttgtttggatgccctggctcttctctggtctcatcttgcttctcactcctcttcaggttaccttgggtgaatgaagtaggtgcatgaggatctggcactcccagatgttctggacatgagtgccccgagaagtggaggagaactgagtaggcagtgctggatctgctgatgactggtagccctaagcattaggtatctggagactgtttttaagcagttgtgtctctgtctcagtcatgtaggagtgcacgtgcacgctgccggtgtgtggtatgttgcacatgccactgctaggtataaaaggcatggctcctacctttagatgcttacaaacaagctgggctgatgaagcaagctcagaaaaggaagagctgctgtttggaatgtggccctcgtgggatggatactgaagcccccaggacaggtagtgagacagatgttaatccgagtgcatacctgggggatgtcaggaggacttggaacaagtcagaagaatgagttgatgggaaagaaaggtgagcaggctgcccattgtggagagggtcatgtaggtgggagcaagtgacagaaagagctgggccagcgcagaagagcctaccctagtgacaaggaaagagcagcatttcccacagggtccctgcaacagtggccctcaccttggcttcactgagttttgtagatgcctccttctcctccttatctgagagaattccccatgtgcactagtataattaaggttttaggaagttctgcaataaaaactcagcttagtctggcatttctcaacacctattaacattcatgtagtgttaaccagactagcgttgctttatgcctcatgtggacaaattcttatgtactatttaatggaccattacttattataacaaagatattagaaacaaacttgctgaatagtgagatagtagttaaataaattatgacccacttattagctagtatcagccactagttatttgtaataaattttaatcacatgaaaaattactggtgatatgactaaaaagttttaaaactacttttctttagaaatggtaatctctttataaaaaaacataaaatacaattaatgggatgataaaagcataaccctccagtgtatatccttcttctagacttcctaccaaaatattttcaagtagatactatcttaacttttcatgccaacaggttatatatttatttatatatttgccagggaaaccagaatgtgtgttaactgtttctgtctgaattgtgagattccaggccattggattaggttttattctgtgttccaggtttctctgaggagcacgtgttaggtctagagccgtaaaaattaagagcaaataaagcagaagtcatttcttcctgtgggctctggcaagaccctcctgtgatggggaaatcccaccagtgcagaggcccctggggttagagaccccagggctctgtggcccccagctgtgtttcccagctgttgggcctccacttgcctcatcagtaaggatcacctgaaattatgttatttgaacatcccgtaaacacaaacttgcgtcaaacatgtgaagctaacttgtagagagctgggtggagatcagcacacactggtcagccagctctctgagggtatgtgctttgtttttctgaatctcctggggtctgaacacagtgtgacacctccaggttgatgtgaatgaaatgccaagctgatgggcatgaatccctgagcaaggcctggagaaatcatgcaagtgggtgggttatgagcacacagctcatttatggaagccgagctcttgggtaaggagtctgaagccctgaggcttgtttcctggtgggctgtggcagcagagagggcatcagggaataaaacccaaagcatttctcccaggttcaaagccgtcaagcatctgctcccagaggaccacattgaaggcaaggggccactgaggatgctgaggaggagcctggagttgttttcctcactgaaagacatggggtggtggtgaagcctagctgtcacccagctgtgggcaaagcacttgttcgccagatgctggagtttgaaaattaggagacatacactgacccttctgatgtaaaggatagggacagagcaaactgctttgcccagtgagcgaaccaagcacataggaagaagttgcacagcagggtcagctgcgtggtgcttatgagcccattcactggggtcggagggcctcggagtgcatcctgcttctctcttccaagctgtaggccttgagcaagtcactccagagcctcagtttcttataaagtggccataaacatgatagatgttccacaagggtgctgtgagggttaaataatgtaatgcatgatctatgcttagcccagtacctgctacacagtaggtgctcaataaatccaagtaagtaccttaggaacagtttaatttgcgggtgagatgattggtgactctgggggatccgtctgacctgtgaggttgagagctagaagcacagctggacccccagaactgacctgggagctcttccctgatgtcctttccatgcttgtgtgtgatttttagagcatcctcctcaagtggacaaaaggcttcaaggcatctggctgcgagggcgaggacgtggtgaccctgctgaaggaagcgatccaccggcgagaggtaggagacacatggcacgaggtctgatgtgtcagctcctcaatgattggcctggtctgtgtgttcagaaagtgaaggcaacagtaagtgtggctgcatgggttgggaggaagattaactcaagcgtcgttcagcagtttagtgtgcactgtgtgtcaagcaatgctctcagcactggcggttcaggagtgaccacaacaaagctttgttctataaagtccatgacctagtggcaggtgctgttaagagctgtgaaacacacacacacacacacacacacacacacacacacacacagtaaaggaataaaagaatggccactccataagcaaaacagccatgagggctgctggttgcacatttttatggttatttcttgattatatgctaaacaaggggtgtattattcatgccttccctttttagaccatatagagtttaaaaaaaaaaaagaaagaaaaggagtgaagtggggtgaggagagcagatggagcaagtgtgctggaaaggggcactgttaaatagcacaacttgggagggtctcaccaaagaggtgacatttaagcacagacctgaatggaatgagagggtcagccatggtgtatgatatatattttatatacctgtaaatctcccatgcaattgtctgaaaggagaatattggggttcacctgtgaactgggcatctgcttcttccctctcaggagtttgacctggatgtggttgctgtggtgaacgacacagtcggaactatgatgacctgtggctttgaagaccctcactgtgaagttggcctcattgttggtaaggacccagactgtcctttccacatggggatgcacagccttgggtgtggaggggttggtgctgagtgaggccctggtatcctgtgattggcaggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggtaggcacccaactggggccctgttaagtgtatcccaggactggatggcaacaagtgatcagagcttccacaatggcatctcccaggacgccggttctcgtgagatgttaataaaggaggttttcttggaaagggtttcttgtcgaatgcacctggaaagttctgagttagtaaatgtaagaagcatctcccacccaaaagcctaggagaacaggtgggagaatactagaccctaggtctggcactctaaggagaaacaagtagaaagttgaagcacctgctgctgacaggctgaagagcatctcttgggtgatgcagacaggagcaaatcctctccctcctccatcttccagcgccgagcaccacctactgtcagaattgagcaaggggccagccccagtgtcacaaggtcctgtgcatggtaggggagcggggtctgagctaagagacaatagcttaagatctaacacacttctcattaagatgttgtctgtagtgtttcctaactagattaatcaaacaccctagtcctgcagaatacgctttgcaaaacatgtgtctagaatagaagttacagactaaaatgcctctaggggccaggcaggcaacattaatgaaggaagcaggctgggtcaagataagatggggtggtgatgggctattggttgaaactagggacctcgtttttttttcaaggcaggattcaggaccaaaagaccctcaagccactgcataataacgtttagttccagtggccaggatgggggccctacagctggcagtagttacttgagtaatgatggttaggtccaagagaatgtatactgaatgcctagtgaggttaaagattaagactcagcattctcccctgctccgagaagtccagtggggttatggtgtgttccttctcgagttgcttcttgaaatttcgaaataagccttggaaaggaaatgagttcctttccctgtgggttcctttccaaggcttatttccccaggagccccacgggcctcgggcactgtggtcagtgttgctgaaggttgtgaattagcatgcaaagacaccagggatcctgcccaagtgaatcaagtagcaattcctttcccatcaggggagtctgcctgtctgccactgctgatgcactgggggtgactaagctggcctgtcctgtctcaacacatccctccaccttcctacttaacctccatgaatgttacttgcattgcaggttcgagaaaatgatcagtggaatgtacctgggtgagattgtccgtaacattctcatcgatttcaccaagcgtggactactcttccgaggccgcatctcagagcggctcaagacaaggggcatctttgaaaccaagttcttgtctcagattgagaggtgagagcttagggctcagggtagcaggggggccatgtccttttttctcactggcagacaaactgaaggatttccataactcagggcatgactcatacaaaagtcagtttagtggcaaacacattcatgtctatagtgtttactaaaagcacattatgggcagttgtcattttaagggcaaacagagcattctcatgaaagtttgtgctaagcctggcctgaggtcatgcaaagtgatattgttgggttttagaccatgtatcaaaggtagaaagatacctgctcatagcatgtaaattgaaacgcacagaggaagataacctattaaagcatccacacttggcttgaaagcccttcctaactgctggctgcagtaatcaggcagccaggattgagtaaaggttggaacgtcaggcaatgcagacacatgccacacagtggctcattagagcaaagcctccctcctacagtcaaatggtggaaaatctccaaattagaacagtgaatttcagagccctttaaaaattaatgctgtgccattactctcagggcagagaagaacaggaactagacaactgatgtgagtagacccctcgggcatctgcaccagtgaatagaaagatatattctagcttataggtctgttatgttcagcgaggtgattccaggcttctaaaatagctttctttatataggagggtttattttctttctataactttatttacacttccttcgtaaatagcatataaatacagttcagaccacccagagcagcagagcagaaataaagcacgagtctaatgctgcttggttagttcctgccctgcaaacccatgaacagcagcgagaaaatggacatgaaagagctttgtaactgaccactgtgataaacagtgaatttgctttgttttgagtatctactttgtagtagtaatggtctatctggagtagggagagtagaatgaggagctgtttgtattcctgtcaccgtcaggaagagtcaatgcagtgcagtaggttgagcagtggtctgaatttaggaatgggaaccacctcgaggggccagctcctggagagctagacccccacagagcctcccctgtaaggactcaggccctggtgtggtaggctaccagccttcttggtgcatgactgaacacttgctgtctccctcccaccccagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcagtgagtgcctgatcccagccccccctgcctaccttctttctgtctttgttctttcccttttctttctctctttcctttgttactttatagtgaattatcagccattccaaatagtgtatataatacatggattatagtttaaagattcataatcagaagtaggcctgtgtttcaccccccaccgtgggaagccccctccgagcccctccacaactgtgtcatcattctcccatgccaggggtaagtgttgtgctgaatcagtcccttgcttttcttttccacccccatatatgtaggtatgcatccatattgtttagttttacttatttttgaacttgccacaaatagaatcacatggtatctcttctgtggctggcttttctcacacagtgtttgttttgagacgcatccgcattgaagtatacagttggtagttcattaattttcagagctgtatagcgtacctttgagtatgttgttttttctatcgttgaggtgatatttaggttacttctagattttgaccattacaaacagtgctactgtgaacattctggcaaatgtaatgctagaactctggagcaagattttttttcaacattctagagcaggggttgacaggcaacagccacaggctgttattgtacatatagtttcatgaggattgggagggggcagaagcccagccaccaaccctgggacatggcatcctcagctttgtagatggggagggtgtcctgaccctgctgtattggggcagatcacaactctctctttctctggtccatataggaaggatctgtgatcactgtgatatcctagcagtgactctgtaagtctgcttcttttgcctccgatgacattttggagcacatgtggctctgatatgaggctatgcgccaggaaaatagaaaatcacattcatgagtcctggtcctggtctccccctccagagttgtgctcctctgttaggcacacttgtggcttccatggttgttgaacttctcttttactgactattagttttaagaacacagtttgccaggatctcagacgtttgtcccagaattgaatcctagctctcctaatggctgatatgatgtggaaattgggcatagtactagtgtctccaagccacggttttctggtacttaataatatatagtaaatgtttaatacattatagctgtcatccttctcctcttcttaattatttctgtgtttccagcatcgcttcttagctttcatttctaagtgcaaatacaaaccaatcatgactaagatggtttttcctgtgtcttcctcccaccttttccagctttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgagtagatctgcttcttcatcttgacatgtaatgaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataa

SEQ ID NO: 204 - DNA, 77948 bp, Homo sapiens
ttctgttctgaataactttattgcaagtcacataatcttggtttagacttgacgcaacgggaggttacagagctgtaaataacaactggtcattaccttattgagtttagaaaactttcaagttcgtgacatatgttaattgcacttaaatagacagtgagagaaagatttataaaggcatcattcaaaaggatttttacatttgggtgtgccttactcgattacaaaaatttcaaaccatcttcccacctagggcctagggcgagttttctctttccctgggactgaactatcacaaagcactaaagggtttaagcaaacgtgagtatcactgaaaagcactagaagaaagtctcaatgtggctggaagaaaccagaaggcaagattgcctgggtgagaaagaaaacataaaaatctgtgtgtgagatcacaagcagcaacttctctgtgttgaattcagatgtctttcccacagtcggggcacaggatgtcgtccctctctgtgaggaagccacgccccaccagtgagagggagcacttcttacagttaaagcagtcgttatgccactgccgttcctcaaaggagatgtattttgtgccaccaagtcctgttaacagagagaaaataataccggatgaagaaagttagaatcaggcaactgggactgaagaaggaattctggtttgatccatttcaaagtttggattgtgtaatatggataatgtgaatttctagtgactgggtgttgggaatccatatgtaaatcagattctatgcacagcctggaggatctcgtgaatatcagaagagatatataaactggttccaaaacgatgggataagtgcgatcaaagaatgctgactgtgtatttgttatgtgttttcccacaaaatgaaactccatgagaagagggagcagatttctcttatgtcttcactaggtgcctcacgttgcctggtgctcaaatttttatgacttaatgattgaagcagtgaagggagtgtagaagaggaaaaggttaatcctccctgggatggccaggaaaggcctcacagataaagtgcgatgtgggtgggaatgaggggagagggatattgtcgcagtgggaagatcctgagaaagctgcagacagatagaatggaatcaaatatttaaggtacattggtccgtgattataatacagttggtttttacctagtgttttttctcagtgccacaataaccacaattcacattcatatctaatgttttacatttaaaagtgcttttatatagattgtatcactttataaagcttaatgttataaacatttacctcaacagaagttactgctgaaaacagcattaaagatgaatatgttctggcaaaagattacattttccccctaaaagattccaagggaaatctggtatataaatgaccagaaacagatattttaacataggtaaagtgtaaatactgtgcttttcttcatattttaatttcacatggaaatgtaatgagctctgcattacacatgagagtactgttttagcgacctgggaaggtgagttagctgagttaggtgaacttggttctaggcctaagggaaaggaaagtcaaggacaagtacacagggggtgtatagatgtgtttctgtagttacactgaaaagccacacaggaaagccaggccaccgggtactccaagtgtctgccaccttcctctgataggaacgaaccagtcaactgaatgcaacgggattgcaaatcccacatcataaaacttctcctgtgttattacagaacacacacttttctctccccacccagtcactcatttgtgtagcgatatgtggtgaccatttaaaggactttagtgtgaactcctctgttctccacactgaatttctccagcctgcttaatagtctagtccagaagcctggtctgccagccagccagattttgggctctcacttagctgaattctttgggggaatacaatatgaaaaactccttagaatgtaccctctgccctcatatagctatggccttgtggtagaagtttcccattaagatgttttggagtacaaccgtcccactaagatgctaggggacacttctaagaacacagcacagctgctaagcctgaaaaggccagtttttattgtgcttttgtgatgtcacaggctcacagactgcagttttagcgataatccaacccaaagcagaaactaaactggagcactggccatatggttgtgatcaggtgggctgcagaggaaggaatcattacttgctgaagcatagccagtgcaccaaggagaggaaagcagataggcagaaaagtctgctgtgttcagagccttagggaggtctggggagttgagggatatagacagggtcacaggctaaaatgctaggccttgttcaagcttccaatcgcccctggaaatgggaaccccgggacactcaccgctgatggggttggtgcacccagcacacttcttggcatacaagtcacagaagcagttcaggcagtaggcaaagtcatcgcgagctgtgaagcgctgcccagacagctgcttcctgcaggcggtgcacacgaagcactccttgtgccagggctgctcccggtaagtgacccctcccgtggtgatgggctgcagggacgagggggagagttagtgtggcctctgtgcttggcagacatcttcagtctcagctactgccactggacgatgcaagatcctcatccagaaacgtccagtttgttaagtcaccaagaagctgctttacaaacttcacagtcactcgtcaccctcaccacacgctttcattccagtgtcataggccctggctttcccgttagtgaaactggagcttggggttgccctcagcccttcccagggatgctggggatctaaggcatagggtgcctcagtggtgttgccacctttctgagcagggaagcagcacagtggaggggtcgggattcaatacagcatcaaggagacctgggtttgaatcctaaccctactccttaccagccctgtggctgggagcaggtcatgataaagatctctgcacttcagttttctcatccaggaagtgagggtgatgaggttaattgggcaagttgatgaggagtccttacttagaagcctggcagggctggtggctcacacctgtaatctcaggactttgggaggccgaggcaggtggatcacttgaggtcaggagttcgagaccagcctggccaacatggcgaaaccccatctctactaaaaatacaaaaaattagctgagtgtggtggtgcacctgtattcccagctactcaggaggctaaggcaggagaatcgcttgaaccctggaaacagaggttgcagtgagccaagatcatgccactgcacaccagcctggacaacagagtgagactgtctcaaaaacaaaacaaaacaaaacaaaacaaaaaccctggcaagtggtaacctctccaatgccactcacgagcctgtctctccagccacttacggtgaaagaaggaagaggcttaaaggacagccgggactagcacctgctgatgccacaagaagagatgggcatcttggaagttttgggaaaaataagctggatgccttcattctcacctgtcttgtggtcttagaacatctgtgaggtgaagctgcaaagccacatgaggtggaactggccatcagtacctcaattttacctgatatttttctccaaatgttgcatctcacattctatttaaaaatgagtgcttggtggagctgagtaagctatcagagaggagtgtaggtggcctcagcttggcaaacgaaggctgtggaagatggagtgcaagcacctcacaatcacacttttttgctttttattttttgaacatttcagtatcatgcagtaactcctttggtctttacataaagcttgtgaagtaggaaagatattatcttaattttatggatgagtaaactgagactcagagaaattaaaaagtgacttgccaaagaattcatagctggttaatgacgaagcaggaactagaattctggactcccttctatcttgtattcttttcattaaaccataaatcatgaagcatcttagtataacccaccccactgcacaagagaatgaacaccaaacacgcttggttgcaacgtatccatgtgaatgcagtagcctgtgtgtgtaagacatctctgcctgcaacatgtgtcctcagtcctcccttgctccggattccatgcttcccacccacatcagctaactcaatgcctctgagcatagcatgactttctcagagactccttccctcaacaccaccctggcccccaactcctcagattagttgaggtccctccattccacactctgctcttctcctccatagcacactgctcagtaactactgacgggtttgacactggagtgtacttccacctagactacagttaagtgtctgcatcttgtccagcatcagatccccagtgcctgagagggccaagttcatgtcgaggaatggatgcttctggcatgaatgtttttgtgtatttaatgaacatgcacacaaaaagcatgcatcccagaaggatgtgttgctttcatttctgcaaatgaataaagcacacattggaaagatgacagaggaagagcaactcagatgaacttccgttaggtcttgatgagaagaacaaaccaaaataaaaataaaaaggggagagaacagggaagagggttcctaaaataaaagcaggaatgagagctcaatctaagaataaagaaaaaaacaggagtttgtgaccagtctggccaacaaagtgagacaccgtctctactacaaaaaaaaaaaaaaaaaattaggtgggtttggtggtggcacctgcctgtaatcccagctgctcaggaggctgaggcaggagaatcacttgaacccagaaagcagaggttgcagtgagttgagatcatgccactgtactacagcccaggtggcagagtgaaactgtctcaaaaaaagaaaaaaacagaagcataaaaggagaggaaataaagagaaataaaatttaaaataacagtaaagaacaaatggggccaggcatggtggctcacgcctgtaatcccagcactttgggaggtggaggcaggtcgatcacctgaggtcaggagttccgagatcagcctggccaacatgttgaaaccccgtctgtactaaaaatacaaaaaaaaccggctgggcatggtgacgcacgcctgtaatctcagctacttgggaggctgaggcaggagaaattgctcgaacccaagaggcggaggttgcagtgagccaagatcgagccactgcactccagcctgggcgacagtgtgagattctgtctcaaaaaaagaaaaaaaaaaaggaaatgagagaaagactgaatggaaattggtaagaatactcagcacttagaaaaggtgtgggcaaggtggggatattcttgcccaggccagccaggtacaggtagcagcattggggatgtttctccatggcccagacgcaagggtagaggccccaagggcaaaacagcagaagctgggtgagcagagtcaataacaggaggagagcgaacagaacctgtgatgagttccacagctggcgctgcccagggcgagtgagcagtgggagggtgccactcaacaggctgatgcaaatcctaacaggacagagacgctggaagctatagcataataagaattgcgtgtgtctaagagtcagagggcacagcagaaaactaagctacaccctgaagggtgcaggtcggggggcaactgggcagagagatggcttcctacagatatgcagttccctttctttctttaaccctaacagagccatgactggaatagcacattatcgagtagataagtttatttatttatttttttaattttttgagatggagtctcgctcagtcgcccaggctggagtgcagtggtgggatcttggctcactgcaacctccacctcccgggttcaagtgattctcctgcctcagtctcctgagtagctgggactacaggcgtgtgccaccacacccagctaagttgtgtatttttagtagagatggagtttcatcatgttgcccaggctggtcttgaactcctgacctaaggtaatccaccagccttggcctcccacaggtgatccaccagccttggcctcccacagtgctgggattacaggcatgagcctccatgcccggccagagtagatacatttaataaatgatctgtcccatatccatggaggcagacttttctcctttacttttcttctcacatccgtctctctctcctcccttcctctcctccctcttccttccatctttctctccctctcaagtttgcagttgttttcttgttttattcatggagagaagctgaacaagacagctttgggatggtggctccccttccctctaacctcaggttatcaacataagaacatatttagaaatggtctagaagaaggcagggttaaacgatttgatcacagagctcaacaatgttgatgtctttgaaagaaggatggacacccagacccgatggataaatgctcagaatgtaaggcaggacaggcacagctcccacgccacttaagtatcacaggtatccttggttttggaaagagaactgacagacatggaccatggaggcaaaccagccagaacgtgcaagggccaagggggcatctgagatacctttttgcactgaacgcactgcatggcatgttgtttctcatagcagggcacacagaaattctgattgtctttggggatgaaactcttggttccaattggctgctggcagcggtggcagatgaagcaggtctcatgccagctgctgcccttgtactccatcttgcgggtacctgtcatcagggtcaagaggaacacagcagagttatggttagaggggtgtggagtcccagcaatctgccttcagagcttgctgccctctagttttatgaccagagcaagccacttcagctcttgaaggctcgcctctacatggaggtaattcctattttgtgcagggcgtggactttgtcttttggttcactactgtacacccagctcctagaacaacacgtgtacattttaggcacttaacatttatttattgaataccgtggttaggaatgttaaatctaaaaaaagttaagtctctctcagcaatgcaaagtataaagagaagtgtggcatagctccgatgaattcccatggagcatgacttttggagtctagggactgtattcacctattgcacacctgataatgaacaccccgtctggttcacagcaggatggaaatggctagagtgtgaatgaacctggaacctcgaacctgattcagtgagcagcctctacaacactcactttacatactgcctgttgaaccaagttgtgatgtatctaggtagttttatgcactgtactaagtgctataattaaaacctacatgtagtttttttttgttttcgagacagggtctcactctgtcacccaggctggagtgcagtggtgcgatcctggctcactgcagccttgaacatctgggctccagggaaactcctgcctcaacctgagtagctggaactacaggtgcacaccaccatgcctggctgaaatcttcatgtgttacttgtacatcccatttagtaattgcctaaacctacgccatccattgtcttttgaataactattagcatttgatacatttctaccatttctccaagtgaactgaggagctctagagaactgaaacacttatgggtcacccctgccaccaccaagctggactcactgcaagtgctcggtgtctgttgactgacattttttcatttttgtttgccagaaagaagtgtatctatttatagtaacggatgattccagataggcgtataaacaagtacccttcatataaagcaaaggtaaagaacaatctggggaaataagtatcagggacaaagaaagaggaaagtgttgtaagtgcccggactagctgaggggcctggccactgtgtaagaccaaatccagactgctgcctgcttttcaaatgaagttttattggaacacagccacgcccattaatttacttccattgtttacatccgcttttaagctagacggccgagtagtgtgcagctgtgtgcagttgtgcagttgttgtgtagttgtaatagttgagtagttgtgacagagactgtatggtccacaaagccccaaatatttatctgatttttgaaggaaaaatgttgccaatccctggggactgtggcatgagggtcacatacatgtgacttcaactgggggtcagggaatgatggggaatcaagccgacagagggactgccccgctccagaccaggtggaagcagctgcagtaacacaggtggcttataggagtctatagactagtccatagctctcagccccaaaatcttatggtcccaaggacaaagctaggggttgtattttagctggctagaaagttggtcatgaaatgtctgtcctccagtaattaggaatgtgctgagaattatcacgattgttatttaggatcattttctcagcttcctgtacttccaagaccagacatttgagattatataaaataagcagggtgtgtgttggggggcaatgtgtgagagggaatttgggatggtgacacgcagcgatcttttaattcaaaactaagctgtacaatctatggaattcaattgtggggtgatgaatcctaaaacaaacattacatgaagcaattgaaattcaagtaaaaatagtggaaggactttgaattcacaaagattttcttcaacctccatgcatacttttgtcacttgctctttggatctctgacattcattctgatcaagcagcccagaagccaaaggattttgccaatgaatatggggcaattatgactctcatggcattcttgtcgagttctgaaataagtctgatcagatcaacaccagttcgagggcaactctacgtgcagggaatgcacagggcacctggagcctcagggacatggcgcgtgcacctcaggcatggcgacagcagtggccgcaagcctgcatggtcatatgcagcaataccggcaggtggcaggagcgttccttctcctaactgaatcgcacactctgaaccaagtctcccgcaggcggaagcgcagtcttgaagaagggatgtcttaatctgattcaaatagtcaaatgaggctggctgcggtgcctcagccttgtaatcccagcactttgggaggctaaggcgggagatctcttgagcccaggagttggcgaccagcctgggcaacatagagagtccctgtctctacccccccaaaaaaaaaattaggcgggtgtggtggtgtgtgcctgaggtcctagacacgtaggaggctgaggtgggaggatcatttgagcccgagaggtcaaggctgcagtgagcagtgatcgtaccactactctcccgcctgagcgaaagagcgagatcctggctcaaaaaaaaaaaaagtcaaatgaggagccagaaatttggttgcagggttggagacagaatcgctacttgagtctgctcagaggctgtggtgcatctgtaagcaacgtctgctaataggggcgcgagagccggtaaaccccagcactggggttactgatggtattccagtttcctgattggtcatcaggaaactgacttgtgtggggggtgtggagctggtgggtgagtttttcacttgtcctctaaatgtaaattcaccgcaaaagctgtgcactgacgctgtaaacccatattcatcttgaatgggttctaacacttttaaaaatcaaacccaggcaagcaagtgctttgattcagtgttttgtcggtgctggtttgttttgcatacaccgggattcttctagacgccctgcctttggtgcccagtccgtttcttctggcagaggcacctgtaaaatggggatgaagccatccaacccagggaacaccgaagattcaatgggattctgtaaagcagcagggtctgacgcctgtgtgtgtgctcaggggctggaagctgtagctgtgttgttattattactacacagcatttcttaccacagagcctgaattcttgcttcccccattccttagtagaagaggctgccggccagttaattctcagatattcagtatgggttacctctcactgaacattaggtttttacttcttatctgatcatgtttttcttttctttccctccccagtaaacaccatgagaaagggaaggtgtgatggttaattttatgtgtcagcgtggctgggctctggtacccagttgtttggtcaaaaaacaggtttacttgttgccgtgaaggtgttttttagatgtgactaacatctaagtcagcaagcttcgagtgcagcacgttacccacgtatcagggccgggcttcatctaatcggtagtgggccttaggggcaaagactaaggtttccctaagggcaactaattcttctcaagactgcaatagacacaccctgcctgagtttccagcctgccgccctacggaattcaaatgctcccatttggaactgcagtatcatctcttccctgagcctccagcctgctgccctgttctatagattccagacttaccgcctccacaatctcatgagccaatcccttgaaatctctctctctctctctctctctctctctccttatgtatgtatctatgtgtatacatttccttgattgattctgtttctctggagaacgtgactaacacagaaagtcaagacaggtgaaaaattcaaaatccgggaaatatgcatactttttatgtcatggttggtgctaacagttaaagtctttaaacagcccctagagtccccagtggaagcttccttgggcccttgttcaggaaactagtaagggtttaatttgtttttcaattaatgtcgtggttcttattgttactgagtgttgtgtctctgcagtgactccctgtggggcaggacacaggtcagcctggctttctacgggcttcaattctcatttgcactgtcgcacagcactggggcccgagtttccagcctctgcaggatccacatgatcttagaagaggccttcttgcctggagctgccccatctaaagtcaccatgcagcccttccagctgttttcccttacagctgccaacagggctgggactgtgtcagcctgggcatttttcttccctgtcatagtgtgtcacagttgttttaaagttatattaaccagagaaatgtagtggcagtaagaaaccatcttaccaaaggtcagattacctccttgcctttttaaaaaatgattattccttatcctacataactttcttttttttttgagacggagtctcactctgtcacccaggctggagtgcagtggcgtgatctcagctcactgcaagctccatctcctgggttcaggccattctcctgcctcagcctcccgagtagctgggactacagacgcccgccactatgcccggctaattttttgtatttttagtagagacagcgttttaccatgttagcctggctggtctcaaactcctgacctcgtgatccgccctccttagccttgcaaagtgctgggattacaggggtgagccaccacacctggcatcctacatatatttctaaactatttcccatatgtcagtctcttcagtatttctttattatcaaaaacaaagcaaaccaacatgatgaaaccccatctctactaaaaatacaaaaattagccaggtgtggtggtgcacgcctgtagtctcagctacttaggaggctaaggcagaagaatctcttgaacctgggaggcagaggttgcagtgagtcaagattgcaccactgaaccacattggccaggccgatttcaaactcctgacctcaagtgatccacccacctcagcctcccaaagtactggaattacaggtataagccaccgcacccagcttctttctgtattttgaaattccacatatttttgtccactttgctttttaaaataaaagattctgctctcctacataaaaaacaaaacaaaacaaataactccccccacatacacacacaaaaaaaccatgagggacacagtcccatcaacacacaaggcacctttattgccatcctcggcacctggcccagttgcggctgtgccctttttgactgtccgtctagaacaccaactctacaagggcagaggaccaggtgcacctcggctcacaccctacgaatgctcagctcgagcccagtgcctggcacgcaagggcaccatgcacacttggtgaaataactgaatgagtacaaattcagcaggtagaagggaagaaaagagaaactatctatggtggtgggagagtgggggctgatgcaggagatgtatttttaagggggatacccaccattttcttactctaacaatttgactgcataacactgccccacgtgcacagcaaaaagatcccgttactgcccatgatagaacctgtatgtccctgcttcgtaagtactctaaatactcctctgcagttcaaggtcaaactggaaagtcaacacgagtgtctggaaccaagtcaatgtgaacagggggtcagaggaacgtgcacaaggcttgaagctagactggctcacgcatgagaaaggagtgcctcctgacctggcatgatggtcttcttgcattcctggcacttggatgagtactcgttggaatagcagtctgtacagagcagctggtcctccttggcagcaaagggcttgtccaccagtgagtttctgcactgcgagcagtggaaacaggcttcatgccagtgccggtccttgtaagacaagtcctgtggggccagaccacacaagacagtcagaggcaggacaggagggcttggacccacagcataggggccccttgcgaatctgcagggcaaacaaggaaagaagttgggccgaggcaccctggcgcacccacattcatgccccaggaccacctaactgctgaaatcaattaagactaggctgcttttctcttgctgcattttagagcaacaggttagacagatgtgcatgtatgcacatgtctgtgtgtgagagatgcttctaaaaaacaaagggatttcccttatgtattgcctgcaagaaagagaaacagaaaacatgaacacctatcaattcgtctcacaccacatccggtgacagagaaacagactgcaggacatccttggctgagggagccctgcccaactcagatcactgtggtcaccggcatggcagagaggctctgggtgtcgggatgttcacaggaggcccaaggactgtttggtgggagacggtcaggagagactgtgtgtgtgggtgctacctctgtgggtggccgtgagctgggggaggaagggaatttcaggcagagaaagagcacagacacagaagatctggggacggggggcatgtcagattggagggaccacaggccaggggcgaggtgggagggccccccggcctggctggactggaagatatggctgcctttttgccttttatgtctgtgtagagattccattgatcctgaaggcagtggacagctgcttttcaacaggagagtgaagtgctcagactgggggacgggtaaggatgtgggagtggaggggcgtgagggtgggagaagtgagacaaaaactgagcacacatgagagaggccctgagaagacagacgtgtgcttttgagtaaaagatgagggagagaaaggagccccgcagaaaactcgactccacacttggcttcatcttgcctgaggaataagagaaccctccatatttgccttttaaaaatgacatacggcatttttaaagtgccaacacaaaattaaaataacaatctctttatgcccagctttatcttagaaaggatatgtttctattgctgtctttgtgttcccagctctgaccccaaatcatcatccatttatacatgaggcagaaacagagtattaggctctgcacggtttcctgggcaggcttccagttggtaggtatcctgaacagggcacaggagggctgttcacgcgatggccctgaagaagagcctgcccacgatgtctctgttactgaaaccgaagtcgaagctggagttatgctgaatgtaggatgtgaagacatggatcttggccttgattagaaagtcctaaaacaccagctaactcggaaccaaaactagaacaaacagttctcttttgctgaagtatgtgtgtgtgtgtgtgtgtgtgtgtgcgcgtgcgtgtgcacatgtgtgcatgtatgtgtgttttcccggaacctggaaccaaactagttatttgatttagtgatctctttgcgcattttgttttagttcaaggaattttaaaaatgtgaacgctgagacactttgaagacagtcatgactatggcctttgtgaggggtgacctcttgtgctatccctgttggaagtttgcttcctagaacatctgggaataggattattgctgacgcaagacgataaagaatgaaggagaggtcaggagttcaagacaagcctggccaacatggcgaaaccctatctccactaaaaatacaaacattagccgggcgtggtggtgcatgcctttagtcccagctacttgggaagctgaggcaggagaatcgcttgaacctgggaggtggaggttgcacagccttggtgacagaaggagactcagtctcaaaacaaaaggaatgaaggtgagaggagcatagagtgctctcaaagctggactaaatgcccttgtttctgcggaattcattctcacctgagcccagcacctctgggtattgtgggtcccctggggtaggcactgcctgtcagggggactcgggggcaggttgctgaaatgcccaagccctcttcatccttgagaacccaaactgggtatgcactgggagttgggggcagagggctaacctgtcttttgtatttttagcttaaagtattttcagaaatctgaggggaacatcacctgtgctttattggttattttgacaagtgaaatagaggacaaactgctttgatttgagttgatgtctacacatgtgaactcatgagaaacagcaaagcccacaatccacatggacatcatcatcgttcgggaacaggcatggtctccattctttccatgcacacgccccggcttcaaaaagacatctgaaacactagtgatgaccatcattaccccatctgtgagctccaggcacggcacagccctgcaaggtaaatgttattactgaaggtcagagaagttccgtaacttgcccagtcacatacctggcacggagctaagccaagcttcgagctcaagtcctcctgatgcgaaagttatttccactgaaccagcccaggcaaaatcctggtcgggtctgtgttactctttgctttcaaaacagatagccttgaggagatgtgtgtgtgtgttcatttaaaaaaatccagaaacgaccaaactctggcaactttctagaacatattttgtacctaaatgaatgtggctcagtattgcctttgtttagactttgaataaaattgaacaaatcattagaagccctatccacccaaaacagtaatctgcctaatttaagaagagatggagattttattcatgttatcactgttagaatgctgattgtggaagaaatgcattaagaataaattttgtgtggaaaacaccatggctgatattaaaagtagaattaccatatgattcagcaattgtacttttggatatatacccaaaagaattaaaagtaaggtctcgaagatatatttgtacatccacgttcattgaagaattattcaccatagccaaaaggtgggagcaagccagatgtctatcaataggtgaaggggtaaacaaaatgtggtctgtgcatacaatggaattttattcagccttagaaaggaaaggaattctgactcatgctacagcatggatgaatcttgaggacatgacgttaagtgaaacgacaaatcggtcacaaaaggacaaatactgcatgatctcacacatgtgagatacttagggaagtcacattcatggagacagaaagtagaagagtggttgccaggggctgggatgagaggggaatgggagtgagaatgtgttctgtaacccattcatgcctgaggttgcaattttttgaatttctgcaatcagaccttggcgatgatcttgagcagtaagatatacataactcccacatgcttagcattccactaatggaatactaggcgtaaatgggcttgatgggggtagtatttcagatttgcaagaagcaaaagctctggggattggttgcacagccatctgaatgcacttactactgaacagtactcttaacagtggttaagaaggtaagtgtgatgttctgtgtattttaccataattaaaagaataaaaaagtaagttttggccaggcgaggtggctcacgcctgtaatcccagcactttgggaggccgaggcaggcggatcacctgaggtcatgagttcgagaccagcctggccaacatggttaaaccccatctctactaaaaatacaaaaattagccaggcgtggtggtgcatgcctgtaatcccagctactcaggaggctgaggcaggagaatcttgaacccgggaggtggagggtggaggttgcagtgagccaagatcgcaccattgcactccagcctgggcaacaagagtgaaactgtctccaaaagaaaaaaaagtaagttttgattgttatgtagcaggtaaaaaacaccgtttcagaagttacctctgtccccctgtgcaggcgagccacctcatagaggactgctcgtttggggaaaagctgcagaatgttttccatgacccaagagtcactgtctggctgggacaagagacctgaaggagtaggcgccagggagaggggaggagatccttggcctctctctgggaagatagttgctttttacatggtggctgccctgcccagggaggaggcattacgcccagaggggtggcaagttatcagtgacaagagagggaagagaaatacaatttctagaaaatttgccttttgggactgaccttcaagaaaaactgagagagaaatctccaaggtcaacaggaaagcaaagccactagatgtcaccacagccagtgctccggtcattaagtccccagatggaggaaagagcacatcagcatgcctgcacagacatggaaaagctggctaagacatgcacatgggtccaaggcactgcagaattccatttttcctacagttaatatttatggcacaaaaatgcaatagctacagtttaagactgattcattgacacgtgacacttgaaactgtccctctaaatgtggatattatccacatgttactggactaagcatccatgcaagacttggagaccttctgcaggcgcagcctgtccccccacaccctgctctatcggatcccacctcgcaaggtgaaggccgcattctctcaggacaacctggtctgctatatcccctgggaaccatttcgccttggctcctgccagatgctgccctttcccttcaggctggtgtagagtggacacctgaaagtgctccccatcccattcgggttggggcatgcagagatccaggttttgtcctaagaaacaaaagacagagtgccttccacaaagtgcctttgcctgcccagggctgcgttatctcggcatcattccctggggccatctgcactcagctccgcaacgtttctctcagcctacctttatgactgcacacacaagcattcctgagtgaatatgcgtgcagcagttcctaattctaaaaccttctaaaggaaactcttttccctgaagataaatattaacctatgctcacgttcttaagttttgtggtgtacaataactaaaaatactctgtaaacaagcttgcatcattgttgttggtgggtcctcagtgggaacagaactggcccacctccctgctgcagtacagggtggtgggcttcctgggccagaaatgcctgaatgcctgctgcatgcaagcaggatgggagagcatgaggtcccacagtccacatctcttgtatcactgtgggtcaagcgcccgcccctctgggatcccaggagcacgtgattaaattgcttggttatttcaccctaggggttcaattcaagggcccaaatgccagattgactaaacttaaatcctggctctgccctatgccacgtacatcaccattgggaagtaattgaacctctcttgccagatttctgacctgtacagcaggaataatggacccactactggctgtaacaagcatgtataacagttgctggtatgtattacaattgctcaatggatgttagtataagtcattatttagaccacagctaataatgagaagagttgcctcaatgtgtcacttgctgaacctacatttccttatgaagacagtcctatcaatgagaatatctgccaccttaaagctccacgttggtaactctaccactctacttttgtaggtgctttttcattttaaatctaaaattctttttcttaattcttcatacctattttgagccatacgataactctatgaaataaagttttattcttatagatgagcagattcaatgtaacgacaccaaaaagtgttttctccaacattcccactgcccttccacctgaaatgatccgacaaaactaaactgtgctcctgttttttacctggcacgtcagcccctttgcagattgaccccaactcgctttccaacctgaccctctgctctggtcccctcttcctcatctccatgcctttgaccatactctgtccctggcctttgaatgccctttcccttctccccaaaaggccaaatcccacttggctgcaagtcccagctgaaatctcatctgttctgcaaagcttccttggccagggcaatgctggcttcagggaagccatgtgccacgccggcgacctagtttgtatgtctccttccaaatcctatttggaaactcgtaggtaactaattatgccacggggtttccctgtcactctctgaatggggcgcccagtttgtgttgtctttagaagtctgagtcaagttaataaattcatgtcactgcttcctcctggactcgcttcttaagaaagttcacaataaggaggaagtgaggaaagactttatgataagaggaaggtaactcaatactgccaggtttgattgttttagagatcttggccaacatggtattctctgagtctcagcaggagggaagattttagccacacgattccctagagcttagaggtagactagaaaatgccaccaaaaggcctagaagcgagattgtcattgattagacccgggtgcctgagcctgtgcttcctatcacactctgaatctttacctgtgaagacctagtgccaagtgacccttttcttttcttctatctatctgttctgtctgtctatctatcatctatctgtttagagacaggggtcttgctatattgcccaggctggtctcaaactcttggccttaagtgatcctcctgcctcagcctcccaaagtgctggaattacaggcatgagccaccacgcccggctcaagtgactctttccaaacagaaaagctccaaaccgatttttagtttcagttattagcaccatgccggtagcttaattttgctatttcattagtactccattgtgaacagcaaacatgagtgtaacagagatagcacttcgatgctgagaggaacagggtaagaaatatggacaccttgacagacttgctcaagaactttaagatggaaatatccggttttaaattcctctagagagaaattgaaaacaaaaagaaagaaaaaaaaagtcttttatacttcccagaaaaaaataccaaggctaatcttgtgctcacagaaatgtcatacattgcagtaaaatgttgataaacatgtacgattaggcccacacacttcctttctggttttgtatttttccattgcagaaacattcctaacatgggctgtgcctgttgcttggctccgaatgtgtcctttttgagactttagctgagctttagtggcaagtggcctggagggagccctggacccctcagttaatggaaggtggctctgggtggcagggtcacccagactgaaacgtctggctctcatcctccctccttcgcaccccattccaccagggctggcaccaaccattcttcagatccatacgatttcacttcagacatggattctcatgtcattcatgctcagcgttatgaaaagatattttctgcttgagatcatcaggtttccaactgtacattctttcaaatccttacaaataaagatgcagaaaaatggacaacagcagaaatgacagcactgtgttggcatgtcacaggtgctccctagacgttaactcactcaattaccccgacagtcccgtgagctaggaaccccagtgtatagacatggaaacggaggcttataggtggcaggacttgtccccttcgcgcagcttgtcaaaggtggagccagggagatttggttccggggtccagcctcggtgcatgcgaggtcactgctgagcgctgtgcacctctgctgctatgtcttgtggctgaacttttggttttatgcactgacaggccaagttcgtgcactgacaggcccttctcatgaaatccatccagacagctttgcttctgatcctaggaccctgcttgattaaattcccttcacagacagatttttgtcttttaggaggaaatccaaataaatacgcgttttcagtgctcgttacaaactctgtggacaaattctacacggaagaagatccaagaaggtaatttgctcattgagaacttaaaaaccaccccaacaaataaaaaagcaccaggttggcaggctggaccctgagaatgtgactggagtaggtgctcttcccagaaaagggtccagaaagaccagcgagggaggcctgtgttacaccgaggacagaagggtgggtttttcaaacctgaccttacacctttcactaggcttggtcagaaaccttccaaaatatactaggggcatctagatttaacctgtatgtgtgaaaaccttcgtctcctatttcagagccctgccaggttgctttctgccaaaatatcactgaacatttctgtccattaccaaacattaactgagacttttacagccaatttgatcatcacttcaatgtttcctattagctacaaaagctggaaagagagtttgtgaaacaacttgagcctcaattctgcaatgtaatcatcaccatctaaaggggcccatgagaagagtaggggcctctgactgaaggtcacttgattgaggccaggtggtcaccatctcttactcataaggactgaccacatctggcccgagagtcacatagacagggtcctgcccgaggctgcaggtagcaggtggcatcacatgctaggtgaggaccctccgggtctgggctcaaattgtacctcggatacttcctaatccctttaacccttggcaagatcctcatcctctctaggcctcagcggctactccataaaatggaatgaaaaaagttcctacctatagggtgttaggagaaatttagatcatgcagtttaggcatttacaagtgcctggaacaagtcatcaggcaatacacagtggtttcaaagactaccactagaaactaaaccctgaatgctagtttctgatctgcagatcttttgttcttgtttattattttttttttctctttgtagcaccctccaagcacatgggtgggtatggtggccagtccaatttcatggcattgcttgcagacccatggaacattcaaagtctaggttacgtgtgtcgcccagggcttaaaatcaccaatttgttaaatgcacagtattagcagctgtctctggagttattggccagcctattttttatttttatttttttaagatggagtcttgctctgtcacccaggctggagtacagtggcgcaatcttggctcactgcaacctctaccttccaggttcaaatgattctcctgcctcagcctcccaagtagctgggattacaggtgcacgccaccacacccagcttatttttgtatttttagtagagacggggtttcgccatgttggccaggctggtctccagctcctggcctcaagtgttccacctgcctcggcctcccaaagtgctggaattacaggcgtgggccactgtgcccagccctattttttctttagttggttgaatttttgaagcccagaacgtaggcagatcccccaaaaactctgtaatcagtctacgaaaatattttgttaatgctaacaggtatccaagaaaaggttcaggaagcatgtaatgtcagaggatcataaaattgtattagcattgtctattctccactattacactggccatacaaatcaataatctttaccctttgagatcacagcattttcccagagtaacttaatagaaataaagattacaattcagtggctacatagagaggatgttcaaactatataacaggctctgaagtcttgcctgtctcatttaagtaggtcaggactctcaaaattagcctaattcccataggcatgccaacatttaaaactcacacacatgaacatgtcctttagagggaagtagctgaggcctgtggtggctgtgctattttaagagaagagattggccaccagacctaagagcacagttcctctatcaggtatctccccgcctgccaggattgtgggctttacttccagaaaaaaacaggaacatttttttctatcattgcttccactacaaacccaactacccgattatttttgaaagtcaagaaaagcacgcctaaagcatcaaaagccccaaatgccaaggtctcgcttcaactcaatgtctctttttgttccaaaatgtacaaaatcatacagtgtaaccccacgtatctcaaaacattaatccgggttgaaaagttcagcacaattcactcctggcttgacagcagccttgatgattttggctccatttgggagactcttgtttatttgctcataaaacatgcgtggaaggatgacggcttttaagggtctttccactaaatcactggagaaacagcaagtgatttttgttttgtttttatttcagccactggtcagggatgattagccccaaatatccaaaatctgtccttgaaagtgagacttaccttttgccagatgatatctgaacctctcacctacgtaagtatttcttttccagctaaagcttttataattatatttttctcgggctatctacttcttcctcaaactggacatttttattgatgtttccaaaatgaaaagcgacaaagagagagggtgaagcttctgaaaggtgtgtggaagggacgtgtcacgaaaagaataaggaagtagtcagcagaaaggtggcagtctggagcttaccctgtcagctgctagaagagtacgagtgcgagtgcaagggcttgtatctacatactagaaagaccctatgaagcagacccctggttctccccagttttttttgggtcttttttgagacagagtcttactctgtgtcccaggctggagtgcagtggcatgatctcggctcactgtaacttctgcctcccaggttcaagtgattctcgtgcctcagcctctcaagtagctgggattacagatatgcaccaccacgcccagctaatttttgtattttcagtagacacagggtttcgccatgttggccaggctggtctcgaactcccggcctcaattgattcacccgccttggcctcccaaagtgctgggattataggctttgagcctatgcccctggcctggttctccccattttatagatgtggagatgtgcacggaagggtcaagtaactgacccaaggccacacagcaagtgagacacagagcctgggctggaactgggcagtctggtggctgagctctcatgcttgtcctgttaaatacatgaaaagggacagagaaaagtcgtcaggtgcagtgagacacgcagcaggcaagacaggatacaggaagatacacaacttttagagtagccagatcagctatttttgcttatggtatttcaaaggtttggcacaataccactgttgagtttcgtttcttttacattcagcacagcatctgccctgaagccaaaagacacagggctgcagcattggtttagggggctggtgctgtacctctttcgtctctgctcaaggcagaggtctctttcgctacaagatggaaaccatccctcaactgtcactaaatccctgggaacagaaagtgatggtgcagccttctgattcctgtctttcctaagaatgatgtgatcagagaaggaaatagaaggaacacatgttggatgtgctagaatgatccaactgcatgcatggcctaagtcaatcagtcagcggcaatgtgctgatattaacgaccagggaggagagcagcaaaaatccctacagagcacaaagcaacgagagcagaaaagagatagtaaaatgccatgaactgacttggtgcccattcagttgggaattcctttagagatgccaaaggaatcccattttgtagccagtttcacggcactcaggatgacagccacatgaggggtttcactggagtgttttagaagccgtttgcgggtgaaggtatcagagagttcagagctatggatgggtcccccagggtgtccttcagcaatccaggttggaacaagagtctgctgagaagcgcaggtcagggttcaccaccctcaaccacggggcagttggtacaagtgaccagtggtctttgctgaaccacgctgtgacataccaggagagccatgaacacatttccccattgaaaggaaacaatacaaatcctgtccttctctcattaaaggaaaagagctcacaatcttccaaggactttgtgcttttatgtgcccatttatccaggaaccaactctggttctctcatgtacacattcattcatcaaatattgactgagcacagcacctgctccacgttactcaccacggggcaaacagacaagaggaagagagcaccacccttaagaaagttccagtattggtaggcagctgggtagttagataagggcactaattgctagaatacagaaaatgtacttagagatactaagcacaaaagtcctggcaaggccctcacccagtgcttgtgggcagagatcacattcgctagagggaagaagcttccgaaaggctacacgcagggtccacgcccctcagagggggctcaagagacagacttcagtggtggatcagggcttcagcacaaaccacagagaaacccgtgtttcctaggggagcgccggggacccgcagaggcccgcagcaggtaccttgcagtcacagccgatgggcttcccacactcctcgcaggtgttggcgaacagggtctcaaagcacaccacgcagtaggggctctcctcccgcaggatgtacttcttgccaaagagagattcgttgcaatggtggcagtcaaagcgctcagtcattttgactcctggcttttcagcaacctatcaaaaagaaaagaaaatccaagtcccattaagcactctctgaaaggggtgcacgcaaaggcattaactgtcccactgtctgtcatctttagccgaaaggtggctaattcctctggatgaataattaaaactcaccctttaatcggtcataatttttaatgataacaccttttttcattagctagggcggttttgtgtttgaatgcattccactttttttttttttttttttttttttggagacagagtcttgttcttttgcccaggctggagtgcagtggtgcgatctcggctcactgcaacctccgcctcccaggttcaagtgattctcctgcctcagcctcccaagtagctgagattacaggcacctgccaccacacccagctaacttttatatttttagtagagacagggttttaccatgttggctaggctggtctcaaactcctgacctcgggtgatctgcccacctcagcctcccaaactgctgagattacaggcgtgagccatcacgcctggtcacattccacttcttgaaaagcacaaattattttttactgtgtcagaaaaagctatctcagttttaaatgcaggtaagggctgacaccagagcccccatcctgtccggctgtgacccggccttgcatcttccccttctccctgcctccaaaatagaaaggcaggcatagaaataatacgtccatttctataaaaagattttccgtgagctcctctttatgattcatgatttgaataggaagaaatcacagtggcaaaagggagggagatctgacctgggaaacctgagattagatgcaatgagggcactaatacccttgacctgggagtgcaagctgcccttgcacaagaaaaactgccaaagtccctgaggatgaatcattgctccctgcgggtaagatcatcctgcagctgcccaggtaccctgagagcaggataaatggaaagactcacttcccaaaacaatgatatcaaatagtcagaaatgcagtggctgcagtcagtggctctctgggcaacacctcaagcccttccaacaggaacaggacactggcgaggttgcagagaaaagggaacatttatacactgtgggtgggagtgtaaattagttcaacccttgtggaaagcagtatggtgattcctccaagagctaaaaacagaactaccatttgacccagcaatcccattactgggaatacacccagaggaatacaaatcattctaccataaagacacatgtacatgaatgttcattgcagcactcttcacaataccgacaacatggaatcaacctaaatgcccagcgatgacagattggataaagaaaatgtggtacatatacatcatgaaatactatgcagccacaaaaaagaatgagatcatgtcttttgcaggaacacggatggagctggaggccattatccttagcaaactaatgcaggaacagaaagccaaatactgcatgttctcacttgtaagtgagggctaaatgagggaacacatgaacacaaagaggtaaacaacagacgctggggtctacttgagcggggagggaggatggcaggagagagaggagcagaaaacataacacttgggtactaggcttaatacctgggtgatgaaataatatgtacaacaaacccctgtgacaagagtttacctgtataacaaacctgcacatgtaccccgaacctaaaataaaagtttaaaataaggggtctccatgcccggcacactgcatttttctaggatgaatacgcagtgtgaataagcagcaagtgatgggccctcctcttatgaccattcctataaaatcatgttagaatgatcctggagagaaaaagcctaccacaggaatagctggtgtggagaaacggccatagggcattaaaaacacagacaattttcttcaggaataaatggcaatattccatttgctaaaagtggaaagttttctctgttcttaaataggtacactgggctgggtgcagtcactcacgcctgtaatcccagcactttgggaggccgagacaggtggatcacctgaggttgggagcttgagaccagtctggccaacatggtgaaaccctgtctctactaaaaatacaaaaaaaaaaaaaaaattagccgggcttactggcacatgcctgtaatcccagctactcaggacgctaaggcaggagaatcatttgaacccaggaagtggaggttgcagtgagctgagatgataccactgcaccccagcctgggcaacagagcgagactccgtctcaaaaaaaaaaaataggtacactggttggctatgtaactctgagcaagagttcacaggatctaagaaaacttggttcaatttgcagtcttcaaaagataggcgagtgaaatgccagaatcagaccttctgatgcaaataaaatattgccgcctggtttgtgattacagtaattttgtactattgcgtatacacgatcctgacaactgtaagcaaggaaaagatcatctttcaagaattcattcttggatatttctgtgtttacagaataattctcttccaagagcaataaatatgcagctggacacatgcggcaagatccgtccttctaaatcactcttcctggagttaaagaaaacattgtctggacattcttgtgataacatcacaagatgaggctcttgagcacttgaattattattctgaagcccaacgtataaatatcctttgtaccgcagccatctcgagttggagcagccatgctggcacaagattcaatgctttcctgtaattgttcagttattggccttgaaagttgctgtcatttatttcatcacaattgagagctgtttttccaacatatatgtttttccaataaagggtgtgatttagctgtgggacaagaggctcactgcccattccatgcccacaaacataagaataataatttgggaatttgaaataagaacgatgaaaggacagagaactataaattgcggaattgtaaaagctggaaacaaatccccagattatctatgacaacttcctcattctatggatggaaaaactgaagcccacgcatatttatgaaaaagagggtccactgagctttctcaaatagccgtctgacttacagaaaatgaactcccagtctaacttgaaaggccgtctgtgtgggtcaggacaagcaccagccctgctagggaagggagacagtctacagcctctgttaatgtctgcagagctccatttatgttggcagctggtgaaaggggtacacctgttttcctctgaggtaataatcgtgatcacggtgctcatatacctgatatgtgttttccacttcctctgattctacaggaccaggacagaaaaaaacaaaaacaaaaaaaatctggccaggtgcggtggctcacgcctgtaatcccagcactttgggaggctgaggcgggtgaaacacgaggtcaggagattgagaccatcctggctaacacggtgaaaccccatctctactaaaaatacaaaaaaaaaattatccgggtgtggtggcgggcacctgtagtcccagctacttgggaggctggggcaggagaatggcgtgaaccaagaggtagagcttgcagtgagctgagatcgtgccactgcactccagcctgggcgacaaagcgagactccgtctaaaaaaataaaaaaataaatctaagagaataaactctgaaaataagtagggctccacatttgctcaaagtacgactgaggttatgaatgtcatcatggtgaatgtcatcatcagtgatatgatgaatatcattatcagtgataccagctcccagcaggaacagtagcagctgctatctgctcagtgggtccacctgggaggaggcacttggccctgtggttcagctcctaattctacagaattctttctgagagtggtggatccctcttctaccttgttcctcatcttctaagaggacactagagttctacaaagagcagagagcatttctactccaaccaacagggcagagcataaaatgagcaactgctgctacctaggagcacagcaggatgcactgtgtgaaagcaggcccctgaaggagttccacacagttacatactgcacaagccctgagcatcagaataaaaagtccatgagctaataagcaagctcagagcttcccttctattacaacatgtttaaaagtatacctattgtcctgtattagaaatctcctataacttgcattttttttttttttttgagacagagtcttgctgtgtcacccaggctggagtgcagtggcatgatctcagctcactgcagcctccacctcccgggtttcagtgattctcctgcctcagcctcctgggttgctgggattacgggcacacgccaccacactcagctaatttgtgtgtgtgtgtatgtgtgtgtgtgtatgtgtatttttttttttttagtagagacggagtttcaccatgttggccagactggtctcaaactcctgacctcaggtgatccgcctgccttggcctcctaaagtgctaggattacagtcatgagccacttgcattttttacatcccataaatacctgattgctcattcattcactgaataaacattggttgagctggaactatgtgtctaaagtcatgaaaagtgcagaagatacaaagatgaataaaatgcaggcccctcccctcaagggacttgttatctagtgaggaaaagagatatataccaaacagactaccaagccccttactcagtgcgtgctggaggtgcacaggtatgatgggcacgcagaggaggagcccctgagagagcaggcaggcatcccagaggagatgctatctgtgctaggaacaggtcagccaggtgatatggcaggtcaggtcaaggggtggagtaggcaaagccagagacatgagagacagagtagggtaggcagagagcccaggaagatggaagacccagtcaacagccaaggcaatgagggcctggatgccttgttcatggacttgggtatgcctcgcaggcagtggagaaacggacagcccagtgaaagtttactgcatggaagcctgcctttactatgcaagacagggggcaatgactcctaaaaaatgtatcagggtatcagagcccatttctgaatgatttcttcaaataaaagtaggacatcttggttctacaaggacttattaacctaattgtgtacaatccatttactctctgtgaactccacatccctcctgacaggttatcaataattcctgctccttagctggtacacaggaatgctgaaagcatcaggcaacagcctgcagggagatgcccaaacataaggcgcaacccctcctttttatttcactgaatcaaattccaaatcacagtttcctggagttcttattcctcaccaagctaaatcattccatgatgtcattaccccttcggccctgaatagggtatttgaaaaagctggatcttagggtacaggcttgactccaggccaagggaactgcaatgggtgaggcaggtgccaggtgcagctcggaggtctggggatggcccagggaaggctttgatctctgagtctctcgctagcccagctttgactcagatgtaagaataggtcgggtacagaggctcatgcctgtagtcccagtactttgggagaccgaggcagacatatcgtttgagccctgtagttcaagaccagcctgggcaacatggagaaaccccatctctacaaaaaacacaaaaaatttgccgggtgtggtggcatgcatttgtagtccctactactcaggaggctgaggtgggaggatcttgagcccaggaggtcgaggctgcagtgagccatgatagcatcactgctctccagcctcaaggaaacagcctcatggtgacacagaccatgtctccaaagaaaaaaaagaaaaagaaataaaaaggatgtaagaataaaggttcagagggccagggagcaacaatgcactctactactcacaattcatactaattttaaaagttcacaagctcatcagtgtgatctatttttaaattttcagattcaaaaactgtaaaacaaagtatgagtggggaaagtatcaaagctggaggaaaataaagggaaaaggaaacagaaagagtaaagagaaggggagaagggtggtgacaggacaaaaaaaggaaggaggagggtaaatgaaatgaggcagaagagaggcaaggaccctgcatgccaggaagcttttttttttttttttttttttttcttgagacagtgtcactctatcacccaggctggagtgcactggccctatcttggctcacttcagcctccacatcctaggttcaagcaattctcctgtctcagcctcccaagtagctggtattacaggcgtgcatcaccgcacccagctaattttttttttttttttaaccagaaagatttcgatcaaaggaggggctgccatgacagacagcctcccttggcttgctggctcaggccttggagttccaggagcctggcagatccctacaggtaaagcctgaagaggtcagattagcaaaagaagtctatttaagcatccttttcaatgcaccttttattgactacctactttgatctgaccccaatgggcccattttctcctccccctttgaaaccccaagtgcttctccctatcaaccctgctgcaggaggctcctctaacatagccatttcctaaggagaaatctgtgaacgtccccaagcccttcctgcatgcagcccttcaacacatgcaaaagcagcttcggtaagtcagtccctgtatctttagatgtcaccggggatccgcaagggatattcaattacttatcaataatcaaccagagctttccagagacaattaggaaaactggtctatgtgggctcttttaaaaaatacattataaaagtgcagtgttttcatgcaattgccccgtcttctaccaaccgtaagcattgggaagggtgcccactacctgtcgctgagacctcaccagcagggaacacacacaggaccaggggctttgtgaatacttgtggaatggatgaacaaatgaattgacgggtggatgaatacaaacatgtcagagtacaaacatacaggcaaaaatcaagcatgaaaaattagaaacatattatgtgaacaatccactctgcatagcaaacccaacatgtaatgtggtttggcatatgacatcatgagcttccatcgctgccctcgtccctccttccagataagctgctgcttccgcagcggatataactcttcttattgtgtttggactccaatcccatgtgaacacacagctgcacagtccaggatgcagcctggccaggtcaagaagcaaaaagccagctgggagtcgtgcccactttgggaagaacgcacagatccccaacacgggctccaggtgtcagcagaaggccctgatgttctacagacatgtgatgcctataatcaaagatcctccattcaaaggcacgggactctcacacctggaaatgtgctcagagaataccccgcaccattttattttcctacggatgggagtatctacacacaaaaaccgctcacccccaacactcttcatttgtctagctaaacgggttgttttaaacagaaattctgataaaacggagagggccatcatgtcaaggaaagttgctgttttataaactagaataatggatcaagccttggagtccctaaagagagaggatctcttgagcccaagagttcgaggctgcagtgagctgtagtgctgccactatactccagcctggaccacagtgtaagacccggtctctaaaaaaaaaaaaaaatttatatcagttggatatggtgatgtgtgcctacagtcctagctacctgggagactgaggcaggaggactgcttgagcccaggggtttgaggctttagtgagctatgatggcacctgtgaaaagctactgcactccagcctgagcaacagaatgagaccctgggaaaaaaaaaagaaaagaaggaaagaaagaaagaaagagaaaaaagaaagaaagaaaaaaagtatctagcatccacttgaaatctatttttaaattgttggattttaaacaatcttagtttgtaaggtataaaattgactatgcttaccactgtataatatatttacagattaatttaataagcctttactaaatgcatgtacagacaggtgtcagaggtgtattatagtttacataaactggtaacttccaacttaaaaaaaataaataaacatcttcatctctggtggttctgcatgaggcaatgtttgaataaggtaaactgctgtcttctgaattatcttttgaatattgaatactaaaaataaagggaaaacaataaatatcaaatttctgatctgaagtccatgactacaagaggagttacacttgttttgatgtcgttcagccttttgaacccagccgacaagaatgtgttgagtaaccactgttttccatgtgctacgtgaggcactgggaagctgagataaaacacacagtctatgaaggagttccagtctagttctagctccaaataatttaaatcacctttaagatcccatcttgtcatttaatctcaaaacacatcaattgcagccatgcaggacaaccatagctgcacacgctagaatggcgggtggcctcgggtccgtcaatcacaccagtgtggggaccaagggagactccatcctgcatgctatggctctaccatgccttccctgagtgagttacgaacacttctacacctacaaaacgaaaaccacccactcttcttcatggcaggggtctcctctcacctcccaagtgcggctcactgttcactctcccagctatctgaggtgcctatgacccccacccccatgctggcctttctcttggcatccagcagcttccatgaatgactggccacctccttctcactgcagtcctgccactctgtggggtttctctggcgcactgcaacaggactctgtcccgagaggcttgcacagttccttctgcttccttcattgactgcctgcttcttagtgactccaaaagttgtattaacccaagcagacaggtctatttccttgttgactgacaagctccatatttacatactgcaaggacattctggcattaattctgttcacccatgaaaacagggcagctgcttctgccacagacatcccacatctcactcaagaccatatgacgggaggatcttgaagccgcagacagaatcaggctagtaaaggcgtgggccaccgaaggctgaggatgagtgtgaagtctaagttcacaccaggcaagacaccacccacgagcactgggatggacctgggagaccagacgctgctccagacccctcgtgacatccccatgcagagagcatgttttacagcaagaggaaagccaagactcccaggagcaaagtagtgatcaaatcttaaaaaaagggagaatgacagttggtggggagactttttaaatagatgttaccagagagctgtaatagtcagggttttctagaaaaatagaaccaacaagagatgtacatagagagatttatcgcaatgatttagctcacacaattacgaaggtgaaaaagtcccaagacctgcagtcagtaggctggagacccaggagagccgatggtgcaaattgcagtctgaaaagaggagactctatagacccaagaagagccgatgtttcagtgtgagtccaaaggcggaaaggaccaatgtcccagctcaagcagtccggcaggggggcttccctcttactcagtttttttgttctattcaggccttcaactgtttggacaaggcccactcacattatggagagcagcctgctttactcagtctacccattcatatgtcaatctcatccaaaaacaccctcccagacacacccagaacatatgactgaatgtttgggcaccgcatggcccagtcaagttgacacatgaaagtaaccatcacagtagctaaaactgaaatccacaatttaggataacagaggaaattcacttgactcaccccaaagtcaaaatgccagcctagtctccaggaagacacagttctcagccactagagaaagcacacgtgttttgtttcagatggtcatcttgaggaagcgaactcagtataatgcaacttgagatggacacttaataaatgtggctttgatcaaattctcataataaaaccgcacagaagaacccaatgtctaatgtttccattcacccaagctcaaggaactttgtacctcagggcatctgagtcagagagccgcttagcgactcaggcccggtgctgacaaaggaggctgcctgagtcactgaggctgagtaactggccctcggcacaggacaggagtaaactactcctgatatctagtctgtttttttttttttttttttttggcaatattctattgggcgtttttgactgcaatttaaatatctttcagtactggaaatggtttaacacgcaatcttgggtcaaagtatgcatcataaggcctcatagaaatattcaaatgttaaaaaaaataaataaatattcaaatgttcctcccgtggtgcgtttagtggttagaactcaggttctccagttaagctgcctggggtcagatctcagggctaccatttacagcccgggaaaccctgagttaaagttactttgatctctgttttcagtgtctttacctgtaaaaatgaggctatcaaatatgtatacactgtctatgatgtccaggcttcttaacaaccctaacaaaaagacaacatcattgtccctgtttcccagtggagaaaaccgagacactacgagattaagtgacttggcccaggctgcacaggttgagggacccggatgtaaatttaggcagcctacatgcagtccccggcatcccctagcctactgcatctgcctgtggctatttgtgagacggtgagctaaaatgagacagaacctatgtgcccagaacagtttctggtctgtagtaagcccatcattagccttcatcgacatgttatggtgtaaacgcattttaaaccatggcaggctaataaacaccgtggaaacacaattctgtgtattaactgatgatcttctaaactggggggtgatctaaatccagtaacacttgacaaaattttatataaatgcacaatgaaatgttctttgagtttggttttattaaagtttaattgatagactaggaattcctgtacttctaagacttgatgcaaatggtttttgtttttttgttttttgtttttttttgtctaaaacatcttcaggatagtgcaaaacctcttttctttaatatattattataaaacactcattagtagagtcagcaccaaaaatgtgagatgtattgggagttgtgttttgaagacagttctcctgattctaaacccaaattgtgatttattaccttccaaaatatgtggaagggagtgcgggccttaagttcagtgatgtctaagtacactgctgcttgcaagccagctacacatttcagctaaccggattagcctacttccagttaaaacccgactgaggatatgaaaataaatatgactgattcatttaaaatcagaaaaacactcaatattttcttccctctatttctggtatgctaagatatcacacgagtgcgacttaagaaaaacttagaatcttttcatttaaaataagccatttttgttttaaccgaatggttcagttattaaatgtctacctgagtcaaggagcgaggtcacactgcaaactccacttatttctactaaagggaaatggcccggactcccccgcgcagaccaccgtgccaggacagcccgctcgggagtcgggcctggaagcaggcggacagcgtcacctccccgcagccgccggctgggacccgcggccagcctttacccaggctcgcccggtccctgcccgcatggcggtgccccacctggtgaggacgcgggctgcagtcctccctctggggatgagtcggtgggctcctctgagctccagcgcccccagggtctagacccctcccattgctccgctcccctctccccgtggtctccccacccccaacccccagggttcggctctcctctcccgggtctaccccacagctcaactcctttctcccggcttctccccgcacggttcgggtcccctctcccagtggtcttcccggacccacagctctgctctcctctcaccagtctccccaactccggctctgctcccctctccttgggtctcgcaccggattcggcccccacttccgagccctggtggctaagcccctcggcctccctccggggcgcagggggttggaggtactcacggcaccgcagcgggccggggactcccggacggggctggagggcgcgggcggctggtggctgcggctccgctgccggccgagtggagcgctgcgcagctcccgccctcgagaaaccccgccgtgtcatttgaccatataaggagatgcacgcctcggctcgctggcaccgggcgtggggcgcggggggcgggcgcccccaggcctcgcggttgccgtgcccccgccccgggctgcggcggtcccggcccgtaccctttgtttgccagggctcctttcttcgtgccctccgggtcttgggagcacagtagttatcgggagcgtcgcctccggcgtgggctctcgggcgcgagtttcggacgaggcctgggcgcggtggcaggggtctgcccacgccgggatctctgcctggtcccaggagcgggagactggagaagccccaggacgtgccgggggaggcggagggaggagggggtcacttctcaggaggcatgtgcctgggatatatttgcaaggtggacgtttttccttcttaccctgcagatgcttctttacgaaatgaacaccacagatgaccataaagaatccttcgttccactacggaggggactaaaggaaggtcctatccccacctctccctctcggggccagaagactagttagacatcttggattcccctccagggcgggaaaaccaaagtgagctgggagcgtgcctcccacattccaagcccgggccctctgcgtgacgctgacgctgggtagggacagatggcactgttcagcattgtcgcagggagagcacaggttgagcccatccctgggagagggtgcgtcgtgatggaaacatttgctcctgagcaggtaaccggtccacttgcagaaaccggtggacgatgagtaggtggaccacaaaggcgtcctcggcactttgggggcaggtgtattatttttaacattcggggcagctcataggaatacatcctccagagaaggcgggaagaactccgtgattgctttcttttaattgatactctccgtctggtaggcctcatgggtctccatcatggaatcacagaacttgagaataaaggggcttcatcaccttagcttccactcggtgagcactagctctacctggtatctcatttgatccacactcctttaaggtaaagatttttaccagatttacggtgaggaaagttcagctcagatttgctccaggccacgtgaacggtaactgtgccagctgagatttgaactgggatgtggtagatggcaaagccatgtaagtatattacgggatcagaaatgcctctcatccctcagtcactcaggtgactccagaggactgagacttgccataagcccagccagaactagatgtgcggaatacagccctcccccgaccccaccccactgtgtccctgaaacaggacgctttcctgaagaacctgagttaaggccaccctacctgaatttccactaagtgtcaagacaggctagtattttgaaattcagagcaaagtttgtgtagaaaaggctcccagcccctgacagctacctagatgtgttgttgatatcgttacaaattaggaaatggtctcctagttctcaaatggtgagtcttaagcttcagtttgtaaaaacaagccctaaaatgatgaaacattaattctgcatttatcttctttctgattccttttgtcttatattttaattttttttttttttttagctttctgacttacgggtgtaatccatttagctttgcttttttactgatagagttatttagttctgttatttttcttctaataactgctttagctgtgtcacataggttcagctatgttgtgttttattattaagaaattctgcaatttaattttgtgtttaatttttgacctaatgggtagcagaacattttaaatgaccctgtggtcattcgatagggtcagtaaaatccggactctggaaacaaacatacccagtttctacaacaacgatgcacaaagaaaaacaagagagatggagacagaaccaagagattaaaaaaagacttagccaactgccatgtatggatcttattggattcttttttttttttttttttggatcttattggattctaatcaaagaataaactagtagaaaatcaatttttatgagacaaccttggaaaatatgacactgacaggatattttctagtattaatgaacaatttatgttaggggtgataatgtgattacacacacacatatatttttcttttcttaagtccttgcttttcaagaacagtgccaaaatatttcctagtgaaataacattatgcctggagttgtttcaaaataatttggggtggggaaatggatagggcctatatatatacgaaatactatcagccatggattgtggataatcgctgaagcttgatgatggatatgcagcagttcatcttactagtctgtctccttttgtaatgcttgaaaaattccataatgaaaacatttttaaattacagatgaacataccattttctctttacccagcatttccctttataggaaattatcttgtagatatacttgctcctgtgtaaaacgatagacacacaagagtagtcattgtagaattgtttgtaatagaaaaatactgggccatgttatgtgttcgtcaacaagggcttagttaaatacagtatggtgcattttagaattatttacatatgcggctgttaaaatgaacgaggtaactatatttactgatttggcatgatctccaagataaatcaactgagaaaaataaaagtagagaacactttgtaggtagaaaccaaccatttgtgttcatgagcaaagaaaggacgggggaagacaatgtatatttataagcggttgcttctggggagatctgagtggctaggggtcatggggtggaaaggagattaatttttactgtacacatttttatttcttgtaaattttgagctatgttaatgtactcattcaaaaactaaatatatatatacacgaatatatacatatatacgtatatatacacgaatatatatatacgtatatatacgtatgtatgtacatatacatgtatatatgtgtatatatacgtgtatatatacacgtatatatacatatatacatatacacatatacacacatatacacatgtatgtatatgtatatatgtatctgtatgtatatatgtatatatatgtgtatatatgtatatatatgtgtgtatatatatatgtgtgtgtgtgtatatatatatgtatttgagatggagtcttgctctgttgcccatgctggagtacagtggcactgtcttggctcactgaaacctctgcctcccaggtgcaagcgattctcctgcctcagcctcctgagtagctgggactacaggcatgtgccaccatacccggctaattttttataattttagtagacacgaggtttcatcatgttagccaggatggtcttgatctcctgatcttgtgatccacccacttggcctcccaaagtgctgaaattacaggcgtgggcgaccatgcctggcccaaaaactaaatatattttaaaaataaaagcaacagactcctttaaggaaaataggaaacaaatttgttaaactgatattaatagtaagtcaaaggaggatggcaagaaattgaggaggggaatgcaatttctgggtttaatgacatatgctttcatgagcaattccatcgaaggacaaagtattaaaaacaaattttcatgagacaatctaagaaaatatgttttgaaaagttccatccatcttgtacatcattatattcctaggacctaattaattatagagcatggcacatagtatgtgcttaataaatatgtgtattgaataagtgacagatcacagaattgtttgtgacaagtctttcactatagaaagcgtaatgctgtctatggcagcatagcttgatctttgaagtcaagccaggatttgaatctctgttctatctatgactactatgatctccagtaactacaaaacttccctaaccctcagtttgctagtttgtaaaatgggctaataacatatagtctgtgaaattgtggcgaaggtcttttgagatgcacataaaccacttagaactattaacacattacttggcatgaagtaggccctttgtaaagtcctctgttttattcaatggcaaaggggaaattaatccagaataagaaggaaatggactgaactcccaccagaagaagaattaaggttcagatcctgttcagatcctgtttcttcttgagagaaaacctctctgctatggataaaaggctagttcatggaagaaaataaaaacaaaaagtactatttcctggggaaaggatcaacggtgactgtgatcagttattcaagttcttcttttgtttattccaattatcctgacattccttcttgagacaacactgcccataacgttttcccgtctctcctgtaggtgggcttcagggagaggcacagctaggaagggaggaaagagaggaaaagacttcctgcggctagcaggtctcaaagccttgtcccagagtgcagcaggatcccctgcaaacctgttagaagtgcacattctcaggccagctcctgctttaacacgccctccaggtgattctgatgactaaaggtgatttgaagtaaaataaataccacttagggcttccaactctggactcggtaatttaccagaaacctacgaaatgtcagtttagggcgtgggggagggacagggaaatagagatagactaaacatagactagactcaggaactctaaaatccagttggaagtattacttcctctgtcagttacttcactcagggaagcaggaggtagaagtttgagccaggaggtagaagtttcagccagtgggtctgagctgtacaaatgctgaaatttcattctctgggagaggccaaagaaaggcagggcttctaggcgtgtgctcgcaactgccaccctgtggtggggtcgtgggggggaggctggtgggctagacccatctgtgcaggggccaacagtagcctcctacccggatgggggctaccccagggggattaggatgagctcaccattaccaggtagaaagtgaacacaggaaaacatgagctggaggtcagaccgccctatgttcgttaccctaactgaccactgccatcaagattgttaagcattttgtcaccgttaaaggatttcacacaagctgttcctcccactcaaaccttggccaggaaactggtggatgatttgcccttgattcagaggcaatcattcttaattgcctcacatggttggaaggtgagtaagtgtctaagatcataaatgctggcgggaaggggtcaggagtgatcaaaccagcacccctcctggcagtggggtcaggaggcaagtccctgcatgccttcccatgacacagtaccagatcccagggtggtggcacagaaagctggattcgctttttctggaaacactatttgcccggatccagcagggaagtctatgaaagatgactctacgggcagggtatgcacctgcctgtgcccgtgagctgggtgcagttgtgacgggagacccaagggcctccagcaaacaggaggaacttgatctggttacaggaacgatcttgcaggatccaaactttgtttctctgcctgtcagactttcaggaaaagctcagctttccacaaagggcaagctcttttccttttcttctcccttctgccatgctctggttaggagggaaaatgattggctctttcttgagatacacaatttccatatcccatttcttccctctctcctttttcacaaactatttgttggatataaataatcagtgtttaaagcctcaaaacatgcctgacttttagccaaatccacaaacaactccatgattccgagtttcccatccttggttagagtttatttggagcgtcggatacagtttccactgtggctttgatacctctttaagaaagactctgtttggtacattaatgaccaatagaatgaaactattcacacccatagttcatttgggccagtaaatgttgctggatggtttcagatgaaaagtatttgtaaggtagactctgaaaaactttgcttcttatttgagatctctttgtctctgatttcagtccttttcaggagcaatccattcacttctctgcctgccttctcttagagttttactctttttttcctctgtcaatgattccaaaatccatttaaaggaagtattaatgtctaaagtctgtgcaaacctggcaaaattctcttttgagtgaacggtttgcttccctaaaatacctgaaatgggagattcttccaggcatttctgaaatgggggagtctcatgcctcacttgttcctcagaatgtttatgttattttatttgagacagagtcttactctgtcacccaggctggaatgcagtggagcaatctccgctcactgtaaactctgccttccctgattcaagtgattcccctgccatggcctcccaaagtgctaggattacaggcgtgagccaccatggctggcaagagtgtttattttaaaccacaccaagatctgttattctttgtgaattaactttatgagtcaacattaaaaatttgaaatcccaagttctctcttcactgccaccaaggtcgttttgtgctatttccactttgattagggtcattaacagaaaatcccaatagtctaactagaaagagcctggactggccaggctctaggaggcagggggtgaaccccaggtccaggagctcctatggagcagtgtatgtggccacaggtaacacccttcacctttgtatgtcttctttacattatctgtgaaataaagaatgtaccacctctcttcttcctttaaagagttatttcacattatctagtttttcctcaagccacttttatggctaattgacaattgagaatgtctcctgtggctaattctgccccatggtacagatttgtgtgtgatgaaaacctatgctttaagttctagagagcatgtttaggaatacctttcacctatttcagaaggtactttaaaattggacctgggagtcatgacagagcttcctggaacaaccaagcatctttctccatccttgcaatagtagttgactgctgaagtaccagaaacagattttctaaaatatctgaccttcagcatctcctggcaggactgtttggcaaaaataaaaaaaccttcaaaaattctgggccatcctaacactataaatatacttggaatcgtgtgtacagtcagagatgctgagcaattactcctcagtaagaccagaggagtcattgtctccatggagggccggaggggttccagcggtgaatcaccatcagatatctgaactattcatgtagccatctttaaactcgagggctttttcttatcttttttttttttttggccttccttttgataacttgaaattcaatttccatttggcacatggctgtaatgtaatctagcttcccagccattgctaacactttctggactcagttctctgtctcacgctctttgcatggagggtctgtctgtattgctgtattgcttctggtcccttgaatttccaggtcagggtagaagcagatggaaagaatgcttgagaggttttctttttctaagaatatgtttggaaaatgatgaggtcaggaaagcagacactgcaatcctgcgcaggagagagtctttgagagccctcgctgctcactctctttgcacctcacatgttctacctgcggccagtgaggggagagcctttcatcctgtgactgctggaactcccttcctcactctcttctgcctggtggactcctgtttatccttagaccaaataaggtatcccaactaggaaagctgcatggatagccatcatagcctcatttttgaccagtccactccttctttcccatgtttataacaacagaggagactgtgagctccttaggggcaagaactgagacatttgaatctgtgttcacagcactttgcagcttgatcagtattactgaatttaattcagttttcttgaaaatgcctaagctgctgggcgtggtggctcacgcctataatcccagcactttgggaggccaaggtgggtggatcacaaggtcaagagatagagaccatcctggctaacacggtgaaaccctgtctctactaaaaatacaaaaaattagctggacgtggtggcgggcgcctgtagtcccagctactcaggaggctgaggcaggagaatggcatgaacccaggaggtggagcttgcagtgagctgagatcgctccactgcactccagcctgggtgacagagcgagactctgtctcaaaaaaaaaaaaaaaaaagaagaaggaaagaaaatgcctaagccaacataaggctgctatataatggctctatatgaccctgctcagaacaaacacatcaagcccatttcccatttaggcagtcgagttatctgggctttgcaccgagatccagttggcaaataacttgaattaaagcaaagccaagagcttggccttccagatatcagcagatgcaaacttgggaatctctgcctgaattaaaggaagtaacccccaggttacagcatccgcagatacaatgaagagctgaaaatgaggctgcagggaagtgtgcatgtggacgttcttgggatggtgcttctctctcagagtccagcttttctttgctagtgaggggcttcttctcctgccccaatcctccccccgctgccaccaccaccaccagcctaggccttaatcgcagagaaggccactcattgagggacttccttgaaatctgcatcctgcaaacggaagccaccatcttaatttttaggagtctatctggggaattcatggctttagtttctgcttgaagcttgttgattttctatcaaatgctttaaaaaatttctgtctgcataaatggtaacatacaaagttaaacaaaaattctgtctcccacagaaattccataaaggttctttcatctctaccagcatgagcatgtctcatttgtggaagcaggcctacttgccatgacaacaactattctgtggctttgcagaggtaccctcacagttgcagtgtgcttttgctaggcagccggcagagatggcccacatatgaccactgcctttcaaccctacctgttttaaggtggactcacttggattgagaaactggtattttcccctcacttgcacgtattttggatgtataaatattttcaaaagataagtttgactaatacatgcacaccttccttgactatcaccatccaaacccacagagatgactgggaatttccaagtcatgtaatcctaatgttgatttgagcatccacagcctgtcttagaacactttccaaccaagactggaaccagcactttggcacttgcagaatcacagccttcccttcacagccttcccttacgagaagtacggcttcacccagccagttggctttgtatcgagaattcatttattttggacaggtcactcttcctcacttacaactggcacgtggatgcagagaaaggacagcagctcctggctggagcagaactaatggggcagacagttagtgagcatacacatgatggccctgatcctagatgcagagtttggaggagcaatctttcgtcatcactactaccaccatgattgccactatgatgttcatcttatttattagcatattttgactgctgatagggtgacatttttggtataggaaggtgagatccagagtggatcttactcttagagtcttgaaagattactttcttcccctttccgtctgaagctctcagaagacaggcagtttcagagggaccctacatccaacgtgatgtagcaggcagcagagcaagggcagaggggagaccaggctgagccaaggcagcaccaggtcatggtgtcctctctgtgggtgcaagaaagcagcaggaggtgggggtaggaatggctgagagagggtgttgtggcccaaagaaggagaaagccttcatgctttgaggctttagctcacagagagggaacctcagagaccagttgggaggagcaggcccagtgagaacaaaaggagaccctctgcaggaaaaatgggcaagtgagggaaagaaagagactatggggagagcaagccaaaggaagtttttgttggggaaatattcaaggagtctgcacttggcagctgtgcaatttatatgtgcaaacaagggcgctgggtgtaattcacctgctgatttctgggagtcgggaatcattttagaggaagaagctgaagttgcccccagaagtctcccatgatgctcatgtgtggctgtggctattctaagtaggccctggcattgcaagcccagcaagatagccagatagggaaggataggggagatttgccagctctttaggtcagcccccaagttaatagtaaattttacatttttgtgccataaaggcattaacataattaacagcttggtgccagtttaaatatgcgtatgtgcttaggatcaatgctaccattttgatcattgtttgagagaatcccatttctgatgtgttagtaaataatatgatattattgttcacatgcccatctaggctctttgtcccagaaagaggatgcgaaggggtgatataaaatccaccttggagccatctcagggctggttgttcttgattcctctgaagacctggagctgcctgtgtgaatcagactggaaaaacacgtggctgcacttttccatgaagtaggtaacaaagccacagttcatgcctgggaaacttgccctagcatctccgccaggagagcaagccgactcatgcctggactcccacacgagggccagtgccaagtacgctggaatgaagggacactgccaaggatcaggaataccaggagctcagcccacttaccaggctgagctggggatgctgagattactgtgcacactcaggcagagctggaagctgagtctgccatccagaaggctggacccagacagagttcagggatcacaccagaatcgggacacaggagaagtttgctaacctaggtccaacccagaatcagattcagattcagagcaggaggtcagcaggacagctttgtcccccaaaaggaatcaggcggaggccggagaggcagcttgccagctaggagaacacctgagcagtcttaaacccaggcaggttactggcagttgcttcaccttctagtggcctcacttgcacaccagctttccccaagcagataaccccacatagctgcaaaatgaattattttctcttgtctgcttctagagggtccatgaccattctattggcagttggagaggtgagagttaaactgaatgtgagcctgtgtcaggggccatgacccattttaatggagggtctctaacagcaccagtctctcggtagatatcactcgaatggtgctaagctacctactagcagatttagcagggtgatgccttttgaagtctaaagttttgactgctaatctctgggaaacatgtcacatcgtatgctattatttggtggtggtgtccaaaaccaacacattggtctttctcagacgagaaggattcttggcacaggcaagcagagggaagtgtgtggtatgtgcgtcttcctgtatcagcttgtgtttctcttatgctggagacctgaggtgtccacactggtggaaaaaaaatgctgccagatttaaggtgaggagcaatggcatgagtaatcctttcagatagaagttagcagtgctggaccttggaggttgcagttacagctgccaacattcgaaaatggacttagttattttaggaagccaagtgctgcacatagagccaacctcagttgagatgccttgggaccagtacatagaaggtgtttaagattctacagttccatttcatcctttacaaaatgtccaccctgaatctacagcttgcttattgaatctttgtgaaatttgaaggggagagggaaacagtaatatgacccaacataagagaagtaccagcgagcctctgtggacacaggtgtgtgcataaccaccatcgctctaatccttaggttcattctttctcatttcagtcaaaaaactgattctaaaattaaggcagactgacacccactgcgtcctaaactgtagatgcattaaaggttattagcacaatttcctagtattatctttgagtttgttttaaaaagtaactttttaagataaagacaaattgtaactttagaaagaatactatgaactgtcaattctgtcacatactgagcaaattttaaaaaaaagtataatgtacaatttttttttctcattctttttcaagcacagcttgataaaccttgtctcttactcctggttttagatggaattcttttttcctactcacccagaatcctcatctttgaaatgatgaatttgtaaatggtcctgaacttagggttttttttttttttttttttttttttgactttaaaagttctcatggttcccagcactttggtaggccgaggcgggcggatcacttgaggtcaggaattcaagaccagcctgaccaacatggtgaaaccctgtctctactcaaaatacaaaaattaattgggcatggtggtgagctcagaaggctgagacaggataatggcttgaacccaggaggcggaggttgtggtaagccgagatcacgccagtgcactccagcctgggcaacagagcaagactccatctcaaaaaaaaaaaagttcacatggcatccttctcctagtaattggattgagtagagagcccgagggaaactattgagcagaaacttgttgattgctaagtgactcatcctcacaatgccaccaagatgaataaatctcactccatcccttctaagggttaaagtccagtgtgaccagaagggagggagccagctgagtaaagatgaaactccaataagttccggtcaaggttaagatatgaaagtataccccacttctgggtatatatctaaaagaattgaaagcagggtttggaagaaatacctgcacactcatgttcatagcagcattattcacaatagccaacaggtggatgcagcccaggcttccatagataggtgaatgcgtgaacaacatgtagtacatccatacaatggaatcttattcacacttaaaaaggaaggacattctgacacatgctccaacagggatggaccttgaggtcattatgctaagcttgaatgagaattgcttgaacccagaaggcagaggtagcttggataaccaaaaggtataatcatcaggaaaatagaaaaaaacaaactggtggtggaggatgaattcaattttgacttattgaaacagaagcagtttggggacagccatccaaatagaaaattttcccaaacttgtagaaggatgagattcagggagaaggttggagctgatggtatgaacataggggtcattagccaaatggtaggtaaaaaccagtagagcaaaagagcaaataaataaaccaggagagtgagtgaggtcgtgcaagaaagcacgtggatggttaggagtgggtcgaaggtcaagctccaggggagcctaaggtttagggggcagcatccgcagaggtggctgagaaggcagcgtcaaggaaggatgaggagaaagagccagaggcgggggcagtgaagccagtgactgacacagccgaggagcagtggccagggggtgctgagagtgtgttgcacgtggcagcacagtggctgttggtgacgtctgaatgtgatcagtggcatgatggggacagaagcacattgcagtgggctgagggtcagtgacaatggagggtgtggagacggtgatgtaagaggtctgatgggaaaaaaaggaagaaattccacgtagctcagtaaggaaactgaggcccagagagggcaaataatgtactcaaagtcagagttaatggtgtagaaggacaggatgcaaatgaggacagcgtgtgactggtgtgactgctcacgtttcctggttccatcccttccaccaggctgcctcctgaagcaaggcagcgatcagtttctgagctctcatgacccatcttcatagcgtctccttctcaaccagcacaagaaatacaatagtcaaaacagaaaggcaaagcctctctgcaaccctcttccctatttcttcactctcctgacaaaaagggactgaaaaatttccaaaatcaagaagcataaagcctgatttctttttctagtcagactaacgaaacgatttattttctttccactctcttttaaagaaaagaggaacagcaccgctccctggagctattctagcagttaacaacaaagctaagcactacttaccacagaactttgtaagatatcagaaaaaaaaaacagtttacaaaaatttttttagaggcagggttacccgggctggagtacagtggcatgttcacagctcactataacctcaagttcctgggctcaggtgatcctcccacctcagcctcccgacaagctgggaccacaggtgctccaccacacccaactaatctttttttaatttttgtttttatagagacaaggtcttgctatgttgcccgggctagtcttgaactcctggcctcaagcaattgtctttctttggcttcccaaagccctgagattacaagtgtgagccatcacgcccaaccccaagctgtttttcttctactggatgctcacaatgcagaacacttctgtgaccccagatgggggtaattttccctccatataccaagcaattctgcaaacgattctctagaagacaccagctgggtgtcctcaaattcaattctgacactatctacctggagttagatcccacaggatgagggctcagtcccacaagactgccactctgtacttcagatgccgcttgcaaatagtaggttgtcacctatacttctgaccaacaggctattagttggggagggggtcctagaacccctccttggcttccattaatttggtagagcagctcacagaactgagggaagcactttattaatatttaccatgtattatgaagatattgtgagggatacagaacaaagcatggggaaagacacgtggagcttctgtttcctccttggggtcaccaccctccaggaacctccctatgttcaaccatccggacacccatctgaaccctgccctttagggttttcatggaggcttcattgcataggcatgattgattagaccattggccactagtgatcaacttaaccttgagcccctctgccctcctgggaggttggcgttggggctgaaagtcccaaccctctagtcatgccttgttctttccagtgaccaacccccatcctgaagctagctaggacccgccccccctccgccgccattatctcattagcatacaaaagtactcttgtcactcaagagatttaaaggtttttgtttggtttggtttggtttggtttttgagacagagtctcgctctgtcgcccaggctggagtgcagtagcaggatctcagctcactgcaacctctgtctcctgagttcaagcaattctcctgcctccgcctctagagtagctggggttacaggcacacgctaccatgtccagctaatttttatatttttagtagtgatggggttttgccatgttggccaggctggtctccaatttctggcttcaagtgatccacccaccttggcctctcaaagtgctaagattacaagtgtgagccactgtgcctggccagatttaaaggattttaggagctgtacatcaggaaactgaaagaagaccaaatatctgtttcacaatatcaccagcttctttacaattcctcagtaacctatgacttacaattttctctaatacaactgtagtctaagtaatgttggcttacatatcttttgatccttaaagttatattagtatatgtttgttgtacacaaacgcagatgtatacagatactagaacattctttaaggtagcataagttgggaaacaatctaaatgtttataggtaggggcagagtcaagtcattcgtccatacaatggagcaagcgctacaccgctataaatagtgaggcaaaatctcactctctgggacaatctccaagacagggtgttaagtgaaagaggaaagtgcaagtcattgtgtggagtatcctaccatttgtaagaaaaggatgtgtggctattatacatgtttggaatatctggaaggatgcacaaggagttggcaatagtagttgcttctggggagaactaaggaagagaatggagggagggggaaaattacttttaattattctctttttgttgcttctgaattttgcaccgtgtgcattgattacctgttaataactaaaataatataaagtaaataaataatcagcatatcttaccacagcaaaggtggtttaaataatgtctttaaacaattaaattcaataacacttttaaacagagattgaaggtggcttcacaatgggcagggaaataatatgtgacacagtttgcaagaacgaaaaccgtgtctgaaaatcacattaaaatgtgttgggaaacagcctgaagaaaaactgttcctaaaatagaaccaacaataaataaataaacaaatgaagtaagcaatgcaaatttcttaaaagcaccgggattcctgtgtttttaagttatttctttgtggccctaaccccaagttaagtaccagggactccttggaaccgaatggtaccccatggtgggaaaatggcccatatggtacaattatctagatgatttcagcaaaaaatacgtctttgactcagtgttttatacaataggaatagatggggaatattaacaagaattgaaactgtgtgtggaaccatattcaatcaatttcaagtttaattaaaccagctactcttaacccctgttcttaaagagtgcctcaaagagtacagccctatctactctttaatattattaagaatcccaaagggcttttgtttatgtaggttatatctattatatttactgcattagaaaataaaacttagaagctaaaaaattaattcatttaaaattaacattaaatccgtaacaggtaacatagaatgttttcatgaaaaataattacactttccaaaacaaaacaactagtaagaagagtggtgtggttttgaatttttgcaaatctctttaacattgagcttaatagaagacagctggaaagctcaatgctcatgtctgcttctgcattcgatctgtggagtatgtggttttggttgaaatttatgaaggaaatgcaaccttatacagaaatgtcgttggaaaagagaaatatcttgatagccatctcagatcatcatctctctctataaatggatagattctacaccaaaatttgaaaaagagatgtttcttaactactgcttaaagattgcaatgtggaatctgaaatcacatcaatacttttcatattctattacattaaagcccatttggtctatcttaagctttaaacagatctttaacctacacattgttttgttagatttagaaaatattgcttctatagatcttccaaatgctgatacatttcattatacaatattaacaaattacagtaattgatatcaccatccatctaatcaggaaagtttttacacactgggaagctgccacactcacagtttcccaaaatgctaattttcacctgaaaactcaaattttatccttgaaaacaaaaacaaatactgtcagttgtttcccttagaatgacaggctactctgcatttttgggaaaatatctactgccaaaatctaagtatgctttgtctgtcagttgttcttccaagtgaaaatggaagaaacatcttgttgaactcacgacttgggccactgcacaacttcctttcctcaagacagtcacagttctttgatatgagcagaagtgcttcatgcatcttccctttcatcactctgaatactaaaaagatgtgtgttgcggccgggcgcggtggctcacgccggtaatcccagcactttgggaggccaaggtgggtggatcaagaggtcaggagactgagaccatcctggctaacacggtgaaaccccatctctactaaaaatacaaaaattagctgggcatggtggcacgtgcctgtaatcccagctactcgggaggctgaggcaggagaatcgcttgaacccaggaggcagaggttgcagtgagccaagatcttgccactgaactccagcctggcaacagagctagactccatctcaaaaaagaaaaaaaaaatgtgttgctgggcacggtggctcacgcctgtaatcccagcaattcgggagactgaggcgggcagattgtctgagctcagagttcgcgatcagcctgggcaacatggtgaaactcagtctctactaaaatacagaaaattagccaggtgtggcagcgtgtgcctgtagtcccagctactcaggaggctgaggcagaagaactgcttgaacctgggaggtggaggttgcagtgagtcaagattgtgtcactgcactccagcctgggcaatacagcgagactccatctccaaaaaaaaaaaaaaaaaaaagaaagaaagaatgaaaaaaagaggatgtgtgtgtttaagggtccagatttaataacattaataattgttactgttgttttgtcaaggtcattctggaatgcagctgggcttttctttttccccctactgcttggtgatgaagaatatcatgattactagtttggtttggagccaccaccttgattcctgctaaggcactaggagtcttcccaccacaacttttgtaccagcataaatgtcaacacagtgaaaagatgagtcatatcttaatagtatcaaaaaaatagctttaaccacaaaaactccttgaaaaggactcaggggtatagggaccacacattgagaaccacagaattaaaacactttaggctggggaagtcattatattttgtaataggactggaggtagtgtattttccaccatgtgggtaaatggtggagattcagacacagtctgtatagctagtgtttcatatctgtccttatttttgactctgcgaatggccacccaaggctgccaagggctcatcattgagatagtgctgggcttgttaagctggatatcctaactcctgggccttctggtttgaaagatgtggggaccaggcagataagcaccagggcaagccacctgggccacagggaaacactctccccaacagaaaccacttattttcctcctattgaaaataagcctcagagacccaggtggtcaaacaacatcaacaaaaaaaaaacaaaaaacccattttaatctcataagtaggtcagagttgcacatttcatgagaactgggtccaaaagaccaggtaccactaattatccagatatttcagttgagctgatttagtgagcagtttccgttctgcactttacatttttatgaatacaactgtggataaagtatgcgcagacatagagtattctatttcttcttcaaggatatatctctctataaagtgtatttattcatacagtagcgccctcctcccgctccccttatctgcagtttctctttccacgctttcagttactcatggtccactgtggggctgaaaatagattaagtacagtacagtacaatattttgacagagagaggccacattcacataccttttattacagcatattgttataattgttctattttattattatttattgttaatctcttacggtgactagtttataagttaaaatttatcatatgtatgtatacacaggaaaaaacatagtatatgcagggtttgggactatccacagtttcaggcatgcactgcaagtcttggaacttatccccaccagataaggggagactggtgtgtaatatttgtatacaagtattttctttagtatatgtctgtccacaaagtaggctttcctatacccatacatcagaaagacagacatgtagatctatagaaggccactggagaatcaaaatatgccaaaccaaaatatgtcacaccagaatatgccactttggcataaggatttttaaaaaatttttttattttcataggtttttcggaactggtggtgtttggttacgtaagtaagttctttagtggtgatttgtgaaatttgggtgcacccgtcacccaagcagtagacactgcacccaatttgtagtcttttatccctcacccccttcccaccctttctccaagagtccccaaagtctattgcatcatttgtataaggattgttttgaggtgaaggcaattaagaagcagcaaatgcagaaaaaggaggacataaatttccctttgtgaaggtgtttctcctcccatcttccataccaagaggagaccaactcttgtcactggaaacagaaagtcagcaccaagacaggtctgcacaaacaaacctcaccaatatcacccttatctttcattaggttcccctatatgtgtactctcccagtcctagaagcccaggttgctttttgcttgttttgttacttctctgcaaatttatcaccctttgttaaaatggtatataaactcctgggtctaacagcctctttggttcttcacttcttttctatgaatgtcccttcacataaaaattaaaataataacataaaataagatttgtctgtcttttctcctgatggtctcacttttgccagtgtaattaacagaccccagctaaggaacagaagaaggttgaggaaaagttttattttcctcccctatactacatagtccagtatgactgaacatgcattgtcattaagggaaagtgttcagttgagggtgggaggggatgcattggccaaggtctcaagaggagaagtgactgcttggattcagttcttcatttgctcaaagataagccacccaatgccccattgtgttagtctgccagggctgtcatcacaaagtaccacacactggatggcttaaacaacagaaatttattgtctccaagttttggaagctggaagtccaagatcaaggtgtcagcagggttggtcccttctgagggctgtgagggagcatttgctccatgcctctccctagctgctggtggtttgctggcaatctttggcatcccttggcttgtagactcacttccctgatctctgtcttcacgtggacatagtatctccctgtgtgtgcgtctgcccaaatgtccccctaatatccccttttacaagggcaccactcatattggattagggataccctaatgacctcctcttaactaattactcggtaacaaccccatttccgaataaggccatagagttattaggagttacggcttcagcatatcaatttgggggagagacactcaacccataacaccttcactaataatagtagcaaattattcataactaatagtaacatgaggaagaatctaacagatgtggggcagagagagggatggcgaggaggaactagtgcagatatccctaacctttttggcaccagggacccattttgtggaagacaatttttccatgaattgggaggtggggggcagagggtttcaggatgaaactgttccaactcagataatcaggcattagattctcacaaggggcatgcaacctagatccctcacatgtgcagctcacattagggttcatgctcctgtaagtatctaacgcctccactgatctgacaggaggtggagctcagtggggaatgcttctcgcctgctgctcacctcctgctgtgtggctgggttcctaacaggccatgaaccaagtaccggtctatggcctggggactggggacccctgaactagtgggacaagttttaggagaaaacggggctccatccacaccatgagaatggggcactggggttgtacagagccagtggtggcccagtgtccctgtcctatactggatccagctcatgagacagatgcagtttatggtcagactccatgtggtccagtgctcccttgataaagaaggtaatccaatgggaagaaagtgaactgtccctggtcccatcgtcactgggttctctctggcttgtaaggacagccagtttcacatggaatgtctgggacagagtccacacaaatttgatttggtgtcagtgatctggggctttgtggcaatgttctgccctgcttgaggttacaggccaaagttcaaagaccagcaacccaaaagcctggtcactggagtgtagatgctgggtggagtattcacaagcacgctacagaaggcccaatgcctgaagttaagaccataagctcaactctcctgatcaaaaagacaaacactattctcttaacacaaatgctgtctctaggacaaatgctatcaggatgatgaaaatcaattttctgcccattttttgttgttgttgttgttgtgacagatctctggcaacaaaatgctccagatgaaagaaatcaaaattaaatactgtctgcagtttaacactgccaccaaattccatctttaggttgatttttgtgtcctctttatcaaaaggctgcttgattgagaaagtgtctagctcagttatactatggcttgcattgaccaagagaggtatcccagcctcatgacactgatatcgtaactgtcaaatggaggcacttctgtgatgcagagggcacagttccatgcatgagcttgcaatgcagtctctgccatcagggactcaacattctaggatttagttttccagatctgtttctttgatttaatggaaaagatgtttctattacccaccatgctagttttatattaagaccagagttcactggtacatctttttgttcccatcagctttttgcccctcctggggtcctgttgcgtgcattggcagcgtagctcagaggagttgccctaggaaagaatcacggtggagggcagtccttccccacatacatgcaagtcctccaacaccatgcatgtccagcagcaatcttggccgcgttgtggaccagaaaggaaaagccatagtaagaaacagctgtttggcttgaagatgtgttggtttgcttatgtttgtaacttgtttgcttttatgctttgggttttcaagatgctggtgttattggtgagaatggcaagaactcccatgccttgtgaaccacaaccagctcctggcattctcaagttggtggcaagatgcatatggaggtgcatgtcatgtgcatgggaattgcaggggccctatgtggatggatccttggtgcttctcagataagacaaaactacttaggaagcaaaactgtgatgggaatagtggatcacatataagagaaatattttttttatttatagtttcctcttggtttaatttactttttcattataggattatagctctagataagacatgatctacaaactaaaccacaagccacttagagacaacaggaccatgaaaatcaattttccgctaatttgttgttgttgttattgttgtgacagatgtgattcatctctggcaaaaaaaaaaaaaaaaaaatgctccaggtgagagaaatcaaaattaaatactgtctggagtttaatactgccacgagattgcatctttaggttgatttttttgtcctgtttattttatcaattgattacttgattgagaaaaggattgtctgtatcagttatactacaggttgcattgtacaagataccaaaatcattgcagaaccactgtttttcgttctgacagttttactcaatagacactgtacctctcagataactaggaaacgagagtaaagtcttccgtcaataatgtcagaacactaatttactctcccacttctttccttttcctgcagctcagacggcatgggaacccattacaactccctcatagtggaaagcaagctgaggatgcttgcattgggcctgactcaggaagtggtatcaagcgtcaggtccctggggcagctcttccattcctctctctgatgtttgcccccagaggaatgaagattcttctagattttagtacagaatggaggctgtcagtgatacccatatgttagaaaaagccaacagagcaataatgtctccaaaaaatgaaacatgaagcttttagaatgattggaaattacagttcgattttgaattatttgcaagccacttgaagatttcataaacctattgcatcaactctaacaatagtcctttactggtataattatctgcattttgcaggagtagagattgaggtacaaacagaggacacattttgcttgcctgaggcttcgatgaaacttctgacaatatcaggggacatatttatacttctaacagtatttttagctatttgatagacaacagttgcttctcttttcaaagatcacagccattgaggaatccaccatatttctgtagcaggaagaatgtttatctctgtgtcttgtctttctggttaaaggtatttacttccatcacactacctgacttcaaactatattacaaggctacagtaacaaaaacagcatggtactggtaccaaaacagatatatagaccagtggaacataacagaggcctcagaaacaacaccacacatctacaaccatctgatctttgacaaacctgacaaacaacagaaatagggaaaggattcccaattatataaatggtgttgggaaaactggctagccatatgcagaaagctgaaactggatcccttccttacaccttgtacaaaaattgactcaagatgggttaaagacttaaacataagacctgaaaccataaaaaccctagaagaaaacctaggcaataccattcaggacataggcatgggcaaagacttcatgactaaaacaccaaaagcaatggcaacaaaagcccaaatagacaaatgggatctaattaaactaaagagcttctgaacagtaaaatcaactatcatcagagttgaacaggcaacctacagaatgggagaaaatttttgcaatctaagccatctgacaaagggctaatatccagaatctacaagaacttaaacaaatttacaagaaaaaacaaacaaccccatcaaaaagtgggcaaaggatatgaacagacgcttctcaaaagaagacatttatgcagccaacagacacatgaaaaaatgctcatcatcactggccatcagagaaacgcaaatcaaaaccacaacgagataccatctcatgccagttagaatgctgatcattaaaaagtcaggaaacaacagatgctggagaggatgtggagaaataggagcacttttacattgttggtgggagtgtaaattagttcaaccattgtggaagacagtgtggctattcctcaaggatctagaactagaattaccatttcacccagcaatcccattactgggtatatacccaaaggattataaatcattctgctataaagatacatgcacacatatgtttattgtggcactgttcacaatagcaaagacttggaaccaacccaaatgcccatcaatgatagactgggtaaagaaaaagtggcacatatacaccatggaatactatgcagccataaaaaggataagttcatgtcctttgcagggaaatggatgaagctggaacattctcagcaagctaacacaggaacagaaaaccaaacaccacatgttctcactcataagtgggagttgaacaatgagaacacatggacacacggaggggaacatcacacaccaggacctgtcagggagtgggggcctgggagagggatagcattaggagaaatacctaatgtagatgatggattgatggttgcagcaaaccaccgtggcacatgtgtacctatgtaacaaacctgcacattccgtacatgtaccccagaacttaaagtatatatatattgtagggaaaagaaagagagatcagactgtcactgtgtctatgtagaaagggaagacataagagactccattttgaaaaagacctgtactttaaacaattgctttgctgagatgttgttaatttgtagctttgccccagccactttgcctcagccactttgacccaacttggagctcacaaaaacatgtgttgtataaaatcaaggttttaagggacctagggctgtgcaggacgtgccttgttaacaaaatatttacaagcagtatacttggtaaaggtcattgccattctctagtctcaataaaccaggggcacaatgcactgcagaaagccgcagggaactctgcccttgaaagcagggtattgtccaaggtttctccccatgtgatagtctgaaatatggccttgtgggatgagaaagacctgactgtcccccagcccaacacccgtaaagggtctgtgctgaggtggattagtaaaagaggaaagcctcttgcagttgagatggaggaaggccactgtctcctgcttgcccctgggaactgaatgtctcggtgtaaaacccgattgtacatttgttcaactctgagataggagaaaagctgccctgtggcgggagacgagacatgtttgcagtaatactgccttgttattctttactccactgagatgtttgggtggagagaaacataaatctggcttacgtgcacgtccagtcatagtaccttcccttgaacctaattatgacatagattcttttgctcacatgttttttgctgaccttctccttattatcacgctgctctcctactacattcctttttgctgaaataatgaaaataataatcaataaaaactgagggaattcagaggccggtgccggtgcaggtccttggtgtgctgagcgccggtcccctgggcccactattgtttctctatactttgtctctctgtcttatttcttttctcagtctctcgtcccacccaactagaaatacccacaggtgtggaggggcaggccactccttcatatataatatagatgtatttggtatttgcttcctcttcggcaatgtaatggccacactatgtcatcatcgggggtgtctttctatcttgcatgcaagcttttacccggtgcatttgtcaaagtgctcttagctcttggaaaaacaggttctctgctgccataaggaagtgagaagaaaagaactttccagctttctaaaaggcaatgtgcattctgtcttagccacttcccatcacccccagccccactaggaaaagtcagtattcatttttgacgtataaaagtaattgcatctatgttaccttaaccaggctccataattcaagtcaaaagtaaccaaaagcagaatgaaaaacacatggtaaagaatggaaacagcatggtctatcaaaatacctttgcagtttgcttttatctctccttccagacatcctgcctagggtcgctctcttctgctctgcaccagggtcaccctcctcccttccctgagccagcagtcctggaaggcagcctttgatgtgagggctccccactcctgcacctaccttctgcaaaattacaggaagaggctagaagcccctgtgctgctgcaaagaccccgaaacaatgcagaaggggggccaggcactcaggcggagatattttccacttatgttgtggcacagaagggaggtgcatgagaacacacgcacagcaacacccagcactcccacacttaggcacaaatagtgctggggtgcagatgctgccgaggaggtgtggggttgctgagaattagccgggttgctttgaagcttctcagagatctctactcacatggcccttatcactccttggtgaatggtgcaaggttttggctttttctttcttttcctttttcgataaagacttatgttgatagaactgatcaaataggaaggcatttcgttggctctagcctaaaggatcaaactaagccatctgcagagaatggaggatgcctgagaggggtgtgtaggagtaagagagccgcccttggcactgtaagaatccaggcgaaaggaaaaagaaaacctgcaaagatggtttatagcaggggactgcaaattttggtggctgcccacaccaggaagtacattttttacatcataaccacatcaatcaccctcacatttaatgctagaaaaatatactgtcatgaaaaaattctggaaagaatttcttactatgtgaaaagcattctattccctttaattctattttttcctgctctagtcaatttcattttgttgttaaaaatatgctgatctcaatccactgaactgatttcatgacccatgatatgcactatgaaactcacccggagcttgaaacacttctgtttcagtgaagtctggacaagagagagtgtcttgtgaacatgtggagagggcagcagaaaagcacctcaatttagaacaatgtcacaaaagaaaagtgagctccggggcttgggggatggaggtgcaactctcaaatgtcaataatcaataggataaacgtgtccctgactttcgaacagaggcccttgtgagggagttacatcattggtctgcctcaaaagaaactttattcagcatttcttgtcttgcatgtgaaaggaatgagagtgtttgaggttgcaggcaagcatttagatgttgaataatccctctaaaccattgtgcttacagctaaggcagcttcactaggccctgggtgcctgggtgtgaggctttgggctcagagaagggaccccctctgacagggccccgagaaccagcagttacacctgtggacctcacatacttattaaaagtgctctcaaaagtgcctcagtttggaccataaattcaatagtcactctaagtatgaataactgaggaaagtatgtctagagtatgcagtctactttattcttattgctttgtcacaaaaacacacagcccatgtaaattcacctctgatttctaacactgtgatgctcacattaagcaaaggatcaaagcaactgggtaccaggtaagtaatcctgttctgagaactcatggtcataaaaggtctcagtcaactagaagcctgctgagggtggcccctagtctttcccacctggaggaacaaaggtccttttagattccagtcctggaggccctgagccacccccaagtgagtggaggtatgcgtatatgtgtaagggcggcccgtgccacccataggtgaggtctggacatagctcagctgacacagatttgggagccaggggcttgctgagctgtgaacaccccatcttccccaaactacagctcatctccagcttctagtttccctgcaaccccacttcttttgtacccaaataattctcatgtcctgttgacttgctccctccctggtggatcaaacctggctggtttgctgggccttggaattaccttcgggatctttccatccctgagaggttgggctcctcataggccgccagcctgactcggaggaccgtctactaccctctcctgcggacaggcccgcccatggctgccccatgaccatgcttgccctgtcccttggcttcgtgtgggtcagcttgttctgccaccttgctaggctggttcctggagcttctatctgttgtggcctgggttgccacgctctccctggtcacctgtgtgcccggaccctgtgtccctcactggagcactctgagctaggccgcctcagctcttccttacctgctcctcttactgtggggatcctgcttccaggtctgcccttggcggctgctctgtactctgtacagacaccctgttggatgggaggcatgtcatggcctgtccccatgctaggctttcatttttactttgtaacctacttttatcaaacgtctgtggttgcttaaaagtcaataatatatttggagatggggtgagatggattgttttaaaccttaccttcataagataaaacaatgttgaaagttaactgtgagcctttggcgtcctatactgcagaggagaagggcagaaggggatgacctgtcctgtttaatgtggcatacaaaacctgaatctgggatccagaggtttccaccctccctccactgccacaagggggaaaaaggacttaataaacaccaaagactttgccccacaatatgatggtcaagaaatcggctgggagtcaaatcgcagttctgcctcttagtaattggtagcaaaatgatggtctcccaaaatgtgcacatctgaattcctggaacccatgaatatgacaccttacatggcaagaggggctttgcagatgtgattaagttaaggatcatgagatagggggattattctacattatctggacatcccccaatgtaatcaccagtgtccttatatatgaaagatggagacaggagagccagggtgaaagagaaatgtgaagatgctatgctctgggctttgaagatagaagaaggggccatgagccaaggaacgtaggtagcttccagaagctggaaaaggtggggaaacattccttctctagagcctccagaatgcagccctgctgataccttgattctggcctagtgagacctgtttcagacttctgacctccaaaaatgaaagtaaatttgtgttgctttaagacagtaagtttatggtaatttgctacggcatccataggaaactagtacagcaactatagctccttagttcagatacttttctaggtttgttccctcatctgcagcctaggaattgtaattgtccctgcaccaggtggctgctgtgaagacgggacagtgcaaagcaagtcaagagtatggggtactttctgtgatacaacgtgggctcagttcatggtagccatggctgttagtgcctccttgaatccctgcaagtgaccgacaaggttactgttattattcccattttacagacgtggttctgggaagttaaaatcttgcctgggcccagtgtgaacagcagaactaggaccttgtgccctggcaacctgactcgtcagctcccacctcccttccttgacaaaatgcaagtgtagtggaaatttttaaagtgaagtttaagtggtgaacaagggacattagacttgaatcctaacaagaacactgtgaccagtgataggcatcgttggggcttagcaaacgacaccccaaagtgtggcgctgtggcttgctgagtgctttgaattgaagcacactggaaaggcctctgaagcaaagtctctgtctgatcttctcctgtcctcctcttgtttcctttcctcccttaaagcaggtcagagaagccagaaccactcttcctccaaaataaaacctagaaataggccaggcgaggtggctcacgcctgtaatcccagcacttcgggaggccaaggcgggcagatcacccgaggtcaggagtttgagaccagccgggccaacatggtgtaacctcgtctctactaaaaatacaaaaaattagctgggtgtggtggtgggcacctgtagtccaagctactctggaggctaagccatgagaatcgcttgaccctgggaggtagaggttgaagtgagctgagatcgcgccactgcactccagcctgggcaacaagagcgaaactccatctaacaaaaccctagacatattactttaagctttccccagcccttttgtgtaggagttgggtataaagaaattcccaaacctaccttgtctgaaaggagatcctaagacctcattccacagaggtcctgccctgtgtctgggagaaaagactgccccatacagaggccaagatgaatcagagcagacaggccttgctggggttccccactaagtctgttgccattaggccatacccattatgtccaatcacatttttacaccactgtacactcttcctcgactctaaacataaaaatggacagttttctctttgatctttgggtcttcctttctcaagcctcccatatcacgaaataaattagttatgcttttctcttgttaatctagattttgtgataggaatgcctgccatgacccttatgatggggaggaagagttttataacatttcccctctacaatatgaattacagtcaaaaagtttctaagatctcaaattaaatacatgaaaatagattattcacaacttcatcgttcaacagacatttatttagcatctagtagacaccactcactgctgtaggtattgggcatatctcagtgaacaaaatagagtctctgcattcattggagttcacattttattggaggagagataaacatatatgtaggtggatgtgtatatgtgtgagatagcaagtgaaccagggtaaggagctagagattgataaggagtgtcattttagatgaagtgtttaggggtagctctcagattgggtatgaatgaaggaaggaggaaggcatgtgattgtcttggggaagagtctgacagagatgccagcaggtgcaaatgccctggggcagggcagtgcttggcacagctgggtcagggcagtgtgactggtgcctctctagatggacagagagagaaggaagagatgaggtcagattcctagggcctggatcatgtagggctctgttggctatggttggagttaggattttattttgacttgggaagccattggaacgtttgggaaaaggagacacactgtctaatttaagttacaaatatgatcgcaaattttaaacagagacctgtggttaaattgggctcacattggcctctggggttgcctggctgctcctgcccaaggctggcggaggtttgctgacacttcccaggaaagagtgaagcacagcagacaaaagtagaagcagctcagggcagcaggccaggatcctgccggagctcatcagcagccagagtggaggatgtgctgctgctgctgctgttaataaaagtagctgaagggtttatcagtccttctacccaactttcattattcaaacaatgttgaacttgccactatgagtttccaaactgtctgacttgtggagagccctgtcttaattagaaggtcctcatcccacttttccttgctgcctgcagagattttccttctgagagtgtttgtagacatgaaattgtgggtgtgcttatttctcccctcacttggatgatcgcccatgctggttcatttgagtcccaacacatttgcacctgctcatagatttttgcattttcaatttgcaggagtagagaaacagggacctaaaaggagtttgtctcatgcactttccacatctcagctttatgtcttacactcgctattattttttctctgaacctaactgatttgactgtcttgtttgacctctgtctttgattttgggattggaagggcataacatttggccattggttctctattcaatgtaaataaagttgaaggaaagagactatcctctctcacctgctttttcggttcctaaattatatttaaagagagcaaaatattacagtttcctagtaagttaattaaaagattctgaagaaaattggacgcttttcaaaaaggaagtttacagagtttagaattttttcagcatttccatcctcttctcttcccccaacacaaacagacttatacagaggcacacacagacacacgcagagacatgtgtacacagagacatgtgtgcacacaggcacactcacacaaactaataaattagtaaatggaagctttcaagtcagagaatctactccttaagcatacattatcatcaaatgttaatactgattgcgtccaaaaaattccatgtaaaaaacacgtccttgtgctacgtattgaaaggtagggagtgaatatgaaacctggttcccagccaggattgcagaagggaaaagtactagccaagaagagaaacttctagctccttcctttggatttcaacactcctagaactcaactgaattaaacacaacagtttggttcagcaaatatttattagtcagttgtgcactgtgtgcaggttacagtgctagctctcagggtttaactaggatggatgaatacccttcccagcctcttgagaaggtgctgaaactaaagggagaattaaaaacgaaaaataaaaataagttcaaagtcctcattcttcttcttcttcttttttttttttttttgagaaggagtctctctctgtcaccctgggtgaagtgcagtggcacgatctcagctcactgcaacctccacctctcaagttcaagcaattctcctccctcagcctcctgagtaactgggattacaggcacgctccaccatgcccagctaattttggtattttttaggagaggcagggtttccccgtgctggccagactggtcttgaacttctgacttcaggtgatctgcccacctcggcctcccaaagtgctgggattacaggcgtgagccaccgcgcccggcttcatttttaagatgaggtcctttctccgttgtggagacttttccaagtttctagtgggattagtgtgaaactggcattgcactgcttgtatttaaatctggcttcccctgtactgcctctgtgcccctttgcctctcagtgcctcggcgtcctcacctgtaaacaaggaaaccaggaacactcctcatagagccaccctgtacatcctgagtgtgtgtgcagcatacacaacactgctgcacacaccatgagcactcgaacgccaacaactattatctctctaattcagagctttattttattttaaatctggaatccaaatcagtcctattccagattctttatgaaaatgatttttttcttttttccccttttactttggggagtcaagagactttcttatttcatcttacagaatgttgagttttcaaaatgtccaaaagagaacaaagagaagtgaggtagcccttgtccttaagtcattacccacccctcaacacatttagcatattttctggtaccttcaaaggaatcctatcactttccatctccatattgttcacattccttctcacctgtaatgttctcagcctctgctaatttctcctttccttgaggcaccacgtccctttctctgcaaactttatcccaagtattttaaaacattcatagattttgccctcaatacctgaagcattcatttatgtcattcaaaccatgctgtcccttgcatatggcaacagggttgctcttttgcaattgaagtctaatgccaactggatcggaaagtactggaaagaaagacattgaccaggcacggtggctcacgcctgtaatcctagtactttgggaggctgaggtgggcggatcgcctgaggtcaggagttcgagaccagcctggccaacatggtgaaacactgtctctactaaaaatacaaaaattagcagtggtggcctatgcctgtaatcccagctactcaggaggctgaggcactagaatcacttgaacctgggagacggaggttgcagtgagctgagatcttgccactgcactccggcttgggcaacagagtgagactccatctcaaaaaaaaaacaaaacaaacaaacaaaaaaaacaagacattatctttaacttggttgcaccctcggcaatgaataacatggttataagcttcagtttccttctctgaaaataggaataataacaaaattaataataatgtttacctatagtgctgttgtattaaatgagctaaaacatagttactggatataatgatctttcaataaatttcaacttttttttttaaatggggtcttgatctcttgcccaggctgttttcaaactcctgggctcaaccaatcctctcacctcagcctccgaaactagctattatttttaatagactaaatcattctggttggttatttatgatttttataattggtggtaataattagactgttttatgtttgcatagaattttgcattacgaaaactttcatgatcagacttagtatagaaaatttagtaaactatttaaaatgtagagaaaaatgtaacattactaccaatcttatccttcagaatcaataattttatatattttggtgtattttttcagttcatatattatgaatattgctttctagtttgagttttaaaaatcaaaagttctatgcaaactttatttttgatggttgcatatattccatactatggctaatcatattttatttaaccatacttcacttttgagctattgcactgtttattggttttagttattacatattattacatatatgtaatgttttcatataacccattgtgccttcatcttaaccatttcatcttcctacaaaggatacgacttggagtagaacattcaaatcatgtcattttctattttgtgttcatacgaaaccgtgaactgataccttgaaattactctagatttatctgcacagaactaagcccaggcaaaaagcactatgatggcttctacttaacgtgaaagtaggtggttcccatagccgcttcagataccatctagacatgcttactctttaaagaccagaatgacagcactttgggaggctgaggcaggtggatcacctgggatcaggagttcatgaccagcctggccaacatgacgaaacactgtcttcactaaaaaaacaaaaattagccggacatggtggcaggcgcctgtaatcccagctactcgggaggctgaggcagaagaatcacttgaacccaggaggtggaggttgcagtgagccgagattgtgccactgcactccagcctgggtgacagagtgagactccttctcaaaacataaataaataaataaacaaacaaacaataaaaaaagaccagaatgaaattcttgcactttcttcttaatatctaattatctgctcctccttaataaaacagatcaagtatgttttatgcattgttgccttgatatggtcttagttcagtttaatttttcagtattactttttaactataacaaaagtcctgtgttaaaatggatttttattcctcttttctccatctaaaatgtatccattaaattcaaatgaagtatcaaattgtaaaacattaaattgctcagaacttatgtgagttcttttctatttttcatccacattttagtgtattagagattaagtgaggaggtgctgacaaatcaacggtaataaaaaaaaatcagtaaaccagattttgtggggtgtggagggcatgcagatcaaggcgcaaggtggttgagtttttcatgattcaaaagggaccagtaatagtgtagaagtcaattaccagatcatactttgaactgatgttatattgctatattctaataaaatgtcttatctaaatctttatccttttttacttctcatctatccaactattatgaatattttaatatgttgactaaacaaattggtcataatgatatatagagataaccaattttcaaggaattagattttgaatctacagtaaaagacattggccataaattggaagaaagaagattagcaaataacttgatttatatatacatatatatatgttttgttaattattatttacagtttcccacataatttaatgtttttggattcaccttaaaatatctcatagtggtatttttttaaaaaaaacgaatattaagttaatggttaatctttcaatcaaagatatcttagaatgaataaataattaagataaacaattaactgcaaaaatagttatctttgagtagtaagactatatatgattttccattttcttctttttgctggtctgtattttttatagtaaacagattatttgtagagtgaaaaagatataaacaatcaatataattttacctctttctttggtggggagagaatgaattagaatcagtctctgggccatatcttgtaaatatgaaacatttcagagatcggtagaaagagtgcaggtccctgtgctttaggtcatgggaatgcagtgagaggcatggcttggcctggccttggggatctgaaatcaatggagaactctggaagccctgaatagaacaatgaaacctaaaagtacgaaacctgctgaaaggcaagatggtgggtgagcagtcagggaaccccgtattggaaaatatgcaacttttcatggaagttatgcattaaaatattttttaatataagaaaatgcctccaaagtgtaatcatttgagtggattagtcacctactcagttaaatacaaaaacttgtgtaaggggtcgggtggatctcaacacataatagaccttattccagcccatcctggataccccaaaaccctgacttggtcattacacattctatgtatgtactgatacacattctatgtatgtaccgaacactcacatgtaccccataaatatgtaaaatattatgtatcgataaaattttgaaagcctagcaataaaataaaattcaaataatattcccaagaaacaaataaaacaactatagtaaacttacatatagcaaatatgagctacaatagcattaatctgtaaggcaggtgtttattaacactatctttggacgtcagaataatttagaaaaataaactggactgacaactttatttttctttttagattagacttgataaagtgtcttacatggagtctggctagaggatgtttatatatatgatgtctattatcatatatatggcatcctatcaatattgagattattacacaattggccagggcattactcaggactgtgcattttggagtttgccctgctctggaaattgtaaaatattcatgcatttcctttttaaagcatgcaatagctctctgggctttcaaaccatcagctgcgaagagtcatgttgcataaacacactttcccagagtaatcagactcatcagtaatttgtcttttcatcccaggctttccggaaattctgtcagggagaaaaagttcaagtgcactgtggttttctccctttccaatgtttattttataacatttcttcttttgctttccccttaaaaaatgttttccgttgttcaaaacagattcccactgaaagggggcagaggttcaattttatttaaatctctcctcattcccaatgagcaggggttctctatcttcaagctgacaccccctgtagctctgggcagggtggcttctgttcttgggctctgccgttggtgggagccagctgccagcaacacctgcatctctgctggggtcagcgagctcccagtgcctgagagcttcctcccagggctggacactccctctgcatgcaacaagatgcctacagagctgctgcagagacaggctgggaaggatggcaagggtgagagaagggcacaggggaaccagtggcccttacctgtggttttagggttctgtcttctgtcctccagcccgatgagcagggacagctgctgtgcaggcggactgcctggttggatggccccaaccttctgtgcagctgccagccagctgcgctgcccttgtcagtggcgctataaataaggcacgtctggacattggccaggcctaggagataagaacccagcccctggctcccacgtgccttttaaggtctccagattaaagaagcctcagctcccagatgggaaggggctgccatgtcctcgtttgtcctgcctgcttcaaggacacacgaggcctcatattttccaggaatccaaagggtggctaaactgggaaggccaccagcaccagaaagggacctcacttt

SEQ ID NO: 205 - DNA, 38293 bp, Homo sapiens
ttctgttctgaataactttattgcaagtcacataatcttggtttagacttgacgcaacgggaggttacagagctgtaaataacaactggtcattaccttattgagtttagaaaactttcaagttcgtgacatatgttaattgcacttaaatagacagtgagagaaagatttataaaggcatcattcaaaaggatttttacatttgggtgtgccttactcgattacaaaaatttcaaaccatcttcccacctagggcctagggcgagttttctctttccctgggactgaactatcacaaagcactaaagggtttaagcaaacgtgagtatcactgaaaagcactagaagaaagtctcaatgtggctggaagaaaccagaaggcaagattgcctgggtgagaaagaaaacataaaaatctgtgtgtgagatcacaagcagcaacttctctgtgttgaattcagatgtctttcccacagtcggggcacaggatgtcgtccctctctgtgaggaagccacgccccaccagtgagagggagcacttcttacagttaaagcagtcgttatgccactgccgttcctcaaaggagatgtattttgtgccaccaagtcctgttaacagagagaaaataataccggatgaagaaagttagaatcaggcaactgggactgaagaaggaattctggtttgatccatttcaaagtttggattgtgtaatatggataatgtgaatttctagtgactgggtgttgggaatccatatgtaaatcagattctatgcacagcctggaggatctcgtgaatatcagaagagatatataaactggttccaaaacgatgggataagtgcgatcaaagaatgctgactgtgtatttgttatgtgttttcccacaaaatgaaactccatgagaagagggagcagatttctcttatgtcttcactaggtgcctcacgttgcctggtgctcaaatttttatgacttaatgattgaagcagtgaagggagtgtagaagaggaaaaggttaatcctccctgggatggccaggaaaggcctcacagataaagtgcgatgtgggtgggaatgaggggagagggatattgtcgcagtgggaagatcctgagaaagctgcagacagatagaatggaatcaaatatttaaggtacattggtccgtgattataatacagttggtttttacctagtgttttttctcagtgccacaataaccacaattcacattcatatctaatgttttacatttaaaagtgcttttatatagattgtatcactttataaagcttaatgttataaacatttacctcaacagaagttactgctgaaaacagcattaaagatgaatatgttctggcaaaagattacattttccccctaaaagattccaagggaaatctggtatataaatgaccagaaacagatattttaacataggtaaagtgtaaatactgtgcttttcttcatattttaatttcacatggaaatgtaatgagctctgcattacacatgagagtactgttttagcgacctgggaaggtgagttagctgagttaggtgaacttggttctaggcctaagggaaaggaaagtcaaggacaagtacacagggggtgtatagatgtgtttctgtagttacactgaaaagccacacaggaaagccaggccaccgggtactccaagtgtctgccaccttcctctgataggaacgaaccagtcaactgaatgcaacgggattgcaaatcccacatcataaaacttctcctgtgttattacagaacacacacttttctctccccacccagtcactcatttgtgtagcgatatgtggtgaccatttaaaggactttagtgtgaactcctctgttctccacactgaatttctccagcctgcttaatagtctagtccagaagcctggtctgccagccagccagattttgggctctcacttagctgaattctttgggggaatacaatatgaaaaactccttagaatgtaccctctgccctcatatagctatggccttgtggtagaagtttcccattaagatgttttggagtacaaccgtcccactaagatgctaggggacacttctaagaacacagcacagctgctaagcctgaaaaggccagtttttattgtgcttttgtgatgtcacaggctcacagactgcagttttagcgataatccaacccaaagcagaaactaaactggagcactggccatatggttgtgatcaggtgggctgcagaggaaggaatcattacttgctgaagcatagccagtgcaccaaggagaggaaagcagataggcagaaaagtctgctgtgttcagagccttagggaggtctggggagttgagggatatagacagggtcacaggctaaaatgctaggccttgttcaagcttccaatcgcccctggaaatgggaaccccgggacactcaccgctgatggggttggtgcacccagcacacttcttggcatacaagtcacagaagcagttcaggcagtaggcaaagtcatcgcgagctgtgaagcgctgcccagacagctgcttcctgcaggcggtgcacacgaagcactccttgtgccagggctgctcccggtaagtgacccctcccgtggtgatgggctgcagggacgagggggagagttagtgtggcctctgtgcttggcagacatcttcagtctcagctactgccactggacgatgcaagatcctcatccagaaacgtccagtttgttaagtcaccaagaagctgctttacaaacttcacagtcactcgtcaccctcaccacacgctttcattccagtgtcataggccctggctttcccgttagtgaaactggagcttggggttgccctcagcccttcccagggatgctggggatctaaggcatagggtgcctcagtggtgttgccacctttctgagcagggaagcagcacagtggaggggtcgggattcaatacagcatcaaggagacctgggtttgaatcctaaccctactccttaccagccctgtggctgggagcaggtcatgataaagatctctgcacttcagttttctcatccaggaagtgagggtgatgaggttaattgggcaagttgatgaggagtccttacttagaagcctggcagggctggtggctcacacctgtaatctcaggactttgggaggccgaggcaggtggatcacttgaggtcaggagttcgagaccagcctggccaacatggcgaaaccccatctctactaaaaatacaaaaaattagctgagtgtggtggtgcacctgtattcccagctactcaggaggctaaggcaggagaatcgcttgaaccctggaaacagaggttgcagtgagccaagatcatgccactgcacaccagcctggacaacagagtgagactgtctcaaaaacaaaacaaaacaaaacaaaacaaaaaccctggcaagtggtaacctctccaatgccactcacgagcctgtctctccagccacttacggtgaaagaaggaagaggcttaaaggacagccgggactagcacctgctgatgccacaagaagagatgggcatcttggaagttttgggaaaaataagctggatgccttcattctcacctgtcttgtggtcttagaacatctgtgaggtgaagctgcaaagccacatgaggtggaactggccatcagtacctcaattttacctgatatttttctccaaatgttgcatctcacattctatttaaaaatgagtgcttggtggagctgagtaagctatcagagaggagtgtaggtggcctcagcttggcaaacgaaggctgtggaagatggagtgcaagcacctcacaatcacacttttttgctttttattttttgaacatttcagtatcatgcagtaactcctttggtctttacataaagcttgtgaagtaggaaagatattatcttaattttatggatgagtaaactgagactcagagaaattaaaaagtgacttgccaaagaattcatagctggttaatgacgaagcaggaactagaattctggactcccttctatcttgtattcttttcattaaaccataaatcatgaagcatcttagtataacccaccccactgcacaagagaatgaacaccaaacacgcttggttgcaacgtatccatgtgaatgcagtagcctgtgtgtgtaagacatctctgcctgcaacatgtgtcctcagtcctcccttgctccggattccatgcttcccacccacatcagctaactcaatgcctctgagcatagcatgactttctcagagactccttccctcaacaccaccctggcccccaactcctcagattagttgaggtccctccattccacactctgctcttctcctccatagcacactgctcagtaactactgacgggtttgacactggagtgtacttccacctagactacagttaagtgtctgcatcttgtccagcatcagatccccagtgcctgagagggccaagttcatgtcgaggaatggatgcttctggcatgaatgtttttgtgtatttaatgaacatgcacacaaaaagcatgcatcccagaaggatgtgttgctttcatttctgcaaatgaataaagcacacattggaaagatgacagaggaagagcaactcagatgaacttccgttaggtcttgatgagaagaacaaaccaaaataaaaataaaaaggggagagaacagggaagagggttcctaaaataaaagcaggaatgagagctcaatctaagaataaagaaaaaaacaggagtttgtgaccagtctggccaacaaagtgagacaccgtctctactacaaaaaaaaaaaaaaaaaattaggtgggtttggtggtggcacctgcctgtaatcccagctgctcaggaggctgaggcaggagaatcacttgaacccagaaagcagaggttgcagtgagttgagatcatgccactgtactacagcccaggtggcagagtgaaactgtctcaaaaaaagaaaaaaacagaagcataaaaggagaggaaataaagagaaataaaatttaaaataacagtaaagaacaaatggggccaggcatggtggctcacgcctgtaatcccagcactttgggaggtggaggcaggtcgatcacctgaggtcaggagttccgagatcagcctggccaacatgttgaaaccccgtctgtactaaaaatacaaaaaaaaccggctgggcatggtgacgcacgcctgtaatctcagctacttgggaggctgaggcaggagaaattgctcgaacccaagaggcggaggttgcagtgagccaagatcgagccactgcactccagcctgggcgacagtgtgagattctgtctcaaaaaaagaaaaaaaaaaaggaaatgagagaaagactgaatggaaattggtaagaatactcagcacttagaaaaggtgtgggcaaggtggggatattcttgcccaggccagccaggtacaggtagcagcattggggatgtttctccatggcccagacgcaagggtagaggccccaagggcaaaacagcagaagctgggtgagcagagtcaataacaggaggagagcgaacagaacctgtgatgagttccacagctggcgctgcccagggcgagtgagcagtgggagggtgccactcaacaggctgatgcaaatcctaacaggacagagacgctggaagctatagcataataagaattgcgtgtgtctaagagtcagagggcacagcagaaaactaagctacaccctgaagggtgcaggtcggggggcaactgggcagagagatggcttcctacagatatgcagttccctttctttctttaaccctaacagagccatgactggaatagcacattatcgagtagataagtttatttatttatttttttaattttttgagatggagtctcgctcagtcgcccaggctggagtgcagtggtgggatcttggctcactgcaacctccacctcccgggttcaagtgattctcctgcctcagtctcctgagtagctgggactacaggcgtgtgccaccacacccagctaagttgtgtatttttagtagagatggagtttcatcatgttgcccaggctggtcttgaactcctgacctaaggtaatccaccagccttggcctcccacaggtgatccaccagccttggcctcccacagtgctgggattacaggcatgagcctccatgcccggccagagtagatacatttaataaatgatctgtcccatatccatggaggcagacttttctcctttacttttcttctcacatccgtctctctctcctcccttcctctcctccctcttccttccatctttctctccctctcaagtttgcagttgttttcttgttttattcatggagagaagctgaacaagacagctttgggatggtggctccccttccctctaacctcaggttatcaacataagaacatatttagaaatggtctagaagaaggcagggttaaacgatttgatcacagagctcaacaatgttgatgtctttgaaagaaggatggacacccagacccgatggataaatgctcagaatgtaaggcaggacaggcacagctcccacgccacttaagtatcacaggtatccttggttttggaaagagaactgacagacatggaccatggaggcaaaccagccagaacgtgcaagggccaagggggcatctgagatacctttttgcactgaacgcactgcatggcatgttgtttctcatagcagggcacacagaaattctgattgtctttggggatgaaactcttggttccaattggctgctggcagcggtggcagatgaagcaggtctcatgccagctgctgcccttgtactccatcttgcgggtacctgtcatcagggtcaagaggaacacagcagagttatggttagaggggtgtggagtcccagcaatctgccttcagagcttgctgccctctagttttatgaccagagcaagccacttcagctcttgaaggctcgcctctacatggaggtaattcctattttgtgcagggcgtggactttgtcttttggttcactactgtacacccagctcctagaacaacacgtgtacattttaggcacttaacatttatttattgaataccgtggttaggaatgttaaatctaaaaaaagttaagtctctctcagcaatgcaaagtataaagagaagtgtggcatagctccgatgaattcccatggagcatgacttttggagtctagggactgtattcacctattgcacacctgataatgaacaccccgtctggttcacagcaggatggaaatggctagagtgtgaatgaacctggaacctcgaacctgattcagtgagcagcctctacaacactcactttacatactgcctgttgaaccaagttgtgatgtatctaggtagttttatgcactgtactaagtgctataattaaaacctacatgtagtttttttttgttttcgagacagggtctcactctgtcacccaggctggagtgcagtggtgcgatcctggctcactgcagccttgaacatctgggctccagggaaactcctgcctcaacctgagtagctggaactacaggtgcacaccaccatgcctggctgaaatcttcatgtgttacttgtacatcccatttagtaattgcctaaacctacgccatccattgtcttttgaataactattagcatttgatacatttctaccatttctccaagtgaactgaggagctctagagaactgaaacacttatgggtcacccctgccaccaccaagctggactcactgcaagtgctcggtgtctgttgactgacattttttcatttttgtttgccagaaagaagtgtatctatttatagtaacggatgattccagataggcgtataaacaagtacccttcatataaagcaaaggtaaagaacaatctggggaaataagtatcagggacaaagaaagaggaaagtgttgtaagtgcccggactagctgaggggcctggccactgtgtaagaccaaatccagactgctgcctgcttttcaaatgaagttttattggaacacagccacgcccattaatttacttccattgtttacatccgcttttaagctagacggccgagtagtgtgcagctgtgtgcagttgtgcagttgttgtgtagttgtaatagttgagtagttgtgacagagactgtatggtccacaaagccccaaatatttatctgatttttgaaggaaaaatgttgccaatccctggggactgtggcatgagggtcacatacatgtgacttcaactgggggtcagggaatgatggggaatcaagccgacagagggactgccccgctccagaccaggtggaagcagctgcagtaacacaggtggcttataggagtctatagactagtccatagctctcagccccaaaatcttatggtcccaaggacaaagctaggggttgtattttagctggctagaaagttggtcatgaaatgtctgtcctccagtaattaggaatgtgctgagaattatcacgattgttatttaggatcattttctcagcttcctgtacttccaagaccagacatttgagattatataaaataagcagggtgtgtgttggggggcaatgtgtgagagggaatttgggatggtgacacgcagcgatcttttaattcaaaactaagctgtacaatctatggaattcaattgtggggtgatgaatcctaaaacaaacattacatgaagcaattgaaattcaagtaaaaatagtggaaggactttgaattcacaaagattttcttcaacctccatgcatacttttgtcacttgctctttggatctctgacattcattctgatcaagcagcccagaagccaaaggattttgccaatgaatatggggcaattatgactctcatggcattcttgtcgagttctgaaataagtctgatcagatcaacaccagttcgagggcaactctacgtgcagggaatgcacagggcacctggagcctcagggacatggcgcgtgcacctcaggcatggcgacagcagtggccgcaagcctgcatggtcatatgcagcaataccggcaggtggcaggagcgttccttctcctaactgaatcgcacactctgaaccaagtctcccgcaggcggaagcgcagtcttgaagaagggatgtcttaatctgattcaaatagtcaaatgaggctggctgcggtgcctcagccttgtaatcccagcactttgggaggctaaggcgggagatctcttgagcccaggagttggcgaccagcctgggcaacatagagagtccctgtctctacccccccaaaaaaaaaattaggcgggtgtggtggtgtgtgcctgaggtcctagacacgtaggaggctgaggtgggaggatcatttgagcccgagaggtcaaggctgcagtgagcagtgatcgtaccactactctcccgcctgagcgaaagagcgagatcctggctcaaaaaaaaaaaaagtcaaatgaggagccagaaatttggttgcagggttggagacagaatcgctacttgagtctgctcagaggctgtggtgcatctgtaagcaacgtctgctaataggggcgcgagagccggtaaaccccagcactggggttactgatggtattccagtttcctgattggtcatcaggaaactgacttgtgtggggggtgtggagctggtgggtgagtttttcacttgtcctctaaatgtaaattcaccgcaaaagctgtgcactgacgctgtaaacccatattcatcttgaatgggttctaacacttttaaaaatcaaacccaggcaagcaagtgctttgattcagtgttttgtcggtgctggtttgttttgcatacaccgggattcttctagacgccctgcctttggtgcccagtccgtttcttctggcagaggcacctgtaaaatggggatgaagccatccaacccagggaacaccgaagattcaatgggattctgtaaagcagcagggtctgacgcctgtgtgtgtgctcaggggctggaagctgtagctgtgttgttattattactacacagcatttcttaccacagagcctgaattcttgcttcccccattccttagtagaagaggctgccggccagttaattctcagatattcagtatgggttacctctcactgaacattaggtttttacttcttatctgatcatgtttttcttttctttccctccccagtaaacaccatgagaaagggaaggtgtgatggttaattttatgtgtcagcgtggctgggctctggtacccagttgtttggtcaaaaaacaggtttacttgttgccgtgaaggtgttttttagatgtgactaacatctaagtcagcaagcttcgagtgcagcacgttacccacgtatcagggccgggcttcatctaatcggtagtgggccttaggggcaaagactaaggtttccctaagggcaactaattcttctcaagactgcaatagacacaccctgcctgagtttccagcctgccgccctacggaattcaaatgctcccatttggaactgcagtatcatctcttccctgagcctccagcctgctgccctgttctatagattccagacttaccgcctccacaatctcatgagccaatcccttgaaatctctctctctctctctctctctctctctccttatgtatgtatctatgtgtatacatttccttgattgattctgtttctctggagaacgtgactaacacagaaagtcaagacaggtgaaaaattcaaaatccgggaaatatgcatactttttatgtcatggttggtgctaacagttaaagtctttaaacagcccctagagtccccagtggaagcttccttgggcccttgttcaggaaactagtaagggtttaatttgtttttcaattaatgtcgtggttcttattgttactgagtgttgtgtctctgcagtgactccctgtggggcaggacacaggtcagcctggctttctacgggcttcaattctcatttgcactgtcgcacagcactggggcccgagtttccagcctctgcaggatccacatgatcttagaagaggccttcttgcctggagctgccccatctaaagtcaccatgcagcccttccagctgttttcccttacagctgccaacagggctgggactgtgtcagcctgggcatttttcttccctgtcatagtgtgtcacagttgttttaaagttatattaaccagagaaatgtagtggcagtaagaaaccatcttaccaaaggtcagattacctccttgcctttttaaaaaatgattattccttatcctacataactttcttttttttttgagacggagtctcactctgtcacccaggctggagtgcagtggcgtgatctcagctcactgcaagctccatctcctgggttcaggccattctcctgcctcagcctcccgagtagctgggactacagacgcccgccactatgcccggctaattttttgtatttttagtagagacagcgttttaccatgttagcctggctggtctcaaactcctgacctcgtgatccgccctccttagccttgcaaagtgctgggattacaggggtgagccaccacacctggcatcctacatatatttctaaactatttcccatatgtcagtctcttcagtatttctttattatcaaaaacaaagcaaaccaacatgatgaaaccccatctctactaaaaatacaaaaattagccaggtgtggtggtgcacgcctgtagtctcagctacttaggaggctaaggcagaagaatctcttgaacctgggaggcagaggttgcagtgagtcaagattgcaccactgaaccacattggccaggccgatttcaaactcctgacctcaagtgatccacccacctcagcctcccaaagtactggaattacaggtataagccaccgcacccagcttctttctgtattttgaaattccacatatttttgtccactttgctttttaaaataaaagattctgctctcctacataaaaaacaaaacaaaacaaataactccccccacatacacacacaaaaaaaccatgagggacacagtcccatcaacacacaaggcacctttattgccatcctcggcacctggcccagttgcggctgtgccctttttgactgtccgtctagaacaccaactctacaagggcagaggaccaggtgcacctcggctcacaccctacgaatgctcagctcgagcccagtgcctggcacgcaagggcaccatgcacacttggtgaaataactgaatgagtacaaattcagcaggtagaagggaagaaaagagaaactatctatggtggtgggagagtgggggctgatgcaggagatgtatttttaagggggatacccaccattttcttactctaacaatttgactgcataacactgccccacgtgcacagcaaaaagatcccgttactgcccatgatagaacctgtatgtccctgcttcgtaagtactctaaatactcctctgcagttcaaggtcaaactggaaagtcaacacgagtgtctggaaccaagtcaatgtgaacagggggtcagaggaacgtgcacaaggcttgaagctagactggctcacgcatgagaaaggagtgcctcctgacctggcatgatggtcttcttgcattcctggcacttggatgagtactcgttggaatagcagtctgtacagagcagctggtcctccttggcagcaaagggcttgtccaccagtgagtttctgcactgcgagcagtggaaacaggcttcatgccagtgccggtccttgtaagacaagtcctgtggggccagaccacacaagacagtcagaggcaggacaggagggcttggacccacagcataggggccccttgcgaatctgcagggcaaacaaggaaagaagttgggccgaggcaccctggcgcacccacattcatgccccaggaccacctaactgctgaaatcaattaagactaggctgcttttctcttgctgcattttagagcaacaggttagacagatgtgcatgtatgcacatgtctgtgtgtgagagatgcttctaaaaaacaaagggatttcccttatgtattgcctgcaagaaagagaaacagaaaacatgaacacctatcaattcgtctcacaccacatccggtgacagagaaacagactgcaggacatccttggctgagggagccctgcccaactcagatcactgtggtcaccggcatggcagagaggctctgggtgtcgggatgttcacaggaggcccaaggactgtttggtgggagacggtcaggagagactgtgtgtgtgggtgctacctctgtgggtggccgtgagctgggggaggaagggaatttcaggcagagaaagagcacagacacagaagatctggggacggggggcatgtcagattggagggaccacaggccaggggcgaggtgggagggccccccggcctggctggactggaagatatggctgcctttttgccttttatgtctgtgtagagattccattgatcctgaaggcagtggacagctgcttttcaacaggagagtgaagtgctcagactgggggacgggtaaggatgtgggagtggaggggcgtgagggtgggagaagtgagacaaaaactgagcacacatgagagaggccctgagaagacagacgtgtgcttttgagtaaaagatgagggagagaaaggagccccgcagaaaactcgactccacacttggcttcatcttgcctgaggaataagagaaccctccatatttgccttttaaaaatgacatacggcatttttaaagtgccaacacaaaattaaaataacaatctctttatgcccagctttatcttagaaaggatatgtttctattgctgtctttgtgttcccagctctgaccccaaatcatcatccatttatacatgaggcagaaacagagtattaggctctgcacggtttcctgggcaggcttccagttggtaggtatcctgaacagggcacaggagggctgttcacgcgatggccctgaagaagagcctgcccacgatgtctctgttactgaaaccgaagtcgaagctggagttatgctgaatgtaggatgtgaagacatggatcttggccttgattagaaagtcctaaaacaccagctaactcggaaccaaaactagaacaaacagttctcttttgctgaagtatgtgtgtgtgtgtgtgtgtgtgtgtgcgcgtgcgtgtgcacatgtgtgcatgtatgtgtgttttcccggaacctggaaccaaactagttatttgatttagtgatctctttgcgcattttgttttagttcaaggaattttaaaaatgtgaacgctgagacactttgaagacagtcatgactatggcctttgtgaggggtgacctcttgtgctatccctgttggaagtttgcttcctagaacatctgggaataggattattgctgacgcaagacgataaagaatgaaggagaggtcaggagttcaagacaagcctggccaacatggcgaaaccctatctccactaaaaatacaaacattagccgggcgtggtggtgcatgcctttagtcccagctacttgggaagctgaggcaggagaatcgcttgaacctgggaggtggaggttgcacagccttggtgacagaaggagactcagtctcaaaacaaaaggaatgaaggtgagaggagcatagagtgctctcaaagctggactaaatgcccttgtttctgcggaattcattctcacctgagcccagcacctctgggtattgtgggtcccctggggtaggcactgcctgtcagggggactcgggggcaggttgctgaaatgcccaagccctcttcatccttgagaacccaaactgggtatgcactgggagttgggggcagagggctaacctgtcttttgtatttttagcttaaagtattttcagaaatctgaggggaacatcacctgtgctttattggttattttgacaagtgaaatagaggacaaactgctttgatttgagttgatgtctacacatgtgaactcatgagaaacagcaaagcccacaatccacatggacatcatcatcgttcgggaacaggcatggtctccattctttccatgcacacgccccggcttcaaaaagacatctgaaacactagtgatgaccatcattaccccatctgtgagctccaggcacggcacagccctgcaaggtaaatgttattactgaaggtcagagaagttccgtaacttgcccagtcacatacctggcacggagctaagccaagcttcgagctcaagtcctcctgatgcgaaagttatttccactgaaccagcccaggcaaaatcctggtcgggtctgtgttactctttgctttcaaaacagatagccttgaggagatgtgtgtgtgtgttcatttaaaaaaatccagaaacgaccaaactctggcaactttctagaacatattttgtacctaaatgaatgtggctcagtattgcctttgtttagactttgaataaaattgaacaaatcattagaagccctatccacccaaaacagtaatctgcctaatttaagaagagatggagattttattcatgttatcactgttagaatgctgattgtggaagaaatgcattaagaataaattttgtgtggaaaacaccatggctgatattaaaagtagaattaccatatgattcagcaattgtacttttggatatatacccaaaagaattaaaagtaaggtctcgaagatatatttgtacatccacgttcattgaagaattattcaccatagccaaaaggtgggagcaagccagatgtctatcaataggtgaaggggtaaacaaaatgtggtctgtgcatacaatggaattttattcagccttagaaaggaaaggaattctgactcatgctacagcatggatgaatcttgaggacatgacgttaagtgaaacgacaaatcggtcacaaaaggacaaatactgcatgatctcacacatgtgagatacttagggaagtcacattcatggagacagaaagtagaagagtggttgccaggggctgggatgagaggggaatgggagtgagaatgtgttctgtaacccattcatgcctgaggttgcaattttttgaatttctgcaatcagaccttggcgatgatcttgagcagtaagatatacataactcccacatgcttagcattccactaatggaatactaggcgtaaatgggcttgatgggggtagtatttcagatttgcaagaagcaaaagctctggggattggttgcacagccatctgaatgcacttactactgaacagtactcttaacagtggttaagaaggtaagtgtgatgttctgtgtattttaccataattaaaagaataaaaaagtaagttttggccaggcgaggtggctcacgcctgtaatcccagcactttgggaggccgaggcaggcggatcacctgaggtcatgagttcgagaccagcctggccaacatggttaaaccccatctctactaaaaatacaaaaattagccaggcgtggtggtgcatgcctgtaatcccagctactcaggaggctgaggcaggagaatcttgaacccgggaggtggagggtggaggttgcagtgagccaagatcgcaccattgcactccagcctgggcaacaagagtgaaactgtctccaaaagaaaaaaaagtaagttttgattgttatgtagcaggtaaaaaacaccgtttcagaagttacctctgtccccctgtgcaggcgagccacctcatagaggactgctcgtttggggaaaagctgcagaatgttttccatgacccaagagtcactgtctggctgggacaagagacctgaaggagtaggcgccagggagaggggaggagatccttggcctctctctgggaagatagttgctttttacatggtggctgccctgcccagggaggaggcattacgcccagaggggtggcaagttatcagtgacaagagagggaagagaaatacaatttctagaaaatttgccttttgggactgaccttcaagaaaaactgagagagaaatctccaaggtcaacaggaaagcaaagccactagatgtcaccacagccagtgctccggtcattaagtccccagatggaggaaagagcacatcagcatgcctgcacagacatggaaaagctggctaagacatgcacatgggtccaaggcactgcagaattccatttttcctacagttaatatttatggcacaaaaatgcaatagctacagtttaagactgattcattgacacgtgacacttgaaactgtccctctaaatgtggatattatccacatgttactggactaagcatccatgcaagacttggagaccttctgcaggcgcagcctgtccccccacaccctgctctatcggatcccacctcgcaaggtgaaggccgcattctctcaggacaacctggtctgctatatcccctgggaaccatttcgccttggctcctgccagatgctgccctttcccttcaggctggtgtagagtggacacctgaaagtgctccccatcccattcgggttggggcatgcagagatccaggttttgtcctaagaaacaaaagacagagtgccttccacaaagtgcctttgcctgcccagggctgcgttatctcggcatcattccctggggccatctgcactcagctccgcaacgtttctctcagcctacctttatgactgcacacacaagcattcctgagtgaatatgcgtgcagcagttcctaattctaaaaccttctaaaggaaactcttttccctgaagataaatattaacctatgctcacgttcttaagttttgtggtgtacaataactaaaaatactctgtaaacaagcttgcatcattgttgttggtgggtcctcagtgggaacagaactggcccacctccctgctgcagtacagggtggtgggcttcctgggccagaaatgcctgaatgcctgctgcatgcaagcaggatgggagagcatgaggtcccacagtccacatctcttgtatcactgtgggtcaagcgcccgcccctctgggatcccaggagcacgtgattaaattgcttggttatttcaccctaggggttcaattcaagggcccaaatgccagattgactaaacttaaatcctggctctgccctatgccacgtacatcaccattgggaagtaattgaacctctcttgccagatttctgacctgtacagcaggaataatggacccactactggctgtaacaagcatgtataacagttgctggtatgtattacaattgctcaatggatgttagtataagtcattatttagaccacagctaataatgagaagagttgcctcaatgtgtcacttgctgaacctacatttccttatgaagacagtcctatcaatgagaatatctgccaccttaaagctccacgttggtaactctaccactctacttttgtaggtgctttttcattttaaatctaaaattctttttcttaattcttcatacctattttgagccatacgataactctatgaaataaagttttattcttatagatgagcagattcaatgtaacgacaccaaaaagtgttttctccaacattcccactgcccttccacctgaaatgatccgacaaaactaaactgtgctcctgttttttacctggcacgtcagcccctttgcagattgaccccaactcgctttccaacctgaccctctgctctggtcccctcttcctcatctccatgcctttgaccatactctgtccctggcctttgaatgccctttcccttctccccaaaaggccaaatcccacttggctgcaagtcccagctgaaatctcatctgttctgcaaagcttccttggccagggcaatgctggcttcagggaagccatgtgccacgccggcgacctagtttgtatgtctccttccaaatcctatttggaaactcgtaggtaactaattatgccacggggtttccctgtcactctctgaatggggcgcccagtttgtgttgtctttagaagtctgagtcaagttaataaattcatgtcactgcttcctcctggactcgcttcttaagaaagttcacaataaggaggaagtgaggaaagactttatgataagaggaaggtaactcaatactgccaggtttgattgttttagagatcttggccaacatggtattctctgagtctcagcaggagggaagattttagccacacgattccctagagcttagaggtagactagaaaatgccaccaaaaggcctagaagcgagattgtcattgattagacccgggtgcctgagcctgtgcttcctatcacactctgaatctttacctgtgaagacctagtgccaagtgacccttttcttttcttctatctatctgttctgtctgtctatctatcatctatctgtttagagacaggggtcttgctatattgcccaggctggtctcaaactcttggccttaagtgatcctcctgcctcagcctcccaaagtgctggaattacaggcatgagccaccacgcccggctcaagtgactctttccaaacagaaaagctccaaaccgatttttagtttcagttattagcaccatgccggtagcttaattttgctatttcattagtactccattgtgaacagcaaacatgagtgtaacagagatagcacttcgatgctgagaggaacagggtaagaaatatggacaccttgacagacttgctcaagaactttaagatggaaatatccggttttaaattcctctagagagaaattgaaaacaaaaagaaagaaaaaaaaagtcttttatacttcccagaaaaaaataccaaggctaatcttgtgctcacagaaatgtcatacattgcagtaaaatgttgataaacatgtacgattaggcccacacacttcctttctggttttgtatttttccattgcagaaacattcctaacatgggctgtgcctgttgcttggctccgaatgtgtcctttttgagactttagctgagctttagtggcaagtggcctggagggagccctggacccctcagttaatggaaggtggctctgggtggcagggtcacccagactgaaacgtctggctctcatcctccctccttcgcaccccattccaccagggctggcaccaaccattcttcagatccatacgatttcacttcagacatggattctcatgtcattcatgctcagcgttatgaaaagatattttctgcttgagatcatcaggtttccaactgtacattctttcaaatccttacaaataaagatgcagaaaaatggacaacagcagaaatgacagcactgtgttggcatgtcacaggtgctccctagacgttaactcactcaattaccccgacagtcccgtgagctaggaaccccagtgtatagacatggaaacggaggcttataggtggcaggacttgtccccttcgcgcagcttgtcaaaggtggagccagggagatttggttccggggtccagcctcggtgcatgcgaggtcactgctgagcgctgtgcacctctgctgctatgtcttgtggctgaacttttggttttatgcactgacaggccaagttcgtgcactgacaggcccttctcatgaaatccatccagacagctttgcttctgatcctaggaccctgcttgattaaattcccttcacagacagatttttgtcttttaggaggaaatccaaataaatacgcgttttcagtgctcgttacaaactctgtggacaaattctacacggaagaagatccaagaaggtaatttgctcattgagaacttaaaaaccaccccaacaaataaaaaagcaccaggttggcaggctggaccctgagaatgtgactggagtaggtgctcttcccagaaaagggtccagaaagaccagcgagggaggcctgtgttacaccgaggacagaagggtgggtttttcaaacctgaccttacacctttcactaggcttggtcagaaaccttccaaaatatactaggggcatctagatttaacctgtatgtgtgaaaaccttcgtctcctatttcagagccctgccaggttgctttctgccaaaatatcactgaacatttctgtccattaccaaacattaactgagacttttacagccaatttgatcatcacttcaatgtttcctattagctacaaaagctggaaagagagtttgtgaaacaacttgagcctcaattctgcaatgtaatcatcaccatctaaaggggcccatgagaagagtaggggcctctgactgaaggtcacttgattgaggccaggtggtcaccatctcttactcataaggactgaccacatctggcccgagagtcacatagacagggtcctgcccgaggctgcaggtagcaggtggcatcacatgctaggtgaggaccctccgggtctgggctcaaattgtacctcggatacttcctaatccctttaacccttggcaagatcctcatcctctctaggcctcagcggctactccataaaatggaatgaaaaaagttcctacctatagggtgttaggagaaatttagatcatgcagtttaggcatttacaagtgcctggaacaagtcatcaggcaatacacagtggtttcaaagactaccactagaaactaaaccctgaatgctagtttctgatctgcagatcttttgttcttgtttattattttttttttctctttgtagcaccctccaagcacatgggtgggtatggtggccagtccaatttcatggcattgcttgcagacccatggaacattcaaagtctaggttacgtgtgtcgcccagggcttaaaatcaccaatttgttaaatgcacagtattagcagctgtctctggagttattggccagcctattttttatttttatttttttaagatggagtcttgctctgtcacccaggctggagtacagtggcgcaatcttggctcactgcaacctctaccttccaggttcaaatgattctcctgcctcagcctcccaagtagctgggattacaggtgcacgccaccacacccagcttatttttgtatttttagtagagacggggtttcgccatgttggccaggctggtctccagctcctggcctcaagtgttccacctgcctcggcctcccaaagtgctggaattacaggcgtgggccactgtgcccagccctattttttctttagttggttgaatttttgaagcccagaacgtaggcagatcccccaaaaactctgtaatcagtctacgaaaatattttgttaatgctaacaggtatccaagaaaaggttcaggaagcatgtaatgtcagaggatcataaaattgtattagcattgtctattctccactattacactggccatacaaatcaataatctttaccctttgagatcacagcattttcccagagtaacttaatagaaataaagattacaattcagtggctacatagagaggatgttcaaactatataacaggctctgaagtcttgcctgtctcatttaagtaggtcaggactctcaaaattagcctaattcccataggcatgccaacatttaaaactcacacacatgaacatgtcctttagagggaagtagctgaggcctgtggtggctgtgctattttaagagaagagattggccaccagacctaagagcacagttcctctatcaggtatctccccgcctgccaggattgtgggctttacttccagaaaaaaacaggaacatttttttctatcattgcttccactacaaacccaactacccgattatttttgaaagtcaagaaaagcacgcctaaagcatcaaaagccccaaatgccaaggtctcgcttcaactcaatgtctctttttgttccaaaatgtacaaaatcatacagtgtaaccccacgtatctcaaaacattaatccgggttgaaaagttcagcacaattcactcctggcttgacagcagccttgatgattttggctccatttgggagactcttgtttatttgctcataaaacatgcgtggaaggatgacggcttttaagggtctttccactaaatcactggagaaacagcaagtgatttttgttttgtttttatttcagccactggtcagggatgattagccccaaatatccaaaatctgtccttgaaagtgagacttaccttttgccagatgatatctgaacctctcacctacgtaagtatttcttttccagctaaagcttttataattatatttttctcgggctatctacttcttcctcaaactggacatttttattgatgtttccaaaatgaaaagcgacaaagagagagggtgaagcttctgaaaggtgtgtggaagggacgtgtcacgaaaagaataaggaagtagtcagcagaaaggtggcagtctggagcttaccctgtcagctgctagaagagtacgagtgcgagtgcaagggcttgtatctacatactagaaagaccctatgaagcagacccctggttctccccagttttttttgggtcttttttgagacagagtcttactctgtgtcccaggctggagtgcagtggcatgatctcggctcactgtaacttctgcctcccaggttcaagtgattctcgtgcctcagcctctcaagtagctgggattacagatatgcaccaccacgcccagctaatttttgtattttcagtagacacagggtttcgccatgttggccaggctggtctcgaactcccggcctcaattgattcacccgccttggcctcccaaagtgctgggattataggctttgagcctatgcccctggcctggttctccccattttatagatgtggagatgtgcacggaagggtcaagtaactgacccaaggccacacagcaagtgagacacagagcctgggctggaactgggcagtctggtggctgagctctcatgcttgtcctgttaaatacatgaaaagggacagagaaaagtcgtcaggtgcagtgagacacgcagcaggcaagacaggatacaggaagatacacaacttttagagtagccagatcagctatttttgcttatggtatttcaaaggtttggcacaataccactgttgagtttcgtttcttttacattcagcacagcatctgccctgaagccaaaagacacagggctgcagcattggtttagggggctggtgctgtacctctttcgtctctgctcaaggcagaggtctctttcgctacaagatggaaaccatccctcaactgtcactaaatccctgggaacagaaagtgatggtgcagccttctgattcctgtctttcctaagaatgatgtgatcagagaaggaaatagaaggaacacatgttggatgtgctagaatgatccaactgcatgcatggcctaagtcaatcagtcagcggcaatgtgctgatattaacgaccagggaggagagcagcaaaaatccctacagagcacaaagcaacgagagcagaaaagagatagtaaaatgccatgaactgacttggtgcccattcagttgggaattcctttagagatgccaaaggaatcccattttgtagccagtttcacggcactcaggatgacagccacatgaggggtttcactggagtgttttagaagccgtttgcgggtgaaggtatcagagagttcagagctatggatgggtcccccagggtgtccttcagcaatccaggttggaacaagagtctgctgagaagcgcaggtcagggttcaccaccctcaaccacggggcagttggtacaagtgaccagtggtctttgctgaaccacgctgtgacataccaggagagccatgaacacatttccccattgaaaggaaacaatacaaatcctgtccttctctcattaaaggaaaagagctcacaatcttccaaggactttgtgcttttatgtgcccatttatccaggaaccaactctggttctctcatgtacacattcattcatcaaatattgactgagcacagcacctgctccacgttactcaccacggggcaaacagacaagaggaagagagcaccacccttaagaaagttccagtattggtaggcagctgggtagttagataagggcactaattgctagaatacagaaaatgtacttagagatactaagcacaaaagtcctggcaaggccctcacccagtgcttgtgggcagagatcacattcgctagagggaagaagcttccgaaaggctacacgcagggtccacgcccctcagagggggctcaagagacagacttcagtggtggatcagggcttcagcacaaaccacagagaaacccgtgtttcctaggggagcgccggggacccgcagaggcccgcagcaggtaccttgcagtcacagccgatgggcttcccacactcctcgcaggtgttggcgaacagggtctcaaagcacaccacgcagtaggggctctcctcccgcaggatgtacttcttgccaaagagagattcgttgcaatggtggcagtcaaagcgctcagtcattttgactcctggcttttcagcaacctatcaaaaagaaaagaaaatccaagtcccattaagcactctctgaaaggggtgcacgcaaaggcattaactgtcccactgtctgtcatctttagccgaaaggtggctaattcctctggatgaataattaaaactcaccctttaatcggtcataatttttaatgataacaccttttttcattagctagggcggttttgtgtttgaatgcattccactttttttttttttttttttttttttggagacagagtcttgttcttttgcccaggctggagtgcagtggtgcgatctcggctcactgcaacctccgcctcccaggttcaagtgattctcctgcctcagcctcccaagtagctgagattacaggcacctgccaccacacccagctaacttttatatttttagtagagacagggttttaccatgttggctaggctggtctcaaactcctgacctcgggtgatctgcccacctcagcctcccaaactgctgagattacaggcgtgagccatcacgcctggtcacattccacttcttgaaaagcacaaattattttttactgtgtcagaaaaagctatctcagttttaaatgcaggtaagggctgacaccagagcccccatcctgtccggctgtgacccggccttgcatcttccccttctccctgcctccaaaatagaaaggcaggcatagaaataatacgtccatttctataaaaagattttccgtgagctcctctttatgattcatgatttgaataggaagaaatcacagtggcaaaagggagggagatctgacctgggaaacctgagattagatgcaatgagggcactaatacccttgacctgggagtgcaagctgcccttgcacaagaaaaactgccaaagtccctgaggatgaatcattgctccctgcgggtaagatcatcctgcagctgcccaggtaccctgagagcaggataaatggaaagactcacttcccaaaacaatgatatcaaatagtcagaaatgcagtggctgcagtcagtggctctctgggcaacacctcaagcccttccaacaggaacaggacactggcgaggttgcagagaaaagggaacatttatacactgtgggtgggagtgtaaattagttcaacccttgtggaaagcagtatggtgattcctccaagagctaaaaacagaactaccatttgacccagcaatcccattactgggaatacacccagaggaatacaaatcattctaccataaagacacatgtacatgaatgttcattgcagcactcttcacaataccgacaacatggaatcaacctaaatgcccagcgatgacagattggataaagaaaatgtggtacatatacatcatgaaatactatgcagccacaaaaaagaatgagatcatgtcttttgcaggaacacggatggagctggaggccattatccttagcaaactaatgcaggaacagaaagccaaatactgcatgttctcacttgtaagtgagggctaaatgagggaacacatgaacacaaagaggtaaacaacagacgctggggtctacttgagcggggagggaggatggcaggagagagaggagcagaaaacataacacttgggtactaggcttaatacctgggtgatgaaataatatgtacaacaaacccctgtgacaagagtttacctgtataacaaacctgcacatgtaccccgaacctaaaataaaagtttaaaataaggggtctccatgcccggcacactgcatttttctaggatgaatacgcagtgtgaataagcagcaagtgatgggccctcctcttatgaccattcctataaaatcatgttagaatgatcctggagagaaaaagcctaccacaggaatagctggtgtggagaaacggccatagggcattaaaaacacagacaattttcttcaggaataaatggcaatattccatttgctaaaagtggaaagttttctctgttcttaaataggtacactgggctgggtgcagtcactcacgcctgtaatcccagcactttgggaggccgagacaggtggatcacctgaggttgggagcttgagaccagtctggccaacatggtgaaaccctgtctctactaaaaatacaaaaaaaaaaaaaaaattagccgggcttactggcacatgcctgtaatcccagctactcaggacgctaaggcaggagaatcatttgaacccaggaagtggaggttgcagtgagctgagatgataccactgcaccccagcctgggcaacagagcgagactccgtctcaaaaaaaaaaaataggtacactggttggctatgtaactctgagcaagagttcacaggatctaagaaaacttggttcaatttgcagtcttcaaaagataggcgagtgaaatgccagaatcagaccttctgatgcaaataaaatattgccgcctggtttgtgattacagtaattttgtactattgcgtatacacgatcctgacaactgtaagcaaggaaaagatcatctttcaagaattcattcttggatatttctgtgtttacagaataattctcttccaagagcaataaatatgcagctggacacatgcggcaagatccgtccttctaaatcactcttcctggagttaaagaaaacattgtctggacattcttgtgataacatcacaagatgaggctcttgagcacttgaattattattctgaagcccaacgtataaatatcctttgtaccgcagccatctcgagttggagcagccatgctggcacaagattcaatgctttcctgtaattgttcagttattggccttgaaagttgctgtcatttatttcatcacaattgagagctgtttttccaacatatatgtttttccaataaagggtgtgatttagctgtgggacaagaggctcactgcccattccatgcccacaaacataagaataataatttgggaatttgaaataagaacgatgaaaggacagagaactataaattgcggaattgtaaaagctggaaacaaatccccagattatctatgacaacttcctcattctatggatggaaaaactgaagcccacgcatatttatgaaaaagagggtccactgagctttctcaaatagccgtctgacttacagaaaatgaactcccagtctaacttgaaaggccgtctgtgtgggtcaggacaagcaccagccctgctagggaagggagacagtctacagcctctgttaatgtctgcagagctccatttatgttggcagctggtgaaaggggtacacctgttttcctctgaggtaataatcgtgatcacggtgctcatatacctgatatgtgttttccacttcctctgattctacaggaccaggacagaaaaaaacaaaaacaaaaaaaatctggccaggtgcggtggctcacgcctgtaatcccagcactttgggaggctgaggcgggtgaaacacgaggtcaggagattgagaccatcctggctaacacggtgaaaccccatctctactaaaaatacaaaaaaaaaattatccgggtgtggtggcgggcacctgtagtcccagctacttgggaggctggggcaggagaatggcgtgaaccaagaggtagagcttgcagtgagctgagatcgtgccactgcactccagcctgggcgacaaagcgagactccgtctaaaaaaataaaaaaataaatctaagagaataaactctgaaaataagtagggctccacatttgctcaaagtacgactgaggttatgaatgtcatcatggtgaatgtcatcatcagtgatatgatgaatatcattatcagtgataccagctcccagcaggaacagtagcagctgctatctgctcagtgggtccacctgggaggaggcacttggccctgtggttcagctcctaattctacagaattctttctgagagtggtggatccctcttctaccttgttcctcatcttctaagaggacactagagttctacaaagagcagagagcatttctactccaaccaacagggcagagcataaaatgagcaactgctgctacctaggagcacagcaggatgcactgtgtgaaagcaggcccctgaaggagttccacacagttacatactgcacaagccctgagcatcagaataaaaagtccatgagctaataagcaagctcagagcttcccttctattacaacatgtttaaaagtatacctattgtcctgtattagaaatctcctataacttgcattttttttttttttttgagacagagtcttgctgtgtcacccaggctggagtgcagtggcatgatctcagctcactgcagcctccacctcccgggtttcagtgattctcctgcctcagcctcctgggttgctgggattacgggcacacgccaccacactcagctaatttgtgtgtgtgtgtatgtgtgtgtgtgtatgtgtatttttttttttttagtagagacggagtttcaccatgttggccagactggtctcaaactcctgacctcaggtgatccgcctgccttggcctcctaaagtgctaggattacagtcatgagccacttgcattttttacatcccataaatacctgattgctcattcattcactgaataaacattggttgagctggaactatgtgtctaaagtcatgaaaagtgcagaagatacaaagatgaataaaatgcaggcccctcccctcaagggacttgttatctagtgaggaaaagagatatataccaaacagactaccaagccccttactcagtgcgtgctggaggtgcacaggtatgatgggcacgcagaggaggagcccctgagagagcaggcaggcatcccagaggagatgctatctgtgctaggaacaggtcagccaggtgatatggcaggtcaggtcaaggggtggagtaggcaaagccagagacatgagagacagagtagggtaggcagagagcccaggaagatggaagacccagtcaacagccaaggcaatgagggcctggatgccttgttcatggacttgggtatgcctcgcaggcagtggagaaacggacagcccagtgaaagtttactgcatggaagcctgcctttactatgcaagacagggggcaatgactcctaaaaaatgtatcagggtatcagagcccatttctgaatgatttcttcaaataaaagtaggacatcttggttctacaaggacttattaacctaattgtgtacaatccatttactctctgtgaactccacatccctcctgacaggttatcaataattcctgctccttagctggtacacaggaatgctgaaagcatcaggcaacagcctgcagggagatgcccaaacataaggcgcaacccctcctttttatttcactgaatcaaattccaaatcacagtttcctggagttcttattcctcaccaagctaaatcattccatgatgtcattaccccttcggccctgaatagggtatttgaaaaagctggatcttagggtacaggcttgactccaggccaagggaactgcaatgggtgaggcaggtgccaggtgcagctcggaggtctggggatggcccagggaaggctttgatctctgagtctctcgctagcccagctttgactcagatgtaagaataggtcgggtacagaggctcatgcctgtagtcccagtactttgggagaccgaggcagacatatcgtttgagccctgtagttcaagaccagcctgggcaacatggagaaaccccatctctacaaaaaacacaaaaaatttgccgggtgtggtggcatgcatttgtagtccctactactcaggaggctgaggtgggaggatcttgagcccaggaggtcgaggctgcagtgagccatgatagcatcactgctctccagcctcaaggaaacagcctcatggtgacacagaccatgtctccaaagaaaaaaaagaaaaagaaataaaaaggatgtaagaataaaggttcagagggccagggagcaacaatgcactctactactcacaattcatactaattttaaaagttcacaagctcatcagtgtgatctatttttaaattttcagattcaaaaactgtaaaacaaagtatgagtggggaaagtatcaaagctggaggaaaataaagggaaaaggaaacagaaagagtaaagagaaggggagaagggtggtgacaggacaaaaaaaggaaggaggagggtaaatgaaatgaggcagaagagaggcaaggaccctgcatgccaggaagcttttttttttttttttttttttttcttgagacagtgtcactctatcacccaggctggagtgcactggccctatcttggctcacttcagcctccacatcctaggttcaagcaattctcctgtctcagcctcccaagtagctggtattacaggcgtgcatcaccgcacccagctaattttttttttttttttaaccagaaagatttcgatcaaaggaggggctgccatgacagacagcctcccttggcttgctggctcaggccttggagttccaggagcctggcagatccctacaggtaaagcctgaagaggtcagattagcaaaagaagtctatttaagcatccttttcaatgcaccttttattgactacctactttgatctgaccccaatgggcccattttctcctccccctttgaaaccccaagtgcttctccctatcaaccctgctgcaggaggctcctctaacatagccatttcctaaggagaaatctgtgaacgtccccaagcccttcctgcatgcagcccttcaacacatgcaaaagcagcttcggtaagtcagtccctgtatctttagatgtcaccggggatccgcaagggatattcaattacttatcaataatcaaccagagctttccagagacaattaggaaaactggtctatgtgggctcttttaaaaaatacattataaaagtgcagtgttttcatgcaattgccccgtcttctaccaaccgtaagcattgggaagggtgcccactacctgtcgctgagacctcaccagcagggaacacacacaggaccaggggctttgtgaatacttgtggaatggatgaacaaatgaattgacgggtggatgaatacaaacatgtcagagtacaaacatacaggcaaaaatcaagcatgaaaaattagaaacatattatgtgaacaatccactctgcatagcaaacccaacatgtaatgtggtttggcatatgacatcatgagcttccatcgctgccctcgtccctccttccagataagctgctgcttccgcagcggatataactcttcttattgtgtttggactccaatcccatgtgaacacacagctgcacagtccaggatgcagcctggccaggtcaagaagcaaaaagccagctgggagtcgtgcccactttgggaagaacgcacagatccccaacacgggctccaggtgtcagcagaaggccctgatgttctacagacatgtgatgcctataatcaaagatcctccattcaaaggcacgggactctcacacctggaaatgtgctcagagaataccccgcaccattttattttcctacggatgggagtatctacacacaaaaaccgctcacccccaacactcttcatttgtctagctaaacgggttgttttaaacagaaattctgataaaacggagagggccatcatgtcaaggaaagttgctgttttataaactagaataatggatcaagccttggagtccctaaagagagaggatctcttgagcccaagagttcgaggctgcagtgagctgtagtgctgccactatactccagcctggaccacagtgtaagacccggtctctaaaaaaaaaaaaaaatttatatcagttggatatggtgatgtgtgcctacagtcctagctacctgggagactgaggcaggaggactgcttgagcccaggggtttgaggctttagtgagctatgatggcacctgtgaaaagctactgcactccagcctgagcaacagaatgagaccctgggaaaaaaaaaagaaaagaaggaaagaaagaaagaaagagaaaaaagaaagaaagaaaaaaagtatctagcatccacttgaaatctatttttaaattgttggattttaaacaatcttagtttgtaaggtataaaattgactatgcttaccactgtataatatatttacagattaatttaataagcctttactaaatgcatgtacagacaggtgtcagaggtgtattatagtttacataaactggtaacttccaacttaaaaaaaataaataaacatcttcatctctggtggttctgcatgaggcaatgtttgaataaggtaaactgctgtcttctgaattatcttttgaatattgaatactaaaaataaagggaaaacaataaatatcaaatttctgatctgaagtccatgactacaagaggagttacacttgttttgatgtcgttcagccttttgaacccagccgacaagaatgtgttgagtaaccactgttttccatgtgctacgtgaggcactgggaagctgagataaaacacacagtctatgaaggagttccagtctagttctagctccaaataatttaaatcacctttaagatcccatcttgtcatttaatctcaaaacacatcaattgcagccatgcaggacaaccatagctgcacacgctagaatggcgggtggcctcgggtccgtcaatcacaccagtgtggggaccaagggagactccatcctgcatgctatggctctaccatgccttccctgagtgagttacgaacacttctacacctacaaaacgaaaaccacccactcttcttcatggcaggggtctcctctcacctcccaagtgcggctcactgttcactctcccagctatctgaggtgcctatgacccccacccccatgctggcctttctcttggcatccagcagcttccatgaatgactggccacctccttctcactgcagtcctgccactctgtggggtttctctggcgcactgcaacaggactctgtcccgagaggcttgcacagttccttctgcttccttcattgactgcctgcttcttagtgactccaaaagttgtattaacccaagcagacaggtctatttccttgttgactgacaagctccatatttacatactgcaaggacattctggcattaattctgttcacccatgaaaacagggcagctgcttctgccacagacatcccacatctcactcaagaccatatgacgggaggatcttgaagccgcagacagaatcaggctagtaaaggcgtgggccaccgaaggctgaggatgagtgtgaagtctaagttcacaccaggcaagacaccacccacgagcactgggatggacctgggagaccagacgctgctccagacccctcgtgacatccccatgcagagagcatgttttacagcaagaggaaagccaagactcccaggagcaaagtagtgatcaaatcttaaaaaaagggagaatgacagttggtggggagactttttaaatagatgttaccagagagctgtaatagtcagggttttctagaaaaatagaaccaacaagagatgtacatagagagatttatcgcaatgatttagctcacacaattacgaaggtgaaaaagtcccaagacctgcagtcagtaggctggagacccaggagagccgatggtgcaaattgcagtctgaaaagaggagactctatagacccaagaagagccgatgtttcagtgtgagtccaaaggcggaaaggaccaatgtcccagctcaagcagtccggcaggggggcttccctcttactcagtttttttgttctattcaggccttcaactgtttggacaaggcccactcacattatggagagcagcctgctttactcagtctacccattcatatgtcaatctcatccaaaaacaccctcccagacacacccagaacatatgactgaatgtttgggcaccgcatggcccagtcaagttgacacatgaaagtaaccatcacagtagctaaaactgaaatccacaatttaggataacagaggaaattcacttgactcaccccaaagtcaaaatgccagcctagtctccaggaagacacagttctcagccactagagaaagcacacgtgttttgtttcagatggtcatcttgaggaagcgaactcagtataatgcaacttgagatggacacttaataaatgtggctttgatcaaattctcataataaaaccgcacagaagaacccaatgtctaatgtttccattcacccaagctcaaggaactttgtacctcagggcatctgagtcagagagccgcttagcgactcaggcccggtgctgacaaaggaggctgcctgagtcactgaggctgagtaactggccctcggcacaggacaggagtaaactactcctgatatctagtctgtttttttttttttttttttttggcaatattctattgggcgtttttgactgcaatttaaatatctttcagtactggaaatggtttaacacgcaatcttgggtcaaagtatgcatcataaggcctcatagaaatattcaaatgttaaaaaaaataaataaatattcaaatgttcctcccgtggtgcgtttagtggttagaactcaggttctccagttaagctgcctggggtcagatctcagggctaccatttacagcccgggaaaccctgagttaaagttactttgatctctgttttcagtgtctttacctgtaaaaatgaggctatcaaatatgtatacactgtctatgatgtccaggcttcttaacaaccctaacaaaaagacaacatcattgtccctgtttcccagtggagaaaaccgagacactacgagattaagtgacttggcccaggctgcacaggttgagggacccggatgtaaatttaggcagcctacatgcagtccccggcatcccctagcctactgcatctgcctgtggctatttgtgagacggtgagctaaaatgagacagaacctatgtgcccagaacagtttctggtctgtagtaagcccatcattagccttcatcgacatgttatggtgtaaacgcattttaaaccatggcaggctaataaacaccgtggaaacacaattctgtgtattaactgatgatcttctaaactggggggtgatctaaatccagtaacacttgacaaaattttatataaatgcacaatgaaatgttctttgagtttggttttattaaagtttaattgatagactaggaattcctgtacttctaagacttgatgcaaatggtttttgtttttttgttttttgtttttttttgtctaaaacatcttcaggatagtgcaaaacctcttttctttaatatattattataaaacactcattagtagagtcagcaccaaaaatgtgagatgtattgggagttgtgttttgaagacagttctcctgattctaaacccaaattgtgatttattaccttccaaaatatgtggaagggagtgcgggccttaagttcagtgatgtctaagtacactgctgcttgcaagccagctacacatttcagctaaccggattagcctacttccagttaaaacccgactgaggatatgaaaataaatatgactgattcatttaaaatcagaaaaacactcaatattttcttccctctatttctggtatgctaagatatcacacgagtgcgacttaagaaaaacttagaatcttttcatttaaaataagccatttttgttttaaccgaatggttcagttattaaatgtctacctgagtcaaggagcgaggtcacactgcaaactccacttatttctactaaagggaaatggcccggactcccccgcgcagaccaccgtgccaggacagcccgctcgggagtcgggcctggaagcaggcggacagcgtcacctccccgcagccgccggctgggacccgcggccagcctttacccaggctcgcccggtccctgcccgcatggcggtgccccacctggtgaggacgcgggctgcagtcctccctctggggatgagtcggtgggctcctctgagctccagcgcccccagggtctagacccctcccattgctccgctcccctctccccgtggtctccccacccccaacccccagggttcggctctcctctcccgggtctaccccacagctcaactcctttctcccggcttctccccgcacggttcgggtcccctctcccagtggtcttcccggacccacagctctgctctcctctcaccagtctccccaactccggctctgctcccctctccttgggtctcgcaccggattcggcccccacttccgagccctggtggctaagcccctcggcctccctccggggcgcagggggttggaggtactcacggcaccgcagcgggccggggactcccggacggggctggagggcgcgggcggctggtggctgcggctccgctgccggccgagtggagcgctgcgcagctcccgccctcgagaaaccccgccgtgtcatttgaccatataaggagatgcac

SEQ ID NO: 206 - DNA, 38399 bp, Homo sapiens
ttctgttctgaataactttattgcaagtcacataatcttggtttagacttgacgcaacgggaggttacagagctgtaaataacaactggtcattaccttattgagtttagaaaactttcaagttcgtgacatatgttaattgcacttaaatagacagtgagagaaagatttataaaggcatcattcaaaaggatttttacatttgggtgtgccttactcgattacaaaaatttcaaaccatcttcccacctagggcctagggcgagttttctctttccctgggactgaactatcacaaagcactaaagggtttaagcaaacgtgagtatcactgaaaagcactagaagaaagtctcaatgtggctggaagaaaccagaaggcaagattgcctgggtgagaaagaaaacataaaaatctgtgtgtgagatcacaagcagcaacttctctgtgttgaattcagatgtctttcccacagtcggggcacaggatgtcgtccctctctgtgaggaagccacgccccaccagtgagagggagcacttcttacagttaaagcagtcgttatgccactgccgttcctcaaaggagatgtattttgtgccaccaagtcctgttaacagagagaaaataataccggatgaagaaagttagaatcaggcaactgggactgaagaaggaattctggtttgatccatttcaaagtttggattgtgtaatatggataatgtgaatttctagtgactgggtgttgggaatccatatgtaaatcagattctatgcacagcctggaggatctcgtgaatatcagaagagatatataaactggttccaaaacgatgggataagtgcgatcaaagaatgctgactgtgtatttgttatgtgttttcccacaaaatgaaactccatgagaagagggagcagatttctcttatgtcttcactaggtgcctcacgttgcctggtgctcaaatttttatgacttaatgattgaagcagtgaagggagtgtagaagaggaaaaggttaatcctccctgggatggccaggaaaggcctcacagataaagtgcgatgtgggtgggaatgaggggagagggatattgtcgcagtgggaagatcctgagaaagctgcagacagatagaatggaatcaaatatttaaggtacattggtccgtgattataatacagttggtttttacctagtgttttttctcagtgccacaataaccacaattcacattcatatctaatgttttacatttaaaagtgcttttatatagattgtatcactttataaagcttaatgttataaacatttacctcaacagaagttactgctgaaaacagcattaaagatgaatatgttctggcaaaagattacattttccccctaaaagattccaagggaaatctggtatataaatgaccagaaacagatattttaacataggtaaagtgtaaatactgtgcttttcttcatattttaatttcacatggaaatgtaatgagctctgcattacacatgagagtactgttttagcgacctgggaaggtgagttagctgagttaggtgaacttggttctaggcctaagggaaaggaaagtcaaggacaagtacacagggggtgtatagatgtgtttctgtagttacactgaaaagccacacaggaaagccaggccaccgggtactccaagtgtctgccaccttcctctgataggaacgaaccagtcaactgaatgcaacgggattgcaaatcccacatcataaaacttctcctgtgttattacagaacacacacttttctctccccacccagtcactcatttgtgtagcgatatgtggtgaccatttaaaggactttagtgtgaactcctctgttctccacactgaatttctccagcctgcttaatagtctagtccagaagcctggtctgccagccagccagattttgggctctcacttagctgaattctttgggggaatacaatatgaaaaactccttagaatgtaccctctgccctcatatagctatggccttgtggtagaagtttcccattaagatgttttggagtacaaccgtcccactaagatgctaggggacacttctaagaacacagcacagctgctaagcctgaaaaggccagtttttattgtgcttttgtgatgtcacaggctcacagactgcagttttagcgataatccaacccaaagcagaaactaaactggagcactggccatatggttgtgatcaggtgggctgcagaggaaggaatcattacttgctgaagcatagccagtgcaccaaggagaggaaagcagataggcagaaaagtctgctgtgttcagagccttagggaggtctggggagttgagggatatagacagggtcacaggctaaaatgctaggccttgttcaagcttccaatcgcccctggaaatgggaaccccgggacactcaccgctgatggggttggtgcacccagcacacttcttggcatacaagtcacagaagcagttcaggcagtaggcaaagtcatcgcgagctgtgaagcgctgcccagacagctgcttcctgcaggcggtgcacacgaagcactccttgtgccagggctgctcccggtaagtgacccctcccgtggtgatgggctgcagggacgagggggagagttagtgtggcctctgtgcttggcagacatcttcagtctcagctactgccactggacgatgcaagatcctcatccagaaacgtccagtttgttaagtcaccaagaagctgctttacaaacttcacagtcactcgtcaccctcaccacacgctttcattccagtgtcataggccctggctttcccgttagtgaaactggagcttggggttgccctcagcccttcccagggatgctggggatctaaggcatagggtgcctcagtggtgttgccacctttctgagcagggaagcagcacagtggaggggtcgggattcaatacagcatcaaggagacctgggtttgaatcctaaccctactccttaccagccctgtggctgggagcaggtcatgataaagatctctgcacttcagttttctcatccaggaagtgagggtgatgaggttaattgggcaagttgatgaggagtccttacttagaagcctggcagggctggtggctcacacctgtaatctcaggactttgggaggccgaggcaggtggatcacttgaggtcaggagttcgagaccagcctggccaacatggcgaaaccccatctctactaaaaatacaaaaaattagctgagtgtggtggtgcacctgtattcccagctactcaggaggctaaggcaggagaatcgcttgaaccctggaaacagaggttgcagtgagccaagatcatgccactgcacaccagcctggacaacagagtgagactgtctcaaaaacaaaacaaaacaaaacaaaacaaaaaccctggcaagtggtaacctctccaatgccactcacgagcctgtctctccagccacttacggtgaaagaaggaagaggcttaaaggacagccgggactagcacctgctgatgccacaagaagagatgggcatcttggaagttttgggaaaaataagctggatgccttcattctcacctgtcttgtggtcttagaacatctgtgaggtgaagctgcaaagccacatgaggtggaactggccatcagtacctcaattttacctgatatttttctccaaatgttgcatctcacattctatttaaaaatgagtgcttggtggagctgagtaagctatcagagaggagtgtaggtggcctcagcttggcaaacgaaggctgtggaagatggagtgcaagcacctcacaatcacacttttttgctttttattttttgaacatttcagtatcatgcagtaactcctttggtctttacataaagcttgtgaagtaggaaagatattatcttaattttatggatgagtaaactgagactcagagaaattaaaaagtgacttgccaaagaattcatagctggttaatgacgaagcaggaactagaattctggactcccttctatcttgtattcttttcattaaaccataaatcatgaagcatcttagtataacccaccccactgcacaagagaatgaacaccaaacacgcttggttgcaacgtatccatgtgaatgcagtagcctgtgtgtgtaagacatctctgcctgcaacatgtgtcctcagtcctcccttgctccggattccatgcttcccacccacatcagctaactcaatgcctctgagcatagcatgactttctcagagactccttccctcaacaccaccctggcccccaactcctcagattagttgaggtccctccattccacactctgctcttctcctccatagcacactgctcagtaactactgacgggtttgacactggagtgtacttccacctagactacagttaagtgtctgcatcttgtccagcatcagatccccagtgcctgagagggccaagttcatgtcgaggaatggatgcttctggcatgaatgtttttgtgtatttaatgaacatgcacacaaaaagcatgcatcccagaaggatgtgttgctttcatttctgcaaatgaataaagcacacattggaaagatgacagaggaagagcaactcagatgaacttccgttaggtcttgatgagaagaacaaaccaaaataaaaataaaaaggggagagaacagggaagagggttcctaaaataaaagcaggaatgagagctcaatctaagaataaagaaaaaaacaggagtttgtgaccagtctggccaacaaagtgagacaccgtctctactacaaaaaaaaaaaaaaaaaattaggtgggtttggtggtggcacctgcctgtaatcccagctgctcaggaggctgaggcaggagaatcacttgaacccagaaagcagaggttgcagtgagttgagatcatgccactgtactacagcccaggtggcagagtgaaactgtctcaaaaaaagaaaaaaacagaagcataaaaggagaggaaataaagagaaataaaatttaaaataacagtaaagaacaaatggggccaggcatggtggctcacgcctgtaatcccagcactttgggaggtggaggcaggtcgatcacctgaggtcaggagttccgagatcagcctggccaacatgttgaaaccccgtctgtactaaaaatacaaaaaaaaccggctgggcatggtgacgcacgcctgtaatctcagctacttgggaggctgaggcaggagaaattgctcgaacccaagaggcggaggttgcagtgagccaagatcgagccactgcactccagcctgggcgacagtgtgagattctgtctcaaaaaaagaaaaaaaaaaaggaaatgagagaaagactgaatggaaattggtaagaatactcagcacttagaaaaggtgtgggcaaggtggggatattcttgcccaggccagccaggtacaggtagcagcattggggatgtttctccatggcccagacgcaagggtagaggccccaagggcaaaacagcagaagctgggtgagcagagtcaataacaggaggagagcgaacagaacctgtgatgagttccacagctggcgctgcccagggcgagtgagcagtgggagggtgccactcaacaggctgatgcaaatcctaacaggacagagacgctggaagctatagcataataagaattgcgtgtgtctaagagtcagagggcacagcagaaaactaagctacaccctgaagggtgcaggtcggggggcaactgggcagagagatggcttcctacagatatgcagttccctttctttctttaaccctaacagagccatgactggaatagcacattatcgagtagataagtttatttatttatttttttaattttttgagatggagtctcgctcagtcgcccaggctggagtgcagtggtgggatcttggctcactgcaacctccacctcccgggttcaagtgattctcctgcctcagtctcctgagtagctgggactacaggcgtgtgccaccacacccagctaagttgtgtatttttagtagagatggagtttcatcatgttgcccaggctggtcttgaactcctgacctaaggtaatccaccagccttggcctcccacaggtgatccaccagccttggcctcccacagtgctgggattacaggcatgagcctccatgcccggccagagtagatacatttaataaatgatctgtcccatatccatggaggcagacttttctcctttacttttcttctcacatccgtctctctctcctcccttcctctcctccctcttccttccatctttctctccctctcaagtttgcagttgttttcttgttttattcatggagagaagctgaacaagacagctttgggatggtggctccccttccctctaacctcaggttatcaacataagaacatatttagaaatggtctagaagaaggcagggttaaacgatttgatcacagagctcaacaatgttgatgtctttgaaagaaggatggacacccagacccgatggataaatgctcagaatgtaaggcaggacaggcacagctcccacgccacttaagtatcacaggtatccttggttttggaaagagaactgacagacatggaccatggaggcaaaccagccagaacgtgcaagggccaagggggcatctgagatacctttttgcactgaacgcactgcatggcatgttgtttctcatagcagggcacacagaaattctgattgtctttggggatgaaactcttggttccaattggctgctggcagcggtggcagatgaagcaggtctcatgccagctgctgcccttgtactccatcttgcgggtacctgtcatcagggtcaagaggaacacagcagagttatggttagaggggtgtggagtcccagcaatctgccttcagagcttgctgccctctagttttatgaccagagcaagccacttcagctcttgaaggctcgcctctacatggaggtaattcctattttgtgcagggcgtggactttgtcttttggttcactactgtacacccagctcctagaacaacacgtgtacattttaggcacttaacatttatttattgaataccgtggttaggaatgttaaatctaaaaaaagttaagtctctctcagcaatgcaaagtataaagagaagtgtggcatagctccgatgaattcccatggagcatgacttttggagtctagggactgtattcacctattgcacacctgataatgaacaccccgtctggttcacagcaggatggaaatggctagagtgtgaatgaacctggaacctcgaacctgattcagtgagcagcctctacaacactcactttacatactgcctgttgaaccaagttgtgatgtatctaggtagttttatgcactgtactaagtgctataattaaaacctacatgtagtttttttttgttttcgagacagggtctcactctgtcacccaggctggagtgcagtggtgcgatcctggctcactgcagccttgaacatctgggctccagggaaactcctgcctcaacctgagtagctggaactacaggtgcacaccaccatgcctggctgaaatcttcatgtgttacttgtacatcccatttagtaattgcctaaacctacgccatccattgtcttttgaataactattagcatttgatacatttctaccatttctccaagtgaactgaggagctctagagaactgaaacacttatgggtcacccctgccaccaccaagctggactcactgcaagtgctcggtgtctgttgactgacattttttcatttttgtttgccagaaagaagtgtatctatttatagtaacggatgattccagataggcgtataaacaagtacccttcatataaagcaaaggtaaagaacaatctggggaaataagtatcagggacaaagaaagaggaaagtgttgtaagtgcccggactagctgaggggcctggccactgtgtaagaccaaatccagactgctgcctgcttttcaaatgaagttttattggaacacagccacgcccattaatttacttccattgtttacatccgcttttaagctagacggccgagtagtgtgcagctgtgtgcagttgtgcagttgttgtgtagttgtaatagttgagtagttgtgacagagactgtatggtccacaaagccccaaatatttatctgatttttgaaggaaaaatgttgccaatccctggggactgtggcatgagggtcacatacatgtgacttcaactgggggtcagggaatgatggggaatcaagccgacagagggactgccccgctccagaccaggtggaagcagctgcagtaacacaggtggcttataggagtctatagactagtccatagctctcagccccaaaatcttatggtcccaaggacaaagctaggggttgtattttagctggctagaaagttggtcatgaaatgtctgtcctccagtaattaggaatgtgctgagaattatcacgattgttatttaggatcattttctcagcttcctgtacttccaagaccagacatttgagattatataaaataagcagggtgtgtgttggggggcaatgtgtgagagggaatttgggatggtgacacgcagcgatcttttaattcaaaactaagctgtacaatctatggaattcaattgtggggtgatgaatcctaaaacaaacattacatgaagcaattgaaattcaagtaaaaatagtggaaggactttgaattcacaaagattttcttcaacctccatgcatacttttgtcacttgctctttggatctctgacattcattctgatcaagcagcccagaagccaaaggattttgccaatgaatatggggcaattatgactctcatggcattcttgtcgagttctgaaataagtctgatcagatcaacaccagttcgagggcaactctacgtgcagggaatgcacagggcacctggagcctcagggacatggcgcgtgcacctcaggcatggcgacagcagtggccgcaagcctgcatggtcatatgcagcaataccggcaggtggcaggagcgttccttctcctaactgaatcgcacactctgaaccaagtctcccgcaggcggaagcgcagtcttgaagaagggatgtcttaatctgattcaaatagtcaaatgaggctggctgcggtgcctcagccttgtaatcccagcactttgggaggctaaggcgggagatctcttgagcccaggagttggcgaccagcctgggcaacatagagagtccctgtctctacccccccaaaaaaaaaattaggcgggtgtggtggtgtgtgcctgaggtcctagacacgtaggaggctgaggtgggaggatcatttgagcccgagaggtcaaggctgcagtgagcagtgatcgtaccactactctcccgcctgagcgaaagagcgagatcctggctcaaaaaaaaaaaaagtcaaatgaggagccagaaatttggttgcagggttggagacagaatcgctacttgagtctgctcagaggctgtggtgcatctgtaagcaacgtctgctaataggggcgcgagagccggtaaaccccagcactggggttactgatggtattccagtttcctgattggtcatcaggaaactgacttgtgtggggggtgtggagctggtgggtgagtttttcacttgtcctctaaatgtaaattcaccgcaaaagctgtgcactgacgctgtaaacccatattcatcttgaatgggttctaacacttttaaaaatcaaacccaggcaagcaagtgctttgattcagtgttttgtcggtgctggtttgttttgcatacaccgggattcttctagacgccctgcctttggtgcccagtccgtttcttctggcagaggcacctgtaaaatggggatgaagccatccaacccagggaacaccgaagattcaatgggattctgtaaagcagcagggtctgacgcctgtgtgtgtgctcaggggctggaagctgtagctgtgttgttattattactacacagcatttcttaccacagagcctgaattcttgcttcccccattccttagtagaagaggctgccggccagttaattctcagatattcagtatgggttacctctcactgaacattaggtttttacttcttatctgatcatgtttttcttttctttccctccccagtaaacaccatgagaaagggaaggtgtgatggttaattttatgtgtcagcgtggctgggctctggtacccagttgtttggtcaaaaaacaggtttacttgttgccgtgaaggtgttttttagatgtgactaacatctaagtcagcaagcttcgagtgcagcacgttacccacgtatcagggccgggcttcatctaatcggtagtgggccttaggggcaaagactaaggtttccctaagggcaactaattcttctcaagactgcaatagacacaccctgcctgagtttccagcctgccgccctacggaattcaaatgctcccatttggaactgcagtatcatctcttccctgagcctccagcctgctgccctgttctatagattccagacttaccgcctccacaatctcatgagccaatcccttgaaatctctctctctctctctctctctctctctccttatgtatgtatctatgtgtatacatttccttgattgattctgtttctctggagaacgtgactaacacagaaagtcaagacaggtgaaaaattcaaaatccgggaaatatgcatactttttatgtcatggttggtgctaacagttaaagtctttaaacagcccctagagtccccagtggaagcttccttgggcccttgttcaggaaactagtaagggtttaatttgtttttcaattaatgtcgtggttcttattgttactgagtgttgtgtctctgcagtgactccctgtggggcaggacacaggtcagcctggctttctacgggcttcaattctcatttgcactgtcgcacagcactggggcccgagtttccagcctctgcaggatccacatgatcttagaagaggccttcttgcctggagctgccccatctaaagtcaccatgcagcccttccagctgttttcccttacagctgccaacagggctgggactgtgtcagcctgggcatttttcttccctgtcatagtgtgtcacagttgttttaaagttatattaaccagagaaatgtagtggcagtaagaaaccatcttaccaaaggtcagattacctccttgcctttttaaaaaatgattattccttatcctacataactttcttttttttttgagacggagtctcactctgtcacccaggctggagtgcagtggcgtgatctcagctcactgcaagctccatctcctgggttcaggccattctcctgcctcagcctcccgagtagctgggactacagacgcccgccactatgcccggctaattttttgtatttttagtagagacagcgttttaccatgttagcctggctggtctcaaactcctgacctcgtgatccgccctccttagccttgcaaagtgctgggattacaggggtgagccaccacacctggcatcctacatatatttctaaactatttcccatatgtcagtctcttcagtatttctttattatcaaaaacaaagcaaaccaacatgatgaaaccccatctctactaaaaatacaaaaattagccaggtgtggtggtgcacgcctgtagtctcagctacttaggaggctaaggcagaagaatctcttgaacctgggaggcagaggttgcagtgagtcaagattgcaccactgaaccacattggccaggccgatttcaaactcctgacctcaagtgatccacccacctcagcctcccaaagtactggaattacaggtataagccaccgcacccagcttctttctgtattttgaaattccacatatttttgtccactttgctttttaaaataaaagattctgctctcctacataaaaaacaaaacaaaacaaataactccccccacatacacacacaaaaaaaccatgagggacacagtcccatcaacacacaaggcacctttattgccatcctcggcacctggcccagttgcggctgtgccctttttgactgtccgtctagaacaccaactctacaagggcagaggaccaggtgcacctcggctcacaccctacgaatgctcagctcgagcccagtgcctggcacgcaagggcaccatgcacacttggtgaaataactgaatgagtacaaattcagcaggtagaagggaagaaaagagaaactatctatggtggtgggagagtgggggctgatgcaggagatgtatttttaagggggatacccaccattttcttactctaacaatttgactgcataacactgccccacgtgcacagcaaaaagatcccgttactgcccatgatagaacctgtatgtccctgcttcgtaagtactctaaatactcctctgcagttcaaggtcaaactggaaagtcaacacgagtgtctggaaccaagtcaatgtgaacagggggtcagaggaacgtgcacaaggcttgaagctagactggctcacgcatgagaaaggagtgcctcctgacctggcatgatggtcttcttgcattcctggcacttggatgagtactcgttggaatagcagtctgtacagagcagctggtcctccttggcagcaaagggcttgtccaccagtgagtttctgcactgcgagcagtggaaacaggcttcatgccagtgccggtccttgtaagacaagtcctgtggggccagaccacacaagacagtcagaggcaggacaggagggcttggacccacagcataggggccccttgcgaatctgcagggcaaacaaggaaagaagttgggccgaggcaccctggcgcacccacattcatgccccaggaccacctaactgctgaaatcaattaagactaggctgcttttctcttgctgcattttagagcaacaggttagacagatgtgcatgtatgcacatgtctgtgtgtgagagatgcttctaaaaaacaaagggatttcccttatgtattgcctgcaagaaagagaaacagaaaacatgaacacctatcaattcgtctcacaccacatccggtgacagagaaacagactgcaggacatccttggctgagggagccctgcccaactcagatcactgtggtcaccggcatggcagagaggctctgggtgtcgggatgttcacaggaggcccaaggactgtttggtgggagacggtcaggagagactgtgtgtgtgggtgctacctctgtgggtggccgtgagctgggggaggaagggaatttcaggcagagaaagagcacagacacagaagatctggggacggggggcatgtcagattggagggaccacaggccaggggcgaggtgggagggccccccggcctggctggactggaagatatggctgcctttttgccttttatgtctgtgtagagattccattgatcctgaaggcagtggacagctgcttttcaacaggagagtgaagtgctcagactgggggacgggtaaggatgtgggagtggaggggcgtgagggtgggagaagtgagacaaaaactgagcacacatgagagaggccctgagaagacagacgtgtgcttttgagtaaaagatgagggagagaaaggagccccgcagaaaactcgactccacacttggcttcatcttgcctgaggaataagagaaccctccatatttgccttttaaaaatgacatacggcatttttaaagtgccaacacaaaattaaaataacaatctctttatgcccagctttatcttagaaaggatatgtttctattgctgtctttgtgttcccagctctgaccccaaatcatcatccatttatacatgaggcagaaacagagtattaggctctgcacggtttcctgggcaggcttccagttggtaggtatcctgaacagggcacaggagggctgttcacgcgatggccctgaagaagagcctgcccacgatgtctctgttactgaaaccgaagtcgaagctggagttatgctgaatgtaggatgtgaagacatggatcttggccttgattagaaagtcctaaaacaccagctaactcggaaccaaaactagaacaaacagttctcttttgctgaagtatgtgtgtgtgtgtgtgtgtgtgtgtgcgcgtgcgtgtgcacatgtgtgcatgtatgtgtgttttcccggaacctggaaccaaactagttatttgatttagtgatctctttgcgcattttgttttagttcaaggaattttaaaaatgtgaacgctgagacactttgaagacagtcatgactatggcctttgtgaggggtgacctcttgtgctatccctgttggaagtttgcttcctagaacatctgggaataggattattgctgacgcaagacgataaagaatgaaggagaggtcaggagttcaagacaagcctggccaacatggcgaaaccctatctccactaaaaatacaaacattagccgggcgtggtggtgcatgcctttagtcccagctacttgggaagctgaggcaggagaatcgcttgaacctgggaggtggaggttgcacagccttggtgacagaaggagactcagtctcaaaacaaaaggaatgaaggtgagaggagcatagagtgctctcaaagctggactaaatgcccttgtttctgcggaattcattctcacctgagcccagcacctctgggtattgtgggtcccctggggtaggcactgcctgtcagggggactcgggggcaggttgctgaaatgcccaagccctcttcatccttgagaacccaaactgggtatgcactgggagttgggggcagagggctaacctgtcttttgtatttttagcttaaagtattttcagaaatctgaggggaacatcacctgtgctttattggttattttgacaagtgaaatagaggacaaactgctttgatttgagttgatgtctacacatgtgaactcatgagaaacagcaaagcccacaatccacatggacatcatcatcgttcgggaacaggcatggtctccattctttccatgcacacgccccggcttcaaaaagacatctgaaacactagtgatgaccatcattaccccatctgtgagctccaggcacggcacagccctgcaaggtaaatgttattactgaaggtcagagaagttccgtaacttgcccagtcacatacctggcacggagctaagccaagcttcgagctcaagtcctcctgatgcgaaagttatttccactgaaccagcccaggcaaaatcctggtcgggtctgtgttactctttgctttcaaaacagatagccttgaggagatgtgtgtgtgtgttcatttaaaaaaatccagaaacgaccaaactctggcaactttctagaacatattttgtacctaaatgaatgtggctcagtattgcctttgtttagactttgaataaaattgaacaaatcattagaagccctatccacccaaaacagtaatctgcctaatttaagaagagatggagattttattcatgttatcactgttagaatgctgattgtggaagaaatgcattaagaataaattttgtgtggaaaacaccatggctgatattaaaagtagaattaccatatgattcagcaattgtacttttggatatatacccaaaagaattaaaagtaaggtctcgaagatatatttgtacatccacgttcattgaagaattattcaccatagccaaaaggtgggagcaagccagatgtctatcaataggtgaaggggtaaacaaaatgtggtctgtgcatacaatggaattttattcagccttagaaaggaaaggaattctgactcatgctacagcatggatgaatcttgaggacatgacgttaagtgaaacgacaaatcggtcacaaaaggacaaatactgcatgatctcacacatgtgagatacttagggaagtcacattcatggagacagaaagtagaagagtggttgccaggggctgggatgagaggggaatgggagtgagaatgtgttctgtaacccattcatgcctgaggttgcaattttttgaatttctgcaatcagaccttggcgatgatcttgagcagtaagatatacataactcccacatgcttagcattccactaatggaatactaggcgtaaatgggcttgatgggggtagtatttcagatttgcaagaagcaaaagctctggggattggttgcacagccatctgaatgcacttactactgaacagtactcttaacagtggttaagaaggtaagtgtgatgttctgtgtattttaccataattaaaagaataaaaaagtaagttttggccaggcgaggtggctcacgcctgtaatcccagcactttgggaggccgaggcaggcggatcacctgaggtcatgagttcgagaccagcctggccaacatggttaaaccccatctctactaaaaatacaaaaattagccaggcgtggtggtgcatgcctgtaatcccagctactcaggaggctgaggcaggagaatcttgaacccgggaggtggagggtggaggttgcagtgagccaagatcgcaccattgcactccagcctgggcaacaagagtgaaactgtctccaaaagaaaaaaaagtaagttttgattgttatgtagcaggtaaaaaacaccgtttcagaagttacctctgtccccctgtgcaggcgagccacctcatagaggactgctcgtttggggaaaagctgcagaatgttttccatgacccaagagtcactgtctggctgggacaagagacctgaaggagtaggcgccagggagaggggaggagatccttggcctctctctgggaagatagttgctttttacatggtggctgccctgcccagggaggaggcattacgcccagaggggtggcaagttatcagtgacaagagagggaagagaaatacaatttctagaaaatttgccttttgggactgaccttcaagaaaaactgagagagaaatctccaaggtcaacaggaaagcaaagccactagatgtcaccacagccagtgctccggtcattaagtccccagatggaggaaagagcacatcagcatgcctgcacagacatggaaaagctggctaagacatgcacatgggtccaaggcactgcagaattccatttttcctacagttaatatttatggcacaaaaatgcaatagctacagtttaagactgattcattgacacgtgacacttgaaactgtccctctaaatgtggatattatccacatgttactggactaagcatccatgcaagacttggagaccttctgcaggcgcagcctgtccccccacaccctgctctatcggatcccacctcgcaaggtgaaggccgcattctctcaggacaacctggtctgctatatcccctgggaaccatttcgccttggctcctgccagatgctgccctttcccttcaggctggtgtagagtggacacctgaaagtgctccccatcccattcgggttggggcatgcagagatccaggttttgtcctaagaaacaaaagacagagtgccttccacaaagtgcctttgcctgcccagggctgcgttatctcggcatcattccctggggccatctgcactcagctccgcaacgtttctctcagcctacctttatgactgcacacacaagcattcctgagtgaatatgcgtgcagcagttcctaattctaaaaccttctaaaggaaactcttttccctgaagataaatattaacctatgctcacgttcttaagttttgtggtgtacaataactaaaaatactctgtaaacaagcttgcatcattgttgttggtgggtcctcagtgggaacagaactggcccacctccctgctgcagtacagggtggtgggcttcctgggccagaaatgcctgaatgcctgctgcatgcaagcaggatgggagagcatgaggtcccacagtccacatctcttgtatcactgtgggtcaagcgcccgcccctctgggatcccaggagcacgtgattaaattgcttggttatttcaccctaggggttcaattcaagggcccaaatgccagattgactaaacttaaatcctggctctgccctatgccacgtacatcaccattgggaagtaattgaacctctcttgccagatttctgacctgtacagcaggaataatggacccactactggctgtaacaagcatgtataacagttgctggtatgtattacaattgctcaatggatgttagtataagtcattatttagaccacagctaataatgagaagagttgcctcaatgtgtcacttgctgaacctacatttccttatgaagacagtcctatcaatgagaatatctgccaccttaaagctccacgttggtaactctaccactctacttttgtaggtgctttttcattttaaatctaaaattctttttcttaattcttcatacctattttgagccatacgataactctatgaaataaagttttattcttatagatgagcagattcaatgtaacgacaccaaaaagtgttttctccaacattcccactgcccttccacctgaaatgatccgacaaaactaaactgtgctcctgttttttacctggcacgtcagcccctttgcagattgaccccaactcgctttccaacctgaccctctgctctggtcccctcttcctcatctccatgcctttgaccatactctgtccctggcctttgaatgccctttcccttctccccaaaaggccaaatcccacttggctgcaagtcccagctgaaatctcatctgttctgcaaagcttccttggccagggcaatgctggcttcagggaagccatgtgccacgccggcgacctagtttgtatgtctccttccaaatcctatttggaaactcgtaggtaactaattatgccacggggtttccctgtcactctctgaatggggcgcccagtttgtgttgtctttagaagtctgagtcaagttaataaattcatgtcactgcttcctcctggactcgcttcttaagaaagttcacaataaggaggaagtgaggaaagactttatgataagaggaaggtaactcaatactgccaggtttgattgttttagagatcttggccaacatggtattctctgagtctcagcaggagggaagattttagccacacgattccctagagcttagaggtagactagaaaatgccaccaaaaggcctagaagcgagattgtcattgattagacccgggtgcctgagcctgtgcttcctatcacactctgaatctttacctgtgaagacctagtgccaagtgacccttttcttttcttctatctatctgttctgtctgtctatctatcatctatctgtttagagacaggggtcttgctatattgcccaggctggtctcaaactcttggccttaagtgatcctcctgcctcagcctcccaaagtgctggaattacaggcatgagccaccacgcccggctcaagtgactctttccaaacagaaaagctccaaaccgatttttagtttcagttattagcaccatgccggtagcttaattttgctatttcattagtactccattgtgaacagcaaacatgagtgtaacagagatagcacttcgatgctgagaggaacagggtaagaaatatggacaccttgacagacttgctcaagaactttaagatggaaatatccggttttaaattcctctagagagaaattgaaaacaaaaagaaagaaaaaaaaagtcttttatacttcccagaaaaaaataccaaggctaatcttgtgctcacagaaatgtcatacattgcagtaaaatgttgataaacatgtacgattaggcccacacacttcctttctggttttgtatttttccattgcagaaacattcctaacatgggctgtgcctgttgcttggctccgaatgtgtcctttttgagactttagctgagctttagtggcaagtggcctggagggagccctggacccctcagttaatggaaggtggctctgggtggcagggtcacccagactgaaacgtctggctctcatcctccctccttcgcaccccattccaccagggctggcaccaaccattcttcagatccatacgatttcacttcagacatggattctcatgtcattcatgctcagcgttatgaaaagatattttctgcttgagatcatcaggtttccaactgtacattctttcaaatccttacaaataaagatgcagaaaaatggacaacagcagaaatgacagcactgtgttggcatgtcacaggtgctccctagacgttaactcactcaattaccccgacagtcccgtgagctaggaaccccagtgtatagacatggaaacggaggcttataggtggcaggacttgtccccttcgcgcagcttgtcaaaggtggagccagggagatttggttccggggtccagcctcggtgcatgcgaggtcactgctgagcgctgtgcacctctgctgctatgtcttgtggctgaacttttggttttatgcactgacaggccaagttcgtgcactgacaggcccttctcatgaaatccatccagacagctttgcttctgatcctaggaccctgcttgattaaattcccttcacagacagatttttgtcttttaggaggaaatccaaataaatacgcgttttcagtgctcgttacaaactctgtggacaaattctacacggaagaagatccaagaaggtaatttgctcattgagaacttaaaaaccaccccaacaaataaaaaagcaccaggttggcaggctggaccctgagaatgtgactggagtaggtgctcttcccagaaaagggtccagaaagaccagcgagggaggcctgtgttacaccgaggacagaagggtgggtttttcaaacctgaccttacacctttcactaggcttggtcagaaaccttccaaaatatactaggggcatctagatttaacctgtatgtgtgaaaaccttcgtctcctatttcagagccctgccaggttgctttctgccaaaatatcactgaacatttctgtccattaccaaacattaactgagacttttacagccaatttgatcatcacttcaatgtttcctattagctacaaaagctggaaagagagtttgtgaaacaacttgagcctcaattctgcaatgtaatcatcaccatctaaaggggcccatgagaagagtaggggcctctgactgaaggtcacttgattgaggccaggtggtcaccatctcttactcataaggactgaccacatctggcccgagagtcacatagacagggtcctgcccgaggctgcaggtagcaggtggcatcacatgctaggtgaggaccctccgggtctgggctcaaattgtacctcggatacttcctaatccctttaacccttggcaagatcctcatcctctctaggcctcagcggctactccataaaatggaatgaaaaaagttcctacctatagggtgttaggagaaatttagatcatgcagtttaggcatttacaagtgcctggaacaagtcatcaggcaatacacagtggtttcaaagactaccactagaaactaaaccctgaatgctagtttctgatctgcagatcttttgttcttgtttattattttttttttctctttgtagcaccctccaagcacatgggtgggtatggtggccagtccaatttcatggcattgcttgcagacccatggaacattcaaagtctaggttacgtgtgtcgcccagggcttaaaatcaccaatttgttaaatgcacagtattagcagctgtctctggagttattggccagcctattttttatttttatttttttaagatggagtcttgctctgtcacccaggctggagtacagtggcgcaatcttggctcactgcaacctctaccttccaggttcaaatgattctcctgcctcagcctcccaagtagctgggattacaggtgcacgccaccacacccagcttatttttgtatttttagtagagacggggtttcgccatgttggccaggctggtctccagctcctggcctcaagtgttccacctgcctcggcctcccaaagtgctggaattacaggcgtgggccactgtgcccagccctattttttctttagttggttgaatttttgaagcccagaacgtaggcagatcccccaaaaactctgtaatcagtctacgaaaatattttgttaatgctaacaggtatccaagaaaaggttcaggaagcatgtaatgtcagaggatcataaaattgtattagcattgtctattctccactattacactggccatacaaatcaataatctttaccctttgagatcacagcattttcccagagtaacttaatagaaataaagattacaattcagtggctacatagagaggatgttcaaactatataacaggctctgaagtcttgcctgtctcatttaagtaggtcaggactctcaaaattagcctaattcccataggcatgccaacatttaaaactcacacacatgaacatgtcctttagagggaagtagctgaggcctgtggtggctgtgctattttaagagaagagattggccaccagacctaagagcacagttcctctatcaggtatctccccgcctgccaggattgtgggctttacttccagaaaaaaacaggaacatttttttctatcattgcttccactacaaacccaactacccgattatttttgaaagtcaagaaaagcacgcctaaagcatcaaaagccccaaatgccaaggtctcgcttcaactcaatgtctctttttgttccaaaatgtacaaaatcatacagtgtaaccccacgtatctcaaaacattaatccgggttgaaaagttcagcacaattcactcctggcttgacagcagccttgatgattttggctccatttgggagactcttgtttatttgctcataaaacatgcgtggaaggatgacggcttttaagggtctttccactaaatcactggagaaacagcaagtgatttttgttttgtttttatttcagccactggtcagggatgattagccccaaatatccaaaatctgtccttgaaagtgagacttaccttttgccagatgatatctgaacctctcacctacgtaagtatttcttttccagctaaagcttttataattatatttttctcgggctatctacttcttcctcaaactggacatttttattgatgtttccaaaatgaaaagcgacaaagagagagggtgaagcttctgaaaggtgtgtggaagggacgtgtcacgaaaagaataaggaagtagtcagcagaaaggtggcagtctggagcttaccctgtcagctgctagaagagtacgagtgcgagtgcaagggcttgtatctacatactagaaagaccctatgaagcagacccctggttctccccagttttttttgggtcttttttgagacagagtcttactctgtgtcccaggctggagtgcagtggcatgatctcggctcactgtaacttctgcctcccaggttcaagtgattctcgtgcctcagcctctcaagtagctgggattacagatatgcaccaccacgcccagctaatttttgtattttcagtagacacagggtttcgccatgttggccaggctggtctcgaactcccggcctcaattgattcacccgccttggcctcccaaagtgctgggattataggctttgagcctatgcccctggcctggttctccccattttatagatgtggagatgtgcacggaagggtcaagtaactgacccaaggccacacagcaagtgagacacagagcctgggctggaactgggcagtctggtggctgagctctcatgcttgtcctgttaaatacatgaaaagggacagagaaaagtcgtcaggtgcagtgagacacgcagcaggcaagacaggatacaggaagatacacaacttttagagtagccagatcagctatttttgcttatggtatttcaaaggtttggcacaataccactgttgagtttcgtttcttttacattcagcacagcatctgccctgaagccaaaagacacagggctgcagcattggtttagggggctggtgctgtacctctttcgtctctgctcaaggcagaggtctctttcgctacaagatggaaaccatccctcaactgtcactaaatccctgggaacagaaagtgatggtgcagccttctgattcctgtctttcctaagaatgatgtgatcagagaaggaaatagaaggaacacatgttggatgtgctagaatgatccaactgcatgcatggcctaagtcaatcagtcagcggcaatgtgctgatattaacgaccagggaggagagcagcaaaaatccctacagagcacaaagcaacgagagcagaaaagagatagtaaaatgccatgaactgacttggtgcccattcagttgggaattcctttagagatgccaaaggaatcccattttgtagccagtttcacggcactcaggatgacagccacatgaggggtttcactggagtgttttagaagccgtttgcgggtgaaggtatcagagagttcagagctatggatgggtcccccagggtgtccttcagcaatccaggttggaacaagagtctgctgagaagcgcaggtcagggttcaccaccctcaaccacggggcagttggtacaagtgaccagtggtctttgctgaaccacgctgtgacataccaggagagccatgaacacatttccccattgaaaggaaacaatacaaatcctgtccttctctcattaaaggaaaagagctcacaatcttccaaggactttgtgcttttatgtgcccatttatccaggaaccaactctggttctctcatgtacacattcattcatcaaatattgactgagcacagcacctgctccacgttactcaccacggggcaaacagacaagaggaagagagcaccacccttaagaaagttccagtattggtaggcagctgggtagttagataagggcactaattgctagaatacagaaaatgtacttagagatactaagcacaaaagtcctggcaaggccctcacccagtgcttgtgggcagagatcacattcgctagagggaagaagcttccgaaaggctacacgcagggtccacgcccctcagagggggctcaagagacagacttcagtggtggatcagggcttcagcacaaaccacagagaaacccgtgtttcctaggggagcgccggggacccgcagaggcccgcagcaggtaccttgcagtcacagccgatgggcttcccacactcctcgcaggtgttggcgaacagggtctcaaagcacaccacgcagtaggggctctcctcccgcaggatgtacttcttgccaaagagagattcgttgcaatggtggcagtcaaagcgctcagtcattttgactcctggcttttcagcaacctatcaaaaagaaaagaaaatccaagtcccattaagcactctctgaaaggggtgcacgcaaaggcattaactgtcccactgtctgtcatctttagccgaaaggtggctaattcctctggatgaataattaaaactcaccctttaatcggtcataatttttaatgataacaccttttttcattagctagggcggttttgtgtttgaatgcattccactttttttttttttttttttttttttggagacagagtcttgttcttttgcccaggctggagtgcagtggtgcgatctcggctcactgcaacctccgcctcccaggttcaagtgattctcctgcctcagcctcccaagtagctgagattacaggcacctgccaccacacccagctaacttttatatttttagtagagacagggttttaccatgttggctaggctggtctcaaactcctgacctcgggtgatctgcccacctcagcctcccaaactgctgagattacaggcgtgagccatcacgcctggtcacattccacttcttgaaaagcacaaattattttttactgtgtcagaaaaagctatctcagttttaaatgcaggtaagggctgacaccagagcccccatcctgtccggctgtgacccggccttgcatcttccccttctccctgcctccaaaatagaaaggcaggcatagaaataatacgtccatttctataaaaagattttccgtgagctcctctttatgattcatgatttgaataggaagaaatcacagtggcaaaagggagggagatctgacctgggaaacctgagattagatgcaatgagggcactaatacccttgacctgggagtgcaagctgcccttgcacaagaaaaactgccaaagtccctgaggatgaatcattgctccctgcgggtaagatcatcctgcagctgcccaggtaccctgagagcaggataaatggaaagactcacttcccaaaacaatgatatcaaatagtcagaaatgcagtggctgcagtcagtggctctctgggcaacacctcaagcccttccaacaggaacaggacactggcgaggttgcagagaaaagggaacatttatacactgtgggtgggagtgtaaattagttcaacccttgtggaaagcagtatggtgattcctccaagagctaaaaacagaactaccatttgacccagcaatcccattactgggaatacacccagaggaatacaaatcattctaccataaagacacatgtacatgaatgttcattgcagcactcttcacaataccgacaacatggaatcaacctaaatgcccagcgatgacagattggataaagaaaatgtggtacatatacatcatgaaatactatgcagccacaaaaaagaatgagatcatgtcttttgcaggaacacggatggagctggaggccattatccttagcaaactaatgcaggaacagaaagccaaatactgcatgttctcacttgtaagtgagggctaaatgagggaacacatgaacacaaagaggtaaacaacagacgctggggtctacttgagcggggagggaggatggcaggagagagaggagcagaaaacataacacttgggtactaggcttaatacctgggtgatgaaataatatgtacaacaaacccctgtgacaagagtttacctgtataacaaacctgcacatgtaccccgaacctaaaataaaagtttaaaataaggggtctccatgcccggcacactgcatttttctaggatgaatacgcagtgtgaataagcagcaagtgatgggccctcctcttatgaccattcctataaaatcatgttagaatgatcctggagagaaaaagcctaccacaggaatagctggtgtggagaaacggccatagggcattaaaaacacagacaattttcttcaggaataaatggcaatattccatttgctaaaagtggaaagttttctctgttcttaaataggtacactgggctgggtgcagtcactcacgcctgtaatcccagcactttgggaggccgagacaggtggatcacctgaggttgggagcttgagaccagtctggccaacatggtgaaaccctgtctctactaaaaatacaaaaaaaaaaaaaaaattagccgggcttactggcacatgcctgtaatcccagctactcaggacgctaaggcaggagaatcatttgaacccaggaagtggaggttgcagtgagctgagatgataccactgcaccccagcctgggcaacagagcgagactccgtctcaaaaaaaaaaaataggtacactggttggctatgtaactctgagcaagagttcacaggatctaagaaaacttggttcaatttgcagtcttcaaaagataggcgagtgaaatgccagaatcagaccttctgatgcaaataaaatattgccgcctggtttgtgattacagtaattttgtactattgcgtatacacgatcctgacaactgtaagcaaggaaaagatcatctttcaagaattcattcttggatatttctgtgtttacagaataattctcttccaagagcaataaatatgcagctggacacatgcggcaagatccgtccttctaaatcactcttcctggagttaaagaaaacattgtctggacattcttgtgataacatcacaagatgaggctcttgagcacttgaattattattctgaagcccaacgtataaatatcctttgtaccgcagccatctcgagttggagcagccatgctggcacaagattcaatgctttcctgtaattgttcagttattggccttgaaagttgctgtcatttatttcatcacaattgagagctgtttttccaacatatatgtttttccaataaagggtgtgatttagctgtgggacaagaggctcactgcccattccatgcccacaaacataagaataataatttgggaatttgaaataagaacgatgaaaggacagagaactataaattgcggaattgtaaaagctggaaacaaatccccagattatctatgacaacttcctcattctatggatggaaaaactgaagcccacgcatatttatgaaaaagagggtccactgagctttctcaaatagccgtctgacttacagaaaatgaactcccagtctaacttgaaaggccgtctgtgtgggtcaggacaagcaccagccctgctagggaagggagacagtctacagcctctgttaatgtctgcagagctccatttatgttggcagctggtgaaaggggtacacctgttttcctctgaggtaataatcgtgatcacggtgctcatatacctgatatgtgttttccacttcctctgattctacaggaccaggacagaaaaaaacaaaaacaaaaaaaatctggccaggtgcggtggctcacgcctgtaatcccagcactttgggaggctgaggcgggtgaaacacgaggtcaggagattgagaccatcctggctaacacggtgaaaccccatctctactaaaaatacaaaaaaaaaattatccgggtgtggtggcgggcacctgtagtcccagctacttgggaggctggggcaggagaatggcgtgaaccaagaggtagagcttgcagtgagctgagatcgtgccactgcactccagcctgggcgacaaagcgagactccgtctaaaaaaataaaaaaataaatctaagagaataaactctgaaaataagtagggctccacatttgctcaaagtacgactgaggttatgaatgtcatcatggtgaatgtcatcatcagtgatatgatgaatatcattatcagtgataccagctcccagcaggaacagtagcagctgctatctgctcagtgggtccacctgggaggaggcacttggccctgtggttcagctcctaattctacagaattctttctgagagtggtggatccctcttctaccttgttcctcatcttctaagaggacactagagttctacaaagagcagagagcatttctactccaaccaacagggcagagcataaaatgagcaactgctgctacctaggagcacagcaggatgcactgtgtgaaagcaggcccctgaaggagttccacacagttacatactgcacaagccctgagcatcagaataaaaagtccatgagctaataagcaagctcagagcttcccttctattacaacatgtttaaaagtatacctattgtcctgtattagaaatctcctataacttgcattttttttttttttttgagacagagtcttgctgtgtcacccaggctggagtgcagtggcatgatctcagctcactgcagcctccacctcccgggtttcagtgattctcctgcctcagcctcctgggttgctgggattacgggcacacgccaccacactcagctaatttgtgtgtgtgtgtatgtgtgtgtgtgtatgtgtatttttttttttttagtagagacggagtttcaccatgttggccagactggtctcaaactcctgacctcaggtgatccgcctgccttggcctcctaaagtgctaggattacagtcatgagccacttgcattttttacatcccataaatacctgattgctcattcattcactgaataaacattggttgagctggaactatgtgtctaaagtcatgaaaagtgcagaagatacaaagatgaataaaatgcaggcccctcccctcaagggacttgttatctagtgaggaaaagagatatataccaaacagactaccaagccccttactcagtgcgtgctggaggtgcacaggtatgatgggcacgcagaggaggagcccctgagagagcaggcaggcatcccagaggagatgctatctgtgctaggaacaggtcagccaggtgatatggcaggtcaggtcaaggggtggagtaggcaaagccagagacatgagagacagagtagggtaggcagagagcccaggaagatggaagacccagtcaacagccaaggcaatgagggcctggatgccttgttcatggacttgggtatgcctcgcaggcagtggagaaacggacagcccagtgaaagtttactgcatggaagcctgcctttactatgcaagacagggggcaatgactcctaaaaaatgtatcagggtatcagagcccatttctgaatgatttcttcaaataaaagtaggacatcttggttctacaaggacttattaacctaattgtgtacaatccatttactctctgtgaactccacatccctcctgacaggttatcaataattcctgctccttagctggtacacaggaatgctgaaagcatcaggcaacagcctgcagggagatgcccaaacataaggcgcaacccctcctttttatttcactgaatcaaattccaaatcacagtttcctggagttcttattcctcaccaagctaaatcattccatgatgtcattaccccttcggccctgaatagggtatttgaaaaagctggatcttagggtacaggcttgactccaggccaagggaactgcaatgggtgaggcaggtgccaggtgcagctcggaggtctggggatggcccagggaaggctttgatctctgagtctctcgctagcccagctttgactcagatgtaagaataggtcgggtacagaggctcatgcctgtagtcccagtactttgggagaccgaggcagacatatcgtttgagccctgtagttcaagaccagcctgggcaacatggagaaaccccatctctacaaaaaacacaaaaaatttgccgggtgtggtggcatgcatttgtagtccctactactcaggaggctgaggtgggaggatcttgagcccaggaggtcgaggctgcagtgagccatgatagcatcactgctctccagcctcaaggaaacagcctcatggtgacacagaccatgtctccaaagaaaaaaaagaaaaagaaataaaaaggatgtaagaataaaggttcagagggccagggagcaacaatgcactctactactcacaattcatactaattttaaaagttcacaagctcatcagtgtgatctatttttaaattttcagattcaaaaactgtaaaacaaagtatgagtggggaaagtatcaaagctggaggaaaataaagggaaaaggaaacagaaagagtaaagagaaggggagaagggtggtgacaggacaaaaaaaggaaggaggagggtaaatgaaatgaggcagaagagaggcaaggaccctgcatgccaggaagcttttttttttttttttttttttttcttgagacagtgtcactctatcacccaggctggagtgcactggccctatcttggctcacttcagcctccacatcctaggttcaagcaattctcctgtctcagcctcccaagtagctggtattacaggcgtgcatcaccgcacccagctaattttttttttttttttaaccagaaagatttcgatcaaaggaggggctgccatgacagacagcctcccttggcttgctggctcaggccttggagttccaggagcctggcagatccctacaggtaaagcctgaagaggtcagattagcaaaagaagtctatttaagcatccttttcaatgcaccttttattgactacctactttgatctgaccccaatgggcccattttctcctccccctttgaaaccccaagtgcttctccctatcaaccctgctgcaggaggctcctctaacatagccatttcctaaggagaaatctgtgaacgtccccaagcccttcctgcatgcagcccttcaacacatgcaaaagcagcttcggtaagtcagtccctgtatctttagatgtcaccggggatccgcaagggatattcaattacttatcaataatcaaccagagctttccagagacaattaggaaaactggtctatgtgggctcttttaaaaaatacattataaaagtgcagtgttttcatgcaattgccccgtcttctaccaaccgtaagcattgggaagggtgcccactacctgtcgctgagacctcaccagcagggaacacacacaggaccaggggctttgtgaatacttgtggaatggatgaacaaatgaattgacgggtggatgaatacaaacatgtcagagtacaaacatacaggcaaaaatcaagcatgaaaaattagaaacatattatgtgaacaatccactctgcatagcaaacccaacatgtaatgtggtttggcatatgacatcatgagcttccatcgctgccctcgtccctccttccagataagctgctgcttccgcagcggatataactcttcttattgtgtttggactccaatcccatgtgaacacacagctgcacagtccaggatgcagcctggccaggtcaagaagcaaaaagccagctgggagtcgtgcccactttgggaagaacgcacagatccccaacacgggctccaggtgtcagcagaaggccctgatgttctacagacatgtgatgcctataatcaaagatcctccattcaaaggcacgggactctcacacctggaaatgtgctcagagaataccccgcaccattttattttcctacggatgggagtatctacacacaaaaaccgctcacccccaacactcttcatttgtctagctaaacgggttgttttaaacagaaattctgataaaacggagagggccatcatgtcaaggaaagttgctgttttataaactagaataatggatcaagccttggagtccctaaagagagaggatctcttgagcccaagagttcgaggctgcagtgagctgtagtgctgccactatactccagcctggaccacagtgtaagacccggtctctaaaaaaaaaaaaaaatttatatcagttggatatggtgatgtgtgcctacagtcctagctacctgggagactgaggcaggaggactgcttgagcccaggggtttgaggctttagtgagctatgatggcacctgtgaaaagctactgcactccagcctgagcaacagaatgagaccctgggaaaaaaaaaagaaaagaaggaaagaaagaaagaaagagaaaaaagaaagaaagaaaaaaagtatctagcatccacttgaaatctatttttaaattgttggattttaaacaatcttagtttgtaaggtataaaattgactatgcttaccactgtataatatatttacagattaatttaataagcctttactaaatgcatgtacagacaggtgtcagaggtgtattatagtttacataaactggtaacttccaacttaaaaaaaataaataaacatcttcatctctggtggttctgcatgaggcaatgtttgaataaggtaaactgctgtcttctgaattatcttttgaatattgaatactaaaaataaagggaaaacaataaatatcaaatttctgatctgaagtccatgactacaagaggagttacacttgttttgatgtcgttcagccttttgaacccagccgacaagaatgtgttgagtaaccactgttttccatgtgctacgtgaggcactgggaagctgagataaaacacacagtctatgaaggagttccagtctagttctagctccaaataatttaaatcacctttaagatcccatcttgtcatttaatctcaaaacacatcaattgcagccatgcaggacaaccatagctgcacacgctagaatggcgggtggcctcgggtccgtcaatcacaccagtgtggggaccaagggagactccatcctgcatgctatggctctaccatgccttccctgagtgagttacgaacacttctacacctacaaaacgaaaaccacccactcttcttcatggcaggggtctcctctcacctcccaagtgcggctcactgttcactctcccagctatctgaggtgcctatgacccccacccccatgctggcctttctcttggcatccagcagcttccatgaatgactggccacctccttctcactgcagtcctgccactctgtggggtttctctggcgcactgcaacaggactctgtcccgagaggcttgcacagttccttctgcttccttcattgactgcctgcttcttagtgactccaaaagttgtattaacccaagcagacaggtctatttccttgttgactgacaagctccatatttacatactgcaaggacattctggcattaattctgttcacccatgaaaacagggcagctgcttctgccacagacatcccacatctcactcaagaccatatgacgggaggatcttgaagccgcagacagaatcaggctagtaaaggcgtgggccaccgaaggctgaggatgagtgtgaagtctaagttcacaccaggcaagacaccacccacgagcactgggatggacctgggagaccagacgctgctccagacccctcgtgacatccccatgcagagagcatgttttacagcaagaggaaagccaagactcccaggagcaaagtagtgatcaaatcttaaaaaaagggagaatgacagttggtggggagactttttaaatagatgttaccagagagctgtaatagtcagggttttctagaaaaatagaaccaacaagagatgtacatagagagatttatcgcaatgatttagctcacacaattacgaaggtgaaaaagtcccaagacctgcagtcagtaggctggagacccaggagagccgatggtgcaaattgcagtctgaaaagaggagactctatagacccaagaagagccgatgtttcagtgtgagtccaaaggcggaaaggaccaatgtcccagctcaagcagtccggcaggggggcttccctcttactcagtttttttgttctattcaggccttcaactgtttggacaaggcccactcacattatggagagcagcctgctttactcagtctacccattcatatgtcaatctcatccaaaaacaccctcccagacacacccagaacatatgactgaatgtttgggcaccgcatggcccagtcaagttgacacatgaaagtaaccatcacagtagctaaaactgaaatccacaatttaggataacagaggaaattcacttgactcaccccaaagtcaaaatgccagcctagtctccaggaagacacagttctcagccactagagaaagcacacgtgttttgtttcagatggtcatcttgaggaagcgaactcagtataatgcaacttgagatggacacttaataaatgtggctttgatcaaattctcataataaaaccgcacagaagaacccaatgtctaatgtttccattcacccaagctcaaggaactttgtacctcagggcatctgagtcagagagccgcttagcgactcaggcccggtgctgacaaaggaggctgcctgagtcactgaggctgagtaactggccctcggcacaggacaggagtaaactactcctgatatctagtctgtttttttttttttttttttttggcaatattctattgggcgtttttgactgcaatttaaatatctttcagtactggaaatggtttaacacgcaatcttgggtcaaagtatgcatcataaggcctcatagaaatattcaaatgttaaaaaaaataaataaatattcaaatgttcctcccgtggtgcgtttagtggttagaactcaggttctccagttaagctgcctggggtcagatctcagggctaccatttacagcccgggaaaccctgagttaaagttactttgatctctgttttcagtgtctttacctgtaaaaatgaggctatcaaatatgtatacactgtctatgatgtccaggcttcttaacaaccctaacaaaaagacaacatcattgtccctgtttcccagtggagaaaaccgagacactacgagattaagtgacttggcccaggctgcacaggttgagggacccggatgtaaatttaggcagcctacatgcagtccccggcatcccctagcctactgcatctgcctgtggctatttgtgagacggtgagctaaaatgagacagaacctatgtgcccagaacagtttctggtctgtagtaagcccatcattagccttcatcgacatgttatggtgtaaacgcattttaaaccatggcaggctaataaacaccgtggaaacacaattctgtgtattaactgatgatcttctaaactggggggtgatctaaatccagtaacacttgacaaaattttatataaatgcacaatgaaatgttctttgagtttggttttattaaagtttaattgatagactaggaattcctgtacttctaagacttgatgcaaatggtttttgtttttttgttttttgtttttttttgtctaaaacatcttcaggatagtgcaaaacctcttttctttaatatattattataaaacactcattagtagagtcagcaccaaaaatgtgagatgtattgggagttgtgttttgaagacagttctcctgattctaaacccaaattgtgatttattaccttccaaaatatgtggaagggagtgcgggccttaagttcagtgatgtctaagtacactgctgcttgcaagccagctacacatttcagctaaccggattagcctacttccagttaaaacccgactgaggatatgaaaataaatatgactgattcatttaaaatcagaaaaacactcaatattttcttccctctatttctggtatgctaagatatcacacgagtgcgacttaagaaaaacttagaatcttttcatttaaaataagccatttttgttttaaccgaatggttcagttattaaatgtctacctgagtcaaggagcgaggtcacactgcaaactccacttatttctactaaagggaaatggcccggactcccccgcgcagaccaccgtgccaggacagcccgctcgggagtcgggcctggaagcaggcggacagcgtcacctccccgcagccgccggctgggacccgcggccagcctttacccaggctcgcccggtccctgcccgcatggcggtgccccacctggtgaggacgcgggctgcagtcctccctctggggatgagtcggtgggctcctctgagctccagcgcccccagggtctagacccctcccattgctccgctcccctctccccgtggtctccccacccccaacccccagggttcggctctcctctcccgggtctaccccacagctcaactcctttctcccggcttctccccgcacggttcgggtcccctctcccagtggtcttcccggacccacagctctgctctcctctcaccagtctccccaactccggctctgctcccctctccttgggtctcgcaccggattcggcccccacttccgagccctggtggctaagcccctcggcctccctccggggcgcagggggttggaggtactcacggcaccgcagcgggccggggactcccggacggggctggagggcgcgggcggctggtggctgcggctccgctgccggccgagtggagcgctgcgcagctcccgccctcgagaaaccccgccgtgtcatttgaccatataaggagatgcacgcctcggctcgctggcaccgggcgtggggcgcggggggcgggcgcccccaggcctcgcggttgccgtgcccccgccccgggctgcggcggtcccggcccgtaccct

SEQ ID NO: 207 - DNA, 38399 bp, Homo sapiens; identical to SEQ ID NO: 206

SEQ ID NO: 208 - DNA, 82 bp, Homo sapiens
ggagatgtgggctccatgcagggatgacagaggctggggtctggagccttcccccagtgccaccgagctggagcctgctgag

SEQ ID NO: 209 - DNA, 32697 bp, Homo sapiens
tcctttttaccaaacaacttttatttgcatgtggctacttagtaaatagtaatcagtgatcatcctagacagctgccaggcaacaaaaggagagacacatagaagcttttcaaggtatcaggttgcaaaaaaaaaaaaaaaaaaaaaagtatcagagtgatcagaaagtgagcagtgagcagtagtgaagccagaattttctttcccatgactcctgtagttctgtccctgtccccgcaaaccccaggaggggaaaaatgtagatacaaaactgtaaggcctcaaaccagttaggacaagtccctttctcgtaataatttatttcattcccaatgacagaaggcacgtgcagttacagggctgtgccctattcgtctgggtcaacagaagagcacagctttctttagaaaaacatttactttaaaaccaagcaccttgatttgatattttagtgtgcacaactttgcccgttgaggtcctggtgagcccttgcccaaccccgtgggcaccaccattccgccaggcctcggagggccaccgggtgcttaagagaatgtgaggggggtgagtgcaggtggcgcagcgcggttcctgggacatgggtccttcactcctcgctgagatgttgcggcagccttttcttccaatgcggttgtggcaggagaatccacggatgtaatgttttcacctttttccctgagggtgctttctgaggaaccagtccttaagaggtggggtcttggattcctgacccaggcgtccggcagctgctcagtttccgagatgtcagactcatggaggagcaggctatgcccttccctccccattccccacccctcaagccccaggtcttactgtataatgatttattttccccacacgtctaccctcaaaattggcttcatgcaaatttcccttgaatcctaatgctggagaggaaaggggaggggaagtgggagggtggtgggcagggtggcttgaccctgtcagcctcccagggaactcgggaccacggctccccagcacaggctgaacaagtaccaggaacaaggtctatgcatctgcgttagatctgaaggccttggcagcacctcttcaattttaagagaatcaggccgggcgcggtggctcacgcctgtaatcccagcactttgggaggccgaggcgggcggatcacgaggtcaggagatcgagaccatcctggctaatacggtgaaaccccatctctactaaaaatacaactaaattagccgggcacggtggtgggcgcctgtagtcccggctactcgggaggctgaggcaggagaatggcgggaacccgggaggcggagcctgcagtgagtggagatcgcgtcactgcactccagccttggaggaagagcgagactccgtctcaaaaaaaacaaaataaaacaaacaaaaaaaagatcagactgagtattcccctagacctactctagggaagcccatagctgaggcaaaatccccaaacagacttggcattagtggggctaggattctccattagtggagtgagggctttgatgtgagttgtctagaagagcaagttcatggtcagataattccaagagacagttgttttcccaggaaaaagaaaagcttcctcctattcagcagagtgaatttaaatgtccaaacaaagtgtggtgtcatcgctcagtctgcaaggacgttctgttaatcccgtggacgttttagtggatcttccgtttgtcatccagatggcaaacgttggaagctgcttttggggaccaataattggagctttcaaagagcatttcccccttggcctggcgcctgtgcatcagtggtaatagatgctgaaggcatggagaatgtagagcagcgtggcgatgaaggcgaagaactggaaggaggtggagagtgactgttagagacagcagcgccagctcctgcccacccctcaggtaccctcagccccactgcccaggaggccacgcatgaccctgcctcctcgcctcctgcgtggcctgagggcagcaacccctggccaacaactccctcttctggaaactctccatcagggcctccctggggccgtcctggtgtcctgccccgactgcagtctccacctcatctgcacctggctgtgaagcaggctcacctccaccacagctctgggcccatatcccacgctgacctcctgcccgaggcccgctctcctctgcccacctccagcaaatctgtgttctgaacactcctacagctcccctcgctggcccagaactctgccctgagcggctgcttatcagctcctcgtgaatgttcagacatcctccagctcttcctggctcacactgagcccctgacgtttcctcacaagcctgacaagcccagtgggccccagggtcctcctctcgccccactccctgagcctgacccctgtggcccctggctcctcctgcctcccttgccagccatatgcaaagccaccccaaaggctactgatttccctgcctagctcttgggacattcatttttcccttgtctcagccaccggcatccctcggcaggactcctcatggcctcacttgtccacttcttcctgccctgcccctcgaatctgctccaccatttgggcagggcaggcagaagtggacaagtgaggacacttctcactcatggggagaacacaatcccgttgccccacgttgaagctgtatgatggctctgctcttttctcagggtagggccgtcaccttcaatacctttcaggccctgccaaacatcccagccccactctgccccactgtccactcacacgctcctcattcagtcagtcagtcaacaaatatcttttaaggacctgctttccttcaagagcaactgtgggtataacagtgaagaaaatattcaaaaattcctgccctcatggagcttacatttgagagataagaagcagatagcagcaagatagatgagtagcacatacatgggttagatggaggtaaatgccacccactgtggagtgcactgtgaccctctggggtggccacaagatatttcagctgccttctggcctgtctgcctcccttccctcctcatcaggtgagtttaacttcctaaacttgcaagaccagcaacggcccctgcaatcctccatggccagctgtcccagctacaccaccctcctggctgcccttgagcacacagagggtccttggcaggggtaactgcctggtgggaccttagcaggggtaactgcctggtggcccctgcctccttctgtcctcttgacagggccttccctgatgcctcctcccctgagacctcgacattccactttccccttccctgcttcatctctcaatagttcagccatgccgagggatgcgggccccattccaaaggcagtgggtgccattgaaggattttcagtaggagagagacatctgttccaatttgtgttttggaaaaagaaaattctgcagacagcgtggggggtgtctaagagagaggaaagctggagtgggaacaatagaaggtaaaagaggacccctgaacgtgggtgcacatgtttacagggacacacatccctatcccctgcccccatggctccttccacttgagggctcagggtctatacagcacaagcaaagttaggcctcctgcacgaaacatcctccaggcaagactgctgtccttggccagcccactcaccgaggctgccgaattaatgtagtaaattcttgggtccagcagtttctcagaaacaatcgtggcatgtacttgtaggacggcagcgctcatgtacaggatgccagtggtcccgtggtacaggctgtcctggaaatgcagagcagagccacgcatggccacatcaatcaggtgaacattttcctctctggctacatagcagtaaagaatgagcaaatgaggcaggccagccccctagagtcctgccttttttttttttttttgcagtgtgatttggtttggctctgtgtccctgcccaaatctcatctcgaattgtaatccccacatgttgggggagggacctggtgggagatgactggattatgggggcagtttccccatgctgttctcgtgatagtgagggagttctcataagatctgatggtttaaaagtgtgacacttccctctctcactcctgctgccatgtaaggtgtgccttgcttccccttcgccttccaccatgattgtaagattcctgagacctccctagccatgcagaactgtgagccaattaaacctcttttccttataaattacccagcctcaggtagttctttacagcagtgtgagaacagactaatacagaaaattggtaccaggagtcaggcactgctataaagatacctgaaaatgtggaagcaactttggaactggataatgggcaaaggttggaacagtttggggtacccagaagaagacaggaagatgtaggaaagtttggaactttctagagacttgttgaatgattctgaccaaaatgctgatggtgatatggacaatgaaatccaggctgaggtggtctcagatggagatgaggaacttattgggaactggaataaaggtcactcttgctatgctttagcaaagagactggtggcattttacccctgtcctagagatctgtggcactctgaacttaaaagagatgatttggggtatctggcagaagaaatttctaagcattgaagcattcaagatgtgacctgacttttcctgaaagtgtacaatcatatgcattcacaaagagatggtccaaaattggaacttatgtttaaaagggaagcagaacataaaagtttggaaaatttgcagcctgatcatgtgttagaaaagaaaaacatattttctggggagaaattcaagctgtcagctgcagaaattttcatgagtaatgagggtccccaagacaaaggggacgatatctccagggcatttcagagatcttcacagtagcccctcccatcacaggctcagagacctaggagggaaaaatggttttgtgggccaggctcagggccctgttgctctgcacagtcctggaacacagcactctgcaacccggctgccccagctccagcagctgggggccaaggtacagcttgggccattgcttcagagtgtgtaagcctcaagccttggcagcttacacatggtgttggacctacaggcatgcagaaggcaagaattgaggtttaggaacctctgccatgatttcagaggatgtatggaaatgactggatgtacaggcagagtctgctgcaggggtggagcccttatgaagaacctctactagggcagtgcagaagggacatgtggggtcagaccccccacagagagtccccactgtgacactggctagtacagctgtgagaagagctgtcctgtagaccccagaatggtaggttcactgacagtttgcactggtcaccttgaaaaagcacagacactcaatgccagtttgtgaaagcagctgcaggggctgtactgtgaagagccacagaggtggagctgcccaaggtcttgggtgcccaccctttgtaacagggtgacttgaatctgagacatgaagtcaaaggagattttggaatgtcgacatttaatggctgcccagctgggtttaggacttgcatggggcctgtagcccctttgttttgaccaatttctcccatttggaatgggagcatttacccaatgcctgtacccttattgtgtcttggaagtaactaacttgctttttgattttacaggctcataggcagaagagacttctcttgtcttagatgagactttggacttaaacttttgggttaatgctggaataagttgaaactttgggggactgttgagaaggcatgattgtatttttaaatgtgagaaggatgagatttgggaggggccagtggtataatgatatggtttggctctttgtccccacccaaatctcatctcctattgtaatccacatgtatcaagggagggacctggtgggaggtgattggatcatgggggcagtttcccctatgctgttctcatgatagtgaatgagttctcatgggatctgatggtttaaaagtatggcacttccccctcccccatctctcctgctgccatgcaaggcatgccttgcttagccttcaccttccaccatgattgtaagtttcctgaggcctccctaaccatgaggaactagtcaattcaacctcttttctttataatttacccagtctctggttgtttatagcaatgtgagaatagactaatacacagtgtttttaatgtaatatctatgtcgtaagcaatggcagactaataaagatcagtatatttcagttacgcaaagtcaatcttggtctgaaatattaaatgaaaaattccagaaattaacaattaaatgtgtgcctttctgagtacaatgatgaaatcttgcactgtcccgccctgttccacctgggatgtgaatcagacatttgtctagcatgtctacactgtctgtgccacccatgttagtcgctttgtactcatctgggctatcagatcaactgttgtggcactgcagtgcttgcattcaaagaatccttattttacttcataatggccccaaattgcaagagtagtgatgctggcaatttggatatgccaaagagaagtcatagggtgctttctttaagttaaaaagtataagttttcagcttaataaggaaagaaaaaaaatatgctgaggttgttaagatctacagtaagaatgaattgtctatctgtgaaattgtgaagaagaaaaaagaagtgcatgcatagcaaattcggagttcagtactctctgaggattcaggcatcccctaggggtcttgggacttatcctccggagatgggggaccactgtatactgtcttaggtatgctgaggaattgtttacttcgtatacatgtgataatgtgagaaagtttgcggagtttttttggaaacatactgaagtgtgtggaatagaatggcatgatgtttggtgtttgctttaaaattccttagtggggacaaaggctagatgaaacaaatgtggtaaggtcttgataatgctggaatctgggttatggctacatgagggcctataatacaatattctgtacttttaaatatgtcttcaattgttcagtgtggaacagttttaaatggttttttgagatgacgtgataaataaaaattagtgatgtaatattaaatgaaagcatctacatccaaaattatttgtagagtacaattaaagtatatatatacatatatatacatatatacatatgtatatacgtatatatgtatatatactttgcatataattcatgtgggatatggaagaaataccctgtcgcagggattgtgttagggccttgagaatggagtgatttttttcctactagctttttcttcagtgttgctccaaggattttaccaggaagaaaatttaggggaaacacatcagaatatgcttgatcacaggtcattgtgtattctcctaacagggaagccagtgaaggggaataccaggaattatttacgcttgcagataaatgtcttcattttagcgtggtagtaaaaatggtaagataaaaagtcttggttccataggagcctagcccaggatccctccctgcccagaaaggccaattgtcctcacccaacccagaacgtccacccaggaagagccatgctgctggttcttaccagaactctccaggattcaaatcttttgtaaaatccaaacaagtaagacaacaggaacatcaaggagatgagaaacgaggtgagcgagacatacatcacccatccttgcagcaaggggtatactatgtgggtggcggctaccatggtccagaccaagaacccaaatatctggaagataaaagcataaaagaaggggcttcattagctagtgtggagtatgtttccctttgcagggtgtctcttttctgtctctagttacaagttcaggtgaagttaggagggaaccaagaggaaaatggggaaggaaggctggccccgctgagtcacggtaaagtcaggtccgattgttagaaaattcaaggggttaatgcagaggtcatgaacagagggactctcagccaaatctagcttgtgaatgtgtcttttggctcaagcagtattggcatatacactttttaaacaattctgaataagttcccaatattcaaaacaggatatttcacatggaaaatccagatttgggacatttctttagaaatccatggttctggccacagtgtacccatttctcaggccagagtaggctgaaatgagtagtgactatctctttaaaaagggcctggagtcctcagtggaccacatcccctcaccccactaacctcacaccatgctgtgggacattccctgttgctcactgacactgtgtaattgtttactaatgagatacagcttatttttatatatttgttagccattaatatttcctcctctgtaaagttttttattttttaatcagttaaatattttaaaattgatttttctttttcttattgattcataggaattcttgctaatggtgtggatttcatggactgccataaacattgcaaatatattctgctagcattcacatattttctggtttcctttgattaactaagcccgcaattttaatgcagttgaatatgtcaatcttttcctctattgactatgttttttatcaagtttaagaaattcttctcacgcacaccaacatggcacatgtatacatatgtaacaaacatgcacattgtgcacatgtaccctaaaacttaaagtataataataataataataataataataataataataaagaaatgcttctctattttgagtcatgaagatattcttgcattccagattttcctcctgagataattttccttcttcctggagtgcaacctttagtagtctctttagtgaaggtcagagggtagtagtctgtttgatttattagaaaacgtctttaaatttcccctgacaattattttctctccgcacttccaagatatgtttccactgtgttgtatatttttccataatattctgttgtattctggcttccattgttgccattgaaaagtcagctgtcagttgaactcttgctttgtaggaatctgtcttccttatttggctatatttagtcttcactctgtcttcggcattctgcagtttgtgaaacagtgataccatgtgtcgagatgtggatatctttttattactcctgcttagtattcattctacattttaatatctgaaaattccattcacttggccttaatagcttgattctgcagtttgtggcttccattaacttctattcttgttcacttgtttcctcttatgtttagtgaattttgattggaagctcatgtccgtggaggtagctcagttctgaatgatgtattagaaactttctagaccaaacaacttcactcacttttttttttcttgagagagtctctctctgtcactcaggctggagtgcagaggtgcaatcatggctcactgcagcctccaactcctgagatcaaatgatcctcccacctcagcctcctaagtagctaggactacaggtacatactaccacacctggccaatttttattttattttttgtagagacagggtcttgctgtgttgcccaggttggtcttaaacccttggcctcaagcaatcctcctagcttggcctcccaaagtgctgagattacaggcaagagccactgtgccctgccttcacacccttctgtatagctcagccaaaagatatacaacttcagttctgctttccgaactatatccttagctttctgggaccagcagttcttatcttacaactggccaatacatagacatagatatgtcaccctttcccttctgaggtttccacatgctgttgtctggcagttgtctttggatttatggaatattcacagtcttttaaggagaaaaaagaaaagggagatgagaagccagaagagaacaggaagttgaccacaaggcagagactcctcagcaaggagcacaatcatagctttatggggtgggaaaacaactccagcagcgtggccacctcttaaagcaccagttctggtagcaaattcctccttaacaatcaacatccaagtgaattttggaagtcctaggctggtctgagactgccggagaatgagtcaaagccggcttgtcctagggagggggtggtgaggaacggaagccgctgtcctctggctcccccacaactgtgctgctgagtgtcaatcccagtgacaagggctgctgatgcttcagaaaggtaccaggcctcagctttaaggcgcttgccaagaagccatgagaagtgcattaagatgctggcatatgaacagcacccaaacaatgctggttattagtggttcaccaggtactttacagttgataaaatgcattcactcagactgcctcatttagaccacacaacaattctaactcccttggaaagaccagagaactaccattcgacaccttccactgcttactgccagctcacctgtgccaggcatggggacagcaagggaacctcagccccatcttgccagtcagtgcctgcagtggggtcccggtgcccctcttgccatcagaagcttccctggccagacacagccatatgcacgttacttacatttgcacatttaatctttgccacagtccatgaggtaatactgtaccggaggggattagggcctgaggtcacacaggcagtgcgtggtgggactcagacatggtgtaggacagttgtggttcttgccctaaaaaccaggtttcaaggccaagggcagggccaggtagaggctcctagaatatgccagagggtggcctgctacagtcccagccaaggtctgcctggggcattagaggccttgatggggacatcacacctggagtctcagggagcccatcagcggcctcctctctctgggttccagctatagcttagggatccttgtcctacctttcacaacaggccaggggcctctgagcatttgggaatctgctcaaacgtcatgggaaccttcctgcaatggcttcagtgttgcagaatcaatgttctgcagaagaaagtcactcacttcttatttccacacccctctacctcctaaacaggaggagggaccagagccaagggctgcaggtggattgaaacccagtagagttcgtgatctcatttctgtctcaagtagtctaggttggattccttacagttgtgaaaactttgagtatttgtttttactttttcttaaagctcatatttggctttccaaatttcctggtggcctaaactgctttcccattttaatgtttatttttgtatttcctcagagcgggagatatttttcaacggttggggctggccctcaaagttgagaaatatttgattacagcgagccatttagagcaagtagatttcaagcacaactttggcagatccttttcttataagcaaacacacacagtcatatacaaattttccaagaggctgaactgaaacttgaaaggacgtcttaaggaaagatggagcttaacaataggtttttaaaacctattcttctctagaacatgaagagctccttcatgtttagaaagtggttaagaactagaatataataaaataaaatttccaactaaaaaaaaatattgtcaaattaccatcttataacctgcattttaaatttaacgatgtagtgtgaactttttttaaccaataaatctaatcgcgtcatcatttaaaaaaagaaaaaaaaaagaactagactataagaactggggtaaaaacacccagattggtgtccaggaagaaagggctgataccaggtttggagagggaggttgagcctggatgttaccacaccagatagtgagaaaatttccaaaggctcctgaggtccagtcaaaaggactcagcagactcctgctgcccaaagatgggaccgcttgagcttcttacagctatgatggattggaatgcatcaactaaggtaaaatccatgagttcaaaatgatacttaaaacaaaaacttatttggtcacttttggaggatgcttattattttgaaaactgctttaaaagaaagagaagccggcaaaaaacgtggtgtgggggcaaagagcttctcaaatatacgcatacctgagcactaccctccgggcggcactccaagtcctgctactcctagaagcctttggggacttcaagaaagccccagggtctggggtcctgccccagagagtctgcttgaacaggtaagggaggctgcgttgttccccaggtggggtggccagggctgagaaagcttgaggccagctctctgcttctactctcacctccagtccatgcaccatgcagcgcctttcctcctgggtttgaatcccagctctgcctggtgggtaggtcatttagcttgtctgtgcctctgtgtgcctatctatcaaatagaagaggtgggggtctcactggcccctctatcatctggcccttgtgagggtttggtgagtctgctggcacatggtgaatgttggctgtagtagccataaccatttggaacggcacagagggcaggaagggacattccatgagaaagatacagaggagggaatgtccaagagaggcctctctaaaggatgggaaattcacttttggaaaggagagatgggagatcaatcagctgggtgggtgagataacatttagagggcacagactcttcttatgagttgatgatggctttggtcaccaagaaaaatgtacctacacacacacacacacacacacacacacacacaatttttgcctacgaatctggggactcacagacccccagtgtccgtctgcaacctcccagttgaagtccattgccacctccaggttaaataactgtgccatcaacgactctattattttggcaatattgatcaaaacattaaatgcccatactgttcaactcagtaatttcacttgatggaatttgtcctacaaatgatgcatgtgagcaaaatgacaaatataaaagttgtttattgcagcctgttgattacagaaaagctaggaaatgacccctttatccagaggggaccagttaaatcaattatgtctgcaaagtgaaacactctgcaatcttcaaaaacaaaacaaaacaaaaaaaaaaaaagagagagaaaattctatatcccaaaatggaacaaactccaagaatttgtaaaggcacagaccagtgtacccagtgtgctaggatttgtgcagaaaaataagaaaatgcatgtgcgagtgtctgtgtatatgtgcatttgttgtgggtgaacagaatacttccagaatgagacccaatcagccagtcagtgccttggtctcggggaagcagaacctcttggcttggagacagttttgaatgtaggaccctgttcacgtttaaactaaccccaaacaaataatatgtaaatttaaaaagaaaagaaagtcgcgtgggcactggagtctcacggagaattctgaatgggaagagataaggaggatggcctttgggtagagtggatctgctcacctgcacagagcagctggaagcccctcatgggtgggagaggggctgctgcaggggccgggatcacacactgaggttctgagacagacgctgcctgagtaatgatgccctgggaaccgtgaaggatatgtcaaaaagatgcatggtctcaggtctgtgtggccagggctctgggctgtggctgggaggtgtgggtttggggtggggcagacaaggagctgagaaggagggaggagtgccaggggtgggtaccctgtggcaggtttttctgcatagctgggcattgcttcagcatggcaggtttcacgtactgccaaccccaaattccttttcttactgcgtctcttaatttttatgacagctttgcctctccttctcttccctggcactcaggtgaccacaggcttcataaagcctaaaaaacttcaggctgagagaaaaagaccccagtcaagatgggtgcggctcttgtcatcagcacacaggtgagccggggtctcctggtcccaccacgggccaggcaggaatgggctctgcaaaggacacatgcgggcgttgcccacggcgggaacctggatgtcctgaaggctccctctgccattgtgatatttcaggatgaaggaaaggattgtccctcgcattcacgtatgcagagtgcatgctgtttaagtccaggctctcttgcctactagatacctctctctctttttaaaaattgtggttaaatacatataacaaaatccaccatcttaaccatttttaagtgtacagttcagtggcattcatgttcattcacactgttgtgcacccatcaccaccatccatctccagagtgctttccatcttgcagatctgaaactctgtacccattaaacaacaactccccactcttccctccccgcagtccctggcaaccaccattctactttccgtctactctgggtacctgatatgaatggaatcatgccgtatttgtccttttgtgactgcccttctcgcttagcataatgtcctcaaagttcatctgtgttgtagcatgtgtcagaatttccttctttttcaaggctgaataatattccattgcatatgtgtgtcacagttggtttatccactcatttgcttatacgcatttgggttacttccaccttttggctattgtgaataatgctgctatgaccacgagtgtccaaatagctctttgatgcacactcctgaaaaggaaaaaacagctgggtgcagtggctcacacctgtaatcccagcactttgggaggccaaggtggggatcactcgagcccaagtgttcaaaagcagcctgggcaacatggcaaaaccctgtctctaaaaaaatacaaacattagccagacacggtggcacatgcctgtagtctcagctactcggggggctgagatgggaggatcacttgagcccgggaggcagacagccttgattgtgccactgcacttcagcatgggtgacagagaaagaccctgtctcaaaaaaaaaaatgaaaaacaagacaaggcctaccctagggctgtgcttcagaccccatcaggcagttgccatgcaaaatgcctcaagagtcacagctctgtcaaacagttgtgcgcatgttcctgccaccatagcatcccttgggagtttggttctgttcatgcaaaatgagtgggagtttggttctgaacatggagcgctaaggggatctcgaaaaggacaccttacagcacgagaactcaaacaggaaggcagagcgtcaccttgcttgacctcagctgggaatgtgtgtgcgtgcctggcaactcaagtttttagctgctctgagcatgtcaatgactgtgaaagtgccaagtgtattaatttgggggttacaaatacatcttagcaagtaggtggatttgcaaatacagaatccaggagttatgagggtccactgtgttttcagtgtcaaaattatcttccatcaagttgataaaacctcatttactcaattaggccctagtcagggtatgtagagtgttctagctttttcctgttacaaatgatgctgcagcgaataccttgttgcagagagagttctctcattacaaactgtttctgtggagtgagctccccacctgggatctcaccagtaaggggatgtcactgcccatgccattaggctcatcacgttccctactagggatacatacttgacttagtcctggtcaacgagacagagggaaagtctacctggtgcctgagaagggggcacagggcacaatggtccctttcttgctctggccattactgtgcagtggtgaacctggagctatgaaatggaggaggagaaagaggaaaggagcctgcatcccagatgacacgaccgagctgctgacccagatcgcaggacacgagatagtgcatttcccttctgttaaggccagtcccagccagcgacagccctttcacagcactgctgaggagcccctgggattcaagtctgtgcgggtcgcccatacccctcaccctctcttcaaacactccactgcctcacctgactcccaggccaaactcaggacacccaccctcacctttatgctgggctccccaagcctccaccacttcccccagtcctgggactggcaaactatgagtgagactcattcatggattgtgactccatttagtggattatcaaccagcattaagaactgaagccaacagggcataatggctcacacctgtaatcccagcactttgggaagctgaggtgggaggattgcttgaggctaggcatttgaggccagcctaggcaacaaaatgagatactgtctctagaaaacgtttcaaaaaattaagtgatcacacctgtagtcctagctacttggaaggctgagtgcggggaggatcctttgggctcgggagttcgaggctgcagtgaactatacttgtaccactgtactccagcctgggtgacagagcaagactctgtcccccaccctaaaaaaaaaaaacttaagcagactaggatgtaaagtttaggagcgttttgtgtacaggaaagggaaatactgtttcctggatcttttgtttcacttacacacacacccacacccgcctgtagtgtaccaggttgcgatggaaatctctccctttttgtggatgagtttgtggaagcccttgctccagcgtgccttccttcctgcccacccctggaccattcctccccttcacagcactgtcccatgggtaggccacagcccagcacaggccccagcctggcggctgcagcaggagccccatcccagggcctgaggggccatgcgggggtctgggtgggagtgggagccgctgaggaaggtgaagggaaatgtggtgagatgacaggcccgctgtcagggagagtgggaggagccctggagtgccctacctctgtggggctggaactccctgtatccgagctagggtcttccacacgcatgctcctaccccaagtgccacagctggaggtcagggacccagccaggctgtgctgggtgctcctgggcagggctcacctgactgcaagtctccctgtgggtggctcagagacccagggtccacctgggtgctgcttatagcccatgaggcagctcccacccccgtgtcactggccctgcagcctcatgaagcctgagcagccatccttatctcctttgtgcttcgaatacaggaggatgctggctttaaaaggcagaggggcatcctcagttacccagtaggggtgtggcaggtctgtctccagcaccccaagagcaccctgaaaacaagtagcattgcatgaaagttccacactctgcagttcaacctagcacacttccaaaccctgagtcactgcgtcctgactcatggagggagaattttctttttctgtggctttaaggctagcaggaaattgccagcccaggcccctaaggcctccagtgagggccaggtctcatctcccgctggataacagtgttggcaggaacttccatccagcactggtgggaactcgcgtccgcagctgctcctggctgagcaagtcaggcgtccttggtactcataagcactcactgaatggggctggcagtgcgcccggcctccctgggatgggcgcaccagagtggcaggaagtgcagtctgggaggggccctgagtcagggccaggcatccccattcctgcttcctcctcccccagcaccacgtccgcccattcagactgattgccttcactttttactgaccaaacagcacagatttgcaatgtcacataaaattgactaatgagaacattcttttccatccaaagtctaaagcccttttccttcttgtctcttaaaaaaaaaggaagaggacaaaattaaacacagcatttggggggcatattttcccttttgactacctgtgtaccttagaaaagcacagaaatgctgtaaagcagcaaggggaaggcatcctgctcccaccgcggcccggtggctgggcttccccactctccctggccccctgccccagtgtcctctttctcactctccctgtacattgattaacttcatgttcctgcccatgttccccaaaagaagttgcctgatgatccctggactcaggctcaggggaagtccccataccctcctttctcctcaggagcccacagacattttgtgactaataacctgcccttcattaggcaccgggtcacttagttctggttgatggattgcctgcttggctctccccagctgatccccagtctatctatgactagaccctgaaaggcagggaccagaccatgtcacctcctccaggaagccacccttgactaccaagtcccccagcatacctcccctaggatcactctccactgtcattgtctctcttttctcttccctgcctcctgttgaaactctgagctcctggaggcaggactgtgtgccctgaggtctctgtccctggagtacagcatggagcctggcataaagcaagtgcttggtacatgtcactgactcacttgagaaaggaggagggggttgctggacacaccactcactagctgctcacagcctcagattcctgggacagacgcccatggaagtggcatcgcctgccgccttctgggccttccactgtggcctagccacagaccggcattcctgccaggagcctgaaccaaatggagacagacgtgtatttgtttcatcctcacctatttcctgctccatcacctcccaggccccagaaattctcacagtagggtagggagcaactgtccctcaggattccctgggaaggcttttcccaccaccctgcctcctccctgaccccatcggcaccccttgtcatcctgagatgccccaccaccctggtacataggacagactactaaaaaatgtgctgtcagaaaggacagtgctcaaataaatacacatccccctccatacctcccccaacatcactggggcagaaagagtccagatgggcagtgttggagggaggctggtgggggtatctgtgaatagtgctgaagtagaaaagcaaagctcaaagaatccagtcttctttgaaagaggtctgaagactctggagtcccagactcatgatatccggcccctctggatggggatcccactgagactgtactctgggaccccgctggtatcttctagggacagtttgtggccaggggacaggaagtggtgccatggggagctagtgctgtggaacgcggtacaagggctggccctgtccaatggagtggggcctgtgtggggcctgagcagccatccattctggctgagatgggggagcttgaccaggtggtgactgagggacaggctggtctcttcaggaggcaaagggggcccgaggctaggggctggctggcagggatggacgaggcaggggaggggctggaaagagatgagggggcaaaggtcagggtgctcgagctcctccgcactagggccctttgccctgagtgttgccaatctggacaacactctaggagcctctcctgactcccacagatctgccccgcccaggggaaagttcttcagggagacagctcctgggaatggcggagagagccagcacttctactggcaaggctccttatctagggctcgccctgggtccagtgggtcagactgcccggggcctctctgttagactccatgccagcagccggtggctccttcagagcagccgtcaagtctgtggacccctccgggtgggctggccttctgacagtgtgcttggttgcctgtcttggccaagttgaaagagaccactggttcagggacggctgctcatggtcctgctggacggccagggaaagaccagggctggaagttcagacaggggccggagtggccagggatgcggggccaggccaggtggttcccagcatctctctgctgtgtggtgtgggctccctcggtggctgattccttgctaggttctggcaggggaggacttggagggaggctgggatgttaggagagaagtgggggcttcctgctgccttttccaggccttgccattgtctctccagaatcagcagcagcagctggagatgagggtcccagtgccctttctttagggtgaccactgtctcccagcacccccacactggtctgagcactggcaagacagagacagcttcatctataggtttgagcatcagcatcgctgcccctctgtccctgattctggggttgggcagcaggcactgtgagcacttattattctctggattgttcagtgacccctttctgttcatcgagccttccaacgactgtgtcaacaagtccttgtattgaatcccctctgtgtgaagcacctatcatggtttctgtttcctactggaccgtgacaggcacagcgcctttacagatttccttggctgttctccaccgccctcattacgcatcaggctccataggcaggggccatgtctgtcttgtttattttgtatcgccagtgcttggcagagagagagtaggtgctcagcttgaatgaatacttggaatttaagtgggagacttaagtctttatgtaccctgactttatatatttgttaacttcctggtcctaggcagtcctaatctgaacaagaaaatgcgtcacccatcaatccaagccctccaagaatgtcaagctcctccttgaatcatcttgtcctgacaccacctggctcccagggcctctgggcagctgtggctgtgcagcccctgcttttcacctgtctcctgtcctggagtgctcgttgcatcttcagtgtgttagttgcaccactcctttaagagaggctcatgccttaccttatcccctcaatgactgtcttatttttgtatgcccctaagagcagagcatggggctagagtggcagtagtgtttcaataaacacttgttgacttacaattgttacttgtcttacaatgcgctttctagtaagaggtccaatgaccgccaatgctaaagtagtatgggctggcattatggagcactcactcaccatgtcctgacatttcctatgaagtccacattcaaaccccacagctgtcttataggatccttgtttctctttattgttactctttccattgttgatgaaactgcggctgagagtgatgaagtaacctgcccagggtctcacagcaatgaagaagcagagccagactttaggccccatcctgactgactctattttactgaacctgaatacacagtgccctcccagagtaggggctgggcctggccaaggggccaaggtggccacaggcagtgtggggaggttcacatccaactcctgtcccatggcccttttcatcttctctcctgggaggtcttgctcttccccagcccaaggccttccctttcctcatgttctcccgtccttgttttccaggggacatccttggccattattccaacgggaccccatggtcccacgggcacagaggttggtggctcccatgtcctgcaggagaacagaagagaagggtgctgccctgtgggagccagaccaaggacaggaagacgccacatggcagtgaggggagtgaagggagggacagagacagaaaggctgaagcatgaaaagaaaattataaaataaactggggtaaattgagttaactttgctgctcctggaagtatggagaactgacaggggagcagaggaaagcaagggagatgatttctcctcctggaaaactcaacttctaaggcacagttggaaggaaggggaagatgcctgccttaaggtcaggcctaagaggagccctaatttcttctcccagccccacccattcactttcagtccacagagagttggccctagggggctcccgggaagcccctggcttcagtgagcttcagacaggctcttccatataaacagagtagaagcagcagcaggttggaatgaaggtggtactggccatttgggtaagacatacaatgaacttgccgaactggaagagctcaggatgaacttctaagggctcagaggatttatctctgactaatgtgctggtgagttaagcagctgaaaggaaaacatctaacatcaaacaaagagtttgcatggtctccgcttttaactttctgaacctctagaaatcttagctgtttgttttaaactagtcaaaaatctcataagtcaactagtgacaaggttgacagttaaaataatttattggagtcatagtcataaagcatttccttgttcacagtcaccctgggtgagcttgcagcttccacccttcggcttataaaattcagcttataaaaaagctgatgagtcacctcgtatcatacaggtaatggcatggtcagcccccagcacccgcagacagctggctccagagcagggcacgggtgtgagccgcacccaccccaggctcccccaaggcacacacacttgctacatgaaggagagagaaaataaatggatgtctgttctcatcttaaaattcacccattcaaaccttttttgcacttggagattatgtttcaaaattaatattgtctttaaataagaaatctaaattcaccagtaaactacataaaacatgaactttactgataaagtttcatcaatcactagtggggatgtaaaacacagaagttattctccagccactctggaaaatagtttgtcagtttcttaataaagcgtacacttactacaccacccagcaatcatacgggggcattttccctggagaactgagcattacccccacacaaaagcctgcacacaagttttcacagcagctttatttggaacggccaagaactggaaacaggcaaactgtttctcaataggtggatggttaaacaaatgacggcaaagccagaccacggaacgctacttagcagtaagaaggaaggagctattgacataggccacagcttggatggtgctcaagagcattaggctgagtggaagaagccaacctcaaagacccatatactgtgtgatttcatgtatttatataactttctggaaataacaaaattgtaggaatgaaatttgtggttttcaggggtttgttcaggagggggtgagggagggcagggtagggggtgcaccctgaaagggtagcacgagggagctctttgtggtgagtggcagtcctgtgccttgatgcagtggtgattccctgaatctacacatgtgagaaaagtggagcccccaagtaccaagggcagcttctgggctctgatactgtactactgttaggaaagatgcagccaccgggggaagctggggaggaggatagcctggggcaagttttcaaacccatcttgccctccacctagaaacagacttggggctgctggggggtacacagagggagtgagactggccatttggtttgtgtgggagctgggtgaggcctgtaactgccagctttcccccacttccctgacaacctgcatgacccagcagaagcagccataatcttcctaagtgcacaactccagtaacttgggaatctcacctttacccctcacagcagcaacagcaagacccacccaaggagagtctgagctcatacatgcctagccctgcccctatctgatggtccttccctatccactctggtggaagacaaagggcatataatcttgggagttctagggctccacccaacactggtccctctccatactactacagctgctgctttttggaaagtgtcacctcctggcagggggccaaccagcacaaaaatagaccattaaaccaccaaagctaaagaccctcacagagtccactgcaccctctgccacctccaccagaacaggcactgatatccatggctgagagacccatagacattccacatgacagtactctgtgcagacaatccagagtaccagcccagagccaggtaaattcgctgggtggctagatccagaagagagacaacaatcactgcagtttggctcacaggaagccacatccataggaaaaggggaagaatactacatcaggggaacaccctgtaggacaaaagaatctgaacagccttcagccctagaccttcactctgacagagcctatgcaaatgagaaggaaccagaaaaccagccctggtaatatgacgaaacaaggatcttcaataccccccaaaatcacactagttcaccagtaatggatccaaaccaagaagaaatccctgattcacctgaaaaagaattcaagagattagttattaagctaatcagggagggaccagaaaaatgtgaagcccaatgcaaaggaagtccaaaaaatgatacaagaagtgaagggagaaatattcatggaaatagatagcttaaagaaaaaacagtcaaaaattcaggaaactttggacacacttttagaaatgtgaaatactctgggaaatctcagcaattgaatttaacaagtggaagaaagaaattcagagctcaaagacaaggtctttgaattattaacccaatccaacaaagacaaagaaaaaaaaaaagaaaatatgagcaaagcctccaagaagtctgggtttatgttaaacgaccaagcctaagaataactggcgtacctgaggaagaagagaattctaaaagcctggaaaacatatttggaggaatgatcaaggaaaactttcctgaccttgtgagagacctagacagccaaatataagaagcacaaagaacacctgggaaattcatcacaaaaagatctttgcctaggcacattgtcatcaggttatccaaagttaagacgaagaaaaggctcttaagagctgtgagacaaaagcaccaggtaatctataaaggaaaagctatcagattagcagcagatttctcagcagaaaccctacaacctagaagagactgcggacctatcttcagcctcctcaaacaaaacaattatcagccaagaatttcatatctagcaaaactaagcatcatatatggaggaaggatatagtcgttttcagacaaacaaatgctgagagaatttgccattaccaaaacaccactacaacaactgctaaaagaagctctaaatcttgaaacaaatcctggaaacacatcaaaacagaacctctttaaagcataaatcacaaaggacctataaaacaaaaatacaaattaaaaagcaaaaacataaccaaagtagacaggcaacaaagagcatgatgaatgcaatggtacctcacattccaatactaacattgaatgtaaatggcctaaatgatccacttaaaagacacaaaaccacagaatggataagaactcaccaaccctctgctgccttcaggagactcacctaacacataaggactcaaataaacttaaagtaaaagggtggaaaaaggtacttcatgcaaatggacaccaaaagcaagcaggggtagctattcttatatcagataaaacaaactttaaagcattatcagttaaaagagacaaagagggacagtatataacggtaaaaggccttgtccgacagaaaaatttcacaatcctaaacatacatgctgctaacactggaggtcccaaatttataaaacaattactaatagacctaagaaatgagatagaaagcaacacaataatagtgggggacttcaatactccactgacagcactagacaggccatcatgacagaaagtcaatgaagaaacaatggatttaaactaccttggaacaaacggacttaacagaaatgaaacaggagatattacaactgacagaacatttcatccaacaactgcagaatacacattctatacaacagcacatggaactttctctaagatagaccatatgctagaccataaaatgagacttgataaatttaagaaaattgaaattatatcaagcactctgtcagaccacagtagaataaaactggaaatcaactccaaaaggaatcttcaaaaccattcaaatacatggaaattaaataacctgcttctgaaagcattgagtcaaaaacaaaatcaagaaggaaatttaaaaattcttcaaactgaatgacaataatgacacaacttatcaaaacctctggtatatagcaaaggcagtgttaagaggaaagttcatagccctaaacacctacatcaaaaagtctgaaagagcacaaacagaaaatctaaggtcacacctcaaggaactagagaatcaagaacaaaccaaatcctaacccgcagaagaaaggaaataaccaagatcagagcagaactaaatgaaattgaaaccaaaaaaacccatgaaagataaatgaaataaaaagctgtttctttgaaaagataaataaaattaatagaccattagcaagattaaccaaggaaagaagagagaaaatccaaataacctcactaagaaacgaaacaggagatattacaactgacaccaccaaaatacaaaagatcattcaaggctgctaggaacacctttacacacataaactagaaaacctagaggagaaggataaattcctggaaaaatacaaccctcctagcttaaatcaggaagaattagatacactaaacagatcaataacaagctgcaagattgaaatggtaatttaaaaattaccaacaaaaaaagtccaagaacggatggattcgcaccagaattctaccagacattcaaagaagaattggtaccaatccttttgacattattccacaagatagagaatgaaggaaccctccctaattcattctatgaagccagcatcaccctaatatcaaaaccaggaaaggacgtaaccaaaaaagaaaactacagactgatgtctttgatgaacatagatgctaaaatccttaacaaaatactagctaactgaatccaacaatgtatcaaaaagataacccaccatgatcaagtgagtttcataccagagatgcaaggatggtttaacatatgcaagtcaataaatgtgatacaccacataaacagaatttaaaacaaaaatcacatgatcatttcaatagatgcagaaaaaacatttgaaaaaatccagcattgctttattgtcaaaactctcagcaaaatcggcatacaagggacatatcttaatgtaataaaagccatctatgacaaacccacagccaacgtaatactgaatggcgaaaagttgaaagcattccctctgagaactgaaacaagacaaggatgcccactctcaccactcctcttcaccatagtactggaagtcctagccagagcaatcagacaagagaaagaaataaagggcatccaaatcagtaaagaggaagtcaaactgtcactgtttgctgacgatatgatcgtttaacttgaaaactctaaggactcttccagaaagctcctagaactgataaaagaattcagcaaaagtttctggatacaagattaatgtacacaaatcagtagcttttctatacaccaacagcgaccaagcagagaatcaaatcaagagctcaacccctttcatgatagctgcaaaaaataataatagtaataataaaatacttaggaatatacataacaaaggagttgaaagacctctacaaggaaaactataaaacactgctgaaagaaatcacagatgacacaaacaaacggaaacacatctcatgctcatggatgggtagaatcaatgttgtgaaaataaccatattgccaaaagcaatctacaaattcaatgcaatccccatcagaataccaccatcattcttcacagaattagaaaaaaaaattctaaaattcatatggaacaaaaaagagcccacataaccaaagcaagactaagcaaaaagaacaaatctggaggcatcacactacctgatttcaaactatactataaggccatagtcaccaaaacagcatgatactggtataaaaataggcacatagaccaacggaacagaatagagaacccagaaataaacccaaatacttacagccaactgatctttgacaaagcaaacaaaaacataatgtggggaaaggacatccttttgaataaatggtgctgggataattggctacccacatgtaggggattgaaactggatcctcatctctcaccttatacaaaaaccaactcaagatggattaaggacttaaacttaagacctgaaattacaaaaattctagaagataacattggcaaaacccttctagacattggcttaggcaaggatttcatgaccaagaacccaagagcaaatgcaatgaaagcaaagataaatagctgggacctaattaaactacagagcttttgcacagcaaaaggaacagacagcagagtaaacagataacccacagagtgggagaaaatcttcgcaatctgtacatctgacaaaggtctaatattcagaatctacaaggaagtcaaacaaatcagtaagaaaaaaacaaacaatcccatcaaaaagtgggccaaggacatgaatagacaattctcaaaagaagatatacaaatggccaacaaacatgaaaaaatgctcaacatcactaatgatcagggaaatggaaattaaaaccacattgtgaaaccaccttactcctgcaagaatggccataatcaaaaaatcaaaaaaaaaatagatgttggtgtggatgtggtgaacaggaaacacttctacccttctggtgggaatgtaaactagtacatccactatggaaaacagtgtggagtttccttaaagaactaaaagtagaactaccatttgatccagcaatcacactactcagtatcaatccagaggaaaagaagtcattattcaaaaaagatacttgcacacacatgtttatagcagcacaattcacaattgtgaaattgtgtaaccaactcaaatgcccatcaatcaatgggtagataaagaaactgtgatatatatatatatgtatatatataaatatatacatatatatgatggaatactatgcagccacaaaaaggaatgaattaacagcattcgcactgacctggatgagctcggagactatgattctaagtgaagtaactcaggaatggaaaaccaaacatcgtatgttctcactgatatgtgggagctaagctataaggacacaaaggcataagaatgatacagtggactttggggacttggggagaagagtgggagaggagtgagggataaaagactacaaatatgggccaggcacggtggctcacgcctgtaatctcagcactttgggaggccgaggcaggcggatcacgaggtcaggagttagaccatcctggctaacacagtgaaaccccgtctctactaaaaatacaaaaaaaaaattagctgggcatggtgggggcacctgtagtcccagctactcgggaggctgaggcaggagaatggcatgaacccgggaggtggagcttgcagtgagccaagatcgcgccactgcactccagcctggacgacagcgagactctgtctcaaaaaaaaaaaaaaaaaaaaaaaaagactacaaatgtagtgcagtgtatacatggatgatgagtgcaccaaaatcttacaaatcaccactaaagaacttactaatgtaaccaaataccacctgtaccccaataatttatggaaaaataaatttttcaaaagcacaaaaaaagaaaaaaacctaatcagtactcttcagaagtgtcaagataaggacccagattttcccaaattaaaggagatgaaggagatacggcaactaagtgccatgtgggatcctggaccagaaaaaggacattagtgagaaaattagcaaaactggagtaaggtttatagagtacttgatagcacagtatcagtgttagtttcctgatttcaagagttgtaccacggaagatgcaggcattaccagcagctgagggaagagtacacagaactttctctactattattgcagctttactgtaaatctcacgttacttaacagtacaaataaatgaagaaaattgggccaatgtgaattttgattgtcattgagcccctcaccccccacaacacgtaaggccccagagcccaacaccagcgtgcactttgctcttccaggagtttcactggcaggagcagggcaggtgcggccaacatgacctctcatgtttctcaccctgggtgctgtcctggttccagaaactccgtgcctctagcctccttccaggacttctcccctggcctctaggcctttccctctctttccccccagcctgtaaatgcctgttctttgaggtccaactcttggtggcaggcctggacccctccttggcctggagagttcagatggtccctccttgctgaggccaccatccacttgttgggaggaaatgctcatgagtctcttcccggcagacaggaaaccaccaggaggcagtgccctgtcaccaggggcttgcaggactgacatgaaccacaggctcaataaaaagaggcagagtcaaccagtaccccagccacccatgcagctgctccaaggtgaggggcacacccagggcctggcacgtaggactcatcagagcacggttatgtcatcagtctggcaggatgcccacgctgtgctggggatggtagccttggcagaaacctgcctcttaggtggggtttcagctggagccactcagatcctaggcccaccctgcctgattctctttctggtcgccatcaatggctaacccgttcgccagtttgcctaaaagtggcttgagggggcccaactttgcaagcagaagacgagaatgagaagggctgaaaagtagatgcactttctatcttttcccccctgctcagggacagcactgccaaattcagggcaggtaagaaaataccacccacaagctagatacttcagaaggtgctggaaaaagaaaacactcctttgccttgattggaccccaggcttgactgtgctcctccgtgaagaggatgtggtaccagccagttccgagggaacttgtgcagtgcggaacgctgcatacgcacagctctgcagatgggagcaggcaggatccccagggatcagggccacgactcagtcgtagggcgccccagagagtaacacagcgacaggttctcatttgcaaccagggtgccgcacacgactgttttatggcagatgttgccatagctacctggtgtgggagaccccacaaaagtcaaagttcaaagtcagcggacgtgacaattaagaaaacactggaagacctactctcagagggaaacacagtctcctcacttcaaaccagaaaggcacaaatagttggacaaaagaagccgcgtaattaaaattcatgtgcaacatctccctgggaagcctggatattttagcgacgtccccccaggcctccacactcaagtgggttttgttttggagggaggaacccccttggcggcataagacggggcaccgagtggcatctgcctcttgagtacagctgcgccccgctgtgcgcccggtgggaggctggcagccaccgcagcccctgtgctcgctccccgctctcggtccggtctgggtctctctcggcgcggtccggtctgggtccgaggccggtctccccccccctctctgcaggtggcccctgtgcttgctgcccctctctcttctcggtccggtctgggtctctctcttctcggtccggtctgggtccgaggccggtctccccctccctctctgcaggtggcccgggtcgggggtgccgcactcaccagctcgggcaggaagaaggcgaaagggatggtgaggaacagcgcgacccccgagggcacgtcggacggggcgtagctggtggcgggcgggtcgggcgaggccatgctgtcagcccctgccgggtgctccgcggcagctcgcccgcgcgcagcctgtcaaatatcacctcctgcccgacacacccatcggacgtcgcctgggagggaaaaaaaaaaaaaacgttccagccgagcaggtccttccactcgctgcagccagcagatcctcagtgggcggcccagcggcatcggatggctctgcctggccggcggggggcacagcgctggtgcaggagggagcagagcgggagtctcctcctagacctttccagctaaggaatctttgacccccggagcatgttattccaggggatgccagcgacagccactcccctgggcccagagtgtaggcccaagctgcttggctacgagggctgcgtactgaggaccaacaatgagccaagctatctgcagacagcccgggtgcccaccacggcctgcacgtggctgttttgcccttttccaagtgaggagactgagaatcagtgaggtcaagtcaagaccacagagctggttactaacaatgctgggtcttgcccagctccctccttttccactcttggggacagctctcagtccccagcctcccctgggaggagcagccctcccttccagctcatgcccctgggacttggtgtttccttctttttctggatccctttccatggtcctccactcctcttttcctcatggggcagatgaaggccccccagtctctgggagaggaccacaccggcaggcaccagagaagggctgggctggctggctgctgcctctagt

SEQ ID NO: 210 - DNA, 91 bp, Homo sapiens
atggcctcacttgtccacttcttcctgccctgcccctcgaatctgctccaccatttgggcagggcaggcagaagtggacaagtgaggacac

SEQ ID NO: 211 - DNA, 91 bp, Homo sapiens; identical to SEQ ID NO: 210

SEQ ID NO: 212 - DNA, 200363 bp, Homo sapiens
cagcagaatggaagtgaggaaaggcaaccagctgacacaggagccagagtgagaccagcagactctcacactcaacctacaccatgaatttgtgtctatcttctacgcgttaagagccaaggacaggtgaagttgccagagagcaatggctctcttcactccgtggaagttgtcctctcagaagctgggctttttcctggtgacttttggcttcatttggggtatgatgcttctgcactttaccatccagcagcgaactcagcctgaaagcagctccatgctgcgcgagcagatcctggacctcagcaaaaggtacatcaaggcactggcagaagaaaacaggaatgtggtggatgggccatacgctggagtcatgacagcttatggtaagcactgtttctgggacctctccattaaagtgtgccttggccttgaaatggccctagaagctcccagatatggtcttgtcatggactgaatgtcctttgccactgccttcataagcagtgaattgcacacagagaggcatctttaggaaattaaagcaatgccattttgggggttctgagctggtgtatgcagacacactttcccctggagtcagtgggttagtatagttagggctctattggttgtgtttgcagctagctccttctccctgaacacatttcaggaaccatgtgatctcatgtgggagtgagttcagggaatgctgaaaaatattctcatctttccctaaacaaaacttaattaaggctggtgggggtgaggtgaagaggatggggaggaatgttctatggaagccagtaaacttagagccaattgtgttcctccctccagccaataaatatgacactggcacttgcatgctggtgagttttaacctttggcttcttgaggttatgttgctcttcttcttgcccttgtctctaactgccctcactttgaaaggaatctttgtgtacttgttgctttttctttaaagaatttttttcagaattctttttgaaatcagaaagagtaaaaaaatacacatatgggatgtaacttatttttcttttatgtttaatatagaaaaagttggaagctgtagacaagcaaaaaaagaaaaaaattacacataagtctactactccaggcaataaccacaattaacatttcagtgtgtatttttctgatactttgcatacacacacaaatatatatatacatatatatacatatatacatatatatacacatatatacacatatatatatacacacacatatatatatacatacacatacacacacaaatacttggaaaaaaattgcaaatggaatttagatcatgctgtgttttgcagagcagacttggtctgtagaagatgacctgttgttgagtgacaagagtctgatcattgaattgaggtttcagtggtctcactgaagtggtctccctgatagtatagatgagatgcaagaatggggttaggtgaggtggagaaagtggagttgtgttttgtgacccactcaaggaaggtgccctgaagtatgccgatttcaaatcgtgattcccaaaaatgtgcagcaacagttcagttcagtgcaggttgagttcagacacaggaaatcatactcagttatacatgtgcttctttctttccaaaaggggaaaaaaacttgtttttaaaaaagtatgtaaaattttatacacacgtatgtgtatgtgtgtgtgtgtatgtgtatatattagaagatgcttacttctgaggaacattttagaaattcttttctagttcttactatgtaaataatcacactctgcatttaatctgttaaaagtgtctgtaggcattggcttttaatatatctaaaaaaatggtaccttttttgaactgatggatttaaaaaatgagattccactgtgggagcttacactgaaaagtaactaggtagtttttcctagagttgcattttaaaattgctcattgactcacatttgtgtaacatttccagagtagtttagataaaccaacagaaaataaagctgattgtcaccattagtgttaccaatgtatatgacacagcaggtaacacaggtgcagttttaaagtttctggttgtatgcatttcatgttacagctttgaagggaaagagttacagctcagtggtaattttctcttgtttctctcagtctgtcaaaccttttccatgggcaagaagaagccccacaaatagcaaatttataggctttaaatttctgcagttgttttggctgtttgtatttcttgtgtattgatgaaaatctcatagggaaggcttccccacattttaaaggacaataatttggtcttagcttttcagcctcacagaaatattattttttaagttacaaaaaaatcccagaataggctgttagaatttcagccaccttatatgcctgtaatcataagactttgcatctcaaagaaactatagaaattatttattccaacttactttcgtagatgaaccttagcaaaataatttgtctttttctcaaaaacaacaaagaaacaatcaaacaggtcacatcagcaactctaactgacactgctagttttctctttcatcgaatcaactttaacgtatcaaagtggttttgggagctgagtttctggaatttttattggacttgtatgtatgtgcttgaggtactggggggttatcacatggtgagatcctactaagacagtgtctcatttggtgctgttgacttttggtctaaataggtcttgattgtggtaggatttcagcagcatctcaggggtctctacccactagatgccagtaacagctccctagttgtgacaatcaaaatgtctttagatatgtgataattatccccttcctgccaccttggagaactgtactaagagtggaagccacaaacgctatctgacatcatctttttaaggatgttatcaagcagataactggttttagtttttttgtttgtttgtttctgagatggagtcttgcgttgttgcccaggctggagtgcagtggtgtgatcttggctcactgcaacacccacctcctgggttcaagcctcagcctccagagtagctgggattacaggcgcacaccaccacgcctgcctaatttttgtgtttttagtagatacggggtttcaccatgttggccaggctggtctcaaacacctgacctcagatgatctgcccgcctcagcctcccaaagtgctgggattacaggtgtgagccgctgtgcctggcctggttttagttatttcaaacttgaaagcctagtgttccccctggtttccagttctggcaccaacaatttggattgaacaagaggattgtactagggattagttagtatagtccagggccagtcctagaagctggagagccattctgatgatatatgcttcccttggaatctgtcagtatcagtaacattgtgtgacatgcaggcagctctggtagttaatgtcacatgctggtgcagagactgtaggattctcaatggtatagctgggctggcagaacagtgatgtggatgcataggccattagtttgcagtctctttttttttttttttttttgccataaatgcagcctatgtgcagtgcattgcctacacatctgctttgagagtgaagagttgatcctgtatggctaggatttgtgtctggtttaaatgaatccagcaaaaagaagaaaaaaattccttctttatctcatccccatattggtataatcagaggcttttaggataaatgggtatacagtaggtatttgagggattgtagtagctgattttagatgattgctgatttattagaatttctggttagagattccaaggcagcagggctcggtgaactatgacctatgcgccaaattcaggacctttgattgtgtaaatagttttattggaacacctccactcccatttgtttgtaacaaatgcaataacagataaacacggtaattccagtatttatttcataaaacatctgaaacattctgaatccatcaatcagcagtcaccatggttattctaaatactcatctgatcaagttccttattgattcaactatttcccaggactcccatggtctaaggcagagtcagcaaaccatggcctacgggccaagtcttccttggtacctgtgtttgtaaagaaagccatgcccatttaattatatgctgtctatggctgcttttgcactatagtggcagagttgagtagttgtcatacagactgcaaagcctaaatatttactgtctggttctttaccaaaaatgtttatcagtctctgacctagatagtctctgggtgagtctctctctctactggattttgtgtgtgtgtgtgtgtcccaagtctctttcacgcctgtgtttggattcgctcacgacatcttcataaggtgcacacataaaatgtagcatttctctgccctctgaaaatgcttcttctaagtggcaggtcgagagttgtagtggttaggagcatgggtttggagccaactggtttgtctttgccacatcctgtctgcatggcttaggccctagaagcacaaaactgctttaaagtggggtgtcagtgcctctcaccaaggactgtgagacatgagcaaagtgctgtgtgtcaggtgcctgacattgtgtgcttgttgttggctgttagtgtgacttgtgactagtactcaaacaataatagaacttgaagagtatcttcccttccccaacccatccttgttttggtgatttgaaaagagacttctgaacttctttgggatttggcaactccaaagtgatactcagaactcccgggcagcccgtgtggaacattcagtgcgtttgttcttggagtgtggagggcttttctgtgtattaactctgtcagtccagagaggagtgtgttggcttttgcctcccaggcaagtgtagagccagagccctctgcaggtcagccccatctgcatctcccagccagtgtggcaggggccatgcctgccagtgacgtctcgggaattgtgtcatggatggtgccactcacccgagtcaatgctattcttgtttctgaggtgaattgatctctgtctccagcagcctgacccaaattctgatccctagtgatcacctcttatctaacaggacaaacccggtccacttgtgttctctaatgaacagtaatggaaatctgaggcaaggtgacatttccccttatggtccatccacacgttgttaaccctggcttctctgggctggggtactgtcctagaaaagctgccagctcaggctcaagcagctgtgggctcccagcttctctctgccgacccccatcccactttgcctgctgcctgtttcctccttgacctccaggttctgtgtgcctgttcttccctacgttctgcctgtctcctggttccctgagctttttagtcctggactggccctttggcttctgtctttcaagcctggtccttcaggaaatgtctgtcattggctggaatatcccccacattttgtgcatacagtgagaaacagatggacaaaggccctgctctcatagatgctttgttatctttggaagggagaaataataagcaagagaaagtcagatagcagtacattccaggaagaaaaatggtgatagggtttaaaatatctgaggggctactttgcactagaaggtcacctctctggaggtatcttttaaccagaatgacacacggagcagccaggtacagtggaaagagagaggtggaggcagagcatgccaaggagaaggcacggcgtatgctaggtcctaaggcctactccagggtagaagggaggccactgtagctagaacgaagcaagcaagcagtggcatggaaggtgttgaggcagtgagaagccggcagcttatgcagagccctgtaggctatgacttctggtatcaatatggatgttcttatgcagaaaccagatgttgacctcaccctatagttcactgctttctctatgggaggaaggaagttttttccttaaggaggcacacacgccggttggagaaccagcatagggcttttggttgctggttgggggcagtggagaggtaactgctttggacttccgattggccctcattggcttgggatgctatgtctaagatgttaataccatttagggctgccgaagattgctctgaaaggttagcagctgccctgtgttgcagatccagataacgttctgagattcgaatgagagcttttgcaagtgtttccttccacctctcttgtgaaaaaggaacaaaaacaggttggatttcattaaagatgcaagcatgtaaagggttttttagtttgttttgtttttccactttttttttgtgtctctcttcctacaaatagggaaatatggtcaaggaataggaatggtttcttttttctttttcttttttttttttttttgagggctgggactgttgtgggataatgtggaaaaccactgttgccaaagtagaaatcccctgcccttgagggaaatacactgttcttgaagtgaaaatggtagggaaaaaaatagctgggctgttcagtgtgtctgagaaggcttttagttactgtatggtgacgtggctggtgtgattaaagaaagggctttctgctttaaaaagcttggaacctaaaaatgggcctctctgtggcttgggacttttccagccatcctgtggtagagtccagcctgcccagtatcctcatcaaagccaggccaagttcacaagcacgcccaggccagtcaaaaggtctgaggaagacctcagaaatgttttagacaggaggagtaaactcagaataaggggctcattcttctacccctcagtcattaagaccctttctttcatgcagcaccactacttcaagtctggattgaggagggattgcacgcacatgtgtgaggttggagtctcaatctcaatgtgattgtcattgccatgttcaaacgatgaggcttagaatgtcccttgtcttacctgatggtcatagctctctatgaccctctgcttcttcccagctgtgtcctggtgctcttttgctgtcagaagtgcttgagcagacctcttgctgctgtggacaccctaaaaagctccgcaccccctcaagtctactaaggcatggtggctctcttctaggacaagactgttgggtggtggctgagcattcgcctgtctttgagcgtctgcatttgctctcccccaccccttcctctcttccttctttgtttgtaaataaagttggttagaacacagccatgcgcattccattctgtttcagagaagttagccttccctccttcacaggagggcccaaacccactgttactctcattctttataacactcaagctacttagcatcaagtatttgttgtatgagctgatcatgtgtctctcccacttacaatgtaagttctgaaagaggagggactttggtctgttttgttccccactgtgccccagagcttagtaccttttgcctggcacatagtaagagccatgaatgaatagcagcagcccctggtgaaactctgtgatgctctgtgtggtacagttacagctgggactcatttgaaaatcacagtaatgtttttagtgaagcaggaaatgagaagaaattccctatgggctctgcatctaagaggctccaagtagctcttatgcatgatcctaacatgggaaccattgtttattctggaaggtagttagtgtttctgttgggcggatggaacacattgtgttccttactgatgtgtgaccttgaacaagtcaccgatcatcttaaagcttacttcctcttttgtaaaacagacaatataatatcatttaacctcataggcttgttgtaaggattacaaatgacaaagtttattaaggcacttagattaatttagattattcttgttctttttttttggtgttgtttttgttttattttgttttgttttgttttggagatagagtcttgctctgtcaccaaggctgaagtacagtagtgtgatcaggctctagcaacctccccctcccagactcaagccttatgcccacctcagcctccagagtagctgggactataggcatgtgccaccacactaggctaatttaaaacaaaagtttttttctgaagatggagtctcactgtattgcccaggctggtctcaaactcctggcctcaagtgatcctcccatctcagcctccagagtagctgggactataggcatgtgccaccacactaggctaatttaaaacaaaagttttttttctaaagatggaatctcactgtattgcccaggctggtctcaaactcctggcctcaagcgatcctcccacctcagccttccaaagtgctgggattacaggtgtgagccactgtgcccaaccagcgcttaattaaaatgcattcattcctattagtaatcactaactctggcttgaatgtacctgcatctgttaccacccaggcataactgttcatgtagatctgacgttgttcatttgtttgaacacagggcttcagcaacctgtttatgtagctattcttagcatttacaggggtagagcctgaccagacatgagaggaaatatgctctgtttcagaagaggtcaggcttgccaccaccctactaaactaggagatgtggttgtcattgccctgttcaaaagatacagttttcttctgtgggctgtaagataagctgggtatggccaagttcacctttggatctaaccagggcattggtggtggtggtgtttctggcatggtacagcaagcaggaagcagtagtgtgcgaggccaccctttccaagaaggtgcgggccctggcatcaggtgggggacaatggataacaataggcttgacctctcagcacttctctgattccttatcttttctataaaaaaggctaaaattcttggttcctattccctgcagctggctacatgttaggaaaattcaaagaatagcttaagaactctattcaggttccataaagcacttaatatcatcaacaggcctagaaaggatcttttaccagatttcgatgcatggaaacttcctcaatagtaatgacaccctctgcaacaccttaggaaaaacattcgcttctgggcacaagttctggtgaaagcttaaatctgtagttctaacccagaagagaaggctagtcagtgttgctgagcatctgagctgctctttgactttggtgataattgttttatgcccttttctgtccagaatctgctgactgggacaactgcagggtggaagccacctttttgtcagttcaggagcaggcaaattatctaacatgtggctttaaaattcaaatgagataaggcagtaagggtcactaagatgtttctggtgggtattgccttacatgactttagggtactggtggcactatctttgattcttaagagtacaattcattgtactatgtatatatatttaaaataacacttaatgcctttgtgactttgaaaataatgtgaatttttatgtaaaattaaagcatatgaggaagtatggagaagaataaagaataaatacactctttacctctaaatgcagatcttaccagataaaattgatttccctttagttctttaaaaaaaaaaagtgatacgtacatgtgtgtatatgtgtatatatgtacatgaatatatgcttttttaaaaattaagatactgcatttccttatgccattaggttttttttttttttttttttttgagatggagtttcactcttgttgcccaggctgaagtgcaatggcacgatctcggctcgccgcaatctccgcctcccaggttcaagcgattctcctgcctcagcctccttagtagctgggattacaggcatgtgccaccatgcccagttaattttgtatttttagtagagacggggtttctccatgttggtcaggctggtctcaaactcccgacctcaggtgatcggtccccctcggcctcccaaagtgctgggattacaggcatgagccaccgcacccggccagccattaagtatttttgatgactgtatacttttcgttttttatccatccacttaacaaatatttattgaactcctgatattaatagctagtggctgtaaacagagatgacaagcagacttggtctctgccctccctaagtttacagtctagtgatttattctatcttatgaatggctgacataatgtaatttaatctttttattttgtgtttgggtaatttccagttcttatctgtaataacgctattttataaataacactgctttgaatgtccttgtacataataaatggactgtatttgggtcattactgtaactctattatctttctgtggaaagatcactctaaaattaatttaaaaatatataattgatgaaacttgacattcctgacagtcaatggaaataagaggttgaggttaattcttttttcaatagcaccttcctttctcattaacgccctgtctttgccagtttctccagagcagcaagtgaagctgctctgtggctctgttgttcatgctctgcctctcgggcagccatggtgaaagggatttgattcatgagcaggcacagatgtaaataatttttggcatttcagatgtaagaccttgctcattgcgtagttggttctgtgccatagtatcatggcggccgtaccttcacagtagatctcaaccttggctgtgccctaatccttgacggactctgcagatccggatttagtgtgttgaagatgcaacctggtaactgactgcacaaagtgagtctgatgcacagcagggctaagaaccactgctttagaagcatgttccaggaaaaatggggtggtggacagcatagctcccaagcatggccatttttgataattcctcaaatacggattgattttgatgatctgggaaatgaaggtttaccacccagtctcacagcattagctgatagatctataaaccttattccaccagcagggccctcctttttactgagatcccatctccttgaattccagagatggagaaaagtgtgacttgcagttatagctccttggctgtctgctcaaggatgtgtctgtcaggcccttccaatcacttcttacccatcaataccatggcttcctggaaatgaaaacttaacagaagctgtcaaataacctgttccaatgcagtttaatcgaccttaccatttatcaaagaatgctggcatgatagaaaccaaagcctgctttccccagagagacattttaaatgtttttcaactactttgatctcgtcttcatcatgtacagtaagttttaggaatgcagaattgcagtagtaatgttgggattaaatttttattgcaaaggctttgaagcacaaacaaaattttaaaagctcattagtaattgaaaatgataatcttgttgaggacgcattttatggctataataactataagacgcaatgaaatattaaaatatactagaatttggagtaatatttttctatttttattaaactatagaaattatttgtacagttgtattgaacaaaagggttaccattaggattaaaacacaaatggtctgggcgcggtggctcatgcctgtaatccgagcattttgggaggctgaggctggtggatcacaaggtcaggagtttgagaccagcctgaccaagatggtgaaaccccatctctactaaaaatacaaaaattagctgggtgtggtggcacctgtaatcccagctactcaggaggctgaggcaggagaactgcttgaacccaggaggcagatgcagtgagctgaaatcgtgccactgcactccagccttggccacagagcaagactccatctcaaaaaaaaaaaaaaaaagattaaaacacaaaaatactgttatttctttattttattttatttttgtttatttgagatggagtattgctctggctctgttacccaggctggagtgcagcggtgcaatcttggctcactgcaacctccacctcccaggttcaagcgattctcctgcctcagctttccgagtagttgggactacaggcacacgccaccatgcccagctattttttgtattttttggagagacggagtttcaccatgttggtcaggccggtctctaactcctgacctcaggtgatccgcctgcctcggcctcccaaagtgctaggattacaggcgtgagccgccgcgccagcctgttatttctttaaagttgtgataaaactgttaacagtttttggaggtttaacagtaaaatacaaaggtgcaaaataatttcattgcccggaaaggtataatttattgagccttatttgtgagagtactatagtttgtttcactcattcatttgttcacttacgtaacacatgcttaatgtgcctagcactgtataatgatacagatatgggcttggcgtcatctctgtcattgtgttttttattaacaacatccttaatcttgggttggctgctttgaaatggtgactcaggtagctgcttgagttgaaaatgaacttttttctttcatattgggagagaaaacatgcctacctaggtaaagtgcttagagaattcaaggtttttagtaggcttatattccgtcttcattttaagggagaagataaagaaagagtcttaattttaaaaaaatcttggatcacttgatgtatctggtagtctccagtgtcagctggtggatgtttagtgatactgggtcgggtggacagagttaccacaggacagggacatgagtgagtcttaagagtgattggtatatgttgttacacaaacacatggcaaaatcccagaggttattccctaacaagtagattcagggggagcaagtcagagatgcttgctggtggacaggtccattgtagttcttaagaggtggtgaagcatggtgggtaagagccatcagccctggaaccagactgggtttgagtcctggatctgtaatcacctctgctaagttatttagcctctctgtgctgtgatttattcatttgttaagaggggcatagggatgatcacatgctcctcagactgtcttggtaggattaaatgaattagttcatgtaaagtgctcagcacactgcctggcatatagaaagttcaataagtggaggaggttatattggggtggccgtggtgatggtgatccctcctcctcattatgaatccccttttacactccatgtcacacagtcacagaaggtcaatctttggcagatggggtcaacaagagatagtaggtcagttgtatttactggtcactgtaatttgagaattgagggagaatatcttcttaattgtaagtatgacaacttcatatcctacctagagtatactccactaataactatcaccaataacaatggattgagggactgtgtccagtagtctgatgagagcccatcagcattggctcatgttctgttagctcccccatagggaggaaggcagacttctctcactgcaactttctgttgtatttgtagcagtccctccagtgaatggaagtcacacatgatgcaggttcattcagtaggcatttcctatcctgtaacctctctatcacagttctctctccatgtctccacagaggggcagtggggaatacagaggggttgagagaatgcacctaattcagcggttgtcaaatcagggcagttttgtccctccaaaggatatttagcagtgtctggagacgtttttgattgccacacctggataattgctgttgtcattcagggagtagagaccagggatgctgctaagcatcttacaatgcaaggacagtcaccacgacaaagaattacccggcccaaagtgtcagtagtgccgaggttgagaaatcctgagttaagtcacactagagggccagggcttctgtgcttggccaactacaattaccggtgatagttaaatgctattctagattgtattcggattctagctggctgatgacacaggctctaggcaaagaggctgaaatgggggagattgatcttttatatctgaagagtatttctttatactgaacattgccacttctcactggcacgactgcccccttctgtgtgactggcctctggcactcttcagaactctggagagccagttgatgcattagacttagtgacagaacaggtgactgactcccgctgtctgtgccaactaatgatgtgcctgtgacaaactgagtcatgctgaccgtgggactgcagaccgcagaggagagtgctctcatgaccccttggataaagcagtgaagctttgcatcacctgaggagagagttctttgggaaggatgagaacattttccagtgaaaggttttattttacttatatatttaacaggcagttatgcagtgcttattatgtgccagccagtattcaaaacaccttataaatattaactctttaactcctcttgacaacctcaaagctgaagtgttgttcatgtccctcttttacaggtaaggaaacaggaatgccagaggtaggactcaaacctaggaactctggctccaaagtcaggcccttaaccactgtgttatggatgaaagactctgaacttcacccttggtttcttttttctacccaggttcttgacttctgattggtcccattgagatgtcagggaattaagcagtcctgaggcaagccctcattttatcagctcattatttaatatctgtgaacctcagttttcttatctgtaaaacggagtcacatctacctcatggggaggatgtgaagataaaacagttgtccattttgcattgctgtaaaaaatacctgagcctgggtaatttataaagaaaagaggtttatttggctcaagattctgcagctgtacaagaagcacagcaccagcatctgcttctggttcatgaggcataatggaacaggctggtgcacctttgttgagattcgctggctgtgatctgtgctgtttatgtgagcatgtgtgtttatttcatggccagattaccgcatctgctcagggacaagtttgctctgtttttaggagaatggaagatggcaccttcccgtttgtcttaactcagggcttttctcagtcctgctacccacactgtgcacttttcccctggcccactcccaattcagaaatgggtctggattctatttctgtggatggttatgcagtcacccatctgcttttctgacacatacaagtcagtatatctttctgtgattatgaatttttagaggagagagtctaagcttatcttttcttttttctttgaatatcttgtctacaaatagtaaatgcatccataggggtgaagaaggagttcctgtaatttttccagagggaagtgcagtactctttaatgtgtagtcagatgtgtgagaaagggaaccaactcttaaatgtaagaacgatgagagtatatccccagcatctagaataatatctggcacatagtagtagcttaataaatatttgtgagcaaatgaatgagactaatctttattttaaatatttcctaaatctgattatagtcaactctgggttacctagcagacctgaaaatctggagctgtagcttttatgaagtgttagtgtatgtaactaacagaattaaacactttttaaaaaactgggacatgctagagtatgcaacacgaaaaataacaaacttgatccagaggctactttgggatcttgctgcacccttggggtgtcaagctttgtgtgagaaactatggtgctgtaaggaggaggaattcagtgtagtgctatagcaggatgctaaataacaaggagttttctctcttgaccaagtagctggaaatagttataccatgttacttattgccagacttgcattccacgacagactgatgtatttagtaggatctgggccagttgaagacggcccttgtcatctttcagatgtggtttgacagatcttttgtatcacttcagaaacatttgagaagttttgttctccacgataaagagagagcaagccagacagatatgtagaggccatagaattttaaaattgtctgcactttcttttacagatctgaagaaaacccttgctgtgttattagataacattttgcagcgcattggcaagttggagtcgaaggtggacaatcttgttgtcaatggcaccggaacaaactcaaccaactccactacagctgttcccagcttggttgcacttgagaaaattaatgtggcaggtaaaaatagcaattctctgccctgatatggagtcacaccctgctttggaccaagaagagaataaaggagagcagtggttcttactggaacctgcataatataaattctataaacttggcatggccattgtaaagataagtctaaatttattttttaatagcagatgttaaaatgctttttatagttttatcatgatgcataatatttggtggtttgtgtgacacatttgctcttaatgagctcctggaattcacttgtaaagagaagattcatggcatagattaaatgaaatacagaggttatttgagaagcttgtgccttttagagttcttcctcctccgtactcccatcagacaattttgaaagtctgttacgtataataggttctctcctccctgttgttaaaaaagagccaccattgccgaaaatgcctcctatgtatatatggagaaatagaaattctggaaatggcttttaggagataacccctgcctagtcgtaggcagattctgtagccactcatgtacaccaccatgcggttcccactgggaggcattttgtttggctccttctggaaactggaatattggatgagacaaggaaaattgactaaaaacaacacccagattatacgctgcatgttgttgcctgcagctcacattagaacccccccatccccgcaactcccccaccatcacactgctctgaggtcagcccctgggtctttgtgcttgaaccaggactgctcttgttagggtgaccacgattttctggggacccaggacaaagtgaagagcctgaggattaggattcagtgctttgggtgaatggttgtgaacaagctgtctatacttttggtgggtggtagccaaactctggttaatagataaagtaagtaactaggttacttttgacatcagttcctgctttaaaaaaaaatcttgtttcatatacttttaagcttattttcctttcccttttgcttgtaaaaattcacacacttaagtgggagagattctttacctttcccacctcccagcgtcaaaacatttaattgttttacattatgcaaggtggttgttattaccttttttaatgttctttgccctttagcaaattttaaattgcaaaatatatttctaataattcaaagtattcaaccaaacaaaggtattaaaaataacttttaattacaacacagaggcagtgtcatctaggccgtaaatcctgtcttccttgcagtttccaacagcttctgtaattagacaagagaacctcccactgtgtttagctgctttttaataactggaaccatgcctcttcagtctccacttgccacccctgtaccctgtagaaaatgctactggaaaggccctatgtggtttcatcactgttctgtgtcatatttctggaggtgggatggagtgttctgcctttaactttgctgttctccactgcctctgaagtcctgtggcttgtgagcctctataaacacatctgctgtcattctttcccccatcgtggcatcttgctgcctctggctgtcctgtttgttgcaaggctcacaaggactttgctacctgggctttaagccacagagcacagggtcgtgggtacacctctaagaaggaaatgggaaggacttggtgactactttcaaacgaagtctggaaatataccagccgtatgtattgagctagtgtaccgcttaacaagcatcatgttctctaagccaatggctctgagcgggactcctttaaatgtgccactggtgctgtgtttttaataatatttaaagaaccagagtgttgtgttttgttttttttttcctttttgggcaatgggagcaaatttagagttacacatttaatgattaacctcatttgcatgtctttgcatctctcgggtatgtgtgggacacagtccataccatcataatttttactggctaattaggaaaagaatacacatgcataaaatgacacaaaccatggttgctgtaaagtgggggtgactcagaaaaaaattgggaggcagggaaggagaggaaactaacatttagtagctgtccagtaaatacaagttcctctgcctgaccctccaatgtacatgattttacttaatcttcttagcatctctgagaagggttttcacaggttttgttgagtttaagtacttgggagtgggtgactgttggtactggagtcccctgagctcagcttcagatctgctagtgctatgtagagaagagattctgagtgttaactccatctctccttccatttgtaaattatcataaaggcatgtgtctgtaaaaagatgctaccattttcttacctagaagagagctgccagtttcctagatttaatcatctgtctcattaaggatttctctgtctcagtgtctgctctcaggctaatgtttgtaaaagctggcccgtgtatgtgtgtgtgtgtctgtgtgtgtgtgcgcgcgcgcgtgcgcgtgcatgcatgcagaggcatccctttcatagacactgtcttggccaaagtggatatagatatgctggacagccttcttcatttcccccagaaggtgggggggggtcctttatatcttgtcagtcaactacatatttttaaaaaacgatttgccatgtctatagagtaccagaaagaaggacaaggacttaagtgaacagttctcatttatgagcagcccttccttgcttttctgccctctctctgatccataaccatgctgatgtcttcagacccctctgtcaacccaagaatggctcctgagctgtgagagttcagttttatggggttccaatcctcgccaagtaaagtttttctctctcccttcctgaatggagacatgcggtaattgctcagaaatgttctccctggtgtgtctttacagctgactctggtgtcttattgctcactgatgtttctgattgcttattgttgtgtcttattgcttgctaatatatcttctggttggctataaactgtctctaaattgggtaccatagcaattgaagaaggattccctaaatttattttctttagggggatagctctgtgtgtgtgtgtgtgtgtgtgtctgtgtgtctccttattttttctctctagctgtgttctgtgtagcttttatccagtatggcttatcttcacaaatttatcaccgagggttttttaatgtgaaagtaaatttgcccctagggaaatttaggtggaaatgagctttattaaaatcaagaaatcagattgaactggatttttgagctctgtttgtcttgttgaagagaaaggggactcaaaggaatgaaaaagcagatttttaaaatccccacccttccaccaatcacacagtaaattaatttctccatattcactttctgaaagggcttgaagggccttcgtcaaaattctctccttttagaatgatgctttgaattttagaaagacccattctgtctttctctagttttgtgatcttaagtgaggaagtggagcgaataggattggatctgtggttctttgtcatgtacctgaaatggggaaaaggtaaaaagtatacatatctgatcatgaaaatgcttgccttctaaggactgaatgtctgatatatctttgttctgcccatagtgtcttgattgtagccttacctgttgaagataattcagtaaatattgctcacatggattggtttctattggagggaacagcatttggtttcaccacctggaagagtttcttcttatagttcttcttctcaatttacatttgtggtgatttgcctagaagtcggacttggtatttcgtttccctagttctcagaccttagcagacaccgcctaagaagtgggactgccttttttgttggtcaggactgaacttcccatcaatggttatgggatgtggaggcttcataggatgtgatagttacaatcctagatgtgatagttacaatcctagattgtgatactttagaggacaagaacattgtgtagctctctacggggtagtgtatgtatgtgcatgtgtacacatttatttatactctcaataaagagttgtcattcaaggtcagctgaataactggccagtgctgactgttccttaaaagccaaaaccataatgatagcatccaagtggtgttgtgatgacttaataattgcaaggtcacttgggaagcagaaccacaaaatcaaaggtacaggtataactcaagcgacagtttcctggtatttaatccaagttgaacttacagcaaccctgcattttttccaaagtggggagcgatatgcaacactttctagtatttggggttgaagtgcaatgtatttgaatttggaagctgttcttaaaaacagcaaccattattattattcttaccatttgaaagttgaaaatgaaaaatgtccctgctgagttccagggcttgcatttggaagtgcaatttccccctctttgtgctgctaatggaccttgaaatttagttgtacctgtgctctttccttgtatgtgtacccatgtcatcagtttgtgttgaagtagcacctgaagtgtcccagctccacccctgggcagtggctcagcagatgactttcccagggtcagatactggtatgtcagtgagatcccagatgctactgagagacgggagagagatgagattgcaggtggcttcctattaagttgagcaagaagcaaatatgttctgtctatctacctgtcactttctgttttgttatttgcaatggtaacaataaatatgtggacccttgtcagaagctattcttttggtatctttacagaaaaatgcttgtctttgttggtatggttttcactttgtgtggtcaaggatattttgtttttatttagaagaagaaagacagttcagaagtgatggtgatctttgaggaagtgaatttatagcagtgattaacagctgtgggcgattttgcccccaggggacacatgtcaatgtcaggacacattttggttttcacaaatgaagaggtgctatttcctttttttttttttttttttttttttgagacagtctcgctctgttgctcaggccagaatgcagtggcactatcacagctctttgcagcctcgaccttccatgtccccaccccctgccgcctcagccttctgagtagctgggactacaggcaatgtgccatcatgcccggcaaattcttttttcttattttttgtagagaatggggtcttgctatgttgcccaggctggttgggctcctaggctcaaacgatcctcccacctcagcctcccaaagtgctgggattacaagcatgagccactgtgactggcctatttatttctaatagatgaggacaagagatgctgcaaaaagcatcctacaatatataagacactgcccataatagaagtatccagccccaaatgtcaattgtggcaggtttgtgaaattccgatctatgagatactgttagaatctggtgccagcagatattttcacctatggttagtgcagaaagacgcctgagacgctgaagtttcctgattgccagctgagacctaaagttcctttcccttttcctagcaaggctgttcacaagcccccccacccccgccgcccgccaatctccacctcatttagctttgccactggtcttggaggcctccaaggaaagagattttagaaactcccagaagactattttaggatcctgcccttaaggaactcctttcctggcccacagtgtgcttttggcaatgtacattttacttctgcttctatagaaggtaattatttcttctcgtgaaaggaccactaattccggataacaatggtacaaagtagtcttagagaatgggtttaaattgcagaatgttttagaagaaattctttgttattttaagcaaagtatataattatcaagatatgagagagtaaattaaataagttaaagaaaacaagacaggtccccaaagatctactttacatcagaaaatacccttgacagcatacttggagcaatattgaagaaaatgagactagagagttaattgggatttgtgatgcattttcaatgttaaatgaaggagtttctattttgttccctgggccgtggcagttgatgagaggtttaaagtaggaggatgaataggtgtgaggtctgtatttccagagaataattatgggccatgtggagtgaaatgcatatgaatgggtgagagagactgcatttaatcttcagttaggaggagaatgccctgggttagagatgttcctatggcccagggagaaagaatttgagacccacgttagggtgaagctggtgttatggggacacggacagaccgtgggacagggcaagggagaatttgtcataattatttccaagggtgtagcttgaaggatagctgggtgactcattattgaggaaacaacccagcagagagacaaggttccatgaggactgtagccacaagccatttgtttcagaatatcggtttaaaggcagttgaaactttgatgctagtgttgaggggatgagggacaatgaaaggcagcatctgtggaaccagactggctcggttcaaatactggctccaccacttcatagcagtgtgactttgggtaagtttcttagccttcctctggctgagtttccccatttgtaaaatgggggaaataatagtagtgtccatttcacagtattgttaggaggtatattagtccatttttacagtgctataaagatactacctgagactgggtaatttataaagaaaggaggtttaactgactcagagttccacatggctggggaggcatcaggaaacttgaatcatagtggaaggggaaggaaggcacgtcttacatggcgacaggagagagcgagcgagagagcaaggaagtgccacactttaaaatcatctgctctcctgagaactcactaccatgagaacagcatgagggaaactgcccccataatccattcacctcccaccagctccctcccctgacatgggattaaaatttgagatgagatttgggtagggacacagagccaaaccatgtcaggaggattaggtgagaccaataacgttcttagaaacatgcttggcataaagtcagtactgtatgagcatttgttaattacagtttaaaagttacatatttggaatattgacataaaaatggaacactgtagtgacttcttatttggatatcaccactaatagtgaaattaatatgtgtatagtgctttatagattagaaaataattttgtatatagtgtttcactggaacactttaaatttgaagttcccaaattgatctttttgtgcctctgttatcaatatttagctcatcacgaaattcatgttttgtcaataatctcttggttgcaagaggccaaccacttagcttatattaacttaaactaaaagggaacttggggctcatgtcatttgaaagtttgtgggatgctgttgagaggttcagacatgggagccatctttaagaacctcagctgtgtcctctcaggtattggatactgtcagaagccatttcttttggtatgtttaccgaaaattcttctcattgttggtatagttttcactttgtgttgtcaagagggttttgctttttatcattaagaagaaaatacagttcagaagtgatgctgtccttcaaggctatgttaatatgttctgtcttttattttgccttcattcttaggccatctttgcatggtgagggcagagatggatggtcccaaggaggctctaggttttagttttcagtcccagacggctgtgctgctttccaggaagttttggcaactctctagagcagggtcatgattggcttggcttggcctctatgcctattcatgatccagtcagagtgaccagtatcatgttccatcctgattggctaggcctgggtcacatgggtcacccctgggaattcatggtataggagagggtccctgaagagatttcagatgagcagataaaatgcatatggctactagagaccctggtcatgtcatggtttggctttctggagctatcctaaacctgactcaagcttttctctccctgagtgtttggagggcaaagcctcaggactgctaaatttctgcctccattttaagcactactgtggccaaatgtgcctcagccccacttggaacgagcccaaacccctgcctgcagtttattcatgctcttacacacttaacatgtttttgtccacagcctggcatgcttctgttgttctggctgactcttctttaccacttttttcaagtctcatttgaagctctgtctccctaagacttgcttgatgcccctcacatcccagaggtttgtgatgtccttgccttgtgttcctaccatgtgtgtccttggacttttccactctttgcttgtcttcacagccagtctgtaagctcctcaaaggcatgggtgggatctcatatttttcttttcagttcagtgctgagcttggagtctggcaaatcacaggtttttatcaataaatgtccagctgggtacattcctccctctcctaaacacaactcctgccggtcaggcactgtgtcctagaacctttgccatgacgctgatggccatgctttcacttctagatcaccatttctgccacttatgtgctttgacaggtccctgaatccttttggaattcccagaagcacctggaaagtttactgctaaattgttaagaccggaagagcctttgtttcacttcacttttgaaaactgagattccataataagaatttattttgtgtttcttggtggctaattataaacctgtaagtaggattaaaaaaattcaggccacctccactacctgagaggttgctttgaatgaatagttcttgcagaaaagaaacagggacccagaatttctaattctgttggactaattactgacccttcaaggaatacatggcttgtttcatttcgaaaagtgagactatatatatccctgtcgggaataatgttcctccccagccacttgatgggggaactcagtaacatacactgcagggctgtcctggggaccttgaaagtgcgtctactcagggttgttctttgtattggtgataggacatgctgaaattagacttgtttgttttaatcagaaggtgacagatcccacttgcttaatttggcttaatgaggtatgtgtatacagttgtgatatcagcttacatatggtattgattcaatagacattccacagctacagcatagcatatgcttcctcagatagtcccttgtctgtgctgtttcatcctttacctgttttcactgacaagtatttcaacaaactcactgtagagcctgagatcttaaaatttaaaaaaatacttggaataaagctgatttggtgagacatggaagagaggtatctgactccatgtttttgaaaaggttttgtaggtttgaagatttctggggttttgagagattttcctttaagctgtgcttttggctttgcatatccacagcttctaaaattaggcagcctaaataaaaatcagttgctagtttttgtttttcctttctcgcttacatcccagaaaaaggagagaaagcaatgcggggtgaagatggtttgaaattctttgggtttagaaatgacagaaagagggattcaattaggggtgtgactgaactgccctacagttcaggacagcagaaataatcttcatctcacagcctccttcttctgtacttcttttacccttgaacattcagcaagtctcacgtgtgggatcacaaaccccaaatctgcttatgtcaagcagagggcccatggcgtggacagagtcacccgaggacgacatgtctgggattgacagagcattataaactgcattttgatttgcattgtcagagttggacagctgcactcttagctggttttaagctgtcttgaagtttcatgttggagaggttttctagtcaacgtttactgtggaaactttcctttaccttggtgcagctagagatgggctcttgaaccagagaaaagtggacacccagtgaaggacttgtgctaatgttttcccccttcgggggacttgattaaacagcagccacatgattatgggaccctggataaacccagtcagtttcctcattgataaaatgaggataagagcctgtaccatggtattgttgctaggagtatgagttaacacatggaacacactcaaggtgctgggcacaaaataagagctccgtaagctttggctattgcctcatacgcttcttaagtgtccaactcaggttttcactcctgggccaggcatgtagcagatggtcagtgcttaatgggcatgtaaactacccattcccaatgttgcattttatacagaaaaccggaccttgtgaaagggctgtccagaagctacttggcagtcacagcctggacctggtctttggcatcagacatttttgagcagaactctgggtccacttacatacttgctgttagcattttattatacttaaccattgctgaccctccgattcatgctctgtgcaatggcggtagtgacaccaacactgtcctcatggtgaggatgcaatgagatgatgcatattgagatcctggtccaacatcttcctgtgacctacctactgaccttgccctctgtgattaataccgtgttacaaagcagtggtcacaaacataacgtggcaaacactgatgtatcttttatccaacctatgcggacagcatgatgccaggtctgtgtcaggcatcggaaatgcagctgggtaggaaactagggctccttttgggaatgttgagttcaccatctaccggaggagaatgactgaaagtattggttgcgctcatgtcttttttgaccctcaacttgtagatgcattcaccctagtccaagaaaacctattggctttgcctgaccttttggccttagaaatgaccttcaaacactatagccatctcaggatagggatagcaatgatgtacaggaactggcacagaaggaattttctcctgtcacaaggcagaagttgtatggctcctgtgctacttgtcacagcaaacttaagcagatccagaaactgcctgaccctttactgtaccttcccactccaaaatggggaggggaactcctgtgcgggagtgctcagctctcaagggaagacagtcattaacctgtctaaactctatgttaatagaaccttctcgataattgctttcattaagtgtggttaatgtgaacagtacaagttatagcaagatttgcagaagaacaaagtaaatatttaagactttatttcaggatgcagttgggtcgaggcaaggagaagattagtagaagctgtatctgatggtatctgaggttgaaacacagtgaacctcttggcagaagtgccagtcatttctcatcagtggttcacagaatcctaactctggggaggcagatgggtgtctcctggagatggttgtgtgttcaggttttctcctttcgcttctggcctctgtcagacatgaatgacatggtgatgaagataaactgccttccctgtactgcccaggaatgcaatgaggattaagaaggtggcttttagcctgtgtctatgccacatggggaggatggttgctccctgagggcagaaggccattattagcaactgagttggccaggagtgtgtgccatgccgggctgggtgtacggagctgtcaagccaggcacctggggattaatttagcatgggttttcatgcccccgggctaccagtgaccatacagccatcatctctacctttgagttgatgtgtataactgaataatagtgctgtgttttcaaaaggaaaggcttaaaaaacagtgcttctgtagtacaaggagggatgctctgctgaaaatctggaaattacagctaagcaaaaagatgaaaatacaaagtagctgttattctaccacccagagatcgatttgtttctttactaacagatacggcaagtgcctgttctgtgccaggcactgtctaggcactggagatagtgatgagcaaaaccatctcttctttctggagatgacactccagcagtgaaggcagataggaaacaaatacataaacacatctggtgaaaaatgcttgaggaacagcaaagtagggtaagaaattagcgaaggaagtgggtgctgtttcaggtttgaggcttgtcaagaaagcctctctgaagaagagagattgagcagagacccatattattgagtgagggaggcctggggttctccagctagctgccagcaggatcagtctgtacaacagcccagggcacattcttcctgggtgcatttaagaaccactgttgggcccttttaattctaatacagaaggtggcctattaaaaccaaaaccgaaaaaaaaaaaaaggaccctttactgtatcatctgtcatttatgtttctgctaggctcaaactagacttttgagagagcagtgttggaaccacagaaaggtctggatgtgttaacgcattggttcagcatgtgatgagacttgtgtgcgcagtacagactcaggctgctggggttcaagtctgagttccacagtggtgcaactgtggtgaagtcatttagagaggttaagtctcagttctctcatctgtacagcagaaactagctcatggggccacatgagaaagtgtctgtggagggagggctggcacatggttaagtgctcaggaaatactggctgttgctataattaacaaaatgtggttttggcaaatggttttaagagggtctgtatgtgcctttgttccataagtttttaaccaaaactaaggagcctcgaaaattatgttagaggcaccaaatggggagcaggttctagtcattcatcaaagaaggggctaaataaaatcaagatttaacagaaggatcacacatttgaggtagggtttggagtttcagtcatgaagtcggtgcacagtttatatagggttcaacttcttgtctgtaggtgcctgtctctattcacatttaaagccattgttgaggaatgtagtatcttttttttttttttttttttttttttttacagaaactcttctcagtttggagaatgtgggtgtgtggctttgaggcttcagaatcccaccgtgaagttgtcattggtcttcatggttatttatgaggcttgacttaagctgggtcctgttcttaacaggagaacgatacagcttcccccggccgctgggttctctttctgtgatgcaaggatacatcgctgcactaggctctctgagaaatttgtgactggctagcaattagagttgagaatgtaaactggccacagattgaggaattccaggctagagactgtgagccctagtgaagaaatgtagggtcagggctcaggaggctgggattaagcccactgctgacagaattgatgctgagaccttcagcacatcacattatctttgtttcctctttcagatccagagattcatgagcttttataagtggaaaagatttagatgttctaacatttcctccaaatgggagattgcaactttccaaaatccttggtggatggttctccagatttatctcaacagttctagtgctggaacttttagctgccatactgttgaactttagtgggccacatttacatagcctgtgtcaggggtcaacaaactgtggcccatgggccaaattagtccactgcctaaatttataaataaagttttattagaacacaaccttgcccatttgtttacttactgtctgtggctgctttcatgctacagctgcagaatttagtggttgtacaggagaccataaggcccacaaaattgaaaatatttcctatctggctttttacagaaaaagtttgccaacccctggcctaaatgaatggtgctgtctggaatgcagtacatagtctgcatgcaaccctgtgtgctaaacatattagatttgtaaagtgttcataaaatagagcaaaaaaaaaaagccactgtttatggagagatcgctgtgtcccagacacaaataataactttaaaatactttattagttctttcctcagagcaaacctgcagaacagttatctcaatttaagaggatcagggtaggatatgatgtgtaatctacccaaaatggtggcagtctgagccagggttcagatcctggctggtgcatctctaatgtgcccatttaatctgccactgctgggacaatcgcattttattgtgcatcacaccagaaggtcacgtgtggcatttttaaagatgaaaatagtttaaggctcaagagtggaaggtaatctaagagtccacacctttctggccatttggatattgttgtaaatgtttcaggtgttaagcatacttaattttgtgagttttgattttttgttttggtcttctttttgttattgtgtattgattgccctttgattttcttctttaccgttatatattttaaatgaggtaattgtctctagagaaatatctagaattgttttccaattctttttctgatttaaaaattaaaaacactttttataatgcttgataaggccaagttatgtaggaaatttggaaaatacagaaaagaataaggaaaaaaaagtcttgtaatcctgttttctagagcactgtcaatgacagctttttttttctgtgtgtatattgcataaagattataattgtactctttgttttaaagtcttgatttttaagggagcattctctttattcttcaaaagctttatttttaaataactacataataactaggttctcaatttttgtttttccttttttctactacaaagatcattgtggtgaacataaatctttgcattattctcttgggagagtttcttagaaacagaatggctaggtcaaagggcataagccctttttaagtttagtatttatttctgtcaaattagtacatgtatataattttaaaagtataaatttaaaggtcaaatagtataagactgtaaccagtctgtcttctgctatatacttcattcctccttacccctgacttttgttctggaaacacaaatacttctaactcttgtttcttccagtaatatattttcatatttctccataacatgtttatgttgcttttttcttatcttgcatttttttgaggttatctactgattttctgttatggaagatgggaatttagctctctgacactgccaccattgccagcaacccctccgctacatggctcctctctgttttccagaatcagaatgtcctaaatatttgctggggtcaaatttagtggtcagtgcttactttataaggacactgcttagccacttactaaaataaaataaggtgatagtaaattgccattctgatacatctttctgtttttcccagcgttaataatttacttcttatgtttgcattgttttgattaattaggacaatatttactaattatcttctgtgtgccaagccacacatcagtgaacaaaacaaaaaaaaattcttacccttaccaaaattcagccctaaacattccatcagagaacccttcttactgtggcccacagatcaaatagtttaccatgcttttattcagtagtcgtcttcctgatgctttctgccctcctgtgacaggctggcctggctgcatcctgggcctgctgtacagttgtcgtaggactgtttccaaagccccttttcccctttggtgctgggtcttttatttcttagattccacattttcccctttgttggtttcttgcctcatcctgtaatagttttctgagagaagaaggtaaatggaggggaaatcatgagatttctttttctttttttttttaagatggagtctcgctctattgcctaggctggagtatagtggcgcagtctctgctcactgcaacttctgcctcctgggttcaagcagttttcctgcctcagcctcccaagtagctgagattacaggcacccagctaatttttgtatttttagtagagacggggttttaccatgttggccaggctagtcttgaactcctgacctcaggtgatctgcctgcctcgccctcccaaagtgctgagattataggtgagccaccgcgcccaactgaggtttcttgaattttggaaaatgtctttattctgccttcccacttgaatgatacattcgttgcatataaaattctaggtttgaacatgtttttccctaaacaatgtgaagatcttgttcctttgacctctgcttttcagagtcatttttgcaaagtccagaggcattatcacacctagatgtgacttttggccttctggaagctggtgggatttgcttctaccttgtgttcagatgtttcctgtgcctggtgtggaccacatttcatcctttttctgactcttctgtgacatctttcttgtctgggaaatttttgtgaactgtttattgagtagtctcatctccctacagtctttcttctagaactcactgggtggattgtgcacattggggctctattcctaccccttctctcatatcacttttctctcatcttatccttcctgttcatcttatggctgtattttctgtaagattttcacaactttacatccagctcgtctcctgaatttaattcttctattttagtcttctttccaagagttgttgttctctcaaggtcttttaaaaaacaaaaatcctattcttgctctgatttcatgaatcaatattcttcgctcatctgtgaggtattatatttaaaaatattgttaaatcattttctgttgtatgtatcatctgagagtttttctttttcagtttgagttcacttttctttctttggtgtgagaatgttttctcacatatctggtaatctgtagtgctggtttcatatttgagggtgaggttggctgtgagtgagggctggcagctgctgggccacctcctagggaaccatagatgacgttggaccctaaatgtctatttcagtcttttctcttctgcttagtttcctcatagatggatccttcagccttctgcccaggggctgccagaactttgcttcatagctagagaccaagaccttttaaaatttgtagtagagacctcacttccttttccctaccctatccactgttgtgaatctagagccttttttgttcaatctctctagagagtaagcctttgctatttataactggaaggctctagtataagcatcttaagacttgatagacattacaagttatactctgatcaataatgtatgaatattcctgtcttacatcctctgtgtaaatacttggtattttcctttgaaaaattcaccagtgtaataaatggaaaatgatattttacatatgtttctttgattgttagagaggttgttttccatatgttttatgggatttgtatattttgtgaattttctgtccatgtctttctttggtttttattctcaagtgcttactgaattttgaattctcttgctggtgtctggaagcaaaggcctcctttatttttgctggtttggcatgattttgtctcctgacatggctctggtagtttcttgtgagggtggaggcacctgaaacactttatcaggcacatgatagacattgcctatcaaatggctcaacatcagttccacaaaaaacctaaatggccattcaagacctgtttctgcctgtttcaagttccatataggaattagatcagtagttggcaaatgacggcctgtgcgccaaaatctagcccagtctgtaaataaagtcatgctggaacacagctgtgctcctttgttgatgtgttgccgtgttgcctgtggctgctttcacatcacaatatcagaaattgagtagttgatacagagactacgtggacagcaaatctagaatatttaccatctagctctttaaaaaaaaaaaaaaaattcaacccctgaagtagatgtttgtttgtttggtgcttgataccatgtaagtatttgcaaaggcttatggaaattgatggttcattgttcttatgaataaaaactaataagcatgaatgtcatgccttttgcaaaaaccaataaatgacagtggcagtcatcttccttcaaatgatgtatgtgagtgtaatacctctgtcagcctatcttcctgtgaattcccccgataactggtttccagaaatattgctgttgtagccatgctctcccctgacagccacccattccccttcccactcttctccctctcccctactcccacaccttctggaaatatcagatgtacaaaatgggcttcacttgctcaaacctctcattgtcactgttttcacagcattgtaaaacacattacattaaaaaacaaaccagctggtggaagccagtggttagcacctagaaggtgaaagacttggcgcatgtttaaactgccagtcttttttgggtgcccttcatctcccttgtctctagggccccattatttttcctgtggcttctctacgtccccctgtgtggccatcacttccatcctcttcaagacccagacttactcctcaaggtctctgcttgccctataggttgggcaccgcagtgtgccagtctctcctcttcccacatgccctttgctcggcaggactgctcttctactccatggacctgtcttgttccctctgactttgagaaggcaaccattgctgggctgcatgctcttggggaacgcttttctcttccagggtgccgatctctcttctgtggcccttcctaagtccttgccaatactgccccttggtagtggcccgggcacaaagccatcagccagctgcttcctgccagtctcccatgtgctacctgagtcagcggaacactgtgtgttgtgtgcatgtagatgttgagggactttggtgtggttgcagggttctgccgaaagttgtcagcgtagcaggcctgacatagctgtctttagaaaggtctgcttgcaagactaaccatggactagcatctgagaatttggatcttggaaatccagtttcctaccatatgctgataagagtgactgactatgcttcaaccatgtgtacaaataatatggtttatgctgaacacctgcattccttctgggagtctggaatcttggcacatgttaggtacagtgaccaacactcagtaagacacagagtctctaaagaccttccttggtagaccacatttgtcgtcacagctcgttgctggaggaattaagcatgccctatatgactccgctgggagaggattcttggaagcttgtgcctggtctctggacattgccccatgcacctttttcctttcctgatttttgctttgtatctttttgctataataaatctgaactgttagtacatattcatgagtatgtactgtgagtatatatgctgagtgctatgagtcctcctagcaaatcatagaacttgggagtggtcctgggaacccacccctgacacaaggacttctcagagctggagagctttccaggtcatgcagattcaaggcagactgtgaggtatttgatagtcctactcgtgtgttctcatgtgcatcccatctttccaaaagtgcacacttgaaacagatgattttgagaagagctgcttctaccaacttgatcttggccacttgttgtattgttgtgcgttcttagtttttctacttttaccatttctggccagagctgtcacttttaaaaattactccgttgatgttgcctagcaagagccactcagctctttgtggggaattaaagtagattataggttgaggccagttgcacttactgtgctgcaaattggggactgatgatctagtcatcctcttcctttcttacacacttccttcctgtgtcttttccacatgcaaacttgaggtatggcttcctgtctttagtcatttcatatagtttggtttgtgctatctttggtcatagaaattgttcttctaaaacctctccagatcatccttcatttctgtgttggacatgcatcctccatggctggttttactttacaaggggtgctccccctgaaaacagcactggcaggatggccatgcacagttgattgctgtgacagaggggcttgctgatcctgtggctttatctctatctggtgtctgctatgagtagagaaacatgggagagattgagctgcaaagcaaagccagtttatccagtgctttacagttgtggtttaaaaaaaatttacaaagcatggtggaataattctctcagatgagccatgcagagggaatccacttgatcagattggctatatggagttggaggatcaattatgtgactcagtaagtgcttattgcgtgtcttctaggtgccagaaacgtaatgcaaaacaaaatacacaaaaatacctcacttcagagagcttatattctagcaaaggagactggccatagacagtttacatgtaatgtcaaggagtgagaaatcttatttagaaaacacacacacacacacaaaacataaagcaaggttaaaagagaaaattgcctgggaaagaggttgaaggtgtgtagtggactaaatgtttgtgtcctctccaaatacatatgttgagatcctaacccccaaggcgatggtgttaaatggtctggggcctttgggaggtgattaggttttgaggggagagccctcatgaatgagattattgcccttagaagaagacaccagagcttgttttttctctctgttcttgtctgtgaggatacaaggagaagatagctattagctaaccaggaagagggtcctcaccagacacggaatcttcccacatgttgatcttagaattttagtctccagaattatgagaaataaaagtctgtggtaatttgttatagcagcccagactaagacaaggtacgtttaggatggggaaggcctctgaaggagtgatgtttgaaccaatatataaatgaagtgagccactacctggaaaagcattcatgacaaggaacagcagggagagagtccaggacttgagaagttccttagcacgttcatagggcgaagtaaggtcagtgtggctggcgtgcagtgaatgagggcaagagacatatggactcaggttgagagccctgtaaggcaagttagggtcacttatttgatactgtgagaatatatttaagtgtgataacagctgctatgactacttgcttagtcagttttccctagaagcttttaaagtttgggccctgctagaatcttttgatgttttacatttggtgatcactcaagtggcgttaggtatagtgcttcgtctctccctttatatcggcagtcatagaatctggttcattctggaactttccgtgactgtttctctagaaggtgtccgtctcagattcattaactcagtggttctgtcaggcctggttggcatatatgattataccattttttttttgtttagagatgggcatttctaatttttaaaagggttgggcccactgataattttaaaataaaaggaaacatttctttatcttgcaaggcaaatgttgcctaatttagtgaatatcaatttagtgaatgtcatagcagtagtgtgtggttttcagattgcgtctgggtcctcagaactgagtgtacctcagggaaggtatttactgttaatagcaattggaattgagagacaggaaaacacattctgagacccaatgccttttactcagtgctgactctgcttcacatatagcatctcatttaatcctcgcaagtctctcctcttctggaggaggtcagtgaaggtcaaagaggagtggtttgattcgggtccctcagttcacaggtggaacaactctcttcaatccgacagggtgcattgggtaaaaggagaactgctttctgttgccgggtctgctgctaacggaaggtttaaacgtggggataaagccaggttctggtttctttctttttgaaattaggagctttggattttccttaaggtcttcaacttctgtgattttaatacaattcaggtttattttctgctatccctcacctttgctctgccagtcattactaggtgtggtggtgttttgtttgtcttgtttgtttttcctgttaggatctaccttcatctgtgttctatgccatgggccacacctggtgttaacactccgagcaaggggtagctcttgtaaccagtggctgtgctgtagactctcaacgacatacagaggatctttatcaaagcgtgttatgtgacttgctgctcttgcagctctttgaaaccccctgcagttgagccacatacctgtgataagaataagcaggtactcagaaggccaggcttcaaggtggggtctccaaacagataacagatggaggtcatggaccttcacagatgtgtgcctggcatagggcaaatgcattgttgtcactgggaaaaatagctagcaagcatgcctccagggagtgtgggtccttaacacatgaaaggcaccttcacacatgaaaggtagcctattctcatttcattacaattcattttgggtatcactgtgcacccttgcttctcttgcatgcttttataacatgtatatgataataagcattactactcagtgaatagaaaatacgaaaattgaaaatggatggtagattcattaaattggaaatgaatacattatcagtgggtacttgtttccaggcactaggctggttacttgtgctgtgattttagtatacgtatgcgagggaaataacatttaagcccacagatgttaagagtaagtgctttgctccgttccttttcttccctcttttacgtatgtgcctctgtattcttcctcccttccttttcttattcctcccccacttctttgctttatttttttatttttatttttttgagacagggtcaaactctgtcacctaggctggagtgtagtggtgcgatctgggttcactgcaacctctgcccaccaggctcaagtgatcctcccacctcagcctcctgagtagctggagctataggtatacaccaccatgcctggctaattttttgtatttttcgtagagatgagatttcaccatgttgcccaggctggtctcaaactcctgagctcaagcgatctacctgtctcggcctccgaaagtgcttccttgctttaaattgaagaaaagccaagctggaaaactatagattttgatagcagccaaaccccttgagtctgcagttggctgacaccatgatgtgtgatggctcccaggtctgcgactatggctttgctagcatgaaatgagaccatctcctctcctcatacagaagtgtgtggaggatgtgaaacagagtagggaggtaggagggctggaccacatcctaggcaggtaacttgccccctttgttcgttggcttcccagactcctcgtagttgttttaggtggatctagaaaagattgcctcatggagcactgcatgttcagtgtaaagatgtgtcacttttcttacagcctcaaatcttttgcctctgagtgaggaggcaaatggaggagagagaagttttattctaccttccagggtggctattctgcactgttttaggcatcatcaggtaaataaggcatccattgttctctgcggtttagccccatagacctgttaagtcatgggaagatctctgcactggcagtaaagtaactttttgttttcagtgtttttatttttattttcatgtttccaagtcttaatataaggtcttaacgtaggggctttttggagctgctgggtgattttgcctcacaaaccactaagactaagtattcggggtatgatgttcatatttctgagacaaatttagaaatacatacagtctaaccaaggatttttgttccaggtatataccactgcaggtcaagttctgtgtaaggggatttgtagttgtgaatgccaagggcttggttttatagaaggtaggtgtaaaaaatagaggttcctcttcaaagactttcctccccgtctaattaagaataaatagtaacttctcttagaagcaaaatttattcaaagacctgtgctaacattcttaaatatctgctagccgtaataaagaaatcaatgtactttatgttcttagctcccacaatttagcctaaatatttgcttataagtatgtttatactggtccaagcaagcattaggtcatagtctgttcctcttccttatttaaatgtgtttttacctttctcagcatttcacaagttacttcctctttcctttgttctcctctgcctttgcctcttttaaaatgttctaagttgctagccaatcaggacaaatacagaatgtgaggtcctgttccagccaatggaaactggacacagcagtaaggtggacgcgtcaacttataaatgaccctgcctcctttgttcggtgtactatcgtggcaaaactgctggcaagtgtaccctttctgtagaaagtaaaaatggccttgctaaggaaattaaatttatgttcaagtgctatttctttattgcaccgaggaacaagcatttctaacagtaggttttagtatatagtttagatgttccttatgttgattgacatttgatggctcttcagtggttcgaagatgccagaaaagaacaatgagaatggccagaaaaatctagaaactatggtgaaagtacttacaagttgaatatagccataatagaactggattgtgctagaagtgactaaggttggcagtggaattgggagcttagtaggcccaatcaactgtgtggctttcttcacttaggcagggaaaatgtggtatcttaggatcctcttgcagtaatttccaaacataagagctgcgaaataagttataattggaaaaaaatcttcaatgatgttgaaaatatttttccctctggattagccttctcttttattctcagtcataattttagtagggagttttgttgtcactttaagggtattcattccatttcgacttgtcacccagattctcttcgaggatgacaagaacagccagtagtggctggcttgtggctcttctgtgctgttgctggctgcagccaaacaggaaagggctgttcggagtttctattggaaccatcaggaatactgtttggtcagctttgctacctgacaggaatggttttgggaagcttgaattataccaagttgcagtctgtttcagttcagcctcttgccttaatataacagatactcccctgtcttaatctaaacagtgcttaagggtggggagatgggttcggtggatttacagcattccttctgaaccctaagaatctgtggttttattatttgtagtgcaacccaaaaataactacaatttttatttgggaggtggaaattagaggtaaaattctttggaagggaagaggatttcatctaggagtgtttggcagcctcatgcaaacatgtttgttcttatttgaattttgactcttgaaatactgtgatcttggcggtttaggccaagaggtggggtaaagaggaggatgggaaacagactaaactcatggaatttcatgtagctgggtaggccaagtcgactctagtttagttaccatgttttctttgtggctgtgtcagagaattggggatggacacatggaatttaaaaaataacacacaattttaaaagttattaccaccatataaaactagctggacctgggagtcagtttctggaatttatgggcattaaagaaatgccgaatattaaattacttggtttggtatcgagggagtggctgcctggctcttaacagtttttgtgaatttcctgttctttttatccttggcttcaagtttttattgatggaaggttaaatattctttttttttcctttgtagcatatgactaaacctatggttcttttgcttcctctttttttccccttgtcttgtttttccctttcaccccaggaattaattatagtacttgaaagaaaaccactttccttagtcttataaagtacataagagacagtaaaaaatagaaaatctttttatacaactgaccttgtttctgcagacattgtaatctattccacttaacctctctttcttctgttattttactttgttaagatagacttgacatttgattaggaaaaaaaatatgcattcaaatgttatgagatatagaatccaaaaaagggaagattgcagaaatttaaaataaatgtaaaagattacaaggtaatacaatgaataagttcatactatgaaatgacacaactttgatgacatggaaaaattcctagacacaatctgtactgactcaaaatcatctgaaggtggggtggagtggctcatacctgtaattctagcactttgggaggcagaggcgggaggagtgcttgaaaccaagagtttaagatcagcctgggcaacacagtgagaccccattatctacaaaaaataaaattagctgggtgtggtgacacacacttgtggtcctagctacttgggaggctgaggtgggagaatcacttgagcccaggagattaagattgcagtgagccttgattgtgcccctacagtccagcttgggcaacagactgagacctggtctcaaaaaaaaaaaaaaaaaaaaatcatctgaatagctcaataacaaagaatttgaactaataattagaacttttcctacaaagaaaaacccatgctcagatggcttcactggtgaattcttttaggtatgttaagaggaaatgacactgattcttcacagattcttccatgaaatatagaaggagggaataccttgcaattcattctgccagtaacaccctgttaccaaagctagacaaagacatcacaagtgaacaacagaccatgaactcctataaacactgacacaaattcttaaaatattagaaccccaaatttggcaacatatgaaaagggttatatataatgaacaattggaatttattctagaaacacaaggttggtttaacattcagaaatctattaatataatactccataatagaacaaaggtcagaaatcatgttaccttaatataagcagaaaagcatttgagaaaatctgattcatgaaagcaattctcaacaaactaggaaaaacatacaggttaacatcatacttactagaaaagaactgtttaattttttttttctcctaagattaggaaaatggcaaggctgttcactcttgccacttctattcaataatatatttgttaactgttgaagttaagtgatgggtagaagggatttgttgtatcattctctgtatccttgtgtatgtttcaaatttttttctgataaaaattgaggaaaacaaatataggttaaaaaaataagtctactagatccttaagttttgttctgttttctgtttagctaaattgaggttctaaaaccagttattttcttttagagtatgaacgtgtatttctttgggttaatgttgaattatttgtataaataatagagaaaaatattatctctgtattattatttttgaaacaggatctcactctgtctcccaggctggagtgcaatagcgtactcttggctcactgccacctccgcctcctgggttcaagcaattctcctacctcagcctcccaagtagctgagattacagacatatgctaccatacctggctcatttttttgtattttttgtagagacgatgtttcaccatgttggccaggctcgtcttgaactcccgacctcaagtgatctacctgcctcggcctcccaaagtactgggattacaagcgtgagccaccatgcctggcctatctctgtattatttatcaccaaataaaaattatggtgtttataaaaaatgtagagttagaacactatttcttttcataataagttatgtcacttatattttttccactcctaagaatgatcagcaaatcagaggagctgttagggcagttagacaccatgcggatcatattctgttgtaacaaatccttgtttatcataattcaacatcaactaaatatagttgtgaatttccagatgttggaaggtgttttcaataaatttggtactgcagatggtttgggtggtctcctggagtctcttttgattagatgtgatcagaagtatacttgagagcttagtctaggataggaattggagaagaggtagttcataatggtgatggttgagtgtgtttatgtaggcaggaaccatgggttgggattggggctggttgagtgttctgtatgaaagacgattccaggcaggaagcatgaaagcaatttaagactgtaccttccctctgaatgaaaaagtcaaaagaagaatggaagaagaaggaagtcacatttagaagataagaattcttctgctttcttgtgaaagttagtgtcccatttgagaataatattcttacctagatcttcccaattgtacttttccttcttgcccaaaaacacttgcccatcgtttcttcttcttccctagaatttatatctttccaagcgtcaataccactatcatcatctgtagtccacaaaatctctgtcaattctgtgagccagtgttattctggagcatacaaaagcagactgacacatggccactgactttgtggaagttggtctcactggctttgcagtctttgtaggtatgtgcatttctgcacacaaacaaattccaattagaggatggtcaaagccaacaccagatttttagttttagattgttcagtatagactaaaaattttataggtgttcacaggcaccctggaagtacctgtgcgagctggagtactcttgtgaagtttcacagatagaggagagcttgagctaggcctgcaggtaaggtagggtttggaatgctaattgcaaccttcatcaagttgaataaattgaagtgagatttgtatttaaggttttgtagcttttttgttttttaaaatgcagtgtgtctgaatcaggatcttctttatttcagcaagatgaactacaagtgttggtaaaggtagttaaaatcccctcttctgatttcatagtggtagagcccaaacccagtatctaatatttatcccctgtcccctcttttattcctcatgaattttttcagattggatgtgtacagactccattcaaaaattttaaaaagttcccatttcaaagctggtttcctttaatcccatagtccatgtccaaaggcctcttgttgcagttctctcttcctgtagcaaacacccacccttggatcttccctggaacacacaaaccttgctgctgcttaagaaattcctccctggctttccagttgacttgcactcaccttgaatataactctctgaatacctgtaagctcatatcatgaaattttgtcatatcattatagaaagctttagtgattactctttgatctgcagccctgttgcagaggttgctgttatattcatttctatgttctagtgagcagaacagaagtaaagtgaagattaattccttacactgttggttgttcagtataacttttgcaagaagcaaccattctctgacccttgggtttattagcactgcatgatgctggaaaataataaattcctgattacctttcagatttccctcatttagaccatcttctcttttcagtacttacactggcacttactgtgtaagacagagccaggtcctgcagataggctgaaaaatcaagatggcatgttgtaaatctgaagtcgggtgatttctgtcgaagcctacagacaggattaggaatgaaatcacagcctgccttctgctgaatgtcttgagggtgaattatttcctagtactagtgactctttctgcacatgtgcggttaaccttaatggagtaaaggctgttttttaaacctctcttcagctttgggcccaacactatacacaattaactagttcactgcaaataggagacacctaaatgcactcagtgacagagaagaacactttaccaacagtttgtacttaagtccaagattacaatttccaagatgaagattaaactttagttttatgcacttttgtaaccaaactaaagagatggaccctttagcactgccagcccacaatgaaatgtaatattggaagtcactgaaggtgttatttgaggtgctttaggttgcatgtgagcttgttgtagagtaagttccagtgaaggtcgttggcaaagggttagttgttaaagattagcaaaggaaaattgtccttcatctgtgtgcttaagtcacagagaaagcacacatttaagcaacttagcttaattttcataccctgcacagcccagttcttaagtatacaacctgatgagttttaataaatgtatatatctataaaatcaccacaggcaagataaggaacatattcatcaccccagaatgttcccccatgcctctttccattcagtctgcatcccccataggcactctctactctgatttcaatcaccataggttaattttgcctgttcttgagcatcatcaaaatgaaatcttacagtatgaacatttttgcagagtccggcctctttttctcagcatagcgttttcaagattgatccatggtgctgcatatgtcaatagtttattctttttaaaaaatcgcagagcagtactttgttgtatgaacataccataattggtttatctgttttcctgataatgagcatgtgagtcatttccagttgtgagctgttatgaataatgctgctagagacacatgagcctgtctttttttctaagtagtagattctattgctctgaagttactcataacattcttttattattcttttaacatctataggaattatagtgatatccctctttcattcttaatattactcatttatgttttctttttcttgatccctcttgccagaggtttataaatcttattcatctttttaaagaacctacttttttttggttaatttttctctgtttaggattaaatcagagaggcagaactgccaagagaggcgtgtgtctattaagggatttgtcaaaggggtttgaccttacacagctctggaagctggtttaacattttctgtaacgctgttgcttttatgtctgatgatggagttggcatccacagggcaggcagctaggaagggaagataaacggtaactggaggagaataaggacgtgctggaacacatgagtatgagctggagctcataattacaaagcaacactcatgtcagttcgcttttggttttggcttgattttgcctccagccttggagtatggatattcctgcacaagctgggaccctttgtctcaaaatgaaagagacctgggggatgcaagtcttcactattccacttcctagataccaaaaaaattcttaaatagtaagaccaaagaactgtatagggtaggggttgacaaacttcttatgtaaagccggactttttatgtcagccaagtattaaatatttttagctttgcaaaccgtatggtctgtgatctgttgcagtgatttaactctgtcattgtactacaagagcaacactggacaatatgtaaatgattggcttgggcatattccaataagactttatttacaaaaacaggcagtgggccagatttggcttaagggctttagtttgccatcccttgttacagagattgtaatatattttcttatcacggtatagttagagttaatattatacatttcatgtttaatgcatattgattcaccatcctttgtactattgttgttcaatgtcttacatctataaaggccttaaatctcactatgccctaatatgatttttatatttagcagtcaattgtctgataaagaaatgaagagaaggaaaacactatagtgttttatatttagccccatattaatatttctgattctcttaatcccttctgtagttccaagttaccatctaatgtcctttccctttcaacctagagcttcttttattatttcttgccatacaggtctgctgggggtgaaatctttattcatttatcttaaaaaggctttttttggtaggggctggcatttttcaaagacataaatatagaattctgagctgacagtaagttttctctcagcatttaagaaatgctgtgtgtgtgtgtgtgtgtgtgtgtgtgtgtgtgtgtgtgtgtgtgtgtgtgtgttttccagcctccttcttctgacgagatgtcaggtgacattgccatctttgttcccttttatgtaatgtgtcttgtttttctctgtctgctttcaacattttctctttctcatttgcttttagcagtttgattataataaatgtgattgtctttatcttgtggttcactgaattgctggatctgaagttaatgttcctcaacatatttgggaagttgtcagccattatttcttcgaatattttttgtctcttttctcttttctacctctgggcatccgtttacacaaaggttcgcctacatgatgttctccacaggtcatggagactctatgtgttttatttgtcttagtcttgaatgtctctgtttttaggttaagtaatttccttttttgtttttcaaatttactgatcttttattcactgatgaccgtttttcctttgtctttaatcttatttataataaccgctttaaattctttgttagttctccaacagttgcgtcatcttgtttttgttgactgtttttcttgccttgttcacgttttcctgtttctccacatgtttaataattctttattatgtattggacatgacaaggatatgctatagagtgtctgggttcggtaaacttcctctgaagagtactgattttttttctagtaggcagttaaattactgacttactgccttgaacttaagaagacttgcttttatgatttgttagggtgtgtctgtttccatttttttccctagtcttggaccatctgaagtcctgggcctgatgtgaggcccttctggggtttcatggaaagcctgaaatgttgaccctttgactttttggggtttaaactgtggctgccctgcagtgagcagcagctgaagtcttgtgaatactttgaacttttattggagcctccctcacaaatgcttagttttagggtcgctcaagaagtttaaggtagtttatatacagactttggggttctcctctttgggctccctctttttgggaatatgctaccttaatttttcactactatgcaaaacttcattctatgaaacctcaagccagtgagactgtagccttttgtttgctaccttccagacttgatagtcccctctggggcacagccatataaatgtgagtcttattcagtgtagtttccagaaagaatttaaggatcaaatcccttctagtttctgctcactttccctcactctttagtgtcatattgtaagtgttatctgtgggaagattgttccaatacaagcttctctgctattgccaatgcatagtttctctgctttgtttttaaagaatcctaggttaactgttatgtggatcttacacaggtagtgtagtttagcagcgtgctctgggctgggaagctgtctgaattatctgttaccacagtgctgccttccccctggttttggtatgcatgctagctcttttctgttaggtacaatatacaataaccaccatttctaggttggcaaggaccgtatgtatttaacagttgctctcctatccggatgccatggctggagggtaagcaagggactgcactttattctggatactgggatggtgaatgggttttcaggtagtaatcccaccacctgaggatcagtgccttctaagagctaactcaaaaaccaaatattcatctgggaacagactacttgctgaaacgaacaaattcccaggcagttgaaaacctttgtgtttcctactgggaataacctgcattcacaaattcattagccttttatgtggagttgatgaatagcattccaggattataagaatacttgtaacatcccagaatatgcacattagtctcttaactttacaagcagagtattggtatccaaatttacatggtcttaacacaaagcatgttcttttctacatgaaggaatacctgctaagggccgggagaagttctaaggaattaagttgtaagatagcctgattttttgttttttaacatgtcttgctatgttgcccaggctggtctcaacctactgggcacaagcagtcttcctgcctcagccttctcagtaggtgggactgtaggcatgcactactgcacctggcacaatctggtttttaagaggcatcctagccaaggacattacctagcaggcttggcatgtatattttatgccaatggcttgtaggtttcatatcactctggatcagtcacagtagacttacaatttaaatagcttttagcctttcttcaaaccgtacccaagaatttgttgtgcttgtgggtgtttgaaatattctggctttcagcttcttttatacattctctctgtcctactttctctaggaccaaaaccttattatcaaggtgtcatctcaattctgcattatcttgcaatttatttttctgtttaaaaaagtaaggtaagagaccacaaccaagcaaccaaaacaaaatgaaaacctcagtttatgcgagacggtgaaaacaaaaatttttcttgatctcctgttaagagaatagtcgaagcacttccgccttgcctctagatgtctggctggccagatagaatccctgtttctaaccaacagctataagacgcttgtgacaagtgattcagaaagtgggcattgtgtgatatgaagagcacacacctattttgggcaatttatactatcttaaaacagcccaaggatatagctagccttctctcagttattgattccatatttcttttcttcttcagttgcaaaaaggaaatacaaatatacacacataaactacatgtatggctttgcttttcatttttaacaaaatccaaactcaagacacctttgacagtttgataagaacaggcagaaatctatgaactgtgcttaacatggaaccctgttttagaagaaaaatcaaacctctctttgagaggttgaagtgagatatgggtgctctgtgttgcaagggcatgtcactgttacagtaagttatctgtgtaacaccctttccttcttctagtaaactgcatgtgagaagaggggacttggcaaaagcttggcactattttgtttattggaaaaggagaatcgttataaatatcaccttaggcccccaactcgagaatataatacagttttgcaagtatcttgaatttttaatgtctcccacctatttctcagtatattttcttaaatcaaaattgacagctgaggttgtctcagtatgttagcattatatcttattcttttaaatgtatgtatagaaacttttttttctgggaatatatctgtataactttttgtttgttttgatgtataaaactagcattctcctagtttatttcctattaggcccatttgttgtaactaagtacatatatgatacccacgtggaatatttcatatcctttacatcattacttaaaatactaaggaacattttgttgcagaagaaatgatagcaaaaattaaatataaacttacagaaaatggtatttacatagaaatgaatacatgcagagttttgcattaaaaagcactctaattatccaaactatattacaaactcagttttgtcttccagtctcaaagctgctagaatatatatagcatacactgttttgctattatattcattgaaaaagatctaaagcatttttgtcgttgactatacctcataccccaccaagcattgtgacaaaattaattagggacggacaagacaggcacagagaatatacaataggacgagtatattgtacaaatagattaaatgatctaatgagagctagtgtgtgatgtttcagtgtggtgcaggcaatctctccttctcatggctttatctttttcaaaatcccatattttacttcggaagtttgtcctgagggtgaatgaggctataaatgagtgccaggtacagtacctggagccagggtgactcagatgttagaaggctttgctgactctgttttttgagtgaagaaactcctgaaggttaagtaacctgctcagcttatgtgattaataaaaggcagagagataatcccagctgagatctcttacaagacaaagcccctgccttttccagggcatagtcatgacattttctacctttttcattgctgaggttcagtgtggtcaaggactttaaaagaccgggacatgcgggtgctactctctgctgatacatttcagtgtcagttccaggagcaggcctcttcctaatgaggaggcatcttgcatggtggccagatagtatcttacgagagggttgatctactgtttggagatttagagaacacagatttttatagctttgtaactttagaggccgatgggatgacggcattttggaatatgtttaattaattttcattaatttaatgaaaatggatgttaaagagactatttaagaaaagcattagaagctgctgttaatcaaagaagggggcttgagcattcttaatttgttctgaagaccttgtgtcagaaaaacacccctgacttccttactaatgaaagacagttttcaactccggggccatttacaatgttagatataaactctattcaactgtaaagattttatacagtaatatcttttaaattacacatggtcacatttttatccacaaaatgtgactttcattccccttttcctctggatgtcacctttttttcaaaatgttgtttctccactcaaagaacattagttacttcccctggccattgtactgaaactccgcaagtgttttcagttgccttccggtttcctgctgtgataacagtgataaattatgttctgaggctggaattcatgattctgtggcaggccgtgtcagcatacctttccaaccgtatttcttactaccctaccctgagtcccctgctttaaccaaattgtcccgctctgctctcctgtgccctctcagacagagatgattgattggttatgcctacccactgtgggtagatttgctgtcctggtaaaacactctaattgttgaaacataacataaaatccattttccatctctggccgttccttttcctcagtgttatttcaccttttattctattgattcccagctgtggctgccttttagaatcacttgaggttgggagagcattaaaaaagggggtagcagaaccactgcctggggccactcaaataagaatgcctggagggtgaggcacattcttaaaaggtccccaagaaatgtttaaatgtgcagatagggctaggaatggctaacttgtgaccttagccaagttacttaatctgcctgggcctcagtgtcttctgtagtagaatgaaggataatagtacttattattgtgaggctcaatcgagtaatcggtgtacataagatacagtggtgttactagtagatgctcagtctgttggctaccatcattattacgctgttcttcagtgtactcatctttccttttctctcctgtctacttctactttagagctcaactcaaatcccatttttccagtggttacttaaggtttaaactaagttgctgcaacaaagagacccaaaaattcagggttgaaatgagacagaggatggtttctcttgtcacacgataatccagtagtgagcagtccagaccaatagaatggctcttctctgcactgacattcagggctccacattcttcccattttgctggctcatcgcatgtcccatctactagcccatggaaagtgtatatggcattgggctgttaattgccttttctggtgagcaagttttgggttctaagcatatttaaggctccctcaaggtgaataatgttttgtgtttctctttgcttcccaggaaggtactgaaatcatgacaaatgctctaatttaggtgcagtatttgttgaatgagtcaatgtcagaacttttctggtttttgtaacagctttattgagataatttacataccacacatttcacatatttaaagtgtttgatttgaggcttttagggccgagtatggtggcttatgcctgtaatcccagcactttggaaggctgagatgggaggatggcttgagctcaagagtttgagaccagcctgggcaacatagcaagacctcatctctacaaaaaatgaaaataattagttcgatgtggctttcagtatattcagttgtgcaaccaccacaatagtcagtgttagaatattttcatcacctcaaaaagaaacaccatatcacctctcctccctttcctcaaccctaaacaaccacgaattcactctctctctagatttgcctataggttctgaacatttcatgtaaatggaatctcatatgtggcctgtgtgactggttgctttcatctagcataatgttttcaaggttcatctgtgaagcatggattagcacctcattccttttaatggctgaataatattccattttatggatataccatatttggtctgttaattggatgatgggtgtttgtattgtttccaaattttggctgttatgaataaggctattatgaatgtttacatacaaatttttgtgtagttatgtttttattctttcatagtgtaaaccaaggagtagaattgttgactcagatgataagtctgtttaactttttaaggactgctagactgttttccaaagcagctacactattttatatttctactagttgagggttctactttctttacatccttggcaacacttgttattgtctgaatttttattataactattttagttgatgtgaagtcgtacctcattgtgctcttgatttccatttccctgatgactaatgatgataagctctgcctacttttgtcagtagcaattatttaaccccagctgtgttcttcctatcatgtgtgtgctcctaggtgtgtgaataaccttttccctggctgaccatttctagtagcagcaccgtggggcttatcagaatggagggttggtgtatatatgatgttgtggctgtgtgtatgtatagcattcttatataactgtttttcatactgagaatctcagtcctaggtcccctttttaatactaatttaccaaaaaaaggaaaaatcttaatgctggcttaacagcttaattcgacaattctgccataaaatagattaaataaatgacagagggtatgacaaaaggaggtatgaagaatctggagttatttggctgaattgtgatttgaaattttatgacattatcttggcagtgtgttttcatagtcatcacaactttattctttttatacattagttctattcttgaaaagctatacatagagaacccatatatatacactgaatttgattttcttgttgagttccattatgtccatagtatttgtacacaggcagtactgtagcttctggtttttatacagcaagtccatgaggcccttggaggtgcttcttcaagagggaataagaatttgttaattgtgttcactcttgaaatttcccatgcagaacatgaagatgatgatgtgcatttcaacagtgttgtggaaataatcttgactcagaaggcaaatgcctcgttgaacatgcagagtgctttgcatatggaaggtgctagtggattttgtttaatccataaatgaggaaggcacttcatctcactaggccttactgttatgaatcaggaaaactagagggttgaatggtgtggtttcagaagtcccttgcagctctaaaattattttatgcaatgatgattctattttcaacttagattaaaaaacaaaacaaaaatgatatataaacaagtattttcaaagatcccagtatacacctctgggggtccatgagtgagtcttgcctgtttcccatgtcttgacttctcaattgctttgttggggagggaacttcctattgctgtggggccctggttctggaattcatgtacatgacttagttacagaaatcaaattactttttttatggtgcaaaagtaaagcattcctaaatgaatatttgccaagctgagtgactggtgaggtcattttcaatgggagactatattccatcatggctggcttcagtctgatttattgccatccactcctgaagccaagccagctgatggaggtgctggcaagagctgtgtctccaagcccattgtggagattgagtcggttcccagccatggctgagcagccaggccagtggcacgctcatttggctgcactttgcaggggccatctgataagcatggccacatgttcatatcaggtgtgccaagagaaatgctaccttgtctgacacaaaatagaattgctggagaactttatcttttgagagaaaatatctttagagtgtcattgccctgaatggagcccttgctcgtgaagttgataatcttagggtcggcaaaacaactgggtaaggagattgaatcagtttcctgtaacttcctggggtcaacagatactcatgttctttgaggtttctgagagtttttataaacctactttttcttctatttttttctttcctttttttaacctttaaaatggcaatggcgatggatttagatgcccttaatctatcagatgcctgtccagaactagataaaaagttaatggacctgtgttctacaggttgttaaaaacaagtgtcatctcaaacaacacctgtcatctttgctatatagaattagtgtatggaaaagtgagccttaataaaggctcacttcctaatatggtcagccattgctctgaaagaactgtcttctgtgtgagctcgcatgcaaactcctgtctctctctctctcttgcatccactctcctccattccacttcctcactttatcatcctcgcctaggaacaggtagttgagattcttacacatggtaccacctttaagcattggcagaagtgagattagcccctgacttccagcctctttgtttttgagattctttttgtaaccatatttccagatctcctttgttcagcagtgaggagtggttattaaaaactttgtttgtagtaagtgaatgttttatgatgccgcgtagttgatagttggtgatacttaaaaagaaatggacgatagcatctttatatacgtataaatattgatcctaggcaattagaagatgcaagtagccttgtgtgacacccaaggcacctagcatctgatttatacaagcagtgggacagttaacaaatgattcattaagattttctccaggccgggtacagtggcttatgcctgtaatcccagcactttgggaggctgtggcagatggatcgattgaggccaggagttcgagaccagcctggccaacatggcgaaaccacatttctactaaaaatgcaaaaactaaccagtcacaatggcacacacctgtagttccagctacttgggaggctgatgcaggagaattgcttgaacctgggaggctgaggttgtgccactgcactccaacctaggtgacagagccagactttgtctcaaaacaaaaaacaaaacaacaaaaaaaaatctctcatacaaccataaacctctcttttttgaataccagtaagatgtgactgtcagtaattcacatgggggctaggccatgtcccttctcccagcatcaggaatgacttgtctcccactactgcagcttcctgctgttttcctcagctgtgtggcatgtgcagtccagaactcggactccttgggtcagtgactccaagtaaggctctcccactgctttttatctgtggcactttctttcctcttcagttctctggaacttgggcactccatttcttcattgcatttgttccttccgttattaaacaagatggggtctccagtgtgctgggcatatatcctgggagtaccgacgggtagaggaggcttcgttgccgggtacttcattcactgttgtgtgtggtttcccttcctcccacgtgtgccagcccccagaaggcagggctgagtcttacaaggatgcagtgttggcatttcagcacgtggcaggcagcagatgcccagtgaaggtgggctaaattaggaggtcagtgctgaggattttaaaggctttccttttcagactgtcagatgaggtaaccatcttccttttttctaaaacgggataatgtatgtgatgtatcaaggcaagttatcccccatccatttcttttcctgtcctgtattacgctatttctattctcaccgttcctttgagaccgccgtaccaacttctcctgccctgactctcccctttttccttccttgctctgaggccacagacagcaagaaataaacacacacacacacacacacacacacacacacacacacacacacacacacacacatatctgtctggtttcatatttctttgtccctttcgcttcttaatatgaatgtgaaatgccattgtttccctctgtacacgtctctctcgatacgtgtgtgtctgttgggactgtcagggagaatctgtctccacgcctcacaggaacacccccgctgcgtgtatttgtgacatctcgtgctgcttctgctcctgcagtgtgtatgttcctcctgaatcttaagcatttttgatggcaggaaaagtgtttgttcacttagattaaacccatattcgaacacccactacatcgtatgggcacaagtgactgataaagcaacagaatttttacacctgtgtaatctgccttctgtgtagatacctggttgccagtgccataggatcatacagaggtgaagttttgggggaaagatgttgcaacctgggctggtgtaagggtaacggattaaaccgaatcctaaacagagctgagcttcattgcttacacttaaaatttttattttcccttgccctttcaacatttaaaaaaaatggcatggggaaagcttgggataaacagtaggcagagctttcaagttacatatcttggcaggatctttcttcttttttctttttatgccctcactttttattttatttcaacttgtatgacatggactctttataataaaagtttgttacatgagtaaactatgtgatgctgaggcttgaggtcccgtggataccgtcacccaggctataagcatagtacccacctccctcttttgaagagagcttgtgtatagtaagctcagtttcctctggaaagcagtaactttaaccttttttggctcaaagttttgtttcttaaccaaacttaaatgagagacatttccacaggtaggaaggtcctccatggacaaaaactaataaaaatgtttatagaattttggtcatttgatagaaacaaaatgaggagccatcctctgaaaaggagctgaaagtccttatgagctatggtgtgatggaaagtcttggtcaggttattcccggtcaggtttgggagcagttctgccccatgctgggaaggctgggactcccagtttctcccagtcacagattccctctacctgagaaccttgagcactcttaagccaatgcctctggaagccccttatctattcatacccatcactgtgtaactaaataaaggagagaaaattcgtgtataagaacatggagttgcagaggagactgtcgaattagctgacaaaccaccagtttgaggaagaggaaaggccctggcctggtgggagtctctgctcagtctagttctccctgagcccaggagtcaggcccgttgggcagaggggaacatgcctatgtttattcagtcagatggcacttagtgtctggagatccagcaggaagacataaccttcctataggttcctcatgtgctaggaggggagatggactgccataaaggaataacgtgatcactctctgcagtaggagagacatgagcaggaggccagggaagcccagaggaggacaggattcctaacaaaatcctgactaggcttgggaaggaagaactaaggactgttgttttagctgaagaaagaggaaggggctttaactgggcagaggaagagtggtggcctggaaggactgaggagaaggacgttccagggagaggaaggcccgcagggagccttgaaagaagtcagtccagcaggctttggcagaaacgaggggccttgctttgggaatctcctagcatagcaacaggggggtctgtgcctgattctgtaaataacattttattggaacacagcccatccattcgttcagctgttatctgtggctgctttttcatgacaacagcagagttgagtagctgagaaagggaccttgtggctcacagagccttaaatatttactctctgtttctttacaaaaaaagtttgctgacccttaactttattctttgaaattcttaatgaatggacccacactgtcagccctggggcgttgcttgcaggccttcatgcacctgttagtttattttctcattcagtgatcctgcttcaccctgccctaccacaccaccatgtcagtagcctctagatggcagtgaatatttcaggagtagaatagtatctgtggtgtaaagggggtggcatttccccaccaagtaccccctaaaatgtctgattaccaaccccaggctctcatagactgtgcctaattttgtggaacctctgctgctgctcatttgcttggccaaaaccccccatcatgccaagtaagcattgacaagcaaaatcagaatgaaaaatagtgataggaataatggtcattgcaaaatactattctttggtgaggcattccatttgtttagggcttctggagctggcagctagaaggagagccccacctcaagtctgcatctatttcaaaaacacagaatgcttttccagaagtgtctgtgcatttgaaatgctgctttcccagatatagcaagtaaaagttgtgtggaattacatagcaaatgccaacttttaagcacctgctgtggtccgtggtatctgccattgggcctgccaggccagcctcttgatggttagtaagagctggatgaaatagaggcggagtcattcccattttacagatcatgcaacaggggctctgacaagccaagtaacctccattttaactagtaagagacccatgagaaatagggtatttatttttatgctctagttattcttagcaggtagagggcttgttgaaatacttgaatcaagaggtcaagaattttggtgacacactatcaaaataactggttttcaaggggcaggtaaaatcctccttagcactaacttctgtctcagtcccagcagccactgagttatcatttcaatacccctgtgaaataatactgcagtttggaatctaatttttgattaatgctttctttagaaaactatcggcagtaggtaatgatattttccagacatttctggaaaatatagtagctctgaaaagagaagcatataggtttagggttgtcttgttttccgactaaaatggtcattcctacataacagtgtgatcataatcttcccctccataacattattctgccgtgttcttagggtaaagatcagggtacttattgtggcatttgaagcctttcctgttgttgcatctcctgtctgtcctgagtacctcacacttctttctgtttgagaccacctcagttccttgaacggcatcgttagattgtccctttggctggctcactcctactttgtcttcacatcttggctaagatgtcactggatgcaggaggccttcttggagctttggagagtgggttgggtatcttgccttgcccagccctgccataatgcctgttatactgttgttacattgttcattgttcatttatttgtatgttctccaccattagaccgtaagcttcatttaattttttttaaatcgacataattacacatatttatagggcacttagtgatatgatgttgtgatacataaaatgtacggtgatcagattagggtaattagcatattcataatctcaaacatttctcatttctttatagctagacaggaggaataagctctggtgttctatggcactgtaggatgactctagttcacaataatacatggttttaaatagctaggaggagcatattgaatgtttctatcagaaagaaatgacccttagcttctcaaaggcatttgttttcgttttgaccctacagttacaaggaataggaacccattcaagctagctaatataaaaggagtttattgtgaggaagtatttaaaacaataaggagaactttatggaaatctaaggactgggtctgtaagaagctgtatcccatggatgcagggcaggagttccttaggatggtgtagatacgtctcatggctctctgtgcaccagctctattcacacctctctggcctgttggctttctcagttcatgcagttgtcttcacgaggtctgttcatggccccagcttgcccacatagcctagaatgtccctaccagtgctggaggaccctcctaatcacatggctttatttcctgctccctgcttgtttggtttcttagtttccctattgctgatttctaagtaagcgctctggttggcttggctcacttttttaagccgggccacacatgttgtcataggtctctggccagcctgtagttgggctgtcctcaggtcagtcatcactctggaccagttagatatattggagctggaggggctccatgtatcagagcatggctgccaacagagacctttcttttttggtttctctccctacctcttggcttacaagaatgttaggcttgtgttttatagatctcattgtatcctttgttgtttttcattcttcacagatatcattaacggagctcaagaaaaatgtgtattgcctcctatggacggctaccctcactgtgagggaaagatcaaggtaaggcagaggcaagcatcatccccaatctgcacaaacaccccttctttttcccttctcttccttttcctcctcagtgacacaaatgggtgagtgagcccttgacatggatcatttatggggtgcctccatcctgccggctttgtctgtggctatgacaaccctgctatgcctatgtcagccatgtggggttggtcaacagtggctctcactggtcagcatgagagagcctgggccatttcaggcacctgctgagtctttgaagctgacttcccctctctgtttcccagcctccagcaagtgatccttgaaggaccaatgacaaggaactgctgttatttagtgtccaactccccaccatctcagtccccaggctcctgctctgaagcctccagactgtggtttaagtgtcacatttgtatttgtggttgagtactgagagacacttggctgctattttacttggctgcttttttttccagaaatcctatttgtatggcctgcccctggggagaccactccctgctcagtagttttcagagaacagtgtccattcagggatgtagttaggacagtgggaccaaccccagaagcatttgggtggtatccatgtgggccgtccgtcaacgctcgtccgtgccctccttcacgcactgtatttcaggtaccatgctgtgggctgttggaactggagttcctggagggggtgtagatatcagagtcccattaggcacttgatcttgataaaaatccctaagccaccgcctctcctgggctttattgcctgctgtaccacgaccttactctccactctaagcgcttctgctgaggcctaacgtaagccagtgtcttcctgttaatcgtccaagtaggtgagctgcacacctggctatcttgacctcggctcagtgaccctgtcactcagttctttaggccacagcttgagccattcactccatcttcaccattctatcctcgccttccctgtcagcagatgtggagggcctgtgaatgggctgctcagagatgttcttcttgtttcagtggatgaaagacatgtggcgttcagatccctgctacgcagactatggagtggatggatccacctgctctttttttatttacctcagtgaggtgagtagctttctgtggctcctgggggtagatgtgactggttggactgttctgtagctgagtctgaaatttgaaaagcttgaaaacgtgtggtatttttatgtggaggacctatggttccgtccttcattactctccctacctctccaggaatgatgtttttcttttctccttgagggaaaaataagcggagttagttagctatttcctttttttctagcttttctttaaattgtagtaaaatagacgtgagatttgccatcttaaccattttcaaatgtgtatagttcagtggcattaagtatattcacatcattgtgcaaccatcaccactgtccctctctagaattccttgtatcttgcaaaactgaacctctagactcattaaacactaactcccccttaagaccctgctttcagttattttggaaatatacccagaagtgaaattgatggatcatatggtaactgtattgttaattttggggggaattgccataccattttgtaaagcagctgccccattttataccaacagtgtgcaagcattttaatgtcttcatattctcacctacacttgttattttctggttttgttttttgaataatacaaattatttagagaaaggaggatcattcagcttgggttaggtataaagagagtcaatatcaggaaatctcctgggtttgtcaagaagagatgccacatgatcagaatcttgagaaaaaaaaatgttataagtaagttaggtaaatgaaagacaaaagtgtattcaaggcagagaaacaacatagggaaagttatggtatcagttgcacagtgggagtgatgggacaatggacataggcaggggctaccacttgggaagtatggaatactctaccaaaacctgggaatgtgggtagaccttctggttgctgataggctttatcttcaggtcctctatgccatcaacatactcatccatgctgtggtggaattcaatgtagctgaagctcctgctctctgtgtagctatttttggaattctcccagtgacacttgagtacattgggtgcattctgggtccgtacatatgcatgtctatagcagtcatcccagttgtcattagcatgtgtatgctcaatttggtaacctgagatttagatgaacatgtgagagctcttatcttttagagcacttctttttctctcatgaggacatcacatctgtactcttgaacgtgggtagtgatgttttatgagttcccaccagtagatgttcttcctgtgtacaagcagcctgcataggatcaaagcagggccaagagcaggctccagatctttagagaggttgccatctcagtcaccagagccaccctattcagattcagtgtttgagtcactgcttgtagagggatcagtgtgtggatctgaatagcagagtctatgtcctcctcctccttttaaagaccaggaagcatttactggtttattataacagaaacaactcagaaacagccagagggaagagatgcgtaaggctaggtttgggagggaagtaactaaaagatagttacatttacgttccttttttccctaaatctgagcatcattttcatttgtacccttgaatttaaatagcagcttttgtatttttttttttaacggttgcagagaactttatgggccacttgaattttttacagactttaaggatatccatttcacctagaacctcttgggaatcaaaaccggctggcttcccctttatggactgggggaggaaggggttggagcagagtaggcagctttggggtcttgtgaaacaggttctggccaattctgaggtcatgcctccacagaccctctgctgccctttctttttattctgtcccccgtttttgtttgctgttgctgttgttatttgaccaataataacagctggtgatgccatgcaggaaggagaacaccttcatttttgaggctaaataaaatattcttgccatagttttccttttgtgggattcagatgcctctcttttctttgccatagggtgatggggatagaggccaaacagtattgctaatagggcatgtggccctgattctgtggggtttgcccctctctcagactattacttcttttgcctgggtgcattcaagttacactttttgggggttccaaccgggctccatgattttttgggggaagggggacaaggttgttccattgccatcatgaaaaccccagagctaacgatagttaaaatacctcttggaaatgaacagctctgagagttgggtgtgtgaggctcctcattagcaggctgctggcaaattgacttgatagcatttatatgagtttctggcttccggcttgggtggcttgtggcctgccttctcatttccttctccagaggagtaaagcctggggccatgcgtgaaccttcactctagttgaaaagtcaattagaagtacctctcctgccctgaggaaaaggttcctcatttagtttaattttcaaaagttttattcccctttctacttgaaagaatttagccagagtctgaccaagctccatgattgacaagctgggctaatttcatgccttcctaagcctttgcatgttggggtatgctgctgaggcagaggattttacattcccatacttacatctccttggaaggcatggagagtgatccaaatggaagagactgcagttatttgtgacttctttccctccctttgtcacacttcacccctgctcccagtgaagtatatggctaagctgagagaaaagtgaggttctggggaagggaagtagagaggaatacgggatgaagagacatgatggatcacatatcacttgctatctgaggctgagtatttcattttggaacgagcaactacgttttctcttcctgaggtgtgaaatacgcttcattagctcataccactctcttcttatgcagatatcgggtggtctttttgttgcttggctgaattctgttcagtgagcagttattgaattcattgtcaacaattaatgaaaacacattttcttgacaccacgttatgtgttaatcattgtaaaagcaacaggaagaaaggatgcaggtaactgaaccaggagaatgggtggagataactagggaccccttcttacaagttttaatctgaatataaccctgaacctcagggcttttctatgttatcatagcattgtaataagtaccctgtgagagttgaaggagaatgtcaccaatatggtcccttcaataggaataatatcttagagtcacacctgacatcagcttctgtttctgctgctttctcagctctatgaggtcacttaaccttttgtgcctaggattcttcctttatgaaataataggaatgtacttagagtacaacccggcagataaaagacactcaataagcataactgacacttccgtggttttaaatgttgtgatctttttggaatagttgtggggtgtcactttgccttggacattatatgtgggaacattgttccattttagaattagaatcaatttctggttctcatttaccagtgtaatgcaattttagatcctttgacttctggtaatatagaaattcagctgtttcccttaatgcctatttttaaattgacaacgtttgtatgtattcatggtatacaacttggtgttttgatatgggtctgcattgtggaatggctaaatcaagctaattaacatgtgcattacttcacatacatatttatttgtggtgagagtattttcccttgattggtcatttctggacatgatacttgggtttgcactggaattagctgcacgtatggacccagtgcaccctaccattgttaatgtgagattagtagagatgttttgtaaaaccgattaattcctttttagtatttttaaaatcctggacaatatctgtggctttgtaggagctgttggttcacttgtgtggttttattctttcctgctgtcttgaaactttccttattctgttatttaagttaactctgaaacctgcgtttttatttcctgtatcatctaggtttctcttgcaactggggagatgattgagagagacatcttcatttgagttgttaatgtgatcaacacatgcaccagtgacttttattctattcctaatccttattgaaagagccagttcttgttttgatctatgtttaacatcagagctttaacagatgccaaaaggacatgaagtaaaatgtctcttgtatagtcagtcactagtggaattggagcatttagattcagacctgtcttaagagatggtactcttccttcatttttctttcttagggttgtctcagttcaccagcttccgctgagttatgggattagaaacttctgttagtactttcaccctcaccaacttgtagtctatggatcttttttggttaaatcccaggaagaaaagccatcaatatttttccttaaaatacccccacagctgtttgttatatgtctgacgctgtactagagatggtagagataaaagctgagtggttgcctttctttagaggtgggactttggggcagacaagagaagaatgaaagactattgatgctccactgtaccagacacctcaaatacagaataactccattttatttaagtgacttcagcatctgaggattttaatatccacaggggtcttgaaaccagtccccaacagatactgtgggtcagctatacacaatcttatttaaacctcttgccaactctaaagagtaatggagagccaagtcatagatagctcagagaggtcaagtcgcttatccccaaagtcctgcactttttgttcctgctgtctcctttatgatgaaggaaaacggatcttaggtagctaacttgcagccattgactttgcattcagttgtatggttaaatccacttgtgatgggaaaatggctctaatttagctaacttgaatgaatagatcttcattgctagttgtctaatactccataatttcgataccctacgcctccaaaaaaacacaaactctcttgctgccataactcatgaaaaccaggtgtcagccattccaagtggtaggaatgagcaaatgattcattaggcagccttgtatttccagaacatcaggcagttcattttctgtatctgttttcgtgagccatgtaactactcccattacagagacagggccctataaagtaattactctgaatgtcattgtttcaggtatattaacttaaccatctgcagagccttttactgctatcagcttttacaaaatttagaatgaatttcttcatctctgttgatattatgttgatagatgatactgatgtatttgacactggcacttttttttctttttaaacagttgttacagaacctaggaagcatcatacctttccagagttcctaatttgtttatgcttttcttgtatgcacttctgttgccattgcaagtagagttgctctgaaataatcaaattgcccagtgattgattgctagatcttaggatgtgtgcaagctattgcttcaaatgccaatttggactagatgcatgagagtgtgtctatgactctttcacaaaggagcaaaagaagcagtttcatgccttacttgtcaatctagttcttatatttcataaacaacagacgtaaaggtctttgcttctttctgttctcccttggcagtatgtaaaactaatattggctgagcatgtaattaaccttgagtttaaattcagcatacttaatcccttgattaatgctaagattaatgcccaacaggaaaggttgaaagcttaaatgtttgtgaatgcgagcatgaaatgaaatcctaataaccagtacaatgatttggatttatgagctgtgttggctgctaaagataacttggaaatggtgttgcacagactaatttgtcaaagtgggcagtgataaagaatagactgcttaggttacaggacaaaacctgaatgtaaaaacaactaacgttttggggtgggtcagggagtactttaaaaatatcaccggattgttgcccgagaataccaacacacacccttcaaatgttcagccatttgaaatgggaaattccttttcctcaagataatatttctgggcagtaaaggaggtggcagagatttatgatcatgttcttttcaccttctctgttcagcctttattggtatctttttcatctgtatatatttgttgctcttactacctgagttctaagacatccttagtaaaagaatttaaaaaaaaaaaaatcctgagtttacagaacagtatttgttagtcagcctaactgatctgttagtttctccctttagcccctcacccactaaagttcttagcaacacttcctgtttatgaatgttatataccacaacatttatatttagacttcttgttctggcctccactctacaaaaatcagaagggcaaaggacaagacttgccaaaacccaaatcaacacttctttgactgcttcttggaacacatgtggcaggatggggcttcaatgctgtcatctccaatttgttttttatacacatttaaatatcgtctcatgtaatttctattgtatgaccctaaaaatacttttaaaattatgttttaaactttttaatatgcaaaatttccagcatgtactacaaaagagtttaacaaactcctgtgtgcccgtgatccatattcaacaattgtcaatccatagccggtctcatttcatttataacctcctctgcttcattattttaggacaaatctcaagcatcatatcatctgtttcaatgtgtatctctaaaagagacttttaaaacatactgtacaactattctcattataactgctaatactatttcacacctgaaaattaacataattccttcacatcagattagtattcacattttcaggccattgtataaattaaagtttatttatttgaactgggtttccagtaaggaccctaaattgcaattgttgatgtctcctaaatctctcttcattttaggttctcttccgtctcttacttttcctccttctaattttttgttagagaaactgcttcattgccttagagtttgtcttactctgaattttggttacagcccatgttgttgcataacctggctctttgcccccttgtatttccagtaaagtgatagctagctctgaggtttgatcagaatagtgcctaatattgtttgtgcaagttatttcatggataatggtattatatacttgagttgggaggcacataatgcctgatttctctttctctctctctctcttttttttttttttttgatgttagcaatcattgatcagtgcccaggttcattaattcattaaaggtaccttcttaatatatcaggaatacttctgtgcagagatgtgactcttcatcaggtatgtgatcaccctaagaggaaattcatagaagaaaccatttatttcccagttcatttcctagaatttccagcttttcttctttttgcttgcttgctttttgttttttattatcgttatgtagtaatggattaaaacatttgaacaatccattgcagttattttcttactgattgtcaagttgccccgctttggccagtgaggacctattcatactgctttctcagaccttttgacatgaccatggtagtttgtaatagttttcttgttctgtggtatgccaagatcttccagattcatctcatacagttcctgccctaggcctggaaccagcatctctaagaaccatcttgctcccccggcctgcataccaccccagtttccttagaaataatgcttaggggccacaacctgagtgccaagagcattaattgctattgatttttttctggctgctggagatgtaacaatgaataaacactcctcattatggttgtgttatgtaaggagagatagctagcaacatcaaaaaagtaagatgtatcatctagattgtagtgcatgcctggggagaaatactaaagagagggcaagaagtacttatgagaagtgatggtgtcagttttggatagagtggtcaggataggccctactgagaaggtgagaaaatgatgttggaccatatttgaagaaagtgagggagtaagaagtgcagatatctgacaggtgtttagcaggcagtgggaagagaagtgcagtcgccctggagtgaccattaacacctaatgttaacaacaagtacaagcaaagtcatctccacagagagttttgtctgttttgttctcacgtacaatgatgtctggcacatgggtttattgaatgaatggttctatctgaagcattttttaaaattggctatagttttttgttttgagtgggtaacttctagctctaacccttccgatcttaaaaaaaatgttgtaaactttgtaacattaaaatccgctaagacatttgagttgagacatgaagcaggggcgttttgagcactgattaacacatttaatatacagtagtcctctcttatccatgagggatatattttaagacccagtggtacctgaaactgagggtggtaccgaaccctccatatactatacttttttcttcttcacaatgttatggcttctctttggcatatctgaattgccagcatcattactcttgagctttggggctgctattaagcaaaatgagggtttattgaacacaggcactgagatactgagacagttgatctggtaacataaaggctactaagtgactaatgtgagtgggttgtgtctatatcatggatcccctggacaaaggagctgttccagccctgggcatgatggagcaggaatcacaaggtttcatcagctactaagagcattgcgcaatttaaaacttttgaattgtttatttctggaattttttatttaatattttcagactgcagttgactgtgggtagctgaaatattagaaagtgaagccgtggataagagaggactactgtaatgctctgtaatattatgagaacatacaagggctcagatagactgttagaatggaatgagccaattgtattagaaggcacagctttcttgcccattttttattttcattgtcacttagcataattgcacattaaacacaaaaaaagagctatatcattgttgcctaaaatatgactacctcttaaaattgagtgactttagttgtcaaaatgtccttatgtggatacagaccagttgggaccagttttgccagcatccagtgggagctgtgcctagtgagagttgctatagaaagtatctctatgcattatctgtttggttggctacagaggaatttatttgctgcttctcatgtataagggaaaattggcctttctcctcttagagcaatttgggatggattattgaaagtgtcttatcctcttgttagaaccccactggttttgtggcacactgaacacttactacaacatccctttaaattctgcaccccccctcacccctgatatgctgagcagaactctcatggatccctctggccctgtactctgtctcttgcaggtagccagttctgtactttgtgttaataatattcctccctgtcttgtcagggggcagcagtacagtgttagaggaaacacacaagacctgatttgctgtctggatcccaccacttccctatgtggctttgagctttcccttgagttttcagtctggtttctcctcattgaggtcaagataaagtctgctttgcctccctcagtgtattattgaacggttccaataaaatgagaacagtaaagcgccgcgtaagtggaaaagagtatcattatcatgagtctctttagtgcccaagtcatgctttttgatttattcattcactacttaacaaatactaattggacattacctgtgtgccaggtactgctttcaggactggagatagagtgagaaccagacagatgaggtttctgtcctcaaggagcttgcatgcagatggggcagcaaacaataaaatcagtatataaaagaattgcctcaagggttgaatactctgaggaaaaataaactagggaggatgcagagtggccaggtcagtgggtcagggaaggcttctgtaaggagaagtttgagcatagtgtggaaggaagtaagggagtgaggcatggaacactctagaaggaagagggtttcaagtagaaggaagagcaaatgcagatgccctgagctgtagggttaccagataaaatacattacagccaatgaagtttgaatttcaggtaaacaatgagttttttcaaatataagtatgtgacaaacgctgtgtgggacatacttatactaaaacaaaaactgttgtttgtctacggttaaaatgtaattgagtgccctgtttcttttccctaaatctggcaaccccactgaggtaggaatgaacttgcatgttcttgggacttgcaaggaggttggcttatgtagggcagggtgaatgaggcaaacagtgtaggagttgaagtcagattctataagatcttggtataaattctgggttttattctgagagcaaggagaagccattgcagcatttgagtatgtgtagaatgtgatccaattttggcgtttcgtttgctcttgctacatagaacaaatggtaggagcaagagttggaagcagaattgttgctacattcgttaaccatacagtactgccacgcagcgggagtataatcactttaaaggatttcatacagaagacctaggcgatgatactccaatattgaagactggactgtgtttttgggactgtaggaaccaaaagtttagccaatgtgcttcaaatagtgattgagcatatcagctctggggcaagacaggtggcatttccatctttagctgtatctagtctgtgcttcggcgtcttcatctagcatgataattagcctttctcaagaggttatttgaaaagaccaaatgagatgacctgtgtaaagggcttatcctcatgcttggctcctagtacatcgcaacttttattctttgtctctcccagcccactccccctacacagctcttcagataaggagtcggaccaaaatattaatcaactcaggtgttggtgcagagaactagcctagaaagctgaaccacttaccacttacatgagtagacatcctttaccatctgcattttatcattaaaactttagaaagtagaggaatcgggagttggcatgtggtagagagaagtgcagggggcttacttttttttagtgtatcccttaatgagtaacttcactggatgtcatcagtataacaaatgtgtgtatgtttatgtatgcatgtatatataagcgtaatcagtgtgtcaaatgaatatttagatatatagtcaactgtattgatttgatatatgaccaactagcctaacaggatgacataaattctatctttcagatcttataggataataaaattaagagggttacctgatccaactctaaagtagatgagaaaacttgaaagccaaatggtttaaaattacatgcctagttatttgcagagttgggcatagagtccattttgactgatcccagattcagttatctttccccactgaaataggtctcttatccctcactaagcttggcctaaaggtaactctaatgtatcctggtcagagaggcaacaaatttcagttgtcactcagccctgccactcactagagaagttatagtggcaaattcacattaagccttgacttcatcccatgtaacatgttgctagtacccgtgttataaggccctatggggaattaaattgtgtagtgtgtgtgtgtgtgtgtgtgtgtgtgtgttacgaagcccaacatattctaagccttcatacatgatggtatgcttatgtaactcctttaaaaattattctcttaatgttcattgtgaaatgtataatatgtagattagcaaaaagaaaatgaaaagcacccagaacaccatcatccagagatgatctcagacttctcgtatgcatttctctcatttagttttgattatacttaaatcatctgaaaaatacagcatgaaatcctgtgtgttggtgacccattagaacagaatacttcacattaatcatgaaagaaaaagccataacacagactaatcattattctttcaaaagaatagaacattactactaagagttttgccatattatatctaacaacatgcatatatacattggatttattagttttcacagtagctttattactttttctttccatctttaaactccaacttgagctgtcttatgtatctgccagcaacttttttccccttaatataatgaattgtccatcctacagaccttagaaataagtctgaccagattagacttctagggactcagagaatgctttgattcacaatgttcatgtttaagctgcaaaaccctttttgttcaaagaagtttaaatcactatgaggaggaatgtcaaaaaaacaaattgttgtattttatatctccttgttcaagaaaagggattttatagggtcctttccatggaatgtgcattgatgttctaaagttttagcctggctggtctttgtttgtttttgttttctcttcattttgtggcctgaggctagtgagctaaaaagattagttcatgtcagagtttgctttccaattgaaggttactggaggaatgcttctcctcaatcgattgttgtgtgcgtgttgccgtgagctcagacagttttaatttcttagacttatggtggtaaattgtaggctacttttaagactgtccagtcccttccctggcagagggcttgagggaggtctttcccaggccataaaagctgggtagagatggcgttgacggcagggggttggtggggggaggcagggtacccagtgtgtctccatactgaggggaaatataaaatcatgtcccagggagagagtaccaggagccacagttgagaaagtgtgaaggaaggtggtcatagacagctgtaggacgctagggctctgagagccaagagtagaagagctattgagaatgacttgaaatagaaccattttcaggtcaagaaggtggtgggtaggattccaacttacaagggacgtgaaggacctcttcaaggagaactacaaaccactgctcaatgaaataagagaggatacaaacaaatggaagaacattccatgctcatgggtaggaagaatcaatatcatgaaaaggaagaatcaatatcatgaaaatggccgtactgcccaaggtaatttatagattcaatgccatccccatcaagctaccaatgactttcttcacagaattggaaaaaattactttaaagttcatatggaaccaaaaaagagcctgcatcaccaagtcaatcctaagccaaaagaacaaagctggaggcatcacgctacctgacttcaaactatactacaaggctacagtaaccaaaacagcatggtactggtaccaaaacagagatctagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaatccctagaagaaaacctaggcattaccattcaagacataggcatgggtaaggacttcatgtctaaaataccaaaagcaatggcaacaaaagccaaaattgacaaaggggatctaattaaactaaagaacttctgcacagcaaaagaaactaccatcagagtgaacaggcaacctacgaaatgggagaaaattttcacaacctactcatctgacaaagggctaatatccagaatctacaatgaactcaaacaaatttacaagaaaaaaacaaccccatcaaaaagtgggcgaaggacatgaacaggcacttctcaaaagaagacatttatgcagccaaaaaacacatgaaaaaatgctcaccatcactggccatcagagaaatgcaaatcaaaaccacaatgagataccatctcctaccagttagaatggcaatcattaaaaagtcaggaaacaacaggtgctgtagaggatgtggagaaataggaacacttttacactgttggtgggactggaaactagttcaaccattgtggaagtcagtgtggcgattcctcagggatctagaactagaaataccatttgacccagccatcccattactgggtatataaccaaaggactataaatcatgctgctataaagacacatgacatgtatgtttatagcggcactattcacaatagcaaagacttggaaccaacccaaatgtccaacaatgatagactggactaagaaaatgtggcacatatacaccgtggaatactatgcagccataaaaaatgatgagttcatgtcctttgtagggacatggatgaaattggaaatcatcattctcagtaaactattgcaaggacacaaaaccaaacaccgcatgttctcactcataggtgggaattgaacaatgagaacacatggacacaggaaggggaacatcacactctggggactgttgtggggtggggggaggggggagggatagcattaggagatatatctaatgctaaatgatgagttaatgggtgcagcacaccagcatggcacatgtatacatatgtacctaacctgcacattgtgcacatgtaccctaaaacttaaagtataataataataaaaataaaaaaaaagaaggtggtggggctcaccttggggtccagctttattggtagcatcctctactggtgggttaagcttgttaaaggaccctggacagatcaaaagaaaacaaagttagggattaggaagttgttactagccttcagcaagattttccttgaatgttattaatggtgttcttatttaggaaaatgttgctcatttgagagctgtttgtttcagtacttggagttattgccaatgctggctttcttccaatcctggtaatcctccgaggtttcccagagaaagaaatgctttgttttgtttttcccttctccccatgggataattggtttatgtataatttaattattttgttaaccagttatcctatcacagcatacaaaaacaaccttaaaaacccaccttcccgctctgtgctaagatgttcataattgattttcccaccattacgagtgcatgtataacagcaaaatttcttgctaaaagctaaattggattgactctatattttatattttcaggagtgcccttggagccttagggagtaatacccagtgatttagaataagaagaactaagataaatgatcagtttcaaagaggcattacagtcttcaggcttctgtagggaagtcatctttttaaaaatcacctgggactgtattttcatcacagtgaatcttgaaagattcttcttgcagtggcagagtgaggagagaactttatgagtatctggtctcgctcatgtctctcctcttagttgattttctttagtcttgtttcatctttccccatcatgctattcctgggaaaacttcatcctggtgggtggctggtaaatttggttatttacttggtgtaaggtgtatttcaaatctctactttccttgctcatcctttttttttttttttttttttttgcagggttgggggtgggatggggtgaggttaaagatctcacaatcaagtctacaatccatttgaagtcttcatgttataaatatgctttattgagtccattagcacaaatctaattggagctaaataattcaatctggcctaagaatacaaggtacagatgtgcataatgctactgagaccagcttaggcttcatccacttgcaggctttttctctgctgtttttcctcatttttctcatttgtggagctgcagatattgcctttcatggtcatgttgttgtcagatcccagtaattagactgtaggcctccaaggcaagttggtcttttcttttttatgagtaaaaaccattttagctttccttgtggggaatccttttgagtctctgaatcattcacaaatatggtaaggtctaattttatcccgtaagaagataagagaatatttcacttttcctattcagagattccgccctctccccaagctttgcttctctctgcttattgctttgggatcatctgcagtggcagatggctttatgcaaatcaggccaattactttggttatagtaaagatcaccttgcattatgagtaacttccagattaagtaaaactgacatgtttctttgaaaacttacccagactgagagggcacactgtcttgtgctgacccatgaggctatagctccacacgtctctgctatcttagtgacccctttaaggacattccctcactctattgctcattaaattttatagatctacctggccatagaaaaattattttcaatgcctgttagccatatttcataatctcattctttattagtaaacgggtgataatgctgtcttcaaattttatggctagttttgacagagaacagacaccaatataactttaatgcatttctcatttttttgctagaaattaagttgcctaatagtctttgataacctttgctgaaataatttctatagaatcaagttcttttttcctttctctttcctcctcccctcaatttctaaaccttattcattgacagaacaatccatcttccagattggctctcacaagatcatcaaggttttttttttttctcctcctttcatttctttctcagataggttttaccaccttatttcttgagatagtgtgaagcaaatagctagaaaatgagggaaaccttgaccaattagccctaagctatcagtggcattcctaactcagataaaggattgagttctgtggctccaatgccattccctttcctttccagatatgccacagcagataaggatctttcctgtccatttgctaaagggtcacagagacaccttacattctcattccccagtggcaatgtttcagtcttttaactttctgccattagactgcctttccttctggtacagagatgtgaggcttaaatgactaaggaattaattgctgtaaagtacttcgaaggacagatgtaaagtataatctcttccttctgacctttgctgctgattgtttcatctgagagggcacttgtatctggaatactagctaaaagcatgggaatttggctaataataaaaatagcacatattaatatagtgctagttgtgtgccaggagctgttctcggtgctttttatgtatattaattcattatagatgaagctgcatatttagtgtcactgatgctttttaggttgaaaattggtgtcctcatttaccttggagagcaaaaaatccctacgaagaagctgatcataattcattggtaagtgattttggaaaactctttctagacttgtgcatttaggtcagatgccaagtgatacatgtggaatcttctagaaatgccaactataacctgaaatagtgttacactgaaaaacttctgtattcgtctctgtggaagtctaagtgactaaatcagtcaaccattagcataggtttgtttactgagcaattctctgagggttcctgaatgataggctactgatatgagtaagacctggtacgagctgtggaggcccttagtgatctaataaggctgatggcaaataatgaccatctctgtcacaaatgctgtaatataggcctgtgggaattaatgaggaagaggtcattttagtctgcaaggttcagggtagattgaatagtgaagatgacattggggccgaatttaaatgatgagtgagtttatataaggtcaaggagaaaagggtatctctcgtgtgggaaaatgagagcatagcagtttcagggaggagagcatgcacgcatggttcagttggccaaggccataggtgactggatgagctaggctgaaggtgaaattgggaaggtaggaaggggactgtgaaagtacttgttgccacattaaaagcttaagtctttactctttagaccatagatcactaaacttctacaaaatacccagatagtaaatagtttcatctttgcaggccatattggtctcattgcagctcctcagttctgccattgtagcgcagagagcagctgtatatgatatgtaaatgaaggggcatggctgagttccagtaaaattttatgcacaaaaacaagctgtgaggatttagcccaagggctgtagtttgctgttccatgctgtaaaccacaggagtcgtaggatattgtttagtcaagaagggaaatgaaactggatgtggcggctcatgcctgtaatttcagcactttaggaggctgaggcaggaggattgcttgaggccagccatttgagaccagcctgggcaatacagcaggaccccatcactacaaaaaatttaaaaactagctgagcgtggtggcgagtgcctatagtttcagctacttggaaggctgaggtgacaagaggatcgcttgagcgcaagttcaaggctccagtgagctgtgattatgccactgcattccagtctgggtgggagtgtgagaccctatctcaaagggggataaagaaggaaaagagatgagtgttcagaatgagctatggtgattactgaaaaggtggactcagcatgtttgagatgttctatgaaataaatactggttattatgtttctctattattccaatcactcgttgtatccagctatattatccagagcattaggaaaaatattcttcctggcttttaatttattctgtttggaattttaaattgttctcactcatggcagaaaagtagtattcttggctctttaaattccttagaaaacaatgaatttttgtttggactgggacaaaaccagaagatgagcatttatttccctatttaactctgtggacagaaagaggctttctggcaacttccacgttgtcaaacagcctgctaagaattgacttcagttttcttagaagtctgctgtcctgtggtagatccaagtggaacagtaaatttgagtgctgagaatttcaaggtacatcaaccatactcattataaaaactgcattttaacatagctcagggctttgtaatgcctgtgctgcttttctcaatttctaattttttaatgatgtccctttgggcagatcagcagtcagcagccttggcttcagtttgcaatcctgggaccttaaagtcaaagctgcagcagacaagacttacttttgaagctctcaatttaattgactaacccttttaagttttcagatgtcacatcatgaaaactattatgctttctgactttttatcttctattcattttattaaatttctgttgctaggcggaaattcgtacagattttaatattctctacagtatgatgaaaaagcatgaagaattccggtggatgagactacggatccggcgaatggctgacgcatggatccaagcaatcaagtccctggcagaaaagcagaaccttgaaaagagaaagcggaagaaagtgagtttcttattaattcagtgcagttagatgccagctttcttttaaaatttgattttgcttggaaacaagactaagagaaatgtcatatctcaaatgatattctctcagggtgaatctgctcagtctcttgtacagctgtttttgggttgtcctttccccacttacaatgctcccacttagcagggtctggcacaagtttcttgggtgaagccaagcagaatatctgcctgtaagacttttcctttgaacctgtctttgtcagggtatcaggaaactttcccccatttccttacctgaatccaaccttcgagagcttcctattatatcatcatgaaaattttgtatttttgttgtttttcatccctggcttttggatagccagtgagtttcattgttactctgtctggttggtgcttctgcttatgcccgtaggggagagagagagagaaatttgattaaatttgagccagtttctttctagtttatgaggacaggcttggaaaacctctcgaatacccctgggcttagaagactttatgccctgttagctatagatttgatggtctggctttagattaactgttctgttctgatttcagaactgagcaaagtgagtaatttgctcccacatctaaaaaacttaaaaatgagtttggtattcctaatccaactaatttgatatgtttgaaaaagaaaataaagatacatttacaggatcccaagtcacagtttgataggtcagttttgcctagatctcttgaatttgtgagacaacaggaccacacattctgtcaccaaatggttgtgtatggaagagcatgtgttcagatgtgcaggtgggctgtaaaaagaaataaagaatttttctgtatattcctgtggagtaacctcgaggatatattgttaggtgaagaaaagtagagaatagtttacattatttttgagagagagagggaatttatatctatgtatacataaagatatatacagatacatatatttgcttcttgctgttagtttgaaaacgtatttttcttattttgataaactaaaattaaaaataaaggagatggtgatgatggttgcacaataatgtgaatgtgcttcatgctactgaactgtatacattaaaatagtaaattttatgttaggtgaattttactgcaataaggaaaaaaatggtccaattattaaggggagttgggattagcatggaggcaacagaaactaccatagaaactagacttctgaatatatctgactttgtagatttgatgctggaatcattttatgtaagtgttaaacaaaatgttattaccaaaaactaaaaattaaaaggaatataaaacaaatgaactgactatatatccatccagttttgatggaagcgcacagaaaaagactgttcttagtgacttcagaacacagtaaactgtacacttctgatgggatatcacaaaggataaaaactgtaaaaacatcttaaaaccatttttattaatcatgtaatatgtggtagcattgatattctcattctgaatccattgtgaacattggagtaaagcagatgagtaattatgttagtgtctttgagaagtgggatttgcagtgtggaagagaagaattaatggatggtaggattggtgatgttatgtaaaaacactatgaccttgagtttgaattggaagcaccagtctaaactcatgatttgttttatctttgaggaagaacaaatttcctagctagggccactatcaggcctataaatagtaataaaattgagtcccttaagccccacactttagtctctaaatgctgtttctactaagtggtataagaggttcttggaaaaatggcttattaaggtccaagacagaagttgtacctgttgagcctacaacagtcttgtcaggcacatctgtctacccatgtgcagagaagctgtcaaagaagactaggatcgtgtcaaaagaacttaggagccagcttggatagcctaccacaggcctagatgggacaattggatagtcagtgagaggaatatccacaatattttgaagcatatcaaatatgctttgatgtcataatgattttttaaattaaaaatcctcatagatcatcattagagtaggctaaagaacaagtttattattctgaaaaactggcaaatgaagagaaagaatcaagtatttaccaggctccttctttacaaaccttagagttacctcagggtgaccaaatggttgatgaggggtagtttctctttatagagaggtattattccagctaataaacaaagaaggaatggtaaaatatcatcattttgcagtccgtaatggattaatggatctagctagtgaccatccaggactgctaacatcccaagacagagacacctgtacattgttttctatgaggccaagagacatatgaggcaattattacgtatgctctctgactcttgaatcacacaggtgcatttagaaaaaataaagggcagttgaagaagtatgaatattaactggatatcagatgatgttaaggaattactaggttttttagggataatagtgatgttcaagttatatttttcaagtgaaggtttgttccttttagggatacataccgaaatatttacagatgaaaggatatgtctagaatttgttttgagataatctagaggggttgggagaaaatgggggtatagattaaatatgcattaataattgttgaagctacacagtaattactttggcattgactatattgtcatgtttgcctttccatgtgtttgaaattttccatggtaagaggttagaagtattttagctgtagataaaagaccaatagtgttagaaaatactgtcctgtcttaccttcctttaatcccgattttacaaatacactgtgcttttaaaaggtggaattatctgtccataccttgtactcatagccataccaagggctgcagtgattttgtttctctaaaaccacaatgaaaaatgatttccttcctttgtaccttctagaaaaacagcattccccaccctttgattttgttaggatgtaaacatgactttgggattggtcaatcatttcttggcgcattactgtgccttttgtatgtggttcagtgtgaatcagtatatgcctctttgttttccaggtcctcgttcacctgggactcctgaccaaggaatctggatttaagattgcagagacagctttcagtggtggccctcttggtgaattagttcaatggagtgatttaattacatctctgtacttactgggccatgacattaggatttcagcttcactggctgagctcaaggagtaaggagattacttttcaattttaaaatcagaatacaaaaaagaaattgtaaactcttaaagtattacctctattagtgtataattttttgtcgaggaaaatgaaagtgataattcactaaacaggagataagaagattattttcaggagctaaatacatacactgtgaaaaggataatatgttttcattgtcgctgaaggctccagaggcttcataaatgaatgccagaaaattcaaactaaggagcttattctttgctattacaggtgcttccaacatctggagcacaaaacattattgactttcctaattccctgtctcttgctgaaattcataccactgcctactcaacatcaatcttgctaaatcttgaaacagggcaggttcctgtttgtaattcaatttggatagaataaatttcctgaaagccctgagctgatcctttttcaattagccaactttcagctgagtctgttaactctacttgggtttttcatttcactgaaatttgcttctagctccagccctcctgtaatcccttctatattggcatagctggctgagcagggacgcttccatcccctgcagtcacttaggattactgcccatggagacttcccacccaacagtcaagttgccatgttgctatatgtcgtatatttccagaaggaataccttgaatgaacattctagagctcattgagatgagagacatgttaaaacaatatatggtggctcccagcacttcgggaggccaaggtaggtagatcacttgaggccaggggttcaagaacaacctggccaacatggtgagaccctgtctgtactaaaaatacaagaattaaccgggtgtggtggcccatgcctgtagtcccatctactcgagaggcagaggctgcagtgagccgagatcatgccactgcactccagcctgagtgacagagcaagtctctgtcttaaaaaaaaaaaaaaaaaattggatacacaacctacaaagtggctgcatttatacagttagcagtcactcatctggtgtcttctgtaggctagttttggtgtcgggcatacagagatggccagcttgtggtcaaagatcttgctgccaatcttttgataattacaactaatatattaaaaataattacacaaattccaattctattggtgctaattgaggtgtacgtggatgctagaatgtaagcactgggattgcagaaaactgagtatcgtttgtcactgtgtagtgggcacctagatagtgcctagcaagtaatgagtactcacataactatttatagaatgaatgagtgaaggaataaataggtgaatgaatgagtgggtaggtaaataaatggagtgctgtggtagaaccagggacaagtactgcctggggaggtcaggaaagacatgttagggatttatcagtcagagactgaatttgatggtcaagggaaaatttgttcagtatgtcctcacttaacatcgttgataggttcttggaaactaggactataaatgaaattatgtaaaatgaaaccaatttttttcatcaacattataaccagtgatttgaaggaaatgactttattggagggcctgctatctgttgttttgtttaaagtcccagttttcaggaacctattgatgatgttaagtgaggacttaattctagtagtctttatgcacactggggtcagggctagatgtgttttgtttaagaagataattgtggaagcagtatagagcagtggtctttaaatatatctgtacgttagaaccacctggagatctttgtatttatttcttaattttgggggatcttttaaaaatcccatagaccatgccataggctaattagatcacaacccttgggggtaggacacagccataagtattttgtgatgcctccaggtaatttcattatacagacaagtttgggaaacactgaacatggggtggaccagagatcagcaaactatggctcagcaggccaaatcagccctctgtctttttttgtaaatacagtttcatgggaacacagccatgcctattgtttacgtatcatatatagctgtcttcattccacaacgggagaatgggccagttgtgactgaaaatgtatggcctgcaaagatgaagataatcactgtctggcccttaacagaaagggttttctgactcttgggaggaaactggttctgcagaacctagttctttcataaacaggggagaggaagaagggtggctgatgtggtggtagtacagagctgtcaagcagagtcctgtttgtgactctcgtcctttgaagcaggatatccataatttggtgaaggattatcatggggtgttgcagataagcaacagtggtgactgattagtgagtggatggcagtagggttagcactgactcgttcctacacatgaagttggcctaccaatcaagtacatcgtcacgctctgagcgcaagtatggttttgtgtggatggatgcatgggtgggggaaagggtgattaaaaaaaactgtaaaccatagtgctagttctgtaatatggtcaagcgaggaggaaaaatttgacataagagaaaaagttaaggaacagtatgaggcaggtagaaagaagttaatactatagaggctagaaattgaagacatttagaaaaaggggaggggaaggttagtaagggtgctaagcggtaagaacaggctctgggggagaaaactaagttattgagtatctagtattcattaggcactttcttttcaatatctcattgtgaagaacccctgagagactggtatccaatgttctttgtatccagtccttgttttctggaagatgagcaaagagattgagagaggttaggtaacttgtttaaggtctcacagctgctacatagtggtgatggagtcagacccatatcttccttgatttcaaagactgtgtttatatgccaccatttgcttttgcaagagtcagaatcagggtactgggttggccttaatggatggaaataatttatataggtagcagatttgaaagggccatgctgtcatctctaaaaaggatttttggggtggcatttgcccattaaagttgccaagtttattaccttttaagtaaatgatttttctcttttttctcccctctcttttgccgtttctctagaatcatgaagaaggttgtaggaaaccgatctggctgcccaactgtaggagacagaattgttgagctcatttacattgatattgtaggacttgctcaattcaagaaaactcttggaccatcctgggttcattaccagtaagtgctacatggtgttctgacttaaggttttttttcccctccttaacaaaggttgcatggttgtgggtagaaaaagcttatcaaatagtatcttttcagctgtatggagtgttgctcattcgtaattgaaattcagattctcagtgactttgtactttctatggctattcgttattttcattggtttcttagaaaacaagtgtcaacctcctttctaccttgactaatgttaatacttagccttcctctcagtatgcgtatgccagtgtcatctatttaatcaaataacaattttgataaaatatgtacagtgtcatttcttgtgttccgtgggttttagatcatgattcgcttttcttaccctttacctcatcagtattcttgtcattcctggaagggaaatctgggaatacgttatctgaatgctggggtcttgcactttttaagataagcccattaagattagtatgtctgtggtacatgtgtactctgtgcagtctttattatttagtagagtagctcagtgtttgcctgagtgtgggtttgggaccacgatttaatatttgaaatgcttttacctggtatacaaacatggcactaaatcacaatgaattacataacgaaatttattaatttttcaattttctttcagtctttttgagaaaaggtgtagtttgatgctactctgtgtccgacactacttttaacacatgcatttttaacaatgtgagagtagctgtgagtctcagcattcagcaggcaaaagtatctattctgaattgtaaaatatttcctaaaggttatatgcttttttttgttgttatcttgcatttatggcagtcaatactgggttttatttatggtctttaaaagtttcctttaaaaaatcaattttaaaaggtgaataaacttaaatatatttaacaatgtaaatggcacataaatataaaaaaagcaaaactaaaaacttgctgcgggccaagatagtgctctaccttttgcatgaggtgtttttctggtttttggcttgtttcttgaaatcttgacccaagtagagctgttgttttctaccattttgtaaacggcagacatctgataaatgtgcaaaggaatctacacggtataggcttcccttgactcacatatcctcgctgttaagaagagttctttggatggaaaaatattctcagtggtactgtttaggtgaattaaaaaaggataattttgttattaaaatggtcaccgttgattggtatttgatttcttgttggatgaaaaggcaccatctcagagggggttttatggatgagtgtaatgtttatctgcctttctttaataaatcatctatgttagtgatattacctggcaggaggtctgttagtgctttagctctgcagtctttgtggtatggtgaagcaaagattccattaaaagcctactcagatcctcttggaagtttctagctgatttctttcccttttaaaaattagaaattgtcagggaaaattcaaaattttcccttttaaaaatcagaaatttaatggaatgtattccattaaatgtattgctgttatctgatctttcaattaggaacaaacccttgaggccagttggtcttggaaaaataattgtaaattttgtccaatttacgtagggacctaggaaattcaattaaacatatattaaatgcctacacacaactagtattctgctaggtactgcaaagctcatacgcattttacttcctacaaggcctttgttgaaggacatacaagaaagtaaactgcaagtagtccaagatatgccatgttttatgtcaaacaccagattagaaattagggcatggcaaggagctcctgaacatccatttcatagtagtgtggctgagagcaaagagaagtttctaggaggtatttggcatggctgctgcgatcgctgttacgggaaggcgagctgccttgggcatcaaaacaaacatctttttaagtcattagtcggcctatgatgctccagacacagagacattagagggaagacataaatattagcagcacattataaaaatagttgcaaaacacacagatgcaggatgtgattgaagaaggaaaactataatgtcaaaccttccatgtcatagaccaagtccagtgtcctgtctgtgctttgtaaattaaacctagataagctagaaaagcaattcccaagccaaagcctcaagtaaaaggatgtcgaattataaatttctgagagacatccgatcattccattcctctttcaggaagagcccagtgccgcatagcttacatctaggcgctgtgcaaagtccgggctttcaggagttaggcccttagcagacaactttactcatcaggatttgttttaattgcccaaatcaaaaataacaataataaaacttcaaagttaaaaatgtcactagccaaagctagagaagagtatatcgttagcattttatatccatgagttccacatcaacggatcaaccgcagaccaaaaatatctgaaggaaaaagataacaatacaataataaaaatacaaatatgatattaggcattataagtaatctagagatgatttaaatatgagaggatgtgcgtaggttatgtgaaagtactataccactttatataagggacttgagtatccttggattttggtgtccacaggggtcctggaacaaatccaccagataccaaagatggctgtagactgttggagtcaattgccaataaatggaagaagctgagccttcaagccaaggctccacatgaccacagtggcccatttctccctgctttgcctgcacagagtgctgtaatctttgactcacaaagtagtgctggtgaatcccagctctggttctctggtaggagtggagcattccccagccccacaaatcagcgtgggtcctgtcctctcctcccactttttgcagtgacctgcagagctgccaccgttaacactgccagcttttgcagaagaatatatagtggctcaaaccacttccttgtacatctttttttaaacggaaaaatataagttaagaaatgggtatgttttattaagaagtggaaagggatgctctgagctattcaaagagcaacaaaaacaaacactgatcagttccttgggtccctagctttcttttttcgggactgtgggctttatttctgcccacctatcggccacgaggccaatgacatatctttgatgatactgtgaaaactcccactgtgatgagagcatattccgtgagagccacacaagaatctaagacagggaaattcctcctgtagttagcttgtatttgacttgtggtggtggcctgcctgcctttcttttcttcacttcctggccttgacgaatggtagtgatctctaatgacaaaactagcacacagaaatgaaaatttttgagtatacttcctaaaaagtccattctcatgtttggattttttccccctgaatcatacattgaagtgaaaataaaagttgaaagaatgcttttctgatagtaggaaaaaactgagccagatttttagaagtcattgccatcatctgattctaaaatgtgggtttcaatctttacttttatgcttcttagtcttctaaaagttattcagaagttattactgatacataatagaaaatagagctgcttttattggccatcctcaagtttaatttacatcaaatattttgaaagtcagtgatgaaatattatcaaaatcaataaattttgttttaggattgattcctttcttccaactggttgctcttcgtgcactctagagcagtggtcagaaaaccttctgaaaagagccagccagtaaacattgtaagctttttgagccgtatatgcatcgctgcagctacttagctgtgctgttgcaggatgaaagcagccatagagaataggtcaacaacagggtgtggctgcattcaagtacaatttttattttcgaacatgaaaattggaattttatgtaatttgtacatgtcacaaaatattttttaaaaaccatttaagaatgtaaatattattctaagctcacagaccgtacaaaaataggcggtagaccagatttggccctgttttatggctttggtggaatagtaaacaaaacattttcacttgtatcttcaagttctaggagaaagcaaataaagttctattactatcagatatataaaaaaataccattgcctactgaatgagattctaagcttaatgtaaagtcaaatactccaattgatgaaaatgttgaatgattgctcctagagataacacgtgtcatatgctttaagcagaataagacctctatagatggtagctctgtttctttggcatcagttgattagacacctactgtgtgctcagctctggctaggtgctgggggtacagcattgaacatggcagtccccagttcaagctttcatagaactttttattttgctggtagttgaatgatcttctgtaattagttacccgatctgaagcaaatcgtatctgctgtgtgatgtctcagactctaaagtgacacaagtagatgttcggtacacaagctattgtaaaacatcacaattcttgtctggtcctgcttctatttaaaaggatttacctatttttagtagtcttgaaggaagggttagagcttttaccttttcaactttgggggcaagtatgtagtgttcaacacattgcttttttctttcaggtgcatgctccgagtccttgattcatttggtactgaacccgaatttaatcatgcaaattatgcccaatcgaaaggccacaagaccccttggggaaaatggaatctgaaccctcagcagttttataccatgttccgtgagtattcctgtttcatgtatgctttccagaatgccaccaaagatagatgggaaaattagccgccatctattttgggttatgattctcaggaccattagctgtagaagtgtgtgctgttgaaccttttccttgggaattactgaatttgtttttttgtttttgttttttagttgaaatcgaaaggccacatgaatattttttgaaaagccttgaaaatgttctggagaaaaaatgttcaatacaaagtatctttagaaactatttgggaaaggactttgcagttactttagattggcaggcactaaacacattttatgccacatggatgctatttagggtacactttgtcactaatgagaggtgaagtctttcatgcagatctattttccacataattaaaccttaattatttaagcatcaaactttttaaagaaaaaaatagcttttaaaaatggagctgttttaaactcagttttgtattttactgatttttttcaatcctaggcccagaatgaaattttaccttctcttgctgacttggtatcattgttttcagcagcagtgattatttcatgagccgatatagtaagaacagcacaccaaatgatgatgaattaactgaccacagatgctaggctcttagacattttctgtttctataggattattttcccacttttaccatttcttcctgctgctttctgtttacttggcactggcctcatttctaattagctgaggactgtgaactcaaaaaaccacatttgatagtgttagtaccaaaaacgaatttattttataagtcagtagtccttagtaatgagatgaagtcctattccagaagtgaaaggccacatgagataatttggttgatgagagaattcctattttctaaaattatcaggataattttaatccagaggtttccactttataacttctgagatgaatctgtttgctttgtggaaacaagacccaaaagaccccttcctgatcttcttcccatgtggttgcccctcccccttgtacacagctacctgaaggtgacccctgtctcacactcactaaatgtaacagcacatgcattggactaatctttgggtgttaggcatgaaaagggagaattaagaatggagagtaattttaaaaatcaactcatccttaagtgttctattaagctcagatttgtgaaagtgtgttgtatgcttcataaacattattgttcatggagctgtatcatcctgctattacacaccgtccctggggcacagttcatggagcaaattgatttttggcacgttagataacagatggctttcagtatggtgaggatgctcagagtttgcctctggtttgactttgctgtgtaactttgagggatgggatgagatggcacagaatagcctaagaagtgacctatgtgttaaaccaagtgaaataaaacattaactgtgttcaaagtgactaaaaccgctgggtgatatggcaggcgtgtgccctacaagagatagagtttccagggagtagagaagagaggtttcttttttcctagaaaacataaagttctattttagaatattggaattcagagtcctgcaaacctattttgttctccatggatggagaatttcagcagtattggttgattaaattgaaagaaattcactgcttaaaatgtaactgaagacaaaaacatggattaatttctattaatctgggaagggaataagtttcctaaccatgactcagaattcagcagaaatcagggaaaattgatatgcttgactatattttaaaaaaagaagaacctgtatggcaaaacaacaaccagtaacatcataagcaaatcatgtcacagagggctaaattactaacatagacccttatatatacatacatacatataaaaattgagaagaaaaagttccatgttccaacggaaaaatgggaaaaggctattaacagtttagaggaaagagaaatttactgctctgaacatatggaaagatgttaacctcactcacagtaagagaaatgcatttttaaactgcaccaagataccatgccccatgtacagaatggcagaaatgcaaaagttaaacagcatagctattctgatggtgcagtgagcaaaaccagccctcttcaaccctagtggttagaatgcagcatggtactaccccagtggggatggcgtttgtcaggatctagcaaaaccgcctctgcattttctttcttcaactaagcacctcatatatatgaatctatcccaaagataatgagcaaaatcaagatgtggcatgtgctcaagggcatttagtgcagcactagttgtaataggaagcaacaagaaacaacccaagtaatcatcataggggactgagtgaataatatggtccattaatagagtgaagtactacatagctataaaaagaaatgaggaaggctttcattctaggaggggcatgtctaggatattttaagtgataagagccaacgtgcaggacaatgtagagctactcccttttatatatgtcagatacaaaggaagagtgtgtgtggtcatgttagtatatatgaatgaacttatgtttccaaaagaaacaatgaaaggataaataaactaataaaaatgattgccattggataaagtgattcccattggataaagttatccagggatggggctagaagggtgatgtctcttaatgttccctattttgactttaggaccatgtaaatgttttacctaatttaaaaagagaaatactccaaggaattcaaagtaggatctcgaaaaagtgtttgcacattcatgttcactgcagtagtattcctaatagccatgagatagaagcaacccaaatgtccatccacacaagtggataaagaaaatgtagtgtacatatatatggaatattatttagccttaaaaaggaaggaaatcctgtcatatgctacaacatggatgaacctcaagcatattatgctaagcgaaataagctagtcacaaaaggatgaataccatatgattccactcgtaaagtatctaaggtagtcaaaatcatagaagcagaaagcggaaaggtggttaccaagttgggaggaggaattagtgtttaatggctatggggtttcagtattacaagatgaaaaagttctgaagatctcttgcataacagtgtgaatatacttaacactactgaacacttaaaaaaggttaagatggtaactttagtgttatttgttttttaccacaataaaaattcaaataaaaaagaaaagcattcactaaaaattgaaaacagatagagacaaacctagctgtacacgtgaggttggtgttaacctctcatacagagaagattattacttaagtggctttaaaagacaatcttttgactatacagttgtagtgggaaatatttatattgttacttgaaactgttatgggtatgttgtaggaaccacgatgtttagtatacaaaaagaggagagtacctaaagattctagattccggaatgatacaccaaccaagaaaactccacaaagtgtagtgggtcaccttcgcaaattgctaggatactacctcattactgtaaaaagtaaagtgaaagaattcagctttgatcatgcctttctagcacaaattgtatttgaagataatcaaatagttgatgagagaaagtcattaattatggagaaatcacaactaatacatgcaaaaggaatgaattagaaaatgagcgttataaaactcctgatgagacagcagagcaaaacagtcatcatcagtggtcgctaaatccatcaagtaacaggttgatggaaaactttctcatggacgaggctgacttgaatggaggaaatatggaaatgaatagagaaataaagcagtttgatacctttatcctattgagatgtgcctgagctggaaaatttgcaacaacaaaaaaaaaaaatagttcctacactctgttttccagcgcctgcccacagtgaacttggatgcatgcttgcaagagggtccctttcttcccatgtgacaaaggcctggagtccagtccagctaggtccttcccatagagccctccattcctttaccttttgggtcaatgtggctattttagtggtctgaagagaaataccgttcctttgaatatcaaaacttctatttatttcttgttaatttttcaaaagtgaaacaaatactagtgcttaatatatgagctggatagtaatcattatataatttctgtataaatatgcacatatactgaggatgtactcaggttcctgtgtgcttagattgtgttctactgatggaatgcacagtttggagactgcagaaatagagtgctatacttgaggaacaaagtcttcaggactagctgccttatagtaagatgtagcagtattgtggttcatgtgcagacagagagcgtggggaaggccagtccaaacgaacccagtgggaagataaagaaaaatacaccattgggatgcatcttgaggaacagtgaaatgaaatacgctggaccggaatgtgtttgcgttcttaaatattcatggtacacgtctcactttaaggctccttctgtttctcctctaactcgtttcctaagttggtggggtttctacaaattgaagaaccttgcatttctgtattattttgcccccagtctcagaggttcactggcaccatcgtcgtcaggtgttctctttgcagttaggcattttaggtggtgtccacataaactattcctgacaccttcctaagcagcttctggagggactggtggccagacaatactaaggccatttgattagatctattaagtgttgggttttccccaggaatctggtaagtctggttgttcctccttctaggcccccattcctgctcactccttctgtccgcatgctaaaatgacctctgaactaggcactaaggctttccaaccacaaaaaccagctcttgaaagctcagcttggatcaggctgtttctcctcagagactgcagtgccttccttttgtccatgggatcattttcaaactccacagcaaagtattcaagaccttaggctctctggcctcaactcccgaccatattcctccccaggtcctggccccggtctcaccaaacagcctgctggtccctgagaagcaaaatttaattttttctttaaaactctatgtaagtgacttcctccaattttccaatcaaatttataaagaaatgtaacccaattacaaaaacagggaaagacttcctcccactgaaaaaggctcccctaaccctggtgtaacttttatctttttcacaagtgtagttttacatacttgtcacatacgtactaaaattttgtgtttccttttttccacttaatatatcatctttttttttccttcaagactctactcagatttgaaaaccattgtgtccaagactcttctacacgcaagtggctagttcctaagtcatagttatttggggatgcttttgttatttcttgttgagacttaactgatgctttttttatggttgccaggtacctggcttggcttatatttacgtattatttaactgtgcatacggcttgttttaaatttctgaaggcaatcttttatttttgacagtctcaaacaaggtgcattatatctcagtaaataaatgcaagaaatctgcccgcacagaaaaataagagcgaaggcatttgcctttaccatttagaagagaaagctctaaaattgatgacttgcactgtaaattttccggtatttggatagctctaattatctgcaccacacccacatttacaacttcgtctggcttgtataaaaacattggcagtggtaaatcatctttatctaattgagttttttcctctctttccctagagttgatggctgaaagtagcaatagcaggcattacaagataccccatccctggtttcagatctcagaccttatttttatatcctacaaaaatttcaataacctttgaaatcagttctgcttaacagcctcacttttcatatcattaccatagagcatttactacattgcctgagcaaactatgtttgtatagttttatttattttattttattttatttatgcgtgtatgtgttaagtacctgcaacattttggctatcattcacaatgtgaagacacacaagaatttgccttctgggtgctcacattctgtatagtcaagactagagaatattcagcatttcttggtacttgtggaaatttggagcagaaaagacaggaagctataacaaagtggagagaagagcagatgggggattctggaggtgtttagaactttcccatttcaccttccacttctttgattttttttttctttttaccccctcctcctctttcccaaatccttgtaaggtgctccttagtaaaggctacagagctgactaagcctaagtattttcttgttccttatgagcgtcagtttaggagttagattggaatctttatttggttgtcgattttatccactgaacagtgtgtgtttcctgaccatctgtgggatgtctaagtctctgttctccagaagcttactttcggtggagtcaggaggtacgcaaaaataagactttctcatacttccactttaaaaattacagacccaggtgaatggagtagggaaaatttgaatgcagaggtggggaacatcctagttgtggcaactagaggcaagttttcccagggtcctcaaaaccctgtcgcttactacgcggctttttgctcatttctctctacttccttgctgtttcttgagtagaataggcacactccccctcaggacctttgcattggttgtcccatctcctggaacattcttcttttagacttccccatctcctccttcaggtttttaattcaaatatcatttcagtgagactgactgtgacctcctcttttaaaatgcaactccttccttccccaactttctcctccccttccctgctttattttcctccatgactttattgctacccagtatttatgtttcacttatttttattttctttttccttccctggaatctgagacatataatggcaggaattttagctgctttgtttattgctggaactctaacatcctgaagagtggctggcacatagtaggcattcagaaagtcttttattgatagaattaaactagaatgaacaatattgcctattatgtttttaatccatgcaacaatgtagggaaggagactgttgtacaaatttaagattgtagaaacttctttaggccagtggcctcatcttactttcttgtgtcttcccagggaacttactcacatttttgggctttcaagtggcattcagaccataatgattgtcagtatcattgatattccaaccctgaatttctcccaggatttggggctcacagccatttttatttgcatgatcaaattgaatgatggcttgcagatcaaaaattttgcctggcaaaacaggaattttagaaccaagtcaattcccattcatgcagataataagcctgttggctgtagcaaaggatcagttaacttccatgtacaattttatttttaggacatgataaccaaaggagttatttgtgattgaaacttccattttggcctttaacttgaatcaggagggctcttgcctttaagttctgtgcagaccactgaggattaggatcagcctcgtggttccttcagtctgagtctcagctttcaggagtgttactcttctaaggagtccattccctcttaaattgctttttgacacttgaaaattttaccctgaggtgccttttgtcaacaatttaggcgctcatcttctcagctcaacttatattacagtttccctagcctgcatcccagccttctctcttgaagaaactagtatcaccaccatttggaaaaaaaaaaaaatcagtttttgtaaaatttgaagcataacattactatgtatagttttttaatccagatttcttgtgtgacataactatttttcaatgaatttttttctaccgtcggttttatcaggatcagcaaaaacggcatgaatatgatgacaatcagtattcttcttcagtattttaaatgatgttttcagccatacaaaaaaatagaagaaatgttactagaaacccacaaatctagattctacaattaaccatttactgtatcaatctatatgccccagtcctctctctatccatcactccacctttttttttttttggatgcataaaagaactctctgatgcttcagcttcacatcattaactataattcaatattttgaggggaaaaatgatccacaagcttagaaaaaaagtccagtaatagtggttatttctaggtgatgaaaatgtaacttattttttctcatatctttattatctgaaaaaagttttaatctgaggatatatttctgttataatgaggaaaaccaataaatccatttgtatttaggaaaaggaaaagcgtgtttattgcagaagtcttagcaaaaagtgagaaggcctggactcacaaatacaaaaaggaaaggatgagttgatggatttttgagaaactaatatccctgggactacaccgactgtgagggctaaggaatgggcccaggctggcgctggggtttcttctcttggtgaccaggagatgtgaagatacattacattcttagagatgtttgggacttactggtagaaaaaacagacctcagagatttatgcagttgaaagaaaggtcaactcgacttagtatgcattttgaattatagtttaaaagatgatattatgactgcttggtagatatagtgtatgcttcatttattaagtagctggtaagctccttgagggcagaaactcatctttatattgtagtttgtcaatacttatcatataagctggtttgtagaaatgctccaaaacatttgtcattgagtgaattattcaagctaagctaatagtatttcttagaagtagttatcatcatactctgctcagggaccacatcaagctgatttgtaatcatttgtaaataggtgcttccaaagtgcttaaaatagtgtttctcttaataagagacattttgttctaaattgtcttaaaatcattgctaatgtttggcaaatctcctgcagttttttagcatgtgaaaaaatctgtgtggtcccacatacatatggcacaagatactcaagaaactgaggtgacattgcgtatgtattctagatcactcttgtgtattttgctctaccttagaacattattttcctctgaagcatggtttaccactgctgttcacagggtccagaaaattatttggactatgaggctgtgtattagagtgacttaaggagctgatgccctgaaagcagccaatctggctctgaatcccagtgttgccatttcctagcatgtagacttgggtagttaaaccaaaactctgttttcttatctgtacaaacatgttacacggttatgaggttaaaatggaagagtcactataatgcgcttagcacagaacttggcatgtagtcagaactcaaaataccagccatcctttttaaaaatcacatttgtttatcttctgggatggagggattactaaaagtacaggatttcctgcatcccgtttatgatgagatttgtttgatttaccttaaaatgtaaataccttctctttgaaaccctcccaacacaatgaaagtctctgttcccttcctaaggcagagcaaaaaagaaaggttggcctgaagtttgaactcaatgaaatgaacatttcagataacatcctcctggacttgtggcttttgatttattataagcaccattaagaacacttgtgataagaccagggcgctctcggcagatgttaccgggtgggctccagctggtgttcagatccttggaagcaagccacactgggccggtagttacttcagaatcacctgctggggcgagtcatggctgagcaaacccttatgtggtcaaggtttagtgtcctgtggcaagtttagagtcacctgggaggcgaaggcatgtagaggtcagaccagtgctcaggccttggctcattaaacgtggtgatactgtttgtaaatcttaagtctcacctgaggtccttgaaaccacacttgcaggttgttgatccctaagttaacatttcacaaggtgagacaggagttaaagtatttggatgaaaacgtagaagagagcttagatgtgaaattcatagtgtcagagttaattgagtaccaaattatagtcatagcagcaaaagcccaccattcctcacaagtttttctgatatttgcttctccctctcaccagtcaagctagaagctaggagaatctttcacacaaaaatatgttacatatatgtattttttcatttggggggctgaatcattttattttttactatatattagtatattataacatgaaataaaacccattgtttcacttgctggattattttttaagtgcctacctagggactaaataactacatttcagaagcaagtatttcaaagcatcgtgctttaatcaccatgtaaattttctgaaaataaaaaaaatttaaaaacacctgatcctgaagtatagtgtcaggtttgagttcaaaacttttagaattaacaaaaaattttagaaatattttaagctgcataataacactgagaatgcacacaggttttgttcctctccccgctaatccttgaaaattccctatgccctcagcttctcaaaaggggggagaaaagcaactatcgcctcttgttggcaggagaatttattcagtaatttactttccagccaactgcagccattgccattgcctctgggcactggttcaaaaacgcagaaatgaaataacagattggccagactgaacacaactccccagccacaaccctgttatctcctcattctgtcacccccatcaggcaaaagcctgggaaacggagggtgacaacacagtttttacatggctcgtgcatttccacagctcagggcttcctgccactgtcccttcttcattgtgttcccctgcgtgcatggcgggcgacattggaggctgggcatcggagtcctaggcctgtgctgcaggctggcctttgcccatctgtctgtctgaaaggatttctacgctgctacaagcatgggaaatggctcctcagtcctagcacaaccagaacaagatgaagggaccagcttcctctgtttgttgaccacctatctgtgaatggatgtggtggacttttcagaatcttgtgtatatctcaatcaccaggaggaatttggtttcatgttatttatagctgttctattcaggtcagagccaagcagagcagttgcttcatttaatatcagccacacatgggctctgcaggctcatctcctgaaaaacggagatttctcttgacagaatgaaggtagaggagaggagcatctctgtttaatctagagagaattattttctgattgtcacttgctggtgaaatgccttttaaaattataggcacaagatgcggatgtttggagagggtgtggggttgctgtcccccttggtcaagcgttagagaagttacagaacccaaatgagagaaatccaaaattttctcttccagaatagcctactctgtagacagtattcctttgcagtggttggatttttttgagtggtttgtgccccagcaggctttaccttttattctgtcttcattccatgcacctgttcaatatagacccataattacatcttttatgagtgagtaattcttagaggagatgaaaggttctgaggattattcatcactttgtccctcaacctcctgttatgtagctgggtgaaaaacacagctggagtcagattcagttatgtggggactctgcgcctattcagaactcccagtcagccctgccccctacagatttctggccagtaggtggtgaaacctgggtgaaagcatttctgctgggaaatggacagtagccttattctgaggcaacaaggaagagagtacacagcttaatgattttcagacagatgtattttcccctaaaaagcaggttttggttcaggttaatccatcctagagagaagtattcttcatgacggttttactgggaatgtgtgggagagatgacaatccctcacctccctcaggtaagaaagaacagggtaagatgaaaacaaacattttgttatgggtaagatggcctgtgttaaatatgtgattgttatttcttcttgctgattggacactaactgtcctctccatttctttgcacaccagctcataccccagacaacagctttctggggtttgtggttgagcagcacctgaactccagtgatatccaccacattaatgaaatcaaaaggcagaaccagtcccttgtgtatggcaaagtggatagcttctggaaggtgagtcagtctgtgcgtgtctctctctctgaaaagaagcttgttgggtaatttaatttaactttgatccagggaataatcaagccaagtgcccagggcttaatgggatctacttagacataaacaagaatgtgcaaagattcagttgctcagcatttgggtttctaaccaaggctgtatgtacctgctcttctgatagtggctgtacaacagccaccttcactctctgcatgtcagaagggacacattctagctgctttttcacaccttgtacttgcttctgagagccagggccctccaggggttgaatatctttctggagcaagatactgcacagggagaaactttaccaagggagtctttccctctgcttctgggaggtagtctgtggaggtaggcagttccctttcctgggaaatgcagtgggcttcacatcctcttggctatagtcactactcacctgacgtagaaagtaaattcttgctggggctgactgtaggcactttgttcagggaggtcttggctgaaacagcactcttggccacagaccaaaccaagtcctccaaaagcattgggccccttggccctcctgagttgatttcctgagtacatttggggaaagtataacaggagaggaaccagattggatgtgacctgttgacaggtaatgcagatctttttatgtgggaagtctgcctcattggccaaatgtcataatttttttttgaggaaatgtttttagaagatagaagtcttcaggatctcacaacatgcctcttcctaaatgtaagaattcattgctttcttgaatgatcacagactgtggtctcatgtttcttgctagccaaggaagttaggaatcctacagctgagggagtacaggtgatgtacaggataaagaattccttggtactgcttttctgaccctgtgttcagaaaaggaaaagcagtgccctacccctcagctctaaggtactaactacaccaaagggatgatgagatcagcccatctccagggaggcagatttaattccagacaactctttgtcttaaacagctagacctttgtctttgtttagtacagtagttctcaactgcagacgattttatttaccgattcccctctgcccagggaacatctgacagtgtctggagacaattttggttgtgatgtctggtcagtggtgctacaagcatgtagtgggtagaggccagggatgctgtacatgtcctacaatgaatgggatggcccctggcacaaaataccagtaattccaaaggtggaaaaccctcggctggtaagaatgtttcctatgtatgttataccatactttgttgcctcaagtaaaatgaaagtcagtctagattgtaaatggctatcgaagatggtcccataaatttgtgttgctttccttgtataaaaatgtgtcctgtgttgatagtgcattttccagctgactttcagccaaagttgggttaaaacaggcatattgggtgttctcatgctcagcttgtttgtgaaattaatggtttacggcattggttttaggaggactgtggcttttaaagaaaagcctctgtatctgcttgaagaagatagcttgcatgtccgtgtgggcttaatattgaaattatatcactttgttttggggccaagtgcaaccacctcctagcactctctggcaactttttccctttccctagaaaaacaaaacaataaattggttctgaaagattttggtcacctgttttagataaattaatattgccactaaaagggtgacttttccatgccagtaggaattccgaggccaggtgcagtggtgcatgcctgtaatcccagccctttgggaggctgaggcgggtggatcacctgaggtcaggagtttgcaaccagcctgactaacatggtgaaaccctgtctgtactaaatacaaaacaattagctaggcgtggtggcaggtgactgtaatccaagctacttgggaggctgagacaggagaaccacttgtacctgggaggcggatgttgcagtgagctgagaccatgccattgcactccagcctgggcaacaagagtgaaactctgtctcaaaaaaaaaaggaatcccaaaaccattaaccatgttgctcaagtgatctggagtgagatttagaaatccttccagattttgaggtgtgaaaactccatgggtgcccaagcttctgtgtacctgtgctgtgcagcacctaaagattataaaaggttgggttgcagtgtgtccacattcatctttgcctgagtaataacacccaaaaatcctgggtgttatttcaattttattacatccagcattctgtgctggaaaaagcccaaaagatgaaaaatcctataaagttttcacatgaattcaggacatcttctccaactctagaacacggcacagtatgtgagaatttagtttctttttccaaagcttgtgcgtcctggagtatttagtgaatgcacacagaaaaccaatgtgccttttaagtgagatgttactccaaccgcatttctaaagttacgttcaacataggctttagctagcaggatgttttatcagtcgtcttccctatcttgttcttgtgtcccattcccctctcccctacccaatcccgattcacctcagagagcttcaggaagggaagtggcacctttgtgtcctgggaggtttaggattgcaactggaggatgtgggagggcacaatttggaccagatgactttggaaggtcttccttcacctcagattgtaggactttaaattctgaagattcctgctgtgccataaatcctgcttcactcttcccaccaccctccttcttgagggaatctccctactcacctcggcacttaagtgggaaatgcaaccatgtaactccctccaatgttggctgattggaccctggagttgtcctctgacccagtgcagtccagctttttggtggctggaactgtaattctggctcagaaaactgagctgcatcaatgagattcttcagttcatgttggaaaacagagtcactgagagtgagccatgttaacagaaatcaaaaaaatgcgtctgtggcaggagggcgaggcggaagccttccaggagtccacatgatgaagcaggaccaatgttgacagggagagggtgctgttgagaggataatgcattcctccacaaggagaggcaccaccctgacagaattagggtgcagtggagggcctgatagagtggaagacacagatagaactcctgcagcctggagagaaagagaaagtagctgctggagtttctggcagctttcttttcccagattatatatcctttctcacactctggtcttgcagtatctaagtactctgttcctatagtcatatcaacatacttactaaaatactagatactaaatgcctatcaagaaaaacaagtgtattaaatatacaagctaaggaggagcgggcttgtcctttaatatcctgtccccagattcatgaccaaggtactcaatggtcttgtcgtgatgttatagtacatggtggggaggttgaggtggggaggggaatcttgccgtcagactccagaatcccaggggcatcaacttaggaaccacctctgcccaagccccttaatatcaaatgagactactaacagcctaatcccaaatagaagtctctcttcttaactcaggaagctgcagttctgggtccctgatctctacctctgaggccatctaatcattcgctcctgctaacactagagatgtacccagaagaacagcaatctgtccagtatggtcaatttcaaaatccttctacattcttttaaataaagtcatcagagaatggaaaattggtcaactttgtaaaaagagatttttgaaatatgggaattgaagtgttaactatattactttaatttctgtgtttctttaaaaatagtatactgagcataactgaatcttcaagtgatggtgcagggttagtatcttatgtattcatgatcctactatgatcttaatacaagataatacatgatcgccgctaaggtaaatgtcctggaggcctttctttgaccacgtcaggagaacaagagttgcctctgaatcacacattggggttcagacttgcaacttaaccacatgtaaggtggttgactgtcctgagcctcaggttcctagcctgtaaagttgcggcagtaatagctgatggcttctcagccttactaatgcacacatcacctgaggatcttgttaaaatgcagactctggttcatacctgggatgagacggagactctttctcacaagcatccaggtgataccggtgggctgttggaagagcatgctttgagcagcaaggtcttaggataggtgggatttgtacaatgtgtggtacaaagtagctgaccaattcgcaaataaataactcctcttttctatttatctttgtcttcctgctgcttttatcagactgctgcctgtcactttttgctactgtaggtgcctagttcagtcaccctcattcctactttgatatttgcagaccttgctacttctaatctctgccacttagccccaagagccaggtaaagctgtggtgagcagtgggctctgagaggaggtgagaggcacagtgtcttcctcgtgtcctgctgtcctggtttatacattcaggtgcccctgggcagtgtgatcaggagcatagacttggagatagatggctgggttcaaatcctgactgggccaccagctgcctaaggttgggtacattacttagctggtgcacagtaagtctaaatacatgtttgctgctcttactaatatcattattggggccagataggaaatgctgcagtgggaattggtggggatgtgagccagggagttctatcctatgaggaaatggaaaatataagcctgtccaaagatactcaaattctaattcttagtctatgtaagtggttggcgaactctagactgtggaccaaatctagcccaacatctgtttttgtcaattacattttactggaacatggccatggccattccttgtccatggctgcttttgcactaaaattatagagttagataattgtggcagactgtgtgacccacaaagccttaaaatacttactctctggccttttctgggaaaagttttctgacccctgaattatgccacgtcccaagtaaaccagctctctctcagaacacattggccaacagtccctggcattgatctcatcagaggtctttcagggttcttgattgtattcttctgtatgattgaggctggtggatggccaatatgtggaaaagtgaagtgtaacttaactgaaatcctgatcactctagagatggagctccaggcattgagcctggtacctctttgtaggcattcagcaaaagctagtgcttatttagtaactaatgcattgataataaaggagtcgtgaatctgcacagtgtttctgcttcttggagcccttcacagccatcatttaaggtggtacaggctgatgccttttaaggaagcaagggcagctattatcttccttaaccatcctggtgtgtagatgaggagctggctcaaggagggggagtgacatggccaagtcctacagcacatgactggcaaagccagaaccagggtcaggctctgacctctcctcttggagacttgccttcctgctgccagttgttccatggagctgctccactgccactaccctggagggagtgagtctgtggttacagcaggattctaaagctaggaaggaaggtctctctgggtgagctaagtgtacagcagaagccctgagcaaatactggcatcacaggtaaaatgttgctcctggctgcccaccgcaggatcgccaagtcagcgacagccttgcagccagttctgtagagtgagtaaataagcctgatatgagcatttcaaatagtttccagctccagaccctagggcctgatgtggtccagccctcgcctgccttggcaacaaccaaagtcaaccagtcttaactgaatttgaaaagttcctttttatctagacttcaaagactttgtggttttaaagcatcccctgaaatgacacatgatccctttcctatatgcctgagaaatcaggcagcagaactttcagaaatgtgatcccacttcccctgctcctgcccttttctacttcattctccatacagcagcagccagagtgatcttttctaaaatgcaaactgaatcgtgctactcctttgctcagactctccaatgacttcatttcacacttagaacaccttacatttacagtgaaatccagtctgggtagtgtgttttagcgaggctctctgcaagccagccactcctgctctgtacctactcctctctggctcctgggctgtagccacaagggtcctgtgtgtcacccattccaccaggggccaccaccctccttaatggctgctgcctgtcctgctcaccccaactggagccgccaagaccaccctgttccacacttgtgccctcagccagatgtcacccctccccctccctagcacagcaccctgtttattccctttatatcatttgattcatcttgtaatcatataattatctttttttgtcaatctctcttccttactagactatatgctctgtgagagtaggaattgcacctgctttgcttacccagctgcctggcacgtggtaggcactcggaaactacttgatgactgaatgaatctcccctaagtttagcttaaattactgatttatctgtggaacttgggatacaacttggaatgccttctgcctagaacatttccctgtgttctttgctgaccccagggagaccaggaagagggagtctggtagaaaaggaacagagctacacatgcaaattctacagaccacatagaggcttcaaaagtttttctaaacctcttgtgagattagcagggagatggatgggaacaagatactgcacagggaaatgggaacctggctctgggccagctctgctgtcatatgattgggacaggccactccagcctcagtttcctcacttgcataaatgaaggtattggtttaaaaaaagaatgaattattatacacaacaacatagatgacttcaaaataagaggagcatttattctgtttgattctgtatatattatacatataaaactctagaaaatgcaaaccaatccatagtgaccaaaaagaggtcattggttacttagggaggggagaggaggagagatggatatgtttgctgtcttgggtgtggtgatagctttatggtttttacattgtgtgtgtgtgtgtgtgtgtgtgtgtgtgaatgacagacttttatgtgttcccataaagtctagaaatttgctatcttatcctttacggaaaaaatttgatgacaactggataagatcaatcattattcacctgtgtgttttcagagccctagggtctgctattataggaggtcaaggagcagccacacaggatgggccctgtctcaacagagcagttctaatatatctgtggcatagatttggcttttggctttccagtaagatttaactggggaaaagggtggttaaagtctcagactaggtgactgctgcatctgagatagaatcccattctgaaaactatgtaattatctagcttgctaatttggttgacttgggcttagtttaaattaatgcaaaattgggaatgggagtcatttggagaaatgccattttatttcatagtaggaattaactgctcttagctcattgttttaatgaaccacccaagacctttgtaattaaagaatgtactgaaacccttgaaaagaacacatttttgtaagtagattaaaccttgtcattctgttttgttcttcaggctacttagccaagcttctctgcccagatgatgtagagataaataaaccagataaatttaaacccaccctaactcaaattggcatatattttgaaataacaaagttagaatcagttttgttggatttactggaaagtctgatgtgatcatagccatttgttctggttccaaccagaagaacattaaaaattagaaaataatgtgtctcctgcttatttcccctggggtaaaagtcagaaaagatcttttcatgatcccttggagatggcgcttgccagaggcagggaggagtgtaggcatcagtggagatggtgagcccccaggggcagccactcaccaagccatggttacctgtgcctgttttgtgcctagcacatgataaagggcactcacatcacagagcctgttctctaaattcaaggataagattggaataggcaagggaggaacagaggagaaataaaatgcaaagggaaacatcagaaatgaatcattagcttttaagattccaagagccatgatccaggaaccttaaggatttattttaatgggtgttggctgcatgctgactataacataaccccatgtggcatcccctgtgtaagcgtgtcagtgtttgctaagtgtatgtgagtaggaataagtgtggaactaggagcccatgggacccgggggtagccttacccgatgtcatcaccctactggtccattccctgtttcagcaagctttatgcaatcgtcttagatccatgaggtttccttgtcacacattcttcttgtacccatttcaacccagagacactgattggacatggtgtagaggagttggaggcggcttgggtggcaaaggagatgcccggattctcatttccgttgagccatttattgggtacgtgtcctctgaagtcatttgccctctgggtctcactttccttatctggcagccctcccagcagctttctgaaatctgtgaggtttcagaagaagcttttgagttgaataacgagttccacgttccaggccaagtcatgctttcagtctcctgtttaaaagtctatcaagttttggggcataagggtgggaggaaaataaaaccaaggcccctttgtcagcatacagcttcagtagataccccaaattcttgaaatctgtatagcagactgctggttttttctccttgtcagagcccagcccactgacactttacagttgacagcccagcccagatatgggccgctgtggcttctatcgaatcatgcttgggattgccacagttttcttctttggattggggcttgaggtggttgggaagaatgcatgccaaccagccctgcatctgggacttggagcctgtcagctccctgctctttgatgatggaatagtctgtggacttcttcccatttgtgagagaaaactcccccttagaactcaactggtagagcttctcatagcttacagttccaagcaatagcttggttgtaggtccaggcaggactctgacatggccctctggaatagcattgatgtgttgggttctttgctaagatgatttccagtctgtgttccagggagattcaggaaagctgaagttcattcttagaacctaggtctgtgtttgttgttttgttttgtttaaaaaaaaaaaaaaaaaccttgcctgatcttaagtgccagctgggaacttgttcagcatccacatgccagggcctcttgtcaccctcatttagttagaatttccaggggagggaccaggaaatctgtatgctccaacaggtgctccaaacaggcaggcttgggaaatgctacactaggtagccacccattttccttgttcagaaaaaccttaatctcttcctgtccatgtgtggtatatggctgccatgtagccagcaaccacatcaggctgtagaagacacttgctattcctttgttttacctcggttgcatccagtgctccgggcctttgcttcccagtacagctgatcaaccacacggcttccaaggacttgcccccttgtttccatgataacagccaatcgcataaatccatgtggggtgcaaaacatggttatgggtttcagtgatatatctctcaagaatgcttatcttttaacccaggaatgcaaataaaaatttgtatgaattttagatctcttaaagcactgtctcgtagcctcttgaagcatgtgtctattttacaggtgataaagcctcagagacatttagaagaaacagtccacctttaggataagtcatactcttctcagtgtccctcctttcctgtgacctttacactgtagagctagagcaggccactcatggtacaaatgtttgaatgatggatgatagaatcttaggcctttgtcgaaggtggttagggaggtgttccagaagcctgggaatggagagtagttttcttggtgcccccgcatgaaaaccactagccagttgcttattgcgtgggtggctggcagccctcccagcagcataaacagctaagtgcaaatcactgcagctgtgagaagaaaacatacaagactgctgtccatgaaaagaggcccttggtgctcagcagagggtctcctgcgaacgccagggctggcttgggaagctggaggctcaggcagccagtgaacatcctgagggtggggcacttctggaaggttccaaatcactgccttcctgctccaatagtgctgggatgagttcatttgtagctcttagtaaacacagctgttgtggttgtaatttgcctggaggctttttactattactccaaccctaacagtttggcagccgatatgggagctgcggtgttgagggatgggaaaagaagttgctatctgagagcaaagagagatgggtggcagctgcccatggacagaagccaccaagcaagtgcaagtgtgtggaagctgttctccatggacaaggaggaggcagcgtctcacatagtgacccaggggcctttggtgcccagaagatgagcagtacagggagagaagtcagaggacctgtgtggaaggctgttagaaaagcattgcaagattgtttccctcaagtgaggaaagggttgacagcgcgttcttgaagggagacagaactgtaatgcctctgaatttgaaacagtctgaaaggcatggtcttctgaatgttattgggcacagatttataagaatgaggtaattgtgttgattatgcgattttccacctaaatagaaccttattaaaatacagcttgtaggaaaacagagtttggattagatttctaggcatagtccatattctaagagcatggtgacaaattgaggagatagacctatactggtccatcccagacagcaggttgctgggctggcaggagatcgcctcactgttcaatactgagataccggggtgctccttccagtgttcccacagagctcctcgtggcatctcagccctcctgaggcagtgcagtccaggcatggagagacagtcaagggcactgccaccctcccaactcgatgaagccttctcagctggggaaggagaactgggggcttcatttggttcaagggtgaaaatccctgaggttgctccagcttcatcttgggagaataatgttcattcctcgtcaacactgctagaggttcagacacaccaaaaataggatgccttggaatgagttctctatggtccttatcaaccattgtttaaaacatcagccaatggagcaaaatcacagcagtagaaggaaacagaagtgtgtgtagatttctgccttttacttggagagaaaagcaaagttagttgtatgattttaaaatggaggtggagaagcaaatcttaaatctgggaagggtgggggattcatataagccagtggaatgcattgggccagttgaaggaagtctgacctctttccggtggctgtttacacatacacaagtatatgaagtgttagtatggatttgcacctgggggcttaccatgccagttggaatacttaaatttttgatagacgtgaaaatcatgagatttaccctgtggaaccttctacatcagtgcagatccatgtcataaacaccttgaaacataggccctgcaagaacagagcttgttgatggagttttatataaaaaacacagattgggagcagactttacaatgtggaatatttgttggaagcagatttcaaccttcaattgcaagaaagggtattatggcattgagaatcggtgataaaccaacttagaaattatttttaatatatttgcttctaaagtcatgtttagcatcgatacacaattctttacttaaataaaaatcatatatgcagcatatgctcaaaatccagcggtggctgtgcagccctcagtactgaacgagtccatctgcagtcaacataatcaggactagcccgggcacagtggctcatgcctgtaatcccagtactttggaaggccgaggtgggcagatcacttgagcctaggagtctgagaccagcctgggcaacctggcgaaaccctatctcttctaaaaatacataaattaactgggtgtggtgatatgctcctgtggtcccagctactcgggaagctgaggtgggaggatcgcttcagtctgggaggtcaaggctgcagtgagctgagatagtgccactgcactggataaatcgagactcttgctctagtctcgagggacagcagagctccagggaacgctggagttatccctgctcagttgtaatttgtactgctggccagcctttgattctctccctcttgattctgtttttgatagattgagctccttgaggagatgataatggctgacattttagtgcttcctgtgttccaggcatggccttcacaatgactatgaagtaaatactattattaaccccacttttgagtgaaagaactgaagcagatagaggtaaaggttcctcaggtggtcaggatttgaattacatcatgtattgtagccaacacactggactacaaggaatggattctctcttggtaatttcctcctctgtctccaacccatcctctcaaatcccaaaagcctaaataaatacatttatgttggtgtggtactgatttcaaggaaaggttctgtacggttctgtgtggaaacctgaaatccactatgcagagtagtgaaaccgaaatgggctacaactgtttgcctttgttccaaaacaagtgaaacaaagctttattctaaagatgaaatgtgttggttttcagttttcactgcatgtgattcttgtcatccagaaccaattattaggaacttacttgcgtatcaggacttcaaaagatatgtctgcctttagagagcttggagagcagaaataccgacttggtcaagggaaaaatgagggaaatttttaaatgaagttaaaaattgggtggtagagcatatctcttgagcccaaatgggctttaagggaaaaggcaggagtgattgtccacatgtgggttggggggatttcatctcacttccctaattatgtcagagcacatctcgtcaactggagagggcccagaaagtcagtagtgctggctttcaccaagtattttcatcttcttccaggctgctgggggtgtttcatgaccacagaggtgagagtcagtacagggctgccccagagggtcctgcaggttgtccccaggcactccagagagtaacattgccaccataaggaattagtagagcaatgtacagccctgttgatccagaccagttagtgatcttccaggttctcaaggcgtgctaaggtttggccaggcctccagatggtgccagcacaccgacaatgaataatgaggagcttcccaacaaccctataaggcagcagcactgtctgtgtttttccaggaggaaaccaggctctgggagatgtggaattttaacctattgcctaagagagtcttcactgaaatactcaattcaaacgctcccttttcattctttctctttctttccctttctccttttctccttcttccccttccctcacttctcctccttcctcttccctccttttctttaccgtttttaaaatggatatcatttactggagatacacacaatttgtcctaaattgtcctaaagacagtgtctttttattttcttattcttaatgataacgtttacttcgaaggagttggcaaatgaatcatttaaaccagtgacaatgtaagtaacaacttgaaggagaagcagaagtttaaccactttcatggaccgatccctcactatttggaccagatactcattcctcctctgtgacctctaaccccagcatgcctcctgtctggaagagccttccttgctgttggacctaggggaggaaagaaattatccctcatcctcatgcagtggctcagtggaagcagctgaaactagcaggccaatctttatttctcagctgaggccagagaccaaaatattgaattagccttgtttatattttgtgacagtgtgctggcttctgtaggaccgtgatccaaggataggccccctgaaaacggtactcatttagcagccagggtaggtcttcctaccagcaccatccaagatggtaactcagtaggcccagacaaatcctactctgccactaaccatctccatgctctgcccagatcctttcacctacctaaaccatgtttttatccttaaaacggtctcacagcacttgttcttcctagctcacattgttgacacagggatcagacaagagacaggtttgaaaattctttgcaaactgtcacaagctagtcagctatgtctgggaacctgtttggataaattaaaagtgtgcccagctataattagcaaaatacctcacaaccatgaagcaagagttaacttttctcatgtaacacagtgtggggtatggggctggtttcttcactggatgtctgcaaagacccaggccactttggtctctcctttggcatccctcatgcattggcttgccaccatagcgtcacaaggcctgcaggcctcatagctgtggtctaagcagaaagaaaggtgaaggggctggagccttttctcaagaaatagaagcttctcctaaagcttcccttcctctgattctttccccccattatttgacctaggtcacatgaccattcttggctgcagaggaggccaggaaagttgggttgggccaattgagattggcttatcaatcaggattcaatagctgtgtcctcaagagtacatgattctagtaacaaggtagaaaggaagaaaaataagttttatgaccacggctcctttaccttccggtttctttctgtcaaagtcacacaacacttacatggacaaaggcaatgtaggcagtggtcatagagatacaggagatagtttatgtcttcccagggccctgctttccccagatgatgtgacttggtctttcaaaggactcccaccatcaaaactattaactcttttcatgttgagtactttttcctcacctgtttttccattcctgttagccggagcaaaagggcctccaactcctcttttagagagaaatgactaatgctcatactagcagataccagacgtgtccaaggaggtaccttgggcttaattccagcagttctcaacagagtccacgtggcatatgctatacccagcatacctagcctcttctgccagccctgcttagaaggccttcaaacacgttgtttcctggccttggcgtggagggtcagccagtgtaccagttttcagtggattgatattcagctccaaattcatcgtttctaattgctcagtgaaaacggatctggcccctggaagtatgttttctttggagctggcactaaagtgttgtcagtagaaggtgtggaaagatgctacaggaggaagtgttttatatctggttcccgggaaacttcttctacagcatcaggatcctgccgccccagcactagaagtggggaggtggagaccgtattggggagcagaatgtgtgagctcaggactttgtgactgggaggcagagcccatagcagggttctcatcttttataattcttctctgtctgtgctttaccttccccagggtcagatctacttgacaaggcactcaggggtagaagtgtctatcaaacccgagaggcagaatacagttaagagcatgggctttagagacagaccggaatttgtttccaagctgtgccatttactctctctgtgctcttttactggacatttaactaatctaagtctcagtgttctcgatcgttaaatcagaacactaatcatatacaactcacagggttatctggattacttttttttttttttttgagacagaatctcactctgtcgcccaggcttgtgtacagtggcatgatctcggctcactgccacctgtgactcccgggttcaagtgattctcctgcctcagcctccctagtagctgggataacaggcgtgcaccaccatacccagctaatttttgtatttttaatagagatggggttttgccatgttggccaggctggtctcaaactcctgacctcaggtgatgcacctgcctcagtttcccaaagtgctgggatcataggcatgagccatcgcgcctggcctggattacctgaagtgatgatatgtgagagcattcagtgcagttcctggcacatagtaatgattatgttgtggctgtggttgaggcccccggctttcagtgggtgatgggactggataatttgagtcctttctactctaaatcctcatgataacatggatgtctcaggccttctggctttttctcccactttgtcttctcccctgttcttccccaccttttgcttgtatcagttctttctccctatgtctacacttttgctgtaatgaattaacagttgtctgatgaaacagtttctaaatattttcttagtcccttgcagaaacgtgtgtacttttgttctgcatattttatcatcttgtgatgacttgctagtattcccgtctccaagatcaaatattcctttccagctttgttcttttaggaataaaataaagaagtgttattgtggccagtacccaaaagataggtgagtcagagctcaggaatagacacagaggtcttagtgtaagcgatttcttgtccttgctaggaaacatctgtaacttccaatggcttccctttgccagctggataaggagttcaaagaattaagttttaggcaggcacaccagcagatggaggcagcccgccagcacctgcaagcccagagaaagtggttctgtgggtgagtgctgcctctgatgggacagaggtttttaccagcgagcgatcatggctggactgcaggcgttatgagggcaggcacccagtggtcttacatttgtatccctggtgactagctaggcctagcctcaggaggtacaaaatacatatttcaagagaataaaatgtgaacgtttggatggaagtcagccagtcctaggagcatgaagtctgtttcatcccctcttgataagaactctggcatttctcatggacagggacaaatcaagtggtttgcatctgagagctgtgttcttgtggcgaaaggattaggccatggctctgcacttgttctgattctgtcacttggcctgtggccttgggcatattttaacttgtgtcaacccagttttctcacctgtaaaacaagaatgacatgaacagtgcttgggtcatagggctgtagaggtgagatgacgcatgtcaaaaagtgcatagtatagtgtctggcatgtagtaagttcccaagaaaggtttgcttggagattcctttccctaagacaaggagcgtgttgttcagacttagagatttttagcactaagggtttaagaggtcattttctggtccagactctccccatcctgaatttcatatgttaaacaggcataatacttacctcatgggattgtggaaagaaataagctagaaatacgcacgtggcatagtttcttctggagcatagtaaatattcaaatggtagttactatcttttatttgcaccacatacttattgcactgaagttagccttttaacggaaaacagtggtgtcagtctggcccagctttatgctgttgttagaatgcaagtgcaccctttctggcctgttgtgatgcaagtggagtggttaagaaaaagggacatggattataggcagaccctctccctctccccttgccacccagccttgcagtcttgggcaagccacttgtctctgtgagcttccgtttcttcatctgttacccggcaggttcactgtgaagctctcatgagagaagagtataaatactgataccatgttggaatggtagccctcatttttctgattatatcttaatttagtattactttcactgtcctgcttatggtcagatattgtcctgtttagctctcttatttctgcccacccaagccaagttggttatattcaatttgtaacttaacagagcgcaagaacctggtttcattcattgacagtacatacaactgtagagcagacactgttgtaaggtttggtaatgaaagagtaaacacgttgtatgcttgcctttatggatctgatactctaaagaggaaaaagaaggtaatacaccattaaattcatacatagtgcagtgatatgttctatgaaaaataaacgtagagaaacagaatgacagaagttgcccccctttcttgctctttttaaaatccacctacctccccccatcccaaattccgatgaagtccttgcatatagaagagcccatgcaatcatttgtggaaatgaattctgaactctttgaatcatgggaagattgaattttgcctgattataatgactattatagctgggtatggtggtgtgttccttcagtcacagctacttgagaagatgaggtaagaggattgcttgaagccaggacgattgcttgtattgtagttagccatcatcatgtttgtgaatgcactccactgcactccagcctgggcagcatagcaagacctgtctcatagatagatagatagatagatagatagatagatagataagataagatagattagatagatagatagatagatagatagatagatagatagatagatagatagcctgggcaacatagcaagacctgtctggtaggtaggtaggtaggtagagaaatagacagaccagacagacagacagaccagacagacagacagacagacagacagatagatagatagatagatagcactacagcctgggcaacatagcaagacctgtctctaaaatagatagacagacagacagacaaacaggagagattagccagagagagattagatagaatcattatagttccaggaaagggtggttggcttcctactttccatggaaatgcaaacagttttccaaaatcctgcccaggctcttaaatgcaagtcttagtcttagcttcttcaaattttgtaattggcttttgtggacttggtctttaggtttgttctctaaatcatttcaatttgtaattctttagaagttgatttttagctgcttcctggaccctgcttaagcatgaacataggttttttatggtaaaaatacatttgaaatgtatattcttaataaaaacaaaaattatttttctaatagagcctggttatatgaaacaagtttgggttttcaggaattgagaagtgtctgaccccattcttaatgctacccctggagctttgctatggttctcagccaagctgttgctctttggaatcacccggagagccattaaaaccccagtgatggccaggtacagtggctcacatctgtaatcccagcacgttgggaggccaaagcaggagggtcacttgaagccaggagtttgaggctgtagtgagctatgatcatgccgctatactccagcctgggcaacagcaataccctgtctaaaaaaaaaaaataaagtcctagtgcccaggcccagctccagatcagtagatcagatctctgacattgtgatagaagctccccaggtgattataatatgcaacaaaggttgaaaactgctgttctggagacttttctattgtgtcgaaataggaagactgaggttgcccagaatgcttctttaaagagtgtttttcaaatatcgtgtgcctgaaaatcatgggtggaactcgtcaaaagcagtaccacccttagggatttggctacagtaaagctaaatatagggccttaggaacacgagtattctaggtgatttgatacaggtagtggaggaaccaaacttaggtagagcttttaagcctgtacctccccagctaattcttgggcgttccaggattgaacactactgtgaaggtttgggagtagaccagaagatctcttggtggacttctacttctcaaagtcctggttgcctacttctaccatttcctttgtcagacctgctgaggccaacagcccactgaacattggggcggccagactgctcccaacagataccatgaatttctgcacccacagcttgagctgtgtgcacatcaaatgttgagagagtttactaccaaacctgtttatgccacatatttgtgttgtaattatgtagtatcattaacacataaactgatgaaatataaatgtgaaaagtaagagcacgcacttctatataaacttagttggtagctttggaaagatttgatagaggtgagtccttttaaaatattgctgttaaatttggggtagtcaaggtaccagtaaaataatggggaagttcacaaaaatgtggagcctgcatttaacttgctctgcaagtatttttacacttacctgacattttaaagagatttcagagacagcgttatagttttatggtaaaatgttcgtgatacatgggtatcactttttactttgcctgcatcagaggattttttctattagttcatcacctatttctccctcttctgaataaaaaacaatgagcaatgatatctgctgtggttaggtcagactgctgtgattagccattaacatactcacctgagcatttaattttctgcttattatttaaacaatacacaatttaatgaactttgtatttttcttataaaacgccaaatgcctccaatttaaatcaagcactgaaaggagagtattagtcaagtactttattactaatctagctattgaactgtacttcattgaaagatttgcttttgaaattgttttgttcctgctggctgccccaggctgttttaaatactgctgttgtccacttctgcagctggtatccacttgtttttatattaataatacagggattaatctcaaagctctaaatcagtagttcacaaactgcagcccacatacctgtcacctgtttttgtatagccaatgagctaagcatttttttttttttttgagacagtctcactgtgtcgcccaggctggagtgcagtggcacgatcttggctcactgcaagctccgcctcctgggttcacaccattctcctgcctcaggcgcccaccaccatgcccggctaattttttgtattttttagtagagacggggttttaccgtgttagccaggatggtctttatatcctgacctcgtcaccgcctgcctcggcctcccaaagtgctgggattacaggtgtcagccaccgcgcctggccgcttaagcatggtttttatgtttttaaactattgagaaagaatcaaaagaagggtatattggacataaaaattttatgtaattcacatttcaatgtcccataaagtttcagtgggacacatctaaggtcatttgtttactactgtctgtggctgcttttgagcatcagtggtagagttgagtaccatagggacctcatggtacacaaagactaaaatatttattatccggcccttgaaaaaaaaaaaaaaagtcatcatcctctcatccagatgtacgctgtgcccaagtcctaggctttttctctctctctctccgggcatacaatgctcttgcccctacaagttccttcctgtccactatcctttttgattgagggtttgtttggaaactgcctttgaaagtaaatgtgttgaatgtaactggttcagtttttcagggttctttcttcaccggcttcattggagccaatcccctttgtacataagaaccaaactcctagttcttactagaactgtgaaccacaaaatattagtaaaacaaagtctcagttaaaaaaaatatggattctttataactatttgatttttacaattacacatttaacttaaatttctcaagttcacatttgatggcaccagaagtacacttacctttcggaagtttggtgtacaagcatttatgctatatcatgatatctgcatttctgaaaaatcttgaaaactacagattcaaagtgatagaatttatgataaaagtaagggccaaaccactgcaaatcaaatctacacatttttgaacaacagcagttataaaaataacaatccaaataaaaatggtagagtgaaaacatttaaaagctaaaaagcaaatactatagtaaatatacaactttacctttaaaaaggtcaaattagcatgctgggggtgggaatggtttgaggctacttttagtttagagaaagaagggtaagatgcacctgacctttcctgatggaagagaactccacagaagcatgtccatggaagagccatggctacacatactgggctggaaactagtcatggtatacagtactataccctctgcagattactacctgtagctgagtaaatgtatcttatattaagctgctgttattgattctacaaaataataatgtgctggagaaaaatggttatgaaccaaagtgacttacatgttctgtttacatcatttcctacttatccttcgtctatgagataattgacattagagaaacacacattttagcagaacccactgtacttctttcttcattctctgagtctatctctccaagtactgctatgcattaaacagcaatagcagcaaaacctgcctcataataaccagcaaaaaatcaagcagatatcaaataagcattaaaaatttcaggtcagcatttatgtcaagacagcatgtatataccacaatatatattaaatccaaagagaaggaagaataaaagtgtgactagaatgtccttagtcacttaatccttcttgtgccatcaaaagcccctcactccctcgctatggctcctgacttcagaagccctcagctgctgattgagtagacctggggtgttcaatcacaagtggagggcagaggacaacatagtttttaatgccaccaaaattcgaggtagtaaggtaagtatggtttttaaaaggtacacacgtaaggttggatatttataaatacatacgaaacatacatagggcatgacaattaaaaaatgaaaagttttgacaatatgacactagggaaacataaagccactgaagataatattgggtatttttgggaggaggaagaaatgcagatgattaggcttgataaatgcttattgaaaggaagatcgatttagcagggtttttttgtttgtttttacttagggcatataaaataaggtcatattggttctaatagagtggggaaatatggaacaactaaaaagctgtgctaatcaacagcaaaatctcagatggtgagataagatgtaagaagcaccttgttatccggcggaaccacaacacagtaagcactggggacattttgatccggtgacaaattctcaaaaaggtgtcagggtaaaaattttgatgcagagtaaaataatgtgttattttaaggtgtgcgaaattagcttgcagttggaccatggaaaaatcacttaagcatcaggatgagaagctgtcagaggcaaaatacgaaatatttgaaccaaccattgataggaaaagcaaaaaacaggaatgatgtcagagaagttagaagaaatgtcatttaaacaagagactacatagaaaaaaatcaaatgttggcattaaaatttccggtagtcagaacatgcaaatgggttggtgtatcaaattaagaattacattcaaatgtgaatattagattaaaccgtaaaataaaaaaatctcttaaagaatttcctttttctcttaaaatagataagtaaatcgcactgctttagtggtctgttattagggactccagctgcttctgtctttcaactgtcatcttagtaattgcatctgccctcagaggcactcttggtccaagatggctgctgaagctctagccattagggcctcaattcacttaggaggcaaaagcaagaagtgaaggataaaagagtgtgtgtttctctgctgaggcagccccctctaaagagctttctctgaagctgtgtctagtctttacctactcctagttactagggagattaggaaatttcaactactattgctgccccaagaaaaagtgagattctgttcataaggaaaaggggatatctttgcattagataaaggggtagagaagtagttctatatgcttaggaaatatgtatatatgggatatctcaaaataaggaaaagttggagtgaagattaaaatagaaaataacaaaatgttaacacactaagactacacaagagaccatttggccagataaaagatatgtatgagccgggtgcggtggctcacacatgtaatcccatcactttgggaggccaaggtgggcagatcacctgaggtcaggagtttgagaccagcctgaccaacatggagaaaccctatctctactaaaaatacaaaattagctgggcatggtggcacatgcctgtaatcccagctactcgggaggctgaggcaggagaattgcttgaacccgggaggtggaggttgcagtgagccgagattgctcccttgcactccagcctgggcaccaagagtgaactccatctcaaaaataaaaaataaaaataaaaaataaaaagttatgtatgatatatatatatatatatatatatatatatatttttttttttttttttttttaccaaaccagcacagaaactagatttcatagagtattggttaagaactgtgttccaatcctggttctatcggctaacttattagaggactagaggaccttaagcaagtttctgggcctgagtttgtctgtctgtaaagcagaaacaggagtctattctacctaagatcgttgtaaggattagctggaatgaggcaagtaaagtcttcctacagagctgagcacacaggaggcaacatgcccactaacatggctgagccattttccgctagaagttcctgcagctggtaacaaaacacctagcaagctcttgctgcatgctacctcatgttggagggaaggagaagaatcatcattctaatgacttggttctgaacagcacaaaagagtttggtgaaggggaacaaaaaaagacacgaatattgggagaaagctgcccatttatagccacagatggttgagtattcaaatgtgtacccaagagctccaaagtccagtgatgggaatttgcctctcaacagaagactaagaatggagacctccaatggaaggtgacttataaggtgattgttaaagaatcagggtactttccacatgtaattctttgatgacagctcttccaataatgagaagtcaggagactccaaaatctccagctaaaattcatggggatcagagccttggattttagaaggatgcacaaaagatgagtagaagggaggcacagaactaacatggaaggtccctaaagctcaaaattgccacctcttcccaaaaagtcaaggacaatgaaaaagaaagtgttctttctctccactttgagtatttgaaagcttttctcagaataaactgtgatgactctttttctttaaattttgccacgaaacatttctaataaaagaattgtataatgagcccccatgtacctctcacccagcttcaccaatgatcaactcacagccagtcatgtttcctccttatctgccctccgcccccagaatattgtgaagcaaattcaagacatcttattctttcattattaaagtatttcagtatagtatgtatctctaagatatgaagatctttaaaaaaaaaacccactgctattacacctgaaaataattaacagtaaattttttaatattgaaatatacagggttcagatttcttagattgtctcgattttttcattttatttaaataaagatgcaaataagatccacacattgtgattgggtagattctttaagtgtcctttaacaggagcttatttgttataccaggttatttatcctgtagagttgcccacagtctaaattttactaattgcatacctgtggtcttcctccagtatattttctgaagttggtagatgagatacagcagcctgatcaaattcaggtttgatttttttggggggtgggggggtggtcggagtctcgctctgttgcccaaactggagtgcagtggtgcaatctcagctcactgcaacctccacctcccggttcaagcaattctcctgcctcagcctcctgggtagctgttattacaggtgcacaccaccacatctggccaatttttgtatttttagtagagatggggtttcaccatgttggccaggctggtctcaaactcttgatctccagtgatcggcctgcctcggcctcccaaagtgctgggattggcctccccaagtgcctgagccaccgcccccagcccaggtttgatttttgcagggctactttataaggggttttgaggtattggcatcaggaggcacataatgtccggttatcttgcttttttcttcatgttagcagccattaagaataactgcctagacccattagttcattagtacttgctagtgatagtctaattaagtgtctttatgaactcacttaatttaaatatatttgttttccagtccattgcattctatgctgacgagtaatgctatattgactagtaaatatagcttgtaaagactaagcttgggaatctctgaaaagtcatctcaggaaacagacctagacaacatctgcactaagctagcaccctctgtcttttccagatttgctccttttttaaaggaaggctgtttctcactttaatttttctaagtggcgtttagcctcagcctctgtgctactccatatgctttcccagctgaactatcagaccaaccagctagataggttccctggtgattaattttttcttggagcccctgaggcctgtagtcatgcacatatggtgtctaatggcttggtggataactgagttaatggtgtgtgaaggtgacctgaataaatttggaatcaaaactaatacaggttatggcaagctggtcccatcataaatttggagtacttgtattcttgcctaagtaagtgttaggtgactcctttggagagaaactatgtggtcctgagttcagaaattctgttaaggacacaggagaccaaatgcctcctcttgtgaaccttgtattgaacatgttcactttccctttctcacattcaactggagttcagaaaaatatcatcattctccttttacaattattctttctaagctgagaacgtgaataactaggacaggcagggcgttggtgtggtttcatcactttttcccaatccttcctgcagttttttgcaagccttccattccacgcttcagactgccactgggtcttcagtttgtttttgattgttggagccatgtcaatgaaaaaaggctgagtttgacctctcaatatatggatactaatttattgataaaaatggagagtagaataatggtatttatggtatacaaatattacactgtaaagaaacacattcctatttttttgtgcatccccgtggatcatctcgtgcatcccctttttgaggttcactttttagatcaggcactgcttgaggtgccagcaaaacagctaccctccaatcaaatcaaacaccaaaaacaaaatccaacttcagttactttgtttgtttgtttgtttgtttttttattatactttttctagggtacatgtgcacaacgtgcaggtttgttacatatgtatacatgtgccatgttggtgtgctgcacccattaactcgtcatttacattaggtatatctcctaatgctatcttttttaaatcagaaaatatagaaaggaattatttttatttcaatatatgtttcttttgttttcagaaattaaagagtattcaaatcacatggcagaaccctgtaactattttaaatgtaggactaatccaaagactttaaccttgtcctatgtctactgttattttcatggaggagtctgtcttaacaaacacagatttatgtcacatgatatgtattctgtctgaaaacacttccccctaaccctcccgcccccaaatctaagtgaaatataatggtcactgatttttggtaaaaatagttgctgcagagttcctttaacatagcaagttatttgggcctaggtctccactgaagtgggccatttccaacctctctgtatggtttcttttactggataaacgtctcttctttagcatcttttatgccatctctcagacttttgcctctctttgtcttgtttcagaccctaaaggtcttcgtttcttggactcctatttcttttagcatgtgtcaattgagcaacttcagatgctgttgatctagaatatctgatcaggtccttgccccactgaagcttggaatcaagtaagaggaggggacatattgaactctcaagcagtgtttaaccaggtgggagacagcaataagcagaggattagggctccattggctggggatggggattgagtgctgagagagttgaggaggtaggtggtgccgttagtgatctgcttgaggaaaccatccaaaagaggctaccacttggagctcttcaaaaggggtcttacctggggtggtgaatggcaggatggcacttctaagcaggagagagtgtcttgaacaaagactggaaactacagttagttagccttggctgagtgtttgggctgctgtgataaagtaccatagactaggtgacttataaatagcagaaatttatttctcacagttctggaggctgaaagtctgagatcagggtgccactatggttgggttctggtgagggccctcttctgggttacagacagccaatgtcttatccttacctggtggaaagagtgacctagatctctggtctcttcttaaaagggcactattcctatccatgaggacttcacccttgtgacctctttacttcccacaggcctcacctcctagtaccatcacaggggggataaggatttcaatagcggggatatgaattttgggggacacagacaattagtctgtaacaatcctggacgtgggatggacaagaaagacttggctagaatagaaccacaaggttgagaagtcatgagaagaatcctttgtagtttgagtcacttaaccacattatctcatgtgatcctttgggcctctccaggagggagggtggttattacctgaagagtccaggtgcaggtgggtgaaaccacttcccaagggcacatagccagcaaagggcaatgtcaaagtttgaaatcctggtttcctggctctgggtccttctccctttttcttatagacacacctctctatagggtgtgtcgtgttggcattggtaacagggcagagcttcagcactcagaagctgcctgagaaatggggaggaggacgtagaaagtgagagattttctgaaaccattgatgagtatgagacctcagctttgctttaccagtgtattttaattgttcctgttttcaaactgctgcttgcaaattagacacttcagctgcttttcctttcaaatatgtttatttgcagcattttagattggaaggtactctaattagagtgatcacttttattttgctatcttcatgtttttaagaaatcaggaatgaggtgaataaatttcaagaggcatgtgatttattttgaggagagagatggagaggatatttttagcttctgtcttaaaaatcagctcttcatttaaagcctggtggtcagctgtcctttaaagggaccttacgctgctatacctgaatcagaatctcaatctgtacacctcaaacacaaagagatcgtgcctggaatttagaagtttgttcttagcttggtgggagcaggggaaggaaggagcccaagagagtcttgtgttttaagtggcctggtttgtcacgtgtcaagtccccgcctacaacaacagcatgttgacactcggtattctgaggggagagattatgtgcattattaccagtggacacatccatcatcatgaagccatgggtattaatgcatatggcatggggctgagtgcctcagcaaggaaatttagcaagcacagccctacaactagagcttaaaattagaaatgcaccttagtgatgtggcatagtggaaaccagcctatgctgtcccacccagaagggggcacccctgggtcagtggacccagcatctaggacagaaagcccttggtgagggatgggtctgccccacaccacacgaaggcattgcatcctctgaggtccatggtgtccccaatctcagccataactaagtgctgggtagagctctttcagatgcatgagccttggggacagcgagtttgtgaaagaatgtgccttcacataataatttaaaaatctcatttgtttccgtgaatacccacgtgagataatagggcaggtttaatattccttcattttacagataagaaaactgaactttgggaacttgccgaagtcccataagaagttagtcagagaactggaataaaaacacagattacttcattcttgaccccaaactgcctgctaaattttacacaaatatggatagggccccagaaaaggccagattacctcagatcagtgtgggagggctggcctgcctgtgtaaaggctatttacagacagagaccaattctcccctgtctccactctgagtaattaatgccaccccttctgtgagactgctggtaagagctgccaagcataaggatcttcaaaaagtcttgtctttttgaagcagtgctgtttaccctgcgtataattattataacaatgagagcttcctggcacattaaattatgtcttatttggagtctgtcatcccccgtgcagacaatgaagtcaagagctgggatggcaccagaaggggcattgcaacctgcctgaatctggctgtcctggtgtccccagagaggtgccttttattatctattggggcttcaaagagaggaacatctccaaatactactctagaatcatatgatttattattttacagtaaattaagcactgagtgaaattgtttcagcccttgactctgtgccgccatgcttctccacaacatggtggcctggtctcatgttttatgtaattcagaatcaaactaatgaagctgtcctggttgcaccccacccccacccccaccacctgctgctttggaaggatccagggagaagcacatgcatattgagtggagtataaactccttccttatgtgtggtgcattgaattcaggctgccctttttattcctaactttgagaggctggcaggaaggtaaggcccttgggatgaaaggtaaaggtgtgtaccatcccatagaagtgggccctgcctcacacgcctttttccctttctggtttcccaatgaaactgggccttctccactcatcccacctcccagatttctacataattactatatatgagacgtgcccattggagctgccaaatgtgattttgcagacaggtcttatctttctcccttggttgtaagataattacaagtagaaaagttggaaattacaagaaagcaattacttttcatcctggcctgcagaaattgtgttctgccagtcactgtgtgtgttcgtatttttatattttgcttcatatgaaaaaaaactttttgaaattaattttaagaatgtttcttgatcaactgagtaaagatcaattgacatctgctaatactgtcctttaacatgaatatatgaagagtattactttgatggaatccctcacagatttacaacagttaatactggaaaacacaaaatgtaatgttattccttactaagagagaccaatatatagatagaattctccccccttcttgttaccaagaaatacactaaaatgatttaaaagtattaatgtattactttatatttttcatattatttttaatttattctttactgatgtgattgggtggtacttggcctctgtggtttggttcctggcctttggggcctcagtttaattttcagaggaagccccgtcacacctactgccagtgtgaccatgcagttttccaaaattcttccctgacaactctcacaggatggtcctgtaataataggagacacttctcccttgcctttaaacagtatctggccaagctcatcaagctatctcctcctttcaggaaaggatattcagtccatgatttcctgaccctttagggattctataaaacatgcaatttcagtttgccaaggcaaaaccttccactgtgacagccctctttgtcactaaacagtctgttttctgtggttactgcccagataggtggaaaacagaaagctcttggaggagtttgctgacacatttgggctgtggtggtgtgttttcaacctaccagcctgttttctgcatggtagtatagctggtgggctttgttgctttaggaccatgccaatcagagtagatgaaggaacatcattatccgtaagtgactgcatttgcattgaggaaaagagaaaccagctctgcaatttgaaggcctcctgcccttcttaaagcagaaaggaggtcatgccaaagggtttcttgttttcataaactggctggtggttccccagggtcctttaagagccattcgttaaatggcagaaagctctgtgctaaggcagagaaaatcctgaaaaacaaaagtgctggaaaatagagacccacactgaccagttcggactgagagatgtagagtgggcataagcattggttccacatgggcagtgatgtgaagatgctagccagctcaggactctcatgtctagcttgtcccgttttatggctttggagtagtattagcaccttgtttttaaaagcaagggtacatacttaaacatattttaaatgcattttattcccagtgctggctcagcactgtacatgtaatagttgtctaaaagaaccattaagtggtattacttcctatttatggatgagacatttgccatcaagttgcaaatacaggaccattgctctttccgtaccacccatttagcctcagaaatctccctatgtctgtctttggaccagaaaccaaaattctcacctaattggacagtagagaataataagtaaagtgtttgtggctgttctttcttcctgttcgttcccccagataggcaaattctagagccactcagtatcatacttgagacccattgcccaagatgaatcctaatttataccagatgagctcaagccaagactaaatgtggaggccagtacatgaaaggaagcagactcccctctttttagggcctgtgggccaataggtggaccacagactgggctggaaacaagacagcaagcttccccttattgtgccactgcaatcattgagcaccatctttttctcctagagaggtaagggtttgggaaggaagagacagaggtgaacaggctttgagattcttagcttccaagggtttttcagagccccacaaggtttgagtgggacacaacaaggaccaccccatacatatataccttgaccttgggtggttacttgagataaatgagccaaagactgcagagactttaaattgttctgaaatgtaaattttttcggctacactgctgaaattcacagagatttgcattttagaacttacctccaatcttggaataaaataatttttcatctttgttgaattttagacttcaggagcaagcagatgaggtagtttctttttgtctctctcctctctttttcttttttgtttgccttgcagttcctaagtgaatgtggtacttaggagcaatataaaaaggaggatgaatcaactataaaatataccttttaagttttacaactctttttattttgtttttgattagaatacacacttaggtagtcttggactttaagctcgtttgctggaagcaggtggaaagtgaaggaatgtgccgtgcccgagatccatgtttcccacaagtccataagtcctttgtggtttgtgtgcctgccctccttgtgtttttcactcagccagcttgtatttactgagcgctcgctcgccctgtgccaggcctctgccaagcctactggttctgccctggagaagttcacagttccagccatctgggaacatccagtgacagtgcagcccaagcaggaagatggttaaggcacagaggagacagcattgaccttcacctgggtggatccaggactgcctgcttgtaaaggaggaggaggcaggagtccatccagaagaaaaggagggaggagagaaggttcttttgggcattagcagtggcagaccaggtgtgagagagcaggagaggtttgggaatgagggataagttaagtgtaggcagagaccttagcagatgacagagggaatagttggagttaaagctggagagcttgcagaagcccagattgtgaagggccttgtgtgcagtgttgggaagctctttatataggggaacaaaactttgagttttggaacctagtgacaataaggaggatgggttgaaggaatgagagcctacagacaatgtcttagcccacagcctctaggaagcagggcctgagacaaagactaaagtaccaatattttgctgcagaaggagttgcaaatccagggcagcaaggatgaaggaaaagggaagtgcagggtaacagacggtgtgtctgaccatgctggctcctgcctcaccaggggccacagagacacagcagcacattgggctgcctggactctccccaaaggcctgcaaggaggagctctaccttggaatagtggaatagtctggaggagagaaaggaggtgggttttattcgccctgctccttcctgtgtcctgtttgccatcaaccttggttcacctcatagatttctaaggcccctataattctgcgatgctatttaggaaggaggaccccatcaccccatcccatggtaagcttattccccatctggcagcagagggcagcctggtttgtgtgagcactgactgaaaaagagaggagcaggggcaatctgaaagggctcctaaggagcgtgccactgttgagacaacgagcccagcccagacattacgatagcagttcatgcaggagggggctggcagagcaaatggaggcgacctgtagtggagggaggtttacaagatcttcattctgtgcagttgacagccccaaccccaacctttataggagttacgttacagtaacagtaaagtactcccatggctggttctggtcaatgcatactctgtggccttgtgtttcttaaataaaaaataggattcattattgtatgtttgtaaaaccaggtaacaggccgatttccatatttgtggggaaagaggaggagctgccacaggctgagtatcccttatccaaaattcttgggaccagaagtgtttttgattttggattttttcagatttggagatattagcaaatacttaactggttgaacatccatattcccgaaaatctgaagttgaaaattctccagtgctcagcattttggatgacgtgagctgtggaccgagaccctgccactgtcctgttaggccttctctgtaggacttaaatttttctctgccctccatggagtgggacacacgcttgcctctgcagcctggttttgtcaccctggagagggattgacagcacttcccagggaggactactgctgcctaagactcacagatgttcaccctggaggagccaactttgggctgagctgcagaattttttaatgacaggtcataaggtgctgcgtgaatgaggggaactgacgtccaggagaaatatgtgtgtctgcagtggggagcaggggtgttactggggaggatactgctattcaccaaagaacattcctataccctaattcaccagctaaaaaggaagttggagatcaaagagatatccgcatccccatgtttattgcagcactatttacaatagccaagatacggaattagcttgagtgtccatcagcggatgaatggataaagaaaatatgtacataatggaatacgattcggccatttaaaaaaatggcagtctgtagtttgcagcaatatggatggagctggagatcattatgttaagtgaaataagcaagtcacagatgtcgaatgttctcactcctatgtaggagctaaaaaggtggccctcatggaggtagaaagtagaatgacagataccagaggctgggaaaaggggtaggtgggaataaagagtagtgagttaatgtgcaaacataaaggtggatagaaggaataagttctagtgttcaatagtagacaagggtgactatagttaccaacagtatattgtctatttcagattagctagaagaaaggacttgaaatgttcccaaaacaaagaaatgataaatgtttgaggtgatggataccctaaataccctgatttgatcatcacatgtagtatccatgtattgaaatatcccatatatcccataaacatgtacaattattatcaatttaaaaatgttgtaaaataagttggggaaagcttctgattctctagttctgcattctaccactcccccctgctgtggacttacaggagtgttgcgtaaattgaattgtttttctaaagctttctctccaagctctaaatatcttatgactggttctgaacatgtacctgcctccagctacaaccataaacagctgaagagacactgacaacactgctcattgactccagcatgcgctctccttccctttgcatctcctcccctcaaatgagcttaggtggatttaagttttaatcagttagatcagttgttcttaatgagaatttaaattgaactagagaataaaagcattaggggggttgctggttgctcagctggaacctttgggcgacagaggtggttgcatgctgtgatatgatactcagtgcaggccctttttgactgcatctccagagatctgttggtgataaagtttttagagcagataattttctttgaccttagtctcttaagttggagaaggaaagctttctaagaagtgatctcgatccagttcttagatcagtgggacatacaggtctatggtggtcacctatggtcaccttcaccctgggcctggatgaccaaagtaagggaagggaagggggagtgtatgctggaaaatgtctcttacctctaacgccctccccattttgagccttcccatgtgtaggggaaaggcagacaaagacacctttaattttaaaaatcctgaatatcctgcatcttaaacacaaaagataagagtgtccatgaagacagaaggggatcctttgagccccttgatggcaagaactgacccttccatcctggagaagaggagaccaatttgatattatggaggcagaatatacaggactgtgtgactaattcgacatgtgtgtccatggagcttgaaggggacagaaccacaggtgcaaaactggtgtaggtacttggctgggagtttggtatgagaggcttctggggcacctttacctggaataggcagcgtggttcatctgcaccaggattctactcagaactcttacaagtggtaacaagagacctgaggtagaagtacctaattgttacatcaatgtcaaaggctaaagttaggcttgaaacattttttttcctctaatcagctgttgggattttcacgtttatgaaattggtaaatcctttctgaaggtaatctctagttttgattttaccatgcctaaaagttagtaagttcatacactttattagtctttacatatacctctttatatttgcctgaacttgcccccttgttatacttcaagaaaccccagccttttctgggatttaatggtaatacatatgtaatctagtaccttgttactttcccaggcatttagtctgggaaccctaatcttgagtctgtctacagtggatatttttctccaggacaggaaccaaatgggccagttactggtctaccctgtagctcaccacagacatagcctaggggcctttggcccatcttcactagttggcaactggctttttaggcgaaatgcctccttttgcataaaggagagatgcctgtccccacctgcaccgcccatctcctgctttaaggccagcaagatgtcccgagaggcctccttgtagatgagtgaaatccacacagggaaactcaagtaaaaatatggggtggggtctgggaagagctgtgtttattataaggatccagagggacctggggaatttaggatagggaaccactgtgggtgggataagaaccagagtggctccaggccctagttttttctcctctgtctctctgctttcttttcccactctcttctctccccttccttctccttattcttcttctactcctctttttttttctagctctgtgtcatgcttgcagtggtgatgttttggttgtagtcatgctcttgggtccctcttatgaccgactgtctgcgtcttcccctctcctttagcctttacttggttcttttcccaacccacccgccaaaactggcaaccagcttcctcagaacttgttatctggctcgtaattgcccagactccaacgctcaaatgacctttttgctctaaagccagtggccatctggcagtaatctccctgtatacaggattctgagttcccaagagagcatctggttggctccccttgccttcctgagtctgctacatcattcctgggctgctggccagcctaggagtgggtcccctcaggtcagacacaccctgggcaggtcagcagccagcagtgggcacagggtaacagagccccctgcctacttaacaggagctgtgggtgggggcaggagttaccagatacatctagcacaagaaccatatcctagaacccttcaaactaacatatgccaggtaggtgtaagcttctgtactaatttaaaactatacatttctaagttaatgaattcagcatcttgcggccataccagacatggcatggaattaaactttcagtcccactgttcattttattcatacattagggtggcaagggtggtcttgctcattgcaagcaaagtcatcctggttcatgaaatgaagaatgtggactgtgcagttttcccagtcatgaagacttttgatacatcacttgaaatgttcctcctgaagttgagggtcctttgtaatatcaccagggcagtgaatggcagagaccagatcatgaatcgcttcatttagagcctgcctccgggcttccctgcactctgtggctgctaataccacacccctgtgtcccttgtggtcttaagtcacaaaaccagctattattagatttgcctggagtgtctgaaaacaggcttagaatgaggaaaccttgtcccacttttatacaactggaaaacattacagaatttgactttttgaaaatttcccaaaaaaaggaaaagaaaaacccacaaaccccagcttgtacagtttagtcacagggaaacacagaggtaaaaaaggtgaacttgcttccacttcacaggtggttttgatttagaaaacgtgcctcaaaattcagtgcctacaaatacaagaaaaggggtttggttgtgcttctaatagtataagtaaaattactcttgaatgtttcagggctcatcaaaatttacatttattctcttttttctacttttatctacctgagtattctcattatctctccagctgtgagaaactctcatcttcccatgatcccaaattaggtgggatccagttctgacaacatgagttaatcatcactagaaacattggcaagagctggggaatgtttgtattcctctgggacagcttagcatctctgggtaaatgttgcagtccaactgactgccttccccgggctgtccttccccaaacttcctctcctagaggtaggaagagccaaaatcaactgttaggtctgtggtaatttacaaagcaaggatgatatttcaaaacagttggctatataatgtatttcctcttgcaaaattatacagttggtattcagtaatatgttgccatataatgtatttcttcttaaaaaattatacaatggctatatgactgtttatgtccacaaagtccagccagattacttttcaaagaaattttagcagtttgattgccaaattcctgtgatctccatattaagaactctctgtctgtggcctctagtcttagaagttctagtccatgatacaggttgttatgcaaatgaaagaaaaagagaaatgtcttgtgcttgttttcttctttagaataagaagatctacttggacattattcacacatacatggaagtgcatgcaactgtttatggctccagcacaaagaatattcccagttacgtgaaaaaccatggtatcctcagtggacgggacctgcagttccttcttcgagaaaccaaggtaaaaattcaccacggatgtggtgttcaggttattgccattggctgtgaaaatgggatcagaatatttcatgcttgtttttcaatgctgcaataaactcttgtggctattttggggcagcagtttgctagaccaatggcagctgaaaagtaagtgaattgtggaatgagattgctacagtttttttcattgatttattcaaaaatcgtatttactaaggacctactcagtgttaggtgtcaagcaaggggctaaggataaggctgcaaatggaaaaggtaaagccctgcctggaaggacagactttctaatagagcagcagctttcatagtaagccaggggtgctgaactcttcccccaacccaatcatcactgttcaaggagtgggtttcccaaccagcttttcctcatacctccttgttcaccaagtacgcattggacagtgaagaagttcagatgagggcaaagtccctgtgggctcaggaagcagagcaagcatcaggagagatgcaagagatgaaagatggatggagtgtagacacacctggcatgtgggccagacaggagttagagtcaggtggtggaggtggaggtggcatattcaggaaagagctagaagccaacccagctagtctaagtgttgaaaaatagtggaggtaaaattggatgagggaatgtgagggtctgattggcacagatggaggcagagttcacaccatgtggtggaggtagccgggcaagcccttgaggatcattttgctcagcagtagcatgatgacgtgttgctttgacactgtagggaagtccacccagtggtctgtgttttttctgtaatggtgccatggaagtaccaaatgaagttcgggaacttgtgaagaaaccagagtttggccttgaagggttggctggcatttcagtgtattagataaactccctcaggtttattaataagtttttatgaatttcacaaatatttattgagtagctgcaatgtgctaggcgttgtacaagggatgcaagtgtgaagaaggcacatggatctctcttgtggtatgtcctaagcacaaggaagcttattttcagtagtggatttctcagctctcatctctggctcgctttgttttcatgttcaaggtaggggagagaggttgagcaggtggacttctagggcataatctcagttgtccaatcattatgtgatacttcatttataaaaagtgtattcacatatgctatcctctttgattctcacaacagcattaagaggtagatagagcaggtattattgttaactttattttgaacatgaggaaataggctacagagtttggcttgcccacagtaaactggggtcaagtcctggaggtggccctaactcatgatttttttaattgcacattaaagctctgctagccccttgatgtactatcgtcataaacactcaaacttaagaactcttagtggacacccactagccaaaagaatgtatatctcctctttgcctcagtttctccatctgtaaatgcatttgatcctatctacgtccaaggcatttgtatgatgccacaaataaaatgatttgacaatttctttagcttattggccaaagacctggtttgttttaagattttatttccttccaaggtcatctgtagtctgatgactgttttttgttatccaggagtgaagtgtgttctctagttttcactatttgctttctatcaccttctgtcttaggctgacatttcagaatcatcagaatgtctgggccctttaatggcagtgctgtttttgccatttgcctcattttacttttctccacatcagattgtggaaagagctcaagctcctttaaaaaacacttggcagagctggttttcagcagtgtgtcattactgtctcacacacttttattaacccaacctcatgaatgtctctctcagcttcgcaaattttgaaagaacccttacttacctaccatccattaccctgtcagagattaggaaataggccaaaacggagatcgctgatgtccaggggaggacaggaaaagaggcagggaaggcccaggccaagatgtccaagtttgtctaatgagcaaggattgcagcctgagttaaagagcacgaggggtgtatgttcatccttgaaaaactgggacccgtgtagaggatgtcactgatcccattacctattgcctgctccttgagtagagtatattaaaatactctgagtggaatcatggctcagacatttggcaaatgtgacaaggatggggcagcgtattgctgagactcccctcacacctggcacacagctacaggctccaaaatgaatgaacctttggctttgaaataatgacatgaaagaccagtcaggcttcgcatctataaccctttctgtctctgactcctttctctctgtctatgagcaatttaaaagcgatttattctaatccacattggaaatggggaactggagcagccgagaagcagatgtctgcagcatgaatgggattcacacacttcttggactccttactggcaagagaagcagggctgacctcctcaagagagttagagacatagagagatgattgatgcttgatcagcttctgactcattatttttctttacaagccatctttgaatctctgcaccaatcttaggaaaccctctgctcagcagaattttgtccaggcatgccattaggggtgcaggcgtcattagtagcctcttgcttcagggaacctgtgaagatggaaggaattcaatgtaacactaatactggggctaaaagagccaggaagttgttggaatctagcagatccttctaattggggtataaacttggatgaatgaattatttatcacaggaccacagccgagtcattcagtccagcaaaccccaggagtgcagtttaagccagcaaatcaggactcactagggtggcatgtttttatttttggtttaaatctccatctcttttaaagtggcttctttcttcatcttcctggatttaacctcttcatgtccacctccctcagtcttccctgtttcatatatgatactgaatagtgcatttgcatctgcaactcactgagtgctttgtgagctggaccagtaccgtcctttctacagttgaaaacaaattctggttgtggggaagaaaacaggcaaagctgtggcttctgcacatactgtcgctgtaccccttctgtacccagacctccattcattcacctctccaagacttggctgggtcatgacggcactgtttccccatcatgtcagcttatcagcttacctgtgggactcacctaggaacatgggcaggcctggcaaatatgcagtgctccctctgactcatcttatcctcatgactgactgtgccaccctgccccccaccaactatgtctcttcttactgagcttggatgtgctcacaaaacctgtctaaggcaggtgcggtgcagtagctcacatctgtaatcttagcactttgggagaggctgagtcgggcaaattgcttgagccgaggagttcaagaccagcctgggcaacatggcaaaaccccatttctacaaaaaataccaaaaaaaaaaaaaaatagctgtgcgtggtggcatttacctgcagttctagattttcaggaagctgaaatgggagggtcacttgagtccagaaggctgaggttgtggtgagctgaggacacctgcactccagcctgagtgacagagggagaccctgtctttaaaaaaggctgtctgaaatacccagggcttgaggcagcagactctcctgcagctgcatgagggcagagggcctttgcttgttctatccacaggtgcatccacagtgcctggcttctaaaaggcatttagatgattgtataaagaatgaaagaaggagtcaaaatgaaacacattgaccatctgggatctctgagatttcttcctgttctcgtataccctgcgcctagatctcttagatctcaccagctagggacactacccttctgataccccgttcctgcctgtctgtaatgttgcctacatctccaggccctgtgagtgatagcccaagagcttgcttccttaggaggagcagtccttcttctgtttctattacagatactggttcccatttgccctcaggcagccaattgaagcaggtttcatcctagtgagcatacttcaagtcattcccatgccatctagatggggaaaaaattgtacgaacacatccatgcctccttccctcccccttatctacacatgtatatagactgaagagtgtacagaggtatgagtcagtaacctgtctgactttcagagcaaaagtgcatccctacactcaaataaatacaacacgttcaacttctgtgcacagagacacttgattgctggaaagatccagtctcatagtatttattcttttactgtttcatccagcaagtaagtataatattaagtactagatatattctaggccttagtctagccattctagagacagtgatgactcaagcagttttgcccacaaggagcatacaggtatgctggaggaggaaagcaggtaactgtaacaatgtggaaagtacacaggtagaactagtcataatatgaaataatgatacaagcataaaacttcactgtcacgctgagtggggccaacagttcagttgtgtaaaatgtggttctgtgacttgtgaaatcaatgtagtgaattgggcagtcccattcagaggacaggagccactgtcagtcacagtttaacacctccatgctattgcgatgcacctgtctatgggatttaccataacagtaacagccattatctctcccctctaccatgtactaggccctatgctaagccctttctgtgtattctctctttgcatcacaaaaatccaatgatcttggtactgttataaacggtaccattttaatgaagcagccactgaggctccagtcgtaaataagcctgttttgctgcctccgtgttggcggctgaggggttgtcctggtgtggaatttgggggagagaggcgtggtcagaaaagggtcctcccaggagatgatgcctgagtggacttttaatggtgagcacttgaggctggcccaactgaacatgttcagcatctacaggtttaaatttatgcaaatattcttttactcccctatctccaagttaataaatttacaatgtgaattgtaatgcatttgattttatattggggctttcaaatgaccgaaactcaggaactttttatcctgatgctgttgtttgtggtttgggtttttgtttctgaaacggtagttaggtagcttggcataatcagccagctggtcttcaggaaatagtctttggtttagcagcagactctgacaaaagtctgctttgggcatgtaaacatgcttggtgagtcttcttttcttggcctccgtggaccttccagctcttccctagagagtcttcaggtcacatgagtcaggggcttgtggagcccttgggaggatagagccagcctggatggaagagagtctggccactgtttatcccttccttaagcatcaggtacctgaaagaaggcagatggccagggagggaccctttgggctacatgaaagcatcacattttggaaaaattgttttcttcatacccagccccttgtctgggttatttttaagatataaaagggatgcctattaccagaaacattaatataatgattcccagtcattgtataaaaataaacaagcaaagcttagcaatagcatgtgactcatgggactggcttatgtggcagtcactgtaaaccatatcatctcttatctctctcttctgatgaatatccctccccgttttttagtgcagatactttatgaaacaatgagaactcataaatatacatgcaggtgctgaacatcttgtaaaaacccacaaacataactcctgcacacgtaaactccgtctaaatgatataaggccatgatatgcagctgtgtgaagttgcatatggatttgaacttgagtgactgattatccagcacttactaagtgccaagacttggaatgaatcctttccatgtactatctcatgtaatcctcacagcaaccccatgaaataaagcactattgttttacccattttacacatgaaaactctgaggtttagcaagcttgttacccggactaaggtcctataaatagaatagattataaatgggccttaactaatccatagacagaagcacctagcagtgtgtcacagtgactgacctgggaaatgatggagctagaccttgaagcctaatctgtctccagaacctgcgctgttaattaccacattgttctgggcactttgtgccaataatggattcatcaattcatttgatgaaccgggggtgattcattgctcagtttccctctagagtcaccatgccaacttcgctaattaaaactggccagaaaagtatgtgttgtgtgtgtgtttcctatttatgattatcctcaatgttccccatcaagagtgaaactgaccaagcccatggataagaaccccctttatccatgtttaaagattctttaagtactccacttagcagtttaaaacaattgtttcttctttcacagagtgggaaaaatctgggtggttttactggaccctttgtgaatgtgtaggaacgtcccaatcctatactgtgaagaaaacgtatggtgcctcatctgttctctctgcttagcattagttcagaaatttaatcctagatcccacaatccctctgtgtagaaatactcattgatggagctggagttgcagccatggagatattttgtcatctggaatatcctcattagattctgggcttctgaaggcaaggtgaagtataagtaaaatatggccagttttctccagcagagttaagccttggcacttatgtacattcttgcagtgtctcttgcctccttgctaaggaaatcggttaagtaggcagaatagcaggagattaggggaaaagcaattcagtgtggttaaggtgccaatgtgtggcaagaccataagtgcaaggaagtttacagagtgctgtttggtggtgatgaactctctccgcctgttgtgttttcattcaaacctcagatgtgctatttgaccttaatacatctgctccattgtaatatcacaggtaataagcacacaggaagcaagaaaaaaattgcttattgactgaagtgacaaaaaactgttattttggtgtttccaagtaatgtatttcctacaatcctaattgtgtgacagaaaaactcattgccaggaaattatgttgtatttgcttaggcttcattctaaacatatgaggctttgggagagttaataaagtttttattttatgtgtactgagatattctggtgcccacagggcagaagagatggttcatattgttgttcagatataattaaacctaggtcacattcaagtccattaagcaacagcctcaaatccttttaattaatggattcagattgatctaaagaagctaattaaatttttcccaagattttctatttaaatagacaaacattgtgctgcttgcatttcctccaaagctgttctttgaaatttagagttgatgaaggtatccacacttcatggcaggccctgattttcagaggtcaggaggcactgtgggttctctgactaaacctgcagaaatcctgatctgcgtcttctggcacttttctcctcagtcagaaagatctggactccctgtgctatcttatgcccaaccacggcctgacagaggtcatttgttttccactggagagccggcacatcctctccaaagtctgataggagagggcaaatcagagatcacaagtctggtagataacaaccctggattcttcatattccataaagctgggatgtcgtgggactagtacattcccactgtttccttccatttcatctgcagcagtcagatctcccccacccctgagccacatgtccaggccacaccctatagttagaagttctctctgacaatctcgtttctgttagctgtataataagagtaagatgcagagcaggagcttcctaatggtagtagagctttccctttatcctacagcttccaggctcctggctaccatgttttcctcaccaccatcacccccacccgtgatctctggtggttctgctgcccaagggggaaatgacccagccagcattaggggctctgctggcctctaaagcttcttttcttcccagctccctgccctgtggacatctctggcattgtgatcacgcagttttcaggaaacgaaaatttattctttcaaaaaaccaaaaagattgagtaccctattctgttcaaaacaaaagtaaataggtccagaaaacctgagatgttagtgctgtgccccagaattccttcaggagctacctggttctccagtatgtcacccatgggctgtgctcagggttggcctgacacatgcagcccggcagcttgggcctggcaccctccagctgaacctttctaaacgatcattcaattagagcagctgctaagagaggaaagctggtgagaaggaggggattgctgtgaaaagaccgagggaaaaacagaaccaagcttgcagctaaatctagttgagccatctccttcattctcaacacctggccttgtggttgggtgatgctctgtgatggcagaaggtaaggacgccctggggcccagttatcttttctcacttaatgtgcccctgggggctgaaacagaacaggcttttatgtgggtagagaggacacagcttcgtcaagcccagacctggaccctgcccatcaacaacctgcagtgctccagcagtgtgaagtacacccactgtgatggtacgtgccgaggcatttctgtgagcagttatttcatttttggacccaggaaatcagcaccactgaactgcagcttgtcccctttgtcatcgtggcttccagctgctgtggttgctctgaggactgagagcaagttgttgctgccatctatggtctgtcttgggggaagcacatggtttgcctgctggagagggaagcagctgccttgcagattcagcaacacagcaccctctctcccctctgaggggaaaatcaacaccaagatgttggtgtccccagtgtaaaccccattatgaaaacctgtgtttactgacctaccatcattttaaagcagttccgtttgaactgcaatcaaacctccaagtgacctttctgtccctccgcccagcattcctgaaagggcctgttgtttctttggttcaatgaagaaaccttctgtgtagttaagcaagtgtttttccagtcatgtctcctggtgagttacagaaggattattgttgggtcttggtggtggtggtggttgtttttcttttaatactccatcctccctaccccgtggatacccctagacacttaattttttagttccttggtggaggagagcatagtgagttgagcagctttgtggggactttaaaagttcgtagtttttcagatcctggtgtaagctgaattctctctgccccaccccccagggcctgggagccttccaaagtgaggtgtccacacgggaatgggccacagaatcgccgcctgcaagctaggaatgcccgtcctgcctgatggtcctgcctgatgtgttcatacgctgtgtggttttctgtcttacagttgtttgttggacttgggttcccttacgagggcccagctcccctggaagctatcgcaaatggatgtgcttttctgaatcccaagttcaacccacccaaaagcagcaaaaacacagactttttcattggcaagccaactctgagagaggtaagcatctatcaaaattattccattttgaataatatgaataatagctatttattgagtgctcatgtaggtattaacttcatctaacatgattgggtgggagggtgagggtatagaggctcagagaggcaaatgacctgatcacatcaccttgcaagttaggggcaggatttgaatctacttctgccttcaccaagtaagggatcttgacactctacccccactctagcttactgtaaactcagacaatctagcctctgattatagctgaactctggtttcctgaatgtttgaagtttagggagtgagatcaactggttagcagatacttgtgaagaatctgctccccatgatgggctttggagaataaaaagtgggctgtgggagttttcaaagagccatcagcctcaggataccatatgtatcatggataactgaagtaatgtgactgatttttttcacccaccatcccaagaagtaatcctaccattgctagaaccatttgcagaagcctcatttgaattgccttcagagatcctgttgaaaatctgcagtgtgtgatgaatcaccattgagggtagttggatttgatttagggcaataaacaaaagtcttttacagctacgtgtgagtgatcaagctgggtgtttcttcatctggtcagaaataggtgtgtgcaagaaaccataagattgattttctgattatttctatgtagttagtagtaagtgactctgcaggcagcttatgaagggaagtcatagcagcatccttgtcattcagggcctttggctgggggattacattgattagcatccgtcccatggcatatcaatgtagaaggacagtttataaaacatatatttttcagttctacttttaaaccccttctgagtcattttctctcccaaatagtatataagatgcattttcaatggttattttttattgatcagtcagaaaccttgacaatttatagaactgattactttgagagttatttttctctgacccttcctgtcattggtgaaatagccaaaggagatagaagttcaataagatctatgtttatctataaaaggttaatccgtggcccagataacctttgacaagggttgtgcacacacttgtgtgtgtgtgtgtggttttttttttttttccttctgctagaataataaatttgaattcttcatttggggagtggttttgtattaagaggtcagtttgttcatttataagtcggcaatacttaatgtacatctgtgtgctaggtgctgtaggaagtgctaggacacagagactggggacattcagtctgccgtgaacctattcttttgaaaagtttaaaaagatgctgcccagcagtgaaaatatctcagtttaggaatctctgctttagcatgtgactgacttctttgaaactttggagtttggcggggggaaagaaactagtaaatcatccctcgggttttttgtttatttttgacaaaaaatatgcttaaggtgtacaccttgatgttttgataaatatacacattgtgagatagtcattacaatcaagctaatccatcaccttacatattaaatagatatttttttcatggtaaaaacacttaagatctccttttttggcaaatttcaagtatgcaatacagtattgttaactatggtcataatgctgcacactagttctccagaacttaatcaacttgtataactgagactttgaccaacatctccccatatccccacgcaccagtctctgggaatcacgaatgtattctctgctctgcgagttcaaccattttactgtgagttgaactgtgagttcagctaggctggtctgcatgtgggatcatgcagaattttccttctgtgcctggcttattttacttagcataatattttccacattcatccatgttgccgccagtgatgggatttccttcttttgcaggctaaatatttcatatacacataatttgtttatctattcatccactgaaggccacttagtttgtttccatatcttggctattatgaataatgctgcagtgtacatgcgagtgcagatactgctttaacatactgattttaactgctttggatatatacccagcagtgggattgctggattatgtggagttctatttcttattttttgagaaacctccattttctttttcatttatggctgtaacacattacattttcaccagcagggtaccaagcttccctttttaccacattcttgccagacacttgttatcttttgtctttttgataaaagccattttaacaagcatgaggtgatatctccttgtggtttcaatgtgcatctccctgatgatgaaagatgttgagcaccttttcatatgtttgtttgccttgtgtatgtcttctttcgagaaatgtcttcaggttatttgcgtatattttaatttgattggttgggttttttccgcagttgagttgtaggagttccttatatactttgggaattaaccgcttattaaatatgtggtttgcaaatattttctcccattccataggttgccttttcactctattgattgtttcctttgctgtgcagaagctctttagtttgatgcaatctcagttgcctgtttttgcttttgttgcctgtgcttttagtatcatacccaaacatcattgcccagactagtgtcaagaagcttttgcactttttttttcctcgtagttgtgctgtttcaggtcttatattgaagtctaatcaattttgaattcatttttatagatagtgtgagataaagatttgatttcattcttatgcttgtggaaatcaagttttccaaatattatttattgatgacactgtgcttctccattgtgtattcttgtcagcgtcgttgggaatcagttcttttctggtttctctgttctgttccattggtctgtatgtctgtttttatgccaaaatcacctgtacatttgaaattagctctaggaaatctctaaagttctacttctgcccaaattgtagatattatttttccatgttttatgcccaaattgtagatattaattttccatgtttgtttaacatttgagataaagtatatacaacataaaacttaccatttatcgttaaagtttttaaccatttttaagtgtacaattcactggcattaagtatatttgcaatattgtgcaaccatcactgctatccatttccagaacttgttcatcattctaaacagaaattctgcacacgttaaacactaactccccattctccccacttctcaacccctggtaaacctctcttctactttgtgtctctgtgaatttgcctattctaggtacctcatataagtggaaccatataatgtctgtccttttgtgtctggctcaccaacttagcatgttttcaaggtttgttcatgttgtagcctgtttcagaatctcattccttactttttttttttggagaccgggtcttgctctgccacccaggctggaggagtgcaatggtgtgatcatggctcactgcagtctcaaactcctgggctctagtgatatttcttcctcagcctcctgagtagctgggactacagttgtgtgccacgacacctcgctactctttttatatttggtagagatgggatctcactgtattaactaggctgatcttgaactcctggactaaagcgacccttccaagtagcttaggattacagacacaccccaccacacccagctaattaatttttttttttttttttttgcagaaacaaaggtcttactatgttgcttaggctggtctccaactcctgggatcaagtgatcccccccacctcagcctcccaaagtgctgggattacagcatgagtcaccatgcctggcctatgtcactcctttttatgaaaaaaatatatatatttcactcctttttatgaatatctacacactactttcttaaggctgaatattccattgaatatatatataaatcattttgtttattcagttattgatggataaatgggcaaaaggttgtagtcaccttttgcccattgtaatgctactatgaacattggtatacaagtattttgagtctctgctttcaatactttgaggaatgtacctacaagtagacttgctagaatttactttttactttgaaataattttactggtacagaaaagttgcaaaaataatatggagttcaggcatacccttcatctagcttcttcttatggcagcttctacaaaactacagtacagtggtcaaaaccaagaaattaacattggtaccatagtattatctaaactacagactttatttggacttcaccagtttttccaccgagatcctttttctgttcctggatccaattctggacccacattgcatttaatagtcgtgtctccttagtctcgtctgatctgtgccaattcagtctttcactatcacccatgaccttaaccacttttaaggagcacaggttagctttttgtacactgtttctcaatttggatttgactgatattttcccatcagtcaaatttgaagttatgcatttttggcaagaatatcccagaagtgatgtacctttctcagcacatcacattagggggcatatgatgtcaatatgttgtactgattgaccccaggtttctccactatgaagttactcttttagtcttttctctgtggtaggggtagtactctggggctatgttagaatatcctgtttatcctcaaatttttgtatcatatagcagtggatttgtatagtgtcacatactatacaaataaatacagtatttattgtatcatataggactggatcatgtctgcaacaatgattactgtggtattctgatggtgattttctgattccctcatgattttttaaatgcatgaaaagcaaagaagcccctatcttttcttactgcagtttctatatacaagcctttgggaaatgaatcaaaagtagctgagattaagttggcaactgacacacttttgttaaaactgactctaaaggttttaatgacactgtggccactgagtatttttttcccgggaaaaaaaaaattaggacactcttaaacacaatctgaacattgcccagtgaatgatgtaatgttacatggatcagatcagccagcgtgaagttatcaagaaaagcatttcattgttttctatcagttgccatcattttgtaatttactttttgctgaggtcatggaaggttttcattcttcatgctgtaagaagagaataggcattggagctgtcacacggacatttggttcctcctgtcccttcaacccttcagatgattccaccagcccttaaatgtgactctattagagaaactgtgggatcctttcaacagtcgctcagcaagtgacctcacacagatgactccatcagtcctaggctcccccaggagggcaggatgcagaggggagttgacaggtgtttaatgcatccccgcagggtggtactagttgctgcactgggagaattcatcaatgtacatttcctgttttccaggagctccaaatctgatatgaaagagttataggacaaatgcataatcagtggaagtgcatgaagaaatagctaagtgaattcaggaggggagtgaacttggagttgtgctgggtggaggatgtgcagggttagctgcgaaggggatagtggaggagctgtgctttcaaggaaaaggaggcgagcgggtctcaagcctgagaagcatgaatactgacaagtcggggataccccaagaaggtcagtttgctttatgcaagagggcaggttccatctgatatctagctccctccagcaacatcagacagcattgagagggaccagcgagcttgatctcatgtccaggtgggttaccctgtcctgctctgccagctcacaaaagtccacaaaatccctgtaaccaaagaagcttttaatgggaaaagagctgtcaacaggttcatttctaagaatcaaaaatccctagaaattatcttttttccttagcaaatggaaacattgtaaccagagtatacataattacaaaactatctttttacacccacacaaatctttcatattaagtaataattgatccacctaaattgatcatatcaactgcatacatgtctctttgccttcagttgaagagaagaaaaggtctggatatctaaatgtgggtttagctttgtttttatttttgtgctggaccatttttcaaaccatgatgtctactcagagggagaaaagttccgcaaggccttaagtaatgtggctggttcaggttatgttttaatataaactggatttttatctttatattgggaaacatatgagtaggttctcgatcatttttctgacattttttaagccattagaaatactctggcttcagggtttgtgtgtgtgtgtgtgtgtgtgtgtgtgtgtgtgtgtgtgtgtgtgtttccataaagagaactcatgttctccttggagatttaatagccactctgaagtaatgtctcatatttaataagattttcattacttttacaaactatactccagtaaatttattgattgatatacaatgaagtatcttagatcagatggttctcaataaatagcaagaaggaacgtaacattcagaggggaactaatgaatcacaaaatgcctcactcataaagctaagtaaccttcagtaaatgtaaatgaacaaaaggataatagctcagcattttgtattttccaagtgcttggagcaaccttgtaaataagcagagaccttaaaaggcaggagaggagggagactgctgacatgtaaattactaaatagtgacattgatggcaactttaacttaccctgattccgtcagaaaatctaatcagttctccaggccacaaaatgaaaatgatgtgacattttgctcatcttcagaaaatacaggcataaattcagtcctgaatttaggttggcaagttgtaagagctggattaaaaagctggtgtttacattgggcctttgtcttaagaacttaaagacatcctttaaaattgtcaccttcctttttatccaaagctaagaagttgttgaaggacctagatttgaagttggctcttctcctttccagctgtggggtcttaggggaaatgtaatcgcctctcagtctcagaatcgtcattgatgcataataaacctgagaaataacgtttgtgcaggtgattagcaggaagcgtagggcttccttggtaagtgttgaattcagaagtgtgcagagaaaaaaaaatggaagttttctgagttccgtgggcctgcagagagtctgtagcttttatcactgaccatagagctgagccgaggaagacagcacctgtcagaagggcgggaaactgaagagactgatgacgggctgctgctggatagaggcccagataacctgcagtcagcagaggctcactgctgggcccagggacttgtcgggcttcctgccttgaatagcacatgcatgctcttggtgtggcaggatacaaagaacagtggctaagggaaagacggaggggtgccagttaattcctctagccctgtgagtatcctgaggaaaagaggagagccagcttgacctccaaagcaaaggcctgaggagaagagaagagccagcttgacctccaaagcaaaggcctcagcactggcaaacccaatatttcctattgttataaatatgagatgaaatttgtaaattatataaccttgcctacccgtgtaatttcaaaagggaataattctctaacaaatataaaggagaaataaaaggaaaagaatttctaataaagcaatacatatttcagtattatggaatcaagaactgtgctgtcccatacccaacagctataccaggcactatgatgccttgtttctcctcacaatgagtgtttttatttaaaaggaatgaaacattcagctgaatatggtcagcctttttacttaaaattgacattatgaaggaggagcgaagcctgagtgtgtttacgtatgcccacatataaatagaattgccagtaatgtgatagctccaaatatagactaatgtgggtatgttttactggagactctgacatcctcagtggcactgactttgttgctttgatctttctgaaatgatgacagctcattggtgacgtttcagataaaacagagcagagacattgcttcatttacatggtgattatgtctctggataattcaatgtatgtttgaactgtcaaaaagttagattctgactgggcatggtggttcatgcctgtaatcctagcactttgggggctgagacaggtggatcacttgaggccaggagttcgagaccaacctggccaacatgatgaaaccccatctctactaaaaatacaaaaacttagccaggcatggtggtgcgcacctatagttccagctactcaggaggctgaagcaggagaattgcttgaacccaggaggcagaggttgcagtgagctggatcatactactgcattccagctggggtgacaaagcaaaactctgtttcaaaaaaaaaaaataaaaaactagattctctaagcccacgtgaaagccctgcaggccatttgaaagtttcgtgggcagtggacaattcttcctgtgcaggactgtccttggacattgtgaagtgcttatatccctggttcccacccacagactaagggtaacattctccagttattatggtagctgaaaatgctctcacacgtggctagaatgctccctttacaacatgaccttaaagggatatgaggacagaggtggaaacaaaatcaggggataaatttagctgtattaaagaatggactcaactgagcacagtggcttgtgcctgtaatcccggcagtttgggaggcggacacaggagaatcatttgaggccaggagtttgagacccacctgggcaacatacagagaccgtgtgtatacaaaaaaaaaaaaaaattgtttttaattagccaggcatgatgtgcacatctgtagtcccaactactcagaatgctgaggcaaggtgatctcttgagcccaggagtttgaggctgcagtgaactacgactgggcaacagagcaagaccctttggggaaaaaaaagaagaatggacacttcatgaattcagaattgtcatggtttgcacttggtttctttgaccacatgttgtttttaaaataaaaccccctttaggacaaaaactgccattccttgtttttctgaatattatgctaattattattcctgaaaccatcccaaaaattctgtgtatttctgatggtgtcatttttttctatcaccttttgtatgcaccatgacttagcctcctgggactttaaaagccttgatttttcttgtaattgtctatgctgacctttctgtcttagccaggagaatagatactggtttgatctagtaataggtgattttcggggctgggttctgggtaggagaaactgttcatcatttcttgatgtgatgttgggggctaaagcctcctgtagcagcttccttgtcacctggttgtgacattatcttatttccaagtgggattcaaggtacagaaccatcactgttttgttatctgcttatggatggttttgatcatcaaggggaaggacacagtgtcttgttacctacacgattataactcagtaccataaaaagcatagcactccatctagcacaggttattttaaaaattgcttgtgagactgaggtgttcggttcttttccagctgacatcccagcatccttacgctgaagttttcatcgggcggccacatgtgtggactgttgacctcaacaatcaggaggaagtagaggatgcagtgaaagcaattttaaatcagaaggttggttcattttattccactttccctcctttctaatgtgacctgaaatgtgtataaaacacatcataggtccttgtttttagcaaacagatctttaccacatcagcttaactctggaattagaaaataaccaagctgcaggatttggcctgtggatttcatgaatgttctgtgaaatggaaacagagctggtatcccgatgtgggcatggattccatagaccgtttagacatgaccatggatcccaggcacaggagcaggaactggagtcatacttggttcagtgacctgattatgttgctctcacagagatctgaaaagatagccctgcttcctctacaaaagagggagaagtgcaaggaaatgctgaggaatgtttttatagaacatctgtttgtttgtttgttctatctaaacatgtagtagaattttgtaaaagtaactacatttctggcctcttctgatcaattcaacagacatttgtgaggtacctaccatacacagagtgctctctgagtcacctggggttgtggagggcggggtgtttacttccataatcatagaggaggctggcttcccacctatcagaagtttaccatccagtaaagacgagttcagttatcctttctcccaactcggagcccaccgtggactctcacagctgcactctgctgctgtactttggtgggagcactttttacacttagttgcgatgctttaagagaagccggggtaggcatgtgggagggcaggctggacgcacacagtgtgggttcagttctagctctaccacttactagcagcttcccctcatgtataatgtagggctaatattaccacttgattggtcacttgtgaggagtaaatgagataatgtatgtaaagtgcttaagttcaatgtctacttgtgtttagtgtttagtcaatattatgatttttgttgatagtctaaatttctactacaccattagcaacatgaagtcaggatatacatctgtctcatttctgtatttccggtgcccacgtagggatttacccaatggatagatgggagagaggaatagatgtctgcaagtaagcataatacaaggctgaatatgttcagtgccaaagcaacatgcaaacgctccaggagcggaagctggggaagcctttctggagaatgcagccttttagttaagtcttacaggatgaggagtaatttgcaaagtaaaactcagaagtgggtgcagaaaggcatgggttcaaagcacagtgtgactgaaagggaagaggctggaaaggcatatatcctgggagggatagccagtgtgcccatgtggaggccatcttaccctctgggaaacagaacaggataatcagtttgtggcccactgaactgctgatttcagttaattcagaacatctccaggggagtgagggcactccgatgcattatctgtgctctacccgcttcaaggtggtctggttatggggctttagtgtcagcttcccattgatgatacatacaatcccaatcccagtttcagcagtttcagcagtccccaacctcaggagaccgagctgataaaagaagtgccaaatggaatgtggttcctctaggctgcctcaaaatatctgccacacaccaaaagcttcactactggagtcattcctatggaagggtgaaggttcttctttcttgattctcccagtcccttagtatatgagcttcctagggctgccgtaacacagtagtgcaaacaactgagtggcttaaaacagcagaaatttattctctctgttctggaagcaagaagtctgaagtcaaaatgtcagcagggtcatggcccacccccgaagtctctagctagatatcctcccttgcctctttcagcttctggtaggcctaggcatttcttggcttgcagcctcaaaggtttgatctctgcctccattatcctatggcttctctctgtatgtatctctgtcttttcgttttatacaagattagggcccaccctaattcagtgtgacctcatctaacttgtttacatctacaaagaccctatttccaaataagatcacattcacgggtgctgggggttaggacagcatatcttgtaaaggggtacaattcaatccacaacacttagttaatgcttgtactcttgaggagagtaatttaaaagctgaggtagaagcagaaaagaaaaacacaccaagatacattataatcaaactgctgaaaagcaaagataaggaagaaaaccttgaaagcagccagagaaaaatgtattacatttagagtaataatggtattaacacagccaacttctcatcagaaataatggagaccgtaaaagggtcctcaggagccagaatatgtgtggggcctttcaataggccatggtaaacgttcaggggttttttttctcgtttgtgtttttagttttttttgtttttgtttttgtttttgttttgttttgtttttttgtggttggtttttgtgtgtgtgtggttggtttttttgtttctttctttctttttaagtgttgaggattttataagtatgatgggaagttttgaacagggggatgagatgacctagtttactttgaaattatgaagagaaattacagattctgcttactcagaatcctatggttagtatatggaggagccgtgactcaaaccctggcctcctgatactttctaagaccatttcttattgaatgatgccaagccacatctgtcaggtcagaccatggagggcttctcatggaggctgatctctaaaagcaattgcctgtagaagttgtccctgacttggaaaggtgagttggtactagtggagacaggaaatctcacaaggagggaggccaagaagagaaaatggaggggaagataagggaaaatttccaaggtcagcaggaacttcacagtgcaatctgtaggcatccttcctgtggccctcgccatatgagtaacagtcctttttttttttttttaaacaaagcaggatgcccaagaatacttccttgcttctccacagctggcctagcttgggtttctcaatgactggatgtgatttagcattcttcttcattctgtcccccaaagaggccttcacttgttcctaaagaacttttatgcagaaaactgcccgctctcccagcccccagtccacattaacagctgtcacttcagaggctgtcaggactctgaagagctttccaatgcagaagcccctgcctgccctcacccacagggtccagcaatatagacctaccttctgactcaccgacttccttccttccttccttccttcattccttccgtccctccatctctccctcctttttgcttttcttttataggaaaattgtttgcttcatatcctttaaaacagtgaactgccccaaagcagtgaatgagtcaacatccctttggttaaagtgggctaggttggtaggagaacagaggaggagccatttttctgtatttttggctttgaaccctttgaattaactttctttcattttctaatggattccctttggaaatgttgttggaatggtgcttgggtactcggcgtgcttcctaacataactaaatctgttcatctcatgaaagatgaccatggatgtttatttcactgtacaaatcctactttaacactgataaatgaacccagatatgccatgttctttgttttagatcattccttctatgaatctttgagaggaaacttatctctaggccagcaatagaaagcttctggagtcacccatgggttgagtaaacatcctttaaaagaaaagaaaaaattttacattttgtgtgaagggctgtgtctgggttagagagggaacagtaagttcaaaagcttgagttgacaaggaacaaactgagaacatgaaagtcagttcttcgtagtattttgagctcttcagagatgagctgtctaggaatagagtgacctctctgttcttgtagaatagtctgccatgatattacagtatttacggctcagcctctttgagctctattctgacagctgtaggccactgtggcccacatttgtgcatttgttcagcatttgaagacaattaaaatttctgaaaatcatggttgaagatttcaatgtaatgtgtgatttggcatacgagaaagggggagatgatgccctgagaccaactgcttggctgccaactaaggaatgttatttctgttcattgtcccattttcagcaagcttcaattatagaagttttgcctagttctccaccctgtagatcccagcaaacattttagaggtagctggtgctggtgaaggtgcccctccgtctaccctattgctgagaggagctgttgggctccctgaagcaataatagactatattgctggtgattttctctcaaatgaaatttccattttagattggtaatacacctgaaaacacaggcctcatagtgttggcagacactgtgcagcagagatcaaacccacatttcttccccttctccaaggtgtcacaatattgataagattgcctcctctaccctaatgaagcatcctgtagagtttcctactcccctcaaataaaatcgggctctttagcatagaaacctcaaggcttttttggaaattcagtgaattttccacctcgtctcaccagttcccataatactgagctgcagttacctgctgtcctttcatgttaaagaccacactacttgttcaccaaggatgtcttcagcatcttggccctctccagtttgggcctgctagactcagcctgccttaaaagcccagcatgagtagaagtctgctttgaccctctagcctcccaggaccccctagctgacttcttgtgacactttataactttatttttacaccgtgagttcttcggatataggctaacctcacctacaaatacagaccaaatacaggtcactgtcacggatccttcagttgctcattgttgccttacagcagtgaccatgcattcattcaacagatgtttgctaatttcctatatgtgccacactgtgctcatcactagaatgtaaagatgacccaacagcatggactctgccctgtggaaattacctgctagcaagtgataacttccatcttttgttgaatgcccactatgtgctagtcactaaactaagcaccttttttctcccagataatctttgcagcttaaaagaggtgagtttttcttatcacccttttacatatgaggaacctgagacttagagatggcaagtcatttgctcagagtcccacacctagtaaggatcagcttgagatcacgacttgcaagtccatagtcaaccctcatgaggccgactcctggtgttagcacccgtgtattgagtgagtcggaggactgaggaggtgctacatgttctctgtccttctccttcatggtatcatgctctgtttccacagattgagccatacatgccatatgaatttacgtgcgaggggatgctacagagaatcaatgctttcattgaaaaacaggtaaggcttatcagaagtcagtctgtctttgctgtgtactgcttcctgtgacgccatagggctctcaagaacatttaagagctcactgtgtttctgtggctattttcctgctttgggagactctagaagctggataatagtagcactgtcatggtcacccaagagaaccagtattcccttggagtaggtatgttcttgatgacagtgtaaggtgaaatggaaacttataacaagagagatgggatgattactgtgaagatgcccctgaccatcagggtctgtgccctgagtgggttctgaggcccattctcaccttaagaaaggcaagaattgaaaccagctttttctaagcattattttaataatacatgttcagcaattctaaatgttaggactttttagaggttttcagacatcttctaaaagcaggaccctttgtcaaatgaaaccttatatgtatataaaacagataaaaagcaggacaaagccaaggagggtgccaagagttccaccttccccaacaaggtttggaaactgcagcatgtgctcctagaagtaaaggccaggagcctgttgctatcattttatagcattttaattccttggacttcaaaagcaacacagagctagaaatagacggactcagaacccctgtgggtaggagaatatgaactctttgactagatcccagaaataaggtgctcttcctaaaggataaagcattttttaaggcaatcaagggatctttacacaataggggatgaggatggtgcaagctgaaaatagaaatggtgtattgaaaatctaagtaggcccaaggtgggcttcaaaggaagagttgatggtttgaggagactgaaactgtggcgagcagccagcagccctgggtgctgctgttggagctgggagccgtggtcatatacttcggggtggtgtgtctgatatgctgagcttttgttagcagcaagagagcgcgctctgcagccaggccatgtgggttttactcctggcaccatgtgtttctagttacatgacttgggcatgttacttggcctctctatgccttagtttccttgtctgtaaaataaggatgatgctaatagggcctacttcgtagggctgatgtgaggatttaatgagctaatacatacaaagtgcttagaacagagcctggcacatacatagtgctcaataaatgcaaactggtactgttgattatttaatacattatgctatattgtactgtaatacactactttgtagtataattatttggtttcacgagaaaccatttgaatctttatctcattcagcctttatatgacaccagaatgacagtatcatcacaactctagcaaccacatccatacagattttgtgccagcatgtgccagacacatcataatataacatctaattctcacagtaattccaggaggtggtagtaataaccccattatctggatagtggaaaccaagactcacagttatcaggctcacagattgtggaatcaagatttgatacagtttgatgtgaggccaagtctacaccaaccatgcttaccagggcctcaggagacagaaggtgtccagagctttgcttcccgtcttcttgcatcatcaagggctgctcacccttcctgcagctgcaaagaggagttgcagggcctccttcaattatgggtcttaagacatcacagctcttgccgccatctcggcagctctcttgagatcatactaagatccctgcagctgctgctgaaaccctctttgcctgtctccacgtcctcttagggaaaatagttacccaactgccaggcataaatgactcttgatcaggtttatttgaaggcttttatttctcccctgaggctcaggaattccagccagtctttaaaagttaccaggtcctctgtaagccttgctgggcttcctttcaaacaggaaggtcctgttcaccaaatagaccttgctaaatgctccataatgcagaggctccacctggcttcacctctatatccctagtaacctgctggacacatggtcggtgcacagtaacttccaggtgacagaaacaatgaaggaaggaagggaggaagggagggtgagtgtgctttttattcctgtgtgtcaggaaccaggaagctcatcttggacttcatgatttggaatacatgttaccaaaattgtctgctggaaagcatgctaataaaactgcaccgccccccacccccaccatataggcctttctgcagagatctgcagttcacagaaatccagaggtttcttttttgcctgctgttgttgattcattcttctactctgaattatttgtcagctggaacatgccatgggctgtgtggtcagttggggaggacaatagctccaggtccccatccctaccctcaagtagctgcaagtttcatggagaaggcagccaagtccacaggcagtaagtgccactgctgtaggttcagcctggtaatagtgaagcaacaggatgcttggggatcacatggcccagcccgccgagggaggacgggggagaaatggtagagtgtatctgaaggcatcttgcaggaggtgagtcctgaaggcaaactggtagcacagactgaaggctggacaagtccagatgtgaaggcctggaggggggagaaatgtcatggggaatgataggcacttgactgaagagagggatgaggtaagagaccaggctggaggaggagattgcagaatgtgaaaagacgctgaggctcggctgaagaattccagtttgattctgggataataggaagctaaagaagggctttgtcgcaggctaaggggcagtggaactgtcagatgggtgcttagaaaaatcattccaggaatcttgtgttaggggcatttcttattaaacattctccaaatgttcctaaatgagcaataaagggggcctattttgagtttatctcagagattctattgaacccagaatgttcctctgatgccagaaggaagataggaagccaagaccccattggttcacagattgggtctgctacctcttttagctccagaccccagtgttttagaggttggagtattcattattttttgcagctagacgaatatcttcaaagggcagcgaggatggagaggaggtgttcctggtatgaacaagaaagcctgcagctccgaggaggcccttcccatcccttgaatggtaggagcactgcagccctaattaggccaatatctgccttcagagttctccatgtgatctgcaaggagaacacagaagcttttaccccagaaacctttcagggttgtccgtcatgctcagccaaggcagtgggagccagacggagccaacagacagcaatcgagggcacgccgggcttcagtgtgcagttgagcagtcgccagcaggaaacccacctcatacccagtcctccctgggtacaggcacccaatgagaaagactcctggatctaggaaaaccacttgctcttttctcttaatgtccccacttcctttactgtactgaaaatgttgattcagagtgcatgctcttttaaatgagctttctcaaagagacgctgtctccagcagggagaacttctttgtaatctaagatcaagcactgttgttccctatcctcagtatgtgtgggcttgttaaggttttcattatgcatttcttgggaaagtcttttgtattagcctcaggtcagagagtatagcaggacttttttgaaggaatggcaatttcagattgatttattaaaaccatacatatgctcttgaattatattttctgtttcctgtaaagacactgtaaatatatagcatggtcacagtcatgttaatttgtaaagagctgtgtgattcatctgagaagcattctggagagagggagggtaaaaaaaagagttaactccaacaatggctgtggaatcagctgaaggtcctaggatgtctgttcatcagagcccagaataagcccactatggagtgttctggatgcaaggacaagcctgttatgaatctggatagtccaaaggtgggagcaatggtagaggtgacagattgcaaggaaagagggagaaattgaaaaggggagaaggttggtactagcttgaggaatgtttactcttgagaaatcaatagcttttgtttacccagcctttcctgcacccagagagactaggcaggtaatgattaagcacagaaccctagcagctgactgcctgggttcacatcttagctctgcttgtcactgtgtttctgaccttgggcaagttacctaacatctctatgctctttcctcttctgagaaatagggataatgcaacctacccatcaggctggtgaaggaaaaggtagtttgataatgtttagcactaagaacaatgcctggcccatgtgggtgctctcaaagccttcgctacgagttgccgcaggagcccagaaaccaaccaaggtgtgtttttcaaactggctcactgaggtatagtttacagaccataaagttcactgcatataaggacacaattcaattttttttttagcaaattggtagtgttacacaactaccaccacactctagttttgcagcatttccgtcaccccaaaaaactcatttgtccctgttagcaatcaatccttgctcccaccccaggcctaggaaaccactgatctgtttcctgcctttttagatgagccttttctggagatttctggctttcacttagcatgatgttttgggggttcacccatgttgttaaatgtgtcagaactgattttattgctgaatagtattccatgtatgtacagattaatatcacaatttgtttatccgttcaccaattgataggcttttgggttatatccacgttttgactaatgtggtaggtgctgttgtgaacattcacatgcaatctgtgtatggacctgttttcgtttctcctgcgtagactcctagaagtgtgtgaataaggtagatttctgttctggctcttcaaaggtgagttttttgctcagtggaattttgcatgtgtagagataatccatggagattgctgcctactgctcagttttataggcaccgtcactgtttcttttgtggaaacaaaaattcacactcacttctgggaaacaacctctggggccgtgtgtggacacagttcactgtgttttaagggaaagcacacgccgagaatggtcggtttcagcctggcacctgaggtgtgctaatccagtcagttactcaatatttatggaacacttcctgtgccaggccctggatttctcagctgtaacacagataaccaatatgtgccttatccctcaaatagctgaccgaacgggacccaaaccccattttcatggtcctacctgtcctaccaacttttttttttttttttgccaatttctggtttttcttcctctagatcctgcctgcagacatttatatttgaacctgtgttcttggttccagacaatgtgggttcccaccaaaacccacttgcaccgaactctcatgggcttattagtaactctgtgaaagagttggctgcagtgggtggggtgaggggtttctggacccccttcacacaccacttagccctctctgactggcccttctgttaccactcctccgctttgctctgaacaagtgaccctttccctggcccagcaaaccaagagggcgtgaacaagccagtcccgctacctggcgcttctcccagggagcattctcctccccttctctggccccttctgtatttttatggtgttttccccaggctgctaattaattagccttctttacaaaggcggtgctctcacctcttcttcagggttggctgtgttcatttgtttagaacattgttccgtctcataaattggttggttattagactttttgttggtttatgactactgcatggaaatttcaggatagtcaagcacatttagagaaatttggtgactggttgaaataattgttagggaaggatgcagatgttctgtgttctaagcaggcttgttaaccagattggaaattactgtttatatctcatttttgctgcataggagctcgttgagttagaatagtttccttttctacttctgctactgtcaaagcctcaagatgcaaaacacattcagtttagttgagcagctcctgcagtctgttcccagcaccagctatctgcaaagcgccatgttagaggtaagctgctaacttccatacagcctacaaaacccagatggccttccctatctcctggaagccttctctgactgctaccaccactttccccttccctagagttaatcttttcctttctgcaagtggcctgcgcatcctatttgggcatttgtttcatactgttcggtaattttttagcatcggcctctcttactagactgcgcactgaacctctgagtccagggactgtgtctccttcatgtttatatttccagcacccagtgggagactttaatagtcattagtaaagtactgaatgaatgaggaaaccttcaaagccagcttacatgagtgtttcatggggatttgttgaacagagatgccctgtctcagggtctcagtcccgtatctctctcctgtgctgttgcggcagcttcctgtctctctgctgctgctttgctcctgcagtctgttcccagcatgcagatcccgtcacccctcttcccggaaatctccagtgtcttccatcttacttcatggaaaagctagagcattcaattagaccccaaagatctgactcccagggccctcctgaaccccatcacttctgacccataatatacacactctaccaagctacccagaagcgcctgctccccctggaatgtactcccttgtcaaatcttctgatctagatgttcctctgcctagaatgttcttcccagatgcttgcatggctcacttctttacttcctcgtgtcttttcccagctgccaccatttcagtgatgccttatcaggacatcatctctgccaacagtctcacttcattcttttctagaatacttaccaccttttaatgtactatatatattgacttatccattgtttttttgtctccctcgctgaatgcaagccctatgaaggcagggatttgtggttcctctggttcatcatcctttccctcacactccagggactagattgcatgtcgtcatggtgacagccaacatgcagatggtgtttttgtgtcaggcgcttttctgagcatgttatacattatgattaataaacggaggaggtaagagtccaccaggcagtctgagctctgagcccttatgcttttctgcctagtagcaagtatttgttcaaagaatgaaggaatgagtacttatgataaggagataaggcaagttggcactgccttattagcctgtgttgcagttgaatgaaacagaggattcccagccttctctgagcacccaatgggactggcacttatgggagagaagaagctatgacaggggcttccatttcagttgtgccctaaaagcagctgggccaaaaggtggatcttgtggatgtaggtgaattatcatatgtaatcagccaactcaacttttacctccagactcttgcagcaaagaatggtcaaccttggaacattatctttaacatctcaaagttctttcttatcagtcacctcattttcttctcacaggaattagataaggagggaaggacagatggcatcatcctcattttatgtgtgagagcaggcagagctgaagagacatctatgaagtcccacagctgggagccagaatcctaacccagatccccagctttctcctgccaccttcaggcctccctctgttcagtgtgatcatctttagactctccaggtggcagcaagctttgagaagttcctgctgctatttttactattcctgattctgttgacccccaaaacagactgctgagaggatgctagaccatgctcctggggagcaccagaaagggttcctggagctccagtgttcagctgcaggattgaactaagcacacctgttgagggggaccttgagaggggaggctgctgtagtttacaaagaaatgaacaaatagggcatatcagccctgcagtgcagctttaaggacatctcccatggtttgggccttgcggtgccatcctgccctgctggacctgaggtgcaaggtgtccattcatctagggctgccccagattctgcagatgtctccaatgcagtaccttggaagctctacggggcacaggcagctcttccaagaagggctaacaggtggaaaaggagcatttatggagcacctgccatttgccagcattctgctcagctccatgtcttactatctgttagcctcactctttgcagacaagcaggagatgagaccagactgggtaacacacccaaagcaccacagtggtggggcaaggctcccagtctgctccttctgacttgaagcacattccatcgccatatcactcatcacttcctccttgtcaaacaaagcaagactctgcactagcttcaggcttttgttttgttttttgacacagagtctcgctctgtcgcccaggctggagagcagtggcgccatctcggctcacggcaacctctgcctcccgggttcaagcaattctcctgtcttagcctcctgggtagctgggattacaggcgcgcgccaccatgcctagcaatttttttggatttttagtagagatgggattttaccacattggtcaggctggtctcaaactcctccactcaggtgatccaaccaccttggcctcccaaagtgctgggattacaggcatgagccaccctgcctggcctctagcttcagtgttaacctttgtgctgcttcctgtaccccatgaggctgaacatgaataagaagccaagtttctaaagagtcttcaaactcagtaggtacagagatactgccctcagctgtttgtagatgtcatgtaagtagagatgttccacagttttcttgccagccatgaaagcctaaacaggagctttcagccttcgtgggtcttcattttcccagcctaatccaggactgggtcaagccaaatccaaggtgcagagagaaacattcccacttggcttcttctgatgtaaatgatgtgatctggtctagatttcccggttgacttatcttttctgttcagtcacatgatttggtgtatgtggattttaaaatctctttattataaaatttaaaggctgcagaagttatccagttgctcctaaagaattacaggttgagcgggctgacatggtggcttacacctgtaatcccacactttgggaggctgaggcaagcgaatcccctgaggctaggagttcgaggtcagcctggcaaacatggcgaaaccccgtctttactaaaaatacaaaaattagctgcgtgtgatggcatgtacctgtaaccccaggtactcaggagactgaggcaggagaatcacatgaacctggcagagggaggttgcagtgaaccaagatcatgccactgcactcctgcctgggtgacacagcgagactccgtctcaaaaaaaaaaaaaaaagatttacaggttgagtatccctaatctgaaaatccaaaatgctccaaaatctgaaacttgctgagcaccaacatgacactaccatggaaaatttcacacataaaagtactttaactttgtgtaatgctcaaatgtatttaaaatatttttaaaaattacctttagcctccatgtttaagatatatatgaaacataaatgaattttatgttgagatttgggtctcatctcaaagatagcttattatatatgtaaatattccaaaatctgaaaaaatccaaacacttctcatcctaagcatttcagataagggatattcaacctatataaacaaagttgcttgcattagccaaccagaaaaacaaccaaaaaacactttaccttttccaatgcccatgcccccactcagctctgatcatcagtaactccattgatcactgtgtgctttcattcttcctgtctgatgacagctgtcccaatgggatgggcagagtgtcaaaggccagccagcaggtttcctgtcacctaagaaagcaacggccaccagtgatcactgtgcccccattcagggtctcacaggtctgtacagtcatgctgtctgccttagtagcagcattcagactcaagttacgttgcgacccatggcttaacaggggcctggattgtgatgaaaatcaccatgaatataaggagtcatttgagggtcttctgtctagttgtctgtctctggtggtgcccagggctgtatgggtcctggggcactctgcttacccactcacccactgtgcatcattttcagaagagtaagctgcatcctaatatccctcaataatccaatatgtttcttttcatctctgaattattagaccttcctggaattctatttgcagctgataggaatccaagttctaggtttcctgccaactcttcagtgaagcattttgctcattaaccaccaaaactcattcgggctggagtagtcaaatcccctcatcataggaacacatgagtggagggcaacagtgggtttgcctgccttgttggaatcaggatccttgatttaaggagactctaagagaagctagcaccaagtaacctagtagtaacctatagttgcctttctcagcaggcaatgcctttctcagcatttcctccttcaaggagatgggaagaagcaataaccctaagaaatcatcagtatcatcatcttcctttttctgatgaggaaactaaggcttcagactgttaggtattttgcccaaaggctcacatagctggtaaaagcaagaggcaggatgtgctctcagggccagctgcccacagagccttcggtgggttttgctttgctccttcttactgtcttttggctcattaaaagtaacacaaggccgggcgcggtggctcacacctgtaatcccggcactttgggaggttgaggtgggcagatcacctgaggtcaggagttcgagaccagcctggccaacatggcaaaacctcgtctctactaaaaatacaaaaattagctgggtgtgggggtgcacacctgtagttccagctactgaggaagctgaggcaggagaattgcgtgaatccaggaggcggaggtagcagggaaccgagatcgcaccactgtactccagcctgggcgacagaacaagacttcgtctcaaaaatatatctatacaagcacaaggttaaaaaaaaaagaaaagaaaaatggcaacagtatgccctctggatgcagctctgggccagcccctcttctggtgctacacccacctccatgccaaggggcccgcctggcagcatgagaccctcatatccctgtggtggcattccacatgacagacaagggagggacagaaacatttcctcggcttgcgtcagtgctaggagccctgggccctgagattactgatcaactcctcctccgcacagatctggaaaggaaacgtgaggaaaagtaggctactctagaaggacacacattgaaaagtacatctccttaccactcctggtgctggtactccatgttactgctcagtggcagtcctccaaccctctcctcacccccgagtcctccttagacctgctggtttcctctattccctctagatcccagggtcaactggctctgccccactcggagcacttaacacacattcttggtagggggtgccatattcctgctcatcctatcacatgctacttagacttctatttctccagttcttgaatatacgaaatgttgtacagaagatcctcaaataatgtcattttgctataatgtttagaatgaagaaagttgattcctggtcgggcccactgtctgtgtggagtcagcccattctccctgtgtcttcatgggttttctccagggtctctggttttctcccacattccaaagctgggcacctgaggtgaactggcgtgtctacatggtcccagcatgagtgagtgggggtgcgcatgaatgcaccccgcgatagaaccatgtcctgtccagggctgcttcccgtctggcaccctgagctgctgggataggctccagccgccctcaacactgagctggaataagagcgttcgaaaacaaatgaatcgatacaaattattgtacaataaaacttcataaagtctacgataatcatacacatgcaagaaatcagaagggaacagaccagctggtggaggcaggcctgattgcggtgccatgttagtgattgattgatagtgaattatgaggtgggaggaggcacttcttacgattttcacttcgcaaatgtgtattcctcgattgaacccaccaccacaactgccgtcactcactgattcaccaaaaattgagtaaataatttatcttatttgtatttattcatctttcttaaatgtgtgtatagctcacatttgtttcaatgtttaatattagaagtgttttgggtctttatttagaagtttggtgatgttttttgacaagaaatgtaccataggaacttaactcttgttaatatcaattagcctgttgtaaaattggtttctttatattgtcatttcgcttaacgttgcagtttctgagagactattgacgacactaagtgaggacttactgtgcttgttttcaaccaaccagcactaagtccctaccaaagacacagcaccatatgaggtggtgtcagaagtgtctgcagtctccttggcgtgatcttcacctcacagcgtcagaaccttgccattgagataaaagtagcgcttatgaaacagtgtcgtattaggtaactgccaagatagggtagacacagtgcctttggaatcagagaagagaacagaccagctggtggaagctggtctgaagatgggccttgaagagcagaggctctaaatagcctggctgcataagtgttgatggtgatgattgagaatagccacccttcacgggcaggcgtggtgccaagctcatcacaagtatgacctctcatcctggagccctttgtggaaggcactgctgttggtccctgtcttgaggttgagtaagctggtggttagggaggtcaagacctgggctgaaggcatattccagctgagccccaatccagcccatccatgtggctcccaactcttccccgtccctgtgctctcccagtgtgccgcctccattgctagggtggttggcagggctggggatccccagctgtatccttggacctgtggctgatggcttcattgtcgttctaggacttctgccatgggcaagtgatgtggccacccctcagcgccctacaggtcaagcttgctgagcccgggcagtcctgcaagcaggtgtgccaggagagccagctcatctgcgagccttctttcttccagcacctcaacaaggacaaggacatgctgaagtaagtgccctggggtgggggtggggactcagcccctagactccagctggccttgttgggtagtcaggtgagaggtacaggtttcctcttccaagctactgggctgtggggataaggtgtgggaggggagtaggttgcagcaggatccccctagagagttagcccagtgttgttaccgttccttttgggtgagatgaagtcacctggcatgatgatgtgtttagaatttaaatgggagtgttgtatttgcataaataaagctgtatctgggtttgaagattgtgggaggtgttcggcttgctaatgttgaccccaagaacagtgggagtagaggtgggcacagagccacaggtatagatggaccagctcctcagacccctgctggtagccaggcctccagcagagtctgagcagtgcaaggggctggtggcaagtgacattgttcaaccctggagtcagaaaggaatgagaaacatggagaaggagccggcacaaaactgcccacaacaatctccaagagcagccttctcctgcggcctgttcccttttgcactttcttctagctcactgacacatggtgcatctcaggccccagcagacctgagtctgcggggtctcttggtaatgaggcgagtgtggcactgggaatgctggcccagggctgcacaggggaggcgccttccttgaatttcttaccttgtgcttgcattacttagtggcacctttcctttccctttgcattggcattttgagttgggcatttgcagttcccaaatttccgtgtgaggtttcttctggcctctcacccatgatctttgacaggcttgaatccattctctcaatttttatcacaccccaccgtagtccacatattgcataattatctagcctccccacccacccaccaccttagtagctctgattaggtgttttatgcaagagactagcctacaaataataagaccctgctgtcccaactccagatattcgatctagcaggtgtaccattccaggcttgaagaggatgtttaggaagtggagtggacctggggctcagggctcacctgtccctgttcaggcttcacgccctgttagtgctgttgtccactgttgttatttgtgcaccatggtctgagttggcctgtttcttgtgagtcgtcttatccttaagtgtggtataaaacccttcgtagggagagtgtgtggcctcttgtgtcctgcctgctgcagggaagctctcatgagtaggggtgtaagctatgtttttttttgttgttgttgttgttgtttttgagacagggtctctctcttttgcctaggctggagtgcagtggcgcgatcttggcttactgtaacctccacctcctgggttcaagcaattctcacgcctcagcctgggacaaatagctgggactataactgcacgccaccatgcccagctaacttttgtatttttagtagagacagggttttaccatgttggccaggctggtctcaaactcctggcctcaggtgatctgcccgcctaggcctcccaaagtgctggtattacaggcgtgagccatcgtgcccggccctggtgatgctatttttttcctggtctttttatgagaagacccaggcacagaagctgccctgattccaccatgaaaacaaaagcataggtcaaaagtgggggcttggggcggcaccctgctctgccaccaggcaagctttaggagggggcagtggtccaggatgtctggaaagcctgtgatggtactggaagtttccagttccacagcgcaaatcttgaattgtagggtcctgtgaggggctttccatgcgctccttttgcatatagctcttggagtaaggtggattcttgagaaccctgagtctgtctgcatctgaagttggaattcactagttacagactagggactgtctgcataagcccacttctggaagaagagatacgagaagccgcatcctgggaatgggtccaaatgggactcctgaacagcacggcttccttcctggccaggcaggagtcagtgctcttggcccagggactgtgctcagggtctggctcagagctagcatggggccctacaaaggcaggccacctccaggccagggtccaggtcagggaaggcaggaaggagaaagagcaaatggccactcccctcagttctgccagttttctcatctgtaaaatggggatatcctaggtgataggtaagataatgaacagcccttgccaaagacagagtagaacacccctttcttccagagagctttgggcagtggagtaggcccgaggccactgagccaagacggataagccagccccagccctggcccctccccacctccgtatccatgcagagttcacgagagcaaaaggacttggcgtggggctgtcctgaggccaggccctgtgccatgggatcgctggaccccacccccacctcctaccccactgtagagatgcgggctttcttagcaggaggctagaatgaatgctaattttgcaataaagccgtctgatattaattctctgaacataagaaccctgctgaataacttgttcatgcatttgtaaatactgataatgttgtaaaacccctgctatctggcagtctattgagtgcctcctcagtgtggaggtgatcctggcccatccatattcatagccaattagcaattagcagttcctgcaagccagtgctgcctttgcatctccaacttggagcctgctttgagctaagtttaagttcctttttcagtctttgggtatccatagcgtttaagaaccacctgtcctcactctatagtatgactttagtatatcacatcaggggaaccctttggagtgtcctgtgttgtcttgaatcagggccattcaggaaaccagcctcgagttcttgtgcatgcagggtgcaagggcgcagttaagcactgaagaggccaccgcagagcacgcatgattcaggtgcgacccacatcctctggacaagtctcctcccagactggggtggagactggaagatgcaggctccaggaagtgccagggtccattccagtggggcccagtggagaggacctcagttccatacacaggaacatgtgttcctgcccagtttctaattttgctacctcttaaagttgtttcttctacaatgttaaattattggcaactggggttgctctgtgcaaagaattctaagcagtacagtgtagactgagtgctttggtacctgagagagggaaggtgacccttagtaggccacctgctcagccccgcaccatgttgctggggaagacagtgaccccagccccatcaggcagggccaagggcagaagtcatccagggactctggcaagaccctgaactttttggtagaaggttctgatttggtaatactcctgctgcactcagagcagcccagtggagtctttgccaggtgggacctggcaaggcagagctggaatgaacagagccctcaagagagggggctaagggagggaaggcactcaagggaaggggcaggagggaggggcgggagcagcaggtgagacagcagcactcgcctcctgtccagcgcatcctgtcctgtgcattataggtctgtgtcaggaagggactggtgacttctcagcccagtgcctgtgacttcagtcacagcgtggtcagccccattggagggaggctttgcctttttttattcttcaagagctataaactgtaaactgagacctgatgggcccagaaactttaactaccatcctgtaagaaactaggaagaaaggaaaggaagatggcacactgcggtggggtctctgagcaggaggatgtgcttgtttgtgagacagacactgcagggacagagaggcagacatagcaccatgcactgcctggaaaggcagggaccccctaggggttgaggatcctgggctgcagaggctgtctggtctccatgtgctctagcgattggggaaagctgctttgcctcactgatgacctttgctcccaaggataatggagtcaccttcctgactgctcagagctatgggatgggcacatgcatgccagtaaaaggcagagctcactgggggcttagaagacactggggccagggggttggttagagccctgcattccacagccgaatccatcagttgaacccttgaggagctgcctggtgtcgggtctcacctgtggcctggtgaagcgtctgctgcttgagcactctgcggcggtctctgtgcatcaccccaggcaggcttctgctgctgcagccttagctgaatcctgctcacagacacacgctcatgtgtgcttctaccccgggagatggtggcctagagcctgagtccaggtgacccagggagcgagcaggagggtttttcatagctcctgacaattatattcctcgccatggggtctgagagtcgccgtagagatttctatgctctggttagcagtgtgccggcagatggtttaagtaaagccacagcagctgctgtaattcacccaaaaaaaaaggtcataaatataaacctgtatcccaaggtcatgttccatatgtaaacttgtcattcagaattgagttccagatatttttctctctgttgtccagctgaggtattctgtgaaggagctggtagctgcaagtctctgactcatttttccttttaggaaatccataaaaattgacttcctgccctctcccttcatgattcatgaccttaactccctgggcattaccatctcccagctggcatcaagagcaggggtggtggggtatttagggtagttgcagtgctctcccggtgactgtgggagcaagagaagagagtcccgctctcctgagcaggtctgggctcctggtgcagttcacacgtgcaggaggcgccgcaggctctgggggagggaggcctgagcaccagtgacatgctgagttccagaagcagttggggcttcagctgcaactgagcaggagccaggctgacagcctgggagatctcagcagaagccccagcagatgtgcggggaatcgcaggattaatgttggcaaggggaggaaggccccaggcagctggttagctagagaaagacagggcaggagtaggagagaaaatgatgctttacatacacatacacatatgcatacgcatgcacgcacacaaatgcaagtacataaacatgctctacacacatgcccatgtacacacacatatgcatacatacacatacaagcccatttggaagcttctcagaggcaacgagaaacctcaggctccccatcctcatcccctccgtgtcagcagaaaaatgagacttccatgaaccaagtgaaatagaaatggttggtgtgtaaattcataccactggacaagcaagtggggaggtggtatagcccatccgatgtctgccaaggcagggtgatgacgacaatgaccacaatcctgacaacaatgatggttgccatttatccacttacttagagcttgactctgtcacatgctgtagaagcactaacttaattcctgcagtaaagaatcatttatccccattctatggaagggaatctgagccacagagtggctcactcatttgtccagggccacacagctcctaaaagacaaagccaggactcaaacccaggtctgcccgtcccccaacaccactttctctgatatcagatacagcatgggttcccacctcgcattcatgcaggacaccaggtgaggccgctgcctccttcaggaagcaaggtggatgggagcagtcatcccaagtgggagggaaagatatgagataagaggccaaaactgttgggaatggaaacatcagaatatccttggcccccctacgcagtggtcccagccaaaggaagcaaagccaccaggctccaccgcctgagaccactcagctgttgggagaagatggcagaagtacagggctggggagagagggcctggattcaggccgtctctgcacatcctgaagcctcagttcaccttcctctaactggggttaccattgccatggcttaagggtggctgcaaagacccagggaggcgatgccccaggacagcaccttctgtctgatagctttccagcaagaggctaaggccatataacaggaattctttaaagcctttaattaaaaagttaaacatacttaaagaacgtaaatgatgctgagctttgccccactctcacttcttggaagcagccattgctaaggcattagcacatagccgtctcgacttgcagccttcacctcccgtgtgcacactgcgggctggttcccctgtgcttcccattctgggactcacctttccccaggatgactctcctgctcctctcttctccctcattctttttcaacagctgcagagaactctaaaagcacagaagggccatgatttatttggccattccctgcttggtgagtatttgggttgtttccagtttttctccattgcagacaaagcttcactaggcagcctcaaacacacacccctgcacacactccctggtgcacacatgccttcctgagtctagatgcctagaggtggaggattgcagacgaagagggtgggcaccatttcatttctaaagtaggacaagacaactgaacatccccccatgcctcaagatgggggctcacagggccagtgacgaggaaaggctctgtcccttcatcaccaacacttgtgcctttctcttcctcttcaggtacaaggtgacctgccaaagctcagagctggccaaggacatcctggtgccctcctttgaccctaagaataagcactgtgtgtttcaaggtgacctcctgctcttcagctgtgcaggcgcccaccccaggcaccagagggtctgcccctgccgggacttcatcaagggccaggtggctctctgcaaagactgcctatagcagctacctgctcagccctgcaccatgctgctggggaagacagtggccccagccccgtcaggcagggccagggacagaagtcatgcagggactctggcaagagcctgaactttttcgtagaaggttctgaattggcattgcccttgctgcactccgagcaacccagtggagtcttcaccaaaacaaaacaagagcgtatgtcaggccaggagcctggcttgtccctggcacaacatcatttctgtttctcaaggagcaactgtgggaagactgtcactgcagctgctccagggcaaaagaaagtctcaagagtcctttaaaacaaaacaggaggaattgagctgatgggaaagaactctgaatgggaatattcctaaacccattaacttatttattcgggtgggagggaggggaccgcgggagggagaggagggattgatcacaggcttcttttatttccactgttaatcatccaccttcactatactgttgttctgtctgctttgggcagggtgcaggagagagaccgtgtgccgtggggctggtggcctgctcagggacagccatggggacctggcagctcaaaacagatggcagcagaacaaaagaaacttttgctttggaagcacagccaaactccccagggcatcgtcatagatggcacctagagcatgggctgcctcagtcagggggacgtgcctgtgttgtccagagagcccagccagggacgaaaaaggagatgaggcccctttcctccatgtccccatgcccagacacataccttggccgtaatttcttttagaatccctttgggaaggaaatacaggattgagggattttggagtttctggtaaactcaccctccctccagccccgctatgaggaggaaagtagagatgaaagactcacgctgttcatggacttggagaggattatctttgagccaagatttggacaggagtgaagtcggtccttaagaatttgtggcgcgaccggagctgggctcctgacaggtgggcttgtgttgtgtcccctctgatggcaccaaagtccagggaagggggctcttgatgtctgctgggggagtgggggcagctcaggatgaatgcagtgccctgtcctggctactcacctgagggtgtagctcgcaaaggtgggaatctggtgctggcttttccttcaggcaggatcactctgacttgttgagtaatcagtcatcaggttggcctggtcagacacactggaccccaccttccaaaccctggacccccccatgctctgcctttgtataagttcccaccccactgaatcattgctgccatgctctgtacaagtttgtaagtttctgaaaagcccctgacatctccatgctgatgcaagtgagaccccttctgcctaatgtgagcggttggcgtcctccacttggcctctgctgggcgcctcagtcgctcaatgatgtgctctgtgccggggcttccaagcacccttcctgctaacagagggcggcccagtggagcctccgctgggcagaactgatgggcaaggcgtaatggctggtagctttcagaatgtgagggaaaggaagaattccgcttcatggggactagagttagtgtggggcctttaagtctgggaagttacattctgcttctttctcaattgctacacaaatgtgcagccagccttttttcttaggcccactgagatccctgctcagtgcgtctcaattgtatctccagtctaagaggagggtggggggcacccggggcctcctccactccttaggtggcccccaagcacatctgccaggtagagtaccatggggaggcctctgccctgagcatcatcacaggggcgcctccagacctggctgagaatagcctctgcttgggcctaggaagaagggcagaagtccaaaggaaaccttggtgagtgagtgtgtgtgtgtgtgtgtgtgtgtgtgtgtgtgtgtgtgtgtgtgtgtatgagcctgtgcatttcttttaagcaagggcagtttcctgcagtaggagggcagatgactggcatccttgctgtaaggaagagctttttccttgtgaatgggcctcttggctgtaccctagggtgtgggaatttgctagagttccctgacctgcaatccctgggccagtgccgccctctcctgggctcttccaggagcattgaacactgaggatgtcaatgcaagtatctgaccaacagggggagcctgcaggccgagcaaagtttaacccacttagccactgctacttaagcaaggaagctgaaaggtaaccttagccctgccttgtgttccaaaagctgcaaggatcatttgctggctgtccctaagttcaaggcctccctaccttccccttcttttccaagtcacaacccgccctgcccgggccagacagcccagaagaacacttttctgccatttaaaaatccctctttcatcccccccagtccagtattgagtggaagtgcgccggagttccactgacagggcagctgctcttggagcaaacaagcccacactccagttgtttagggcattatctgaagagtcagtgacccctgaatgtgtactggctcccaggcctcctcagacttggcccaggtctagtcagtgatcctggagaggaaactggggagggggcttccaactgccctgcatggaagaggagaggaaggtgcccctgtgtgggctggaagcctgcggaggttttgccattgctgatcttgatagaatcctaaaccgatttatagctgataacagttccatggggagagaaatcctaagttatgattaatgtttttccccgctataatatcttgcctgtttttttggattattttccccattgtgatcctaagctcttaaaaaacttgagggaaaacattcatctaatttactaaaagagaaagctttccattgaaaggtagatactttgaggagtaaaaagacttctttgaatgctggtaaacaccgcatttattttgtgtatgcagtttgatttgcacatgtataaatggagatgcttttcatttttgtttggactgggtttgtgtcactgctcattacagtttgcttttttgtgtgtttgctgtgcgtttggagatattagtcagtttctttagtgatatttgtttccttgatgtgccttttcgtttttctttggggtttttggaatccggatgctgttgaagggcaatagcagactcctccagctaagagacaggacatgttcttgagccactgtagctgttgaagctggacaccagacgctccctataacccccccgccaggccatagcgtgtatgcatgtgcacttccacccacagaggagggtgtgaagccttgagaacctcaagaaagggctggattctgccatacctttgggtctaccttgggactgctggttgccaacgtgtcaaccagcctgtgttccctgccacccacgcacttgctgaggtgtggctgaggcagaatcatgtgaatgggtgcatccaaggagttcagggccctgcttggagaagaaatactttagcatcatgaaagggaaagaacgtgcaccccttttttgtttctttagtgaatgcaagatttaataaaagtgaataatgagcttcccctttgggagtggagcccagtgcagctcactgacagggttgacatcagtatgatgtgttggactgaaactgtatgtctgtaggtaggtgtgtgccttttagggcagaccacggtggccaccccatttctccaaggtggtttacctagcttgtgtatattagacattgccaccctcacctctggccaaaaattcttgatttaaaaagaaaagtctattttgttaacgacaggctctgttgtatgtgttactatcccaagcctggattattttatttatttaaaagtattttaatttccatattggctttattctaatcccatccatccctgtggagctgcagagcatcttcatgtgagtagacggatggacataaatagattcatgctcatttaggaagctgggagtttcgtgaagctgagggtgagttcctgtgattcttgttcgcttcaacaaaaagtgggagaccaagtttttatagcaaaagaccaaattagctgtagagtcttgaatgcagaaaaaaattaccctagctttcttagcacttagggttttgtgaggattcagtgtttagcacagtgcttggcacatagtaagccctagtaaatgttaaatattgttattagtgtttcgtaaaacttgagaaatagagctgagctcattcccttcctgttgattcaaaaataatacctacatgaaaacatgattccaagttgattgaatgttgtaggaattactggtttagagtagcccagttctcggcctaccctgctggttgggatcttactgtattcttgaatgcactggtttgaaaatatgccagacttcagcccccaaggaaacaaggctgcaagaatttatgaactccagctggaaaaggtaaaggtgacctttggctagccacatactggaccttaccccactgacgtctttcagaacattccaagggttttcctcaaggaacatttttgagctagaaattaaaatgggttctctggcagactgcaccccttgagtcaaagttaacagtattcctttgaatgcaataatagaggcttttctgcgttaagggagaaggaatgaccaattgaacttacacattccccaggcaggtccctttgccggcccctacaggctggggtggcccctcctgtcctcagggatcagactcccagactggttagttctgcatgtttccatcaaattaaaggttattccctggccgcctcctggagaaaaccaaccccaccctgccagctgggggcaatggggcagggattttggcctctcagaacagctcctagaggctgctcatgactgaatgttttcccaaatcacctaaatatcggtttgctttttgttttgggggagaggatttagcctcttacttccctgatggattcaaagttttatctatctccttatctcctgccctgtcttggcacaactctggatagattgcaggtgtggaatttgctggagtttggtgacttcgtcaaattcctttggattctgttccgccaaatcagcagtctcgtcctgtggatgcagtgactggaatttcccatctgcaaagcatctctgtagcccagattttgtggagccttaagacactccctcaatgccaccctgaccccacggctggagaaccctgtgcttatgtggtgggcagggccactgttgatggaggatggcggggacggggtggtgctcaaaggatctgtggtgctggaggtctacacgcctctcaggacagcgtgtcaggaacctcagagcagcttcacatctgccaaagctgagagggagcgaacttgggaagcattttgctcattgtcctacccaagtattaatagcataatagttgatgccaaaggagatggtgacgtcccttccactgtagttgctgtcacaaccttgacgtctttaagctaatggccgtttgcatctgtgtcttcaaacagatcctggttacagccattttgtgtgattcacttcgggggttaagtaatgcaggattctgcaaacaaggtgtcgccgtccaaatgtactgtcctggcatagagagcactgctttgttttccactgttgtagagaaaactagggagaactttatttttcaataaacttttcttgtgtga

SEQ ID NO: 213 - DNA, 191425 bp, Homo sapiens
gactcccccctttgtgtctggtctgctcggagccactggaagtgcctcccggagggacgcagggtgtctcgccgcctccctgcccacccccttccccggctaccttcatccgccctcccgccgccccccgccctcggtccgcgacgcccgagttccgtcaggagcccagagctgcgggagaacgaggcggcggcggcggcggcggcggcggcggcggcggcagcagcagcggcttcctcggggggttgtgattcgctcacaggagccattgacgggagaagaggaggctttcttggtggaatttacctcaggcaagatcgagccgcaggaataaaaagcgaggaagggaagggagcgccgccgggaggactagaaggggcagcctctcacacccactccgcctgccgtctcggggagcccggaccggggccgcgaccgcgacccctcccctcccccgctcctacctctcctcagccttcgccagggcctccccaaccctctcacggttgttctgcgaaggcgtggggactgtgagcttgtccatggaggcaggcaccttttttgatccagtcaaggaagaggatttgttgttttcgaaatcagagtgaaggaagcaccgaagcgaaacttaaggaatcctgccttcccggagccgcgggcgatgcgactagggctgccgggcgccgccgccgcccgtccggcttcgtccttcccggcagtcgggaactagttctgaccctcgccccccgaccccggatcgaatccccgccctccgcaccctggatatgttttctcccagacctggatatttttttgatatcgtgaaactacgagggaaataatttgggggatttcttcttggctccctgctttccccacagacatgccttccgtttggagggccgcggcaccccgtccgaggcgaaggaacccccccagccgcgagggagagaaatgaagggaatttctgcagcggcatgaaagctctgcagctaggtcctctcatcagccatttgtcctttcaaactgtattgtgatacgggcaggatcagtccacgggagagaagacgagcctcccggctgtttctccgccggtctacttcccatatttcttttctttgccctcctgattcttggctggcccagggatgacttcctcgctgcagcggccctggcgggtgccctggctaccatggaccatcctgctggtcagcactgcggctggtgagtagctccggccggcacgtcccggccactgcccctgcgggtggcgagggagggagcccgcagaggccgaggcctgtgcttgcccttcgccatgcgtccccccgatcgcggtgcagcggagctgcgacccggtgcctgcgcgcctgccccatgccttccagggaaatcgcctttaatattcttgtgtattttcctatccccacttccatattcccaccccacccccctttacggggtgaaaaagacatattgggtgtggtatcttgacatttttagctgtgaggtaatgcaacgattaaaaataatattttaatcaccagtgaacagtgcttattatgagatctctggaaacagacctgtagatttttaaaattattattataaagaagcggttttggcttatagtaaaaagaacatcaactagagaacacacacttgaaccttattttgaaatttagatcactctgggaatccatgttcctttcattattcagaaatgttaccgaatgaatagaataaatgttgaggaagccagaactgtgagattcttgatatattgtattatacggtttgataactttactgttagtcatctggcatctatctattggctttgctgtcgagacaactttgacctgacattagacttctaggagatttgactccgaaagttctttgacatttcactaaagtctaaagggtggtagtcatcctttcctttggatattttcatttcagttctcagaaaccttaggaaaaagaccttatcttctatttgcaactattttttcaagcagccttttggtgatttgcttttagaaattttcaggagtgaattctacatataactcgtacacttggtttatgatgggcaaatggattgtgcttttaaaacgagtaaaggaccaaatgaccctttcgaattactttttttcttttgataagtgtgtttcacattaaacaaatttctcattgctatgttagatacagaggttacttgcttattttcattttgaaagtctgatctaggaaaatgccgaagaaaatttgaagtttccttttatgcttttgctattgttgaataatgtctactgttgattaatgtctgttaaattgatgataaatctatatggttctgttaaaataatttgaacttctgagtttactttaaaactgatattttaatatttttaataattgtagttgctttcagagtaaaaatgatttttctctaaatttctttatattgtgttagctatttaaattctctagccataagccatgtggttcctgtaaaatatggagtaaaaggccttaaacgttccatgagcagaaatctcagaacataggcttttcaatgttatttgttattcttaacctttttagaatatagattctcatttatgatgacgtgctcataatattgtgatcagaactgataaaagtaagagaaaaagcatttatttaaaaataaacttaatttttgtttggtaatacaatcatcttagaatagtgtctcttaaaagggagagagtaaaagaatcactgcttaaaagtggttgtagtcttttttttctttggtattgcatagcaccagatgacaaaatttgtgaagctggatttcagacctgtaacagtaatgataatagctagtatttattaagtgcctgccatgcaccatcagctattcaaataactttacatatattttttcatttcgtcttcatgacaattctatgttgtaggttattatcattccccttttccatagagggagagtaaagtacagagaatttgaataactcaccacacagtcagtaaattatggagccaggattatagtgtgcgccctcacataccacattaatggtaacagcagcactagcagcaacaacttctcatcttattggatatatgagatggagtaattagccttcaccagatcaacctttgtaaagaagcagggacacttacaaggtgttagtgcagcagtggttatgcaaatgtcgtagttctgaacatgtaaaactttgcttggcctaatattgaagtggctagtgcagcttcattaagtgcaagctgattagagagggcctgtgtggatttgggttacacagatgcagtgatgttaactcgacaggcgcaaatggtgcagctgaacaggaaaataaatcctagaagactgattgatagcacatcctttttcggggtcatggataaatcatttcttttgattccctctttctcacttattgagttcttggactccttaattcttagaacattttctttctttctttctttctttctttcttttttgttcagacagagtatcactctgtcgcccaggctggagtgcagtggcacgaccctggctcaccacaacttccgcctcccaggcgcaagtggttctcctgcctcagcctccagactagctgagattacgggagcccaccaccatgcccagctaatttatttttattttttgtatttttagtggagacggggtttcaccattttggcagggtggtttcgaactcctgacctcgtgatccacctgcctcggcctcccaaagtgctgggattacaggcatgagccaccacaccccgcctaattcttagaacattttctatgccccccccaaaaaaaaaaacaacttatgaaaaataagatgtgctggcttggtttatgaatgaattcttaataaaagaatacaacacagctattatttaaaggtcaacttctgtaatgcgttttaaataattcacttgattagattgcaattttacatacatctcttgaggaacacacacattatataaagtaagattaatctaatgttagtgaatattactgagtaactgaagtttagtaatcttcattttagtttttctcaaagtgtgggtactgcaacagaattacctggggttcttgataaaaatgcatatttttggccctatagtccagatgtactgaatgaatctctctgggagaacccccgcaaagtctcactcaagcaggtgcttgagaagcactgctttatatcatcagtcctgattgtttggatttctttctttttttttttttttttgagttttgctcttgttgcccaggctggagtgcaatggtgtgatctcggctcactgcaacctccacctcccgggttcaagcaattctgcctcagcctctcgggtagctgggattacaggcatgtgccaccactcctggctaattttgtattgttagtagagacagggtttctccatgttggtcaggctggtcttgaactcctgatctcaggtgatctgcccgcctcggcctcccaaaatgctgggattataggtgtgggccactgtgcctggccctggccctggccctggccctggccctggccctggatttctttctttctttttttttttttttttttttttttttgagacagagtctggctcggtcacccagactggagtgcagtggcgccatctcagctcactgcaacctctgcctcccgggttcaagtgattcttctgcctcagcctcccaagtagctgggactacaggtgtgcaccaccacacccggctaatttttgtatttttagtagagacgtggttttaccatattggccaggctgatctcaaactcctgacctcgtgatctgcctgcctctgcctccgaaagtgctgggattataggcatgagccaccacgcctgggctggatttcttaaatatggtgattcagtgacattttgctgtgtaattattggcaaccacaaaatcttagtggcatgcaacaataggcatttattctgctccatgtgtctctttctggggtccaggctagagggagaagtaacatctatctgggggaggcttgtgtcatggcattggcagaagtgcaagaggccaagcccaaccctaccagcacatttccagactctgctctcctaacatcccattggctgaccgagtcatatggctaggctaagctcagaaacaagaggtatcaaagtacactttgcctgtgatgaggctaatgtaatatttggatatatagtactattgcagaagaacgaagaattgaaattctcagtagaccacatataaccagtaagatggtccagaagggaggcttttcttaccctttgaagagggccaacctcttaattagttttttgcattaaaatgatataaactttggtctctacaaaagctattctggcatgtgggatgatgtgatagtagtggtattgatgtggatgagtagtgaggtgagagataactgttcacacaagacaaaacctttccttcattaaaggccagttttttttttaacaaaaagagaagaaattgaatattgatctctaatgggtaaattctaaccattaaaaaaatactgagtggaatctgtgtgaatcagttaattttataattggccacaccacttattttggcacctactcatagattgctgtgctgctggatatcagtttttgtttttgtttttttttttttttttttgagatggagtcttgctctgtcacacagcctggagtggagtggcacgatctcgactcattacaacctccacctcccaggttcaagccattctcctgcctcagcctcccgagtagctgggattataggtgtgcaccatcatgcctggttaatttttgtatttttagtagagatggggtttcactatgctagccaggccggtctcgaactcctgatcttgtgatccacctgccctggcctcccaaagtgctgggattacaggtgtgagccaccacacccgaaatttttttatttttagtagagatggggtttcaccatgttggccaggctggtctcaaactccttacctcagctgatccacccaccttggcctcccaaagtgttgggattacaggtgtgagctaccgcacctgaccaggtatcagttttatgtatttgccttgtccttcctactgataattgcttccagaggacagtattcatgtctgattagttttataatttagtagacatttaagaaatacttagtgaatgaataataaataggaatttcaaccaggaatattctagggttgtttattgactcaaataacacaccaataactttttctttgtcctagttccttcaactataaagtatgtagtttaagaggtatagtgggaagaccactgttgggagttaatgagacctagattctatatgattccgggcaaataggttacttaacatagttttcttacttgtaataatatggggttgtacttgatcattttgaaatacagattcatgggtaccccactagacctactgaatccaaatctctggacaacgagcctgggaatctgcctttgatgccctcatcagccagtaaattttaggtacctttgagaactactggatctaagattctttctaactctcaagttctataactttatttctactttttgtggtaattactacttaatctatatcttttattgcttaatctggtaaacattaggaacaaacatttcttaatttgtgcattaagcaattacccaaaatcttttccttttaaaaatttgcagtgtggcctgggcgaagtggcttactctgtaatcctggcacttggggaggccaaggcaggcggatcacttgaggtcaggatttcgagaccagccctgctgtacaaaaaatacaaaaatttggctgggagctgtggctcacacctataatcccagcactttgggaagccaaggcgggctgataacctgaggtcaggagtttgagaccagcctgactaacgtggtgaaaccccgtctctactaaaatacaaaattaggccagttgccatggctcacgcttgtaatcccagcactttgggaggccaaggtgggctgatcacctgaagtcaggagttcgagaccaacccggccaacgtggtgaaaccctgtctctactaaaaatacaaaattagccgggtgtggtggcacatgcctgtaatcccagctactcgggaggctgaggcatcgcttgaacctgggaagcggaggttgtggtgagccgaggttgtgcctttgcactccagcctgggcaacaagagcgaaactctgtcaaaaaaaaaaaaaaaagaaaaaaacaaaattagccacgcgtggtggtgcatgcctgtaatcctagctactcaggaagctgaggtaggagaatcacttgaacctgggaggcggaggttgcagtgagccgagatcgtaccactgcactccagcctgggtgacagggcgagactccatctcaaaaaaaaaaaaattactattttcaaaagcactaatattggctgggcctggtggctcatacctgtaatcctagcactttgggaggccgaggctggtggatcaactgacgttaggagtttgagaccagcctggccaacatggtgaaaccccatctctactaaaaatacaaaaattacccgggcgtggtggcgggcgcctataatcccagctacttgggaggctgaggcaggagaatcacttgaacccagtaggcagaggttgcagtgagccaagattgtgccactttactccagccttggcaaaagagtgaaactccatctcaaaaaacaaaacaaaacaaaaaaacactgatatgaaagattatatgcatgcctagaatcacaatgcccaacactgtaccttaaccctgccttgtgcatcagtaacgtttaaaatacattacccaaattatcaagatatagtgcaaaatgtgtgcaatcattcacgtcttaaatgtgtcgacggtggacttggtggaaaaattatgagacatgataaagtattgtgccagaggcattggcctaagaattttagatggagttaggtatttgggacagttaggtatttgatccacatctctttctggaaggttagatgcaaatggaggttgagaaatttcagtttctttctttctttctttctctttctttctttctttctttctttctttctttctttctttttctttcttttctttcttttctttctttctttctttctttcgacggagttttgctcttgttgcccaggctggagttcaatggcaagatctctgctcactgcaaccttcacctcccgggtacaagtgattcttgtgcctcagcctcctgagtagctgggattacaggcatgcactaccacacccagctaattttgtatttgtagtagagacggggtttctccatgctggtcaggctggtctcgaactcccgacctcaggtaatctgcctgcctcagcctcccagagtgctgggattacagacgtgagccaccgcacctggccaagaaatttcagtttcttaaaaccagatctcacttcccctttctccttcaagacagtagtttgcccttataattggtgtcaaaaatgtacatgatcatgtactttcattctgccccagtaagtttagtgcaaaataggaaaatttagaacaaaatgtgttaatgataagtgtgaagggatgtataaatatttggccagtaatccaaattcttcagttttttgtttcatttagatgaggaaatagttaagactttctattattattaatctgtgttcagtctttgcttttgtaaataagaatagtctgtgagcaaatctatgtaattgtagtagacacaccaggctaaccttttagggcaagcttttttttttgttttcatttgaaaaattaagagaaaaaatattaatcttcacacaaccctaacactttttgttttggtatgttttcttctaattaaaaaaaagatgcttttttttttttttttttttttgagacggagtctcgctttgttgcccaggtgggagtacagtggcgtgatctcggctcacgacaacctccacctcctgggttcaagcgattctcctgcctcagccgcccgagtagctgggactacaggtgtgcgccaccatgtccggctagtttttgtatttttagtagacacggagtttcactgtgttggccaggctggtctcgaactcctgacctcgtgatctgcccgcctcagcctcccaaagtgctgggattacaggcgtgagccaccacgcctggcaaaaaaaaaaaaaaaagcatgtatttttatatggttgtgattttataatatctattaattatatctgttttttttacatagaataatatagtcatgtatatgtgatcttaataactatcattttttcataattgtgtgatattccattgagtgtatttgttatttacttaattcatattgggagatgtttaggttgtttccgattttcttctctaataaacaatgccatatttaatacttctgtgcgtatgtcctgcttgttgtttgatttatttccaagttcttgttttgacctatctgtagcatgagccaatttaatccttttttttcatccttcaagtactttcttcatttggcttttaagatactattctctcttgatttttctcctacctcaccagcaactttgatagttcctccttatgtccctgatggctaaatgttgtgtttcaggattcagtctttagaccttttctctgtctgcacccaccctcttggtgatctcatccagttttatggctttaaatagcatctaaaggcgtacaagtttcaaatttatttctatctcagacttctttccttgaaattctgttgcatgtagccaactgtgtatctgtcgtatctacttggatgtctgatattcatcacaaacttaacctgtccaaaactgaacttctgaagctgcttcaccagacctgttcctcctatgtcttagcctattcagcaaatgtcagttctatccttccagttgttcaggccccaaattagagatatctttgtctcttctctttctttttttcacattcttatccaatctgatagcaaaaactcttggctttaccttcaaaatatatctagaatcttattgcttcttaccacctccactgtgctactaccttaatctaaaagccactatcttctcttacttgtacttttttactagactctgtttcctctgttaacgtctttgctttattacagtctcctttcaacatagtagcctgagtgacccttttcttttcttttttttttttgccagacagagtcttgctctgtcgtctaggctggagtacagtggcgcgatctcggctcactgcaacctctacctcccggattcaagtgattctcctgcctcagcctcccgagtagatgggattacaggcgcgtgccaccacgcccggctaaattttttttgtatttttagtagagacgggatttcactgtgttagccaggatggtctcaatctcctgacctcgtgatctgcccacctcggcctcccaaagtgctaggattacaggtgtgagccactgcgcccgggcagacccttttcatacataagttagataagacatttctttgcttaaaactattgtcttcccatctcattcagaataatagtcacagtcatttaaaatattgtacacaatctggcttctgcaatttatgacctcatgtgccagcctgtcttgctcaactttcattgggcttttaactttacaaactaggaaagattctgaaaattaaatattttagaagagattaggtttaagataccttattctatctaatttgacagtggctacaattagttaatctatattggggaagtgaagagacacatgagcatttctcatctttagtatagttactaatactaagggccttacatatttactgtgttatctcattatcctctaaacagactgatcagtactattatttttctttattctgcagatgagtaaactgagtaagtgggacacttgggaatcaaggtcaggcccctatggctccaaagcaaaacattcatataatacataaagtgttagtctaaaggtataaaatacttggaatcttttaggcatctgaaaatcttactggtattttgatcatgccagaataattgtccagattgaactatgtcttagatatagtctcttcttttgctgtaaatgacagcaaatatcttaggttttgttttatgtgtagcattcaaatgtcagtggataataaaaaaattcattgaagattcaaagcttcagttttggaaaagaacaccagttagattagaagagtgatgatgacatatttagttgaggttacatttttaatgtttccatgtgttcttagtgattaaaaccccatggggccagtctagtgtgaagaaaaacttttatttagttacttcacaaacgactgtattgtagtgataagaaaggcaagattaaaaacagtcaaatgatatgaagagatgaatttattcatgttacttattcaaacagagttttatgtgggatataacttttctgagatacttaatcgttttttcctttggctaaaccaatgtgttagcttgatgaaacgttatcaagaatgctaatctataaattcagtttagtctttcacaccaacttgttccatttgtacagctgtttcttaagaatcattgtttggctgtcacggtggctcatgtctgtaatcccagcactttgggaggccgaggtgggtggattaactgagatcaggagtttgagaacagcctggccaacgtgatgaaaccctgtctctactgaaaatacaaaaattagctgggtgtggtggtgcatgcctgtagtcccagctacttgggaggctgaggtaggacaatcgcttgaacccgggagatggaggttgcagtgagccgagattgtgtcactgcactctagcctgggtgacagagcgagactccatctcaaaaaaaaaaaaaaaaaaaaaaaacattgtttgtccatatacttaggtttgtaagaaattgagttattctgattccttgctaaggccttcttttaaaagcaagatacgccgggtgcagtggctcacacctttaatcccagcactttgggaggccgaagcgggcagatcacgaggtcaggatatcgagactagcctggctaacacggtgaaaccccgtctctacaacaaaatacaaaaaagaattagttgggcatggtggtgggtgcctgtagtcccagctactcaggaggctgaggcagaagaatcccttgaacctgagaggtggaggttgcagtgagccgagattgcgccactgcactccagcctgggcgacacagtgagattcagtctcaaaaaaaaaaaaaaagcaagattttagtcttaggtttttactgtgttctactctaagcatctaataggctttatatttcacattacccttttaatgaaaatagattaaattcagtaactgacattctttaatagattaaattctagttatttgcaattaaaagtgtgggctgggtgcagtggctcgcgcctgtaatctttgggaggctgaggcaggaggattgcttgaggcctagagttcgagaccagcctgggcaatataatgagaaccctgtctctacaaacaatttttaaaaatcagctgagtgtgagtctgtagtaccagctacttgggaggctgaggtgggaggctcactgaagcccaggaattggagactgcaatgagctgtgatcatgccactgcacttcagcttgggtgacaggttgagaccctgtctcttaaatttaaaaaacaaaaaaggctgggtgtggtggctcagggctgtaatcccagcactttgggaggccagggcgggcagatcatgaggtcaggagattgagaccatcctggctaacatggtgaaaccccgtctctactaaaaatacaaaaaattagcttggcgtggtggcatgcgcttgtagtcccagctactcgggaggctgaggcaggagaatcgcttgaacccgagaggcagagtttgcagtgagacgagattgcgccactgccctccagcctgggcgacagagtaagattccatctcaaaaaaaaaaaaaaaaaaagacttgtttttgcttttgattttatcatttcttttaaaaaactttttgttatttaagattctaaaattatacaaagtcattgtaaaagggttttataaatttatttttttttttttgagactgagttttgctcttgtccaggctggagtgccatggctcgatcttggctcaccgcaacctccgcctcctgggttcaagtgattctcctgcctcagcctcccgagtagctgggattacagtcatgtgccaccacgtccggctaattttgtgtttttagtagagatgggtttttccatgttggtcaggctggtctcgaactcctgacctcaggtgatccgcccgcctcagcctcccaaagtgctgggattacaggcgtgagccactgcacctggcccattaaaaagggtttttaaacgatgatgatggtgaagtgtagaaatgataatgaagtatacaaaaaaaaaaaaaaatcgtctcgtgtttccttaatcccatttcctggatgtaaccagtgttaatagttggtgtataatctttaatgcttttttatatgtgctataaataaatatctgtataattagaatttgcttctaaacaaggtggaataatattgcgtatattgtacataaagttttgtgattattgatctgggacagttctagaagtaagatcatgtggttagaaatttgtacatttaaaatcttgaaatgaactgctagaatttcttcaaaataggttgtactgtcatttctaccagtagtgtatgagaacctcccttttctttcgtgtttttttttttttttttgagacagagtcttgcgctgttgcccaagctggagtgcagtggcacgatcttggctcactgcaacctctgcctcccaggttcaagccatcctcctgcctcagccccccagtagctggaattacaggcacgtgccaccatgcctggctaatttttgtatttttagtagagacagggtttcaccatgttggctgggctggtctcgaacccctgacctcaggtgatacacatgcctcggcctcccaaagtgctgagattacaggtgtgagccaccgtgcttggccgagaatctcccattttcttataccttttcaaatactacgtaatatcattcttttcaatttttgccagagcaaaataaatgatatcttgttggtttagagtcctttaattattagtggagccaagcttttcatgcttgtcagccagttgtatttctctgaattgcctattctaatgatttgtttgtttttcttactgatttaaaggtgttacatgatataaatatatgatataaatgactttatgcaattacaactgctttttttttcctttatgacatctggttttgtgttatcttaggaaagcctctaccttatgtacaactaccaaaaatgcttttagtaagtagtctttttttttttttttttttttttttttgggagatggagtttcactcttgttgcccaggctggggtgcaatggcgcaacctctgcctcccgggttcaagtgattcttctgcctcaggctcccgagcagctgggattacaggcatgtgccaccacccccagctaattttgtatttttagtagagacagggtttctccatgttggtcaggctggtctcgaactcctgacctcaggtgatccgcccgcctcagcctcccaaagtgctgagattacaggtgtgagccactgcgccttagtaagtagtcttatagttttgttgttgttgttgttgttgtttttcaataaaatagggccttgctctgccacccaggctggagtgcagtggtatgatcacagttcactgtaacctcaatctcccggaagctcaagtgatcctcccacctcagcctcccagtagctgggactacaagtgtgtaccaccatgcccggctaatttttttattttttgtagagatgggggctaggctgctcttgaactcctgggctcaagcgacccttttgccttggcgtcccaaagtcctggaattataggcatgcaccaacacacctgaccagtgtacactctttttttttggagacaggctgtcacccaggctggagtgcagtggttcaatctcagttcactgcagcgtctgcctcccaactcaggccatcctctcacctcagccccccgagtagctgggattatagatgcatgccaccatgcccggctacagtctacacttttttcttttttttttttgagatggagtcgcactctgtcgccaggctggagtgcagtggcgcaatcttggctcactgcaacctccgcctcccgggttcaagcgattctcctacctcaacctcctgagtagctgggactacaggcgcgcgccaccacgcccagctaatttttgtatttttagtagagatgaggtttcaccatattgcccgggatggtctcgttctcttgacctcgtgatctgcccaccttggcctcccaaagtgctgagattaaagatgtgaaccaccgcacccagcctacagtctacactctttttttttttttttgaaagaagtctcgctctcgtcccccaggcttgagtacaatggctcaatcttggctcactgcgacctccgcctgccgggttcaaacgattctcctgcctctgcctcccaagtagctgggattaaagcgcctgccatcacgcctggctggtttttgtattttttagtagggatggggtttcaccatgttgtccaggctggtctggaactcctgacctcaggtgatccacctgcctcagcctcccaaagtgctgagattacaggcgtgagccactgtgcctgacccagtctacactcttaactgctggactgtactgtctcttacatagtcaagttgtcttctcatcactgaattccaaataaagaaagtgttacatttgagttgaaagtatcatttagggacaggttatttgatacgtgtaaaatatacttctgcggacatgtcacagtatattttatgtgtgtcatggtaagtaggtgaccaatatcaattgggtaaaatgcctgatcattggaacccagacatttctggctctcattgtagagccttacttattttcatttaaaaatgtctaagagctgtagttgtttgagtttctagctttaaaaagttaagggagcatctggccgggcgcggtggctcacgcctgtaatctcagcattttgggaggccgaggcgggcagatcatctgaggtcgggagttcgagaccagcctgaccaacatggagaaaccccgtctctactaaaaatacaaaattagccgggcgtggtggcacatgcctgtaatcccaactacttggaaggctgaggcaggagaattgcatgaacccaggaggcggaggttgcggtgagccgagatcgtgccattgactccagcctgggcaacaagagcgaaactccgtctcaaaaaaaaaaaaaaaaaaagttaagggagcatcaaataggtaaataaatgactagtatcaatgacttaaaatggctcagcatgtacctatatttaatacattcagaacaactttgagttagaacctagtctctgcagttggtgtatggaaatacatagcataaactggaattaaactggaattctttgtcaccctagtagtccattctagtagtcctatttcacaggatgtgatacacttaaggttagaataatggtagcaagagataaacagacagagtttggggagtctgggagaggaaggagacaaaatattttactaagtttctctcatactgtctttctatctccacccaaactgccccagcttggtgtagccttattgcccttgcctttgctttgatctatactggagtaggctccaaaacggtgtacgattctttgactgtgacctctggtagtaatttaaaaatatatatatttttttgtagggacaggtctcgccatgttgcccaggctggtgtcaaactcctaggcacaagcgatcctcctgactcagcctcccaaagtgttggggctacagctgagagctactgtgcccagtctagacagtagttttaatgttagaaagccttgagggtactacttgaagcaaagaattatatttgaaaacagaattctaaacagtgaaataaatgacagtaccagaagaaagttaacagataggaatattaaaattactaagagaatatactctgtgggttgcatttatcacctgtaagttaggtgagctgattcttgaaatcttttcaagcccattttacttatttaggtcactaattatagagtttgttgtttagaagatggcatctaattaaggtaatgagagagcgagagagagagagagagagagagagagagagagagagagagagagagagagattcctgtgagattcagctgagtcatatcatcagtaattatcttgagaactgtgttggaggagcagtgaatttctgttgctaatgaatatttcattattgtttgaaggaaccggttgtataaaagattactcctggccgggcgtggtggctcatgcctgtaatcccagcactttgggaggatgaggcaggtggatcacctgagatcaggagttcaagaccagcctggccaacatggtgaaaccctttctctactgaaaatacaaaaaagttagatgggcatggcggcaggaacctgtaatcccagctacttggaggctgaggcaggagaattgcttgaacccggaaggcggaggttgcagtgagccaagatcgtgccattgcactccagcctaggcaacaagagtgaaacaacgtctcaaaaaaaaaaaagtaataataataataataatatttcccccaaaataactgacattcataaaatatacagagaaccatattagatgcttactagaagtaacagattaagtaaaatagctactgtttaacaaaagtaacttctccctttatgagtgcctgctatgtgtcaagtgaaatgcagtgtttttacatacattttccttagatcctcagagtagctgaaaggtagatatttttcctgttttagagttagggaaacagactaacagaataagtactttgtctaatgatatgtaaaaataattattgaattattcatcgagtacctccttgtggcaggtattatactacgtgctttatttaacctgattcttatatcagctttctttttcatatatttatgaaaaatatagattttttcataaataaagatattgaggcacagagaggttaaataaatcatccagagtctagaaagtgacagaactgtatttcaaaccagtatcttcttgatttctaaaagtctttacttttttttatttttttttttttgagacagagtctcactctgtttcccaggctggagtgcagtggcgcaatctcggctcactgcaacctccgcctcccgggcaagcggttctcctgcctcaacctcctgagtagctgggactacaggtgcccgccaccacgcctggctaatttttgtatttttagcagagacaggatttcaccatattggccaggctggtcttgaactcctgatctcgtggttcacccgcctcggcctcccaaagtgctgggattacaggcatgcgccaccacgcctggcaagtctttactcttaaccatgtttcctctcatgacttcttcatgttgtaagatacaatttatcacattgacttgcctttcaacttttaaattctgtgaatttttctctctgtaaactaagcaaggtaggacaagtcgattaatatctttacaccaattgtgtataaggaatgtgtgattcattaccagaaagattactattcttgatcaattctgtttccaaattagaatgtattcactgaatatatactatgtttaactgtgttatgatacagaagtgtgaatcttggtcccagaactgaagctattataggataagaacataaacatgatggtttatgctcaactactaaattgtaagtttaaaaatccagatttggagtaagatatacagaatgcacatagatagtaataatttgggcaatggataagtcactgtggctgaacaggtagggataaaagcttacagttcctagctgaatgcggtggcccatgcctgtaatcccagcactttgggaggctgaggcgggtggatcacctgaggttgggagttcgagaccatcctggccaacatgacaaaaccccggctctactaaaaatacaaaaattagccaggcatgggggcgggagcctataatcccagccactcgggaggctgaggcaggaggatcgacttgaacctgggaggcggaggttgcagtgagctgagattgcaccattgcactccagcctgggcaacaagagtgaaactccatctcaaaacaaaaaacaaacaaaaaacaaaaaaaaaagcttacaattcctttgaggctgggctaaggaaattggcctgatgatggagatgttctttggaagagcagccaggtggcaaaggcacagtgatcaaatatgtgattaataggagtgatccagtcctaaacagggatagaggctgagaggcctagtcaagtggtctaaactgcacatgaaaaggaagggaaaaatcggtaacttgagcaatcctttatcatccctacagccactcagttttaggtctgatcagcagttattccactgagctgctggatgagctgagggtggtgatgaaggctgagttatttggtatatatgtagtctaccttatttaatattggctcagttgctgtactcagctctgaagacttgaaatctggctgatgggttatcattctatgtgaagaaagtattgtaaggggagtatagatggttaaggaggtagcagtaaaagcagtgcagaagaacagagatgtgcatgtaagagctcaatgatactgtttagggttgcatttaccaggtagattcttctcactatttttattcttgatagctggggtctttgggacatctaggcttatctattttgtttggctgcaaaaaagtcaggtaagaggaaacacttggaaagcaaaaaataaatgaaggcagagaacatcataaagagatatatgaaaagaagccccatttaaattatttggtaaaatgtgatatacatggtacatcagagatattgcatgcttggattttttggattttacagatacagcaacaatgtatttcattgatgtgaatgccttagagttatcttgagcaagaaactatttttttttttgaaacggagtttcggagtttcgctcttcttgcccaggctggagtgcagtggcgcgatctcggctcaaggcaacctctgcctcccgggttcaagcaattctcctgcctcagcctcccaagtagctgggattacagtcatgcgccaccacgcctggttaattttgtatttttagtagagtcggggtttctccatgttagtcatgctggtctcgaactcccagcctcaggtgatccacccgcctcggcctcccaaagtgctgggattacaggcatgagccaccgtgcccagcctgagcaagaaactttttattgatatcttgaatctccagtataataaagttgggagcagggtcaataaatataaataaataatactttttcctcaaaaatatcatatttttttaaacctaagacatcatcaatcataggagacaccactaggaaaaaaacactgccaagtaaattatgaaactatagtgattgtaaaactaaccccaatttcagaaatgttgcgatgtgcagtacatacattatacagaagttaactatcaattaatatctccttgaacctttagaacttgatctatagtctcacttaagtagattacagtaataagaaagtcagtctctggtttcaatattttgtgactggatatctatagggaaaagtaaatgtaggtaagtgtaggtttttttttgttttttttttttgagtcagggtctctctctgtcacccaggctggagtgcagtggcacaaacatggctccctggggcctccactttctgggctcaaacaattctgctgccttagccttacctgagtagctgggactacaggcatgccaccacgcccacctaatttaaaaaattttttttagagacagggtctcaccatgttgcccaggctagcttcgaacttctaagctcaagcaatcctcccacctcagcctcccaaagtgctgggattatagacgtgagccaccatgcctggccaaaaatgcttccttatattgtcatctttaaagattttctggccaagcatggtggctcccgcctgtaatcccagcactttgggaggctgaggtgggcggatcacctgaggtcaggagtttgagaccagcctggccaacatggtgaaacccggtctctactgaaaatataaaaaattagccaggcacggtggcaggcacctataatcacagctactcaggagctaaggcatgctcctgagattggagattgcggtgagccaaaattgcaccactgccctccactctgggcaacagagcaagaccctgtctcaaaaaaaaaaaaaaaaatctatacttacctgtacttacttttctttatagacatttaatcataaaatattgaaaccagagactcattttttcttattactgtgatctacttaaatgagactgtagatcaagttctaaaggttcaatgagatatcaattgatagttaacttctgtataatgtaagctgtctcaaaacaaaataatataaagatttccttttgtttttagggaaatttctcattcagctcttttctaattgcaggtgaaaacaactggctttttttttaaaaaaagctatatgtgaagcaaatcgtgtgctgttatgcacctaattttgccatgtatgcttaatgaaggaggcaggaggccatttagccatcaagggagataacttggcctagtgcttttctgcagggaagcagttaaaataagtttgaagaaattatatatttaaggagaaggcaagtttgtaacacactaagacaaaatattaactgctgagttttgaatattcttgtggttttcccatgtctactgacatttgaacattgtttagtaatactataaggagatattgagcaaaataagttggaaccctgccttctgtaatctagcttttacatgtttatgtagattaggttaggttaagagaaaataccgtagtattttgtagctatacaaagcatctggatccctgacttcaatggcacttatgtacttgttaagaagacagatcatagccgggtgcggtggctcacgcctgtaatcccagcactttgggaggccgaggtgggcagatcacctgaagttgggagttcgagatcagtgtgatcaacattgagaaaccccgtctctactaaaaatacaaaattagctggccatggtggcgcatgcctgtaaccctagctactcgggaggctgaggcaggagaattgcttgaacctgggaggcggaggttatggtgagccgagatcgtgccattgcaatccagcctgggcaacaagagtgaaactgtctcaagagaaaaaaaaaagacagatcataaataagtagatacataaaggaacaagatcattagagattgtgataaatgccacagggctatattagagggtaattggggaaggccactcacattagataaagggggtcagtgaagctttccttatgaggtgagacctgaggaataatcagccagatatgtgaataattgcaggaaaaacattccaggtagaagaacagaaagtgtaaaggctaggaggtaagaaagagctcgatatttcacaggatcggaaaggagcttgttgtggctcgaatgttgtgaactaggaagagagatgcacaacaaggggttagacaggcaggcaggagccaaatcatttggggatttgtaggccatagtaaagatgaagtttgaattttattttgagaaaataagaaatgctttagaaagagtttaagcagagtaatttcataatctaattttcatttttcaaagaccactctggtttatcggtagagaagaattagaggggaggcataggaaaaacaagaagactggttaggcagatgtgctagtcaagatggccaagggtagtggcaggttggattttttcctctagtactgtcaagtagcattttggtatcattgcaagcctacttctctaatatactgttttttaaatagcagagactctttggatttagagtgtatagttgagtgctgggcttgatggccaatgcctataatcccagcactttgggaggccgaggcaggaggattacttgatcccaggagttccagaccaatccggggagcatagtgagatcctgtctgtacaaaaaataaaaaattagcagggtgtgatggcactcacctgtattcacagctgctcaggagcctgaggtgggagaatcacttgagaccaggaggagttcaaatctgcattgagcacagatgatgccactgccctccagcctgggtgacggagcgagaccctgtcttaaaaaaaaaagaatacatagttgaattagtttattattattatggagatgagatcttgctctgtcactctcaggctggagtacagtggtacaatcatagttcactgcaacctttaaatcctgggctcaagccatcctcctacttcagcctcctgagtagctaggactacaggtgtataccaccatgccaagctaatttttttttttttttttttttggtagagacaacgtctcgctatgttgcccaggctggtcttgaactcctggcttcaagaggatcttcctgccttggcctccaaaagttctgggagtacagggtgagccatcatgccacccttaatgtagtattctttgactgcagaattagatttgaattgaataatacaaaagctgatttttaactatgccttgactgaaaactaaattcttttaaaagtactggtagaggaagtagtcttagagtttagtagatgataatgataatagcacacattgctgttttttcatagttaatgagcataatggttatatttaatgagagttttaaaatttatgtttttatttctacttggtgattttcataacaaattatacttaggctcaggtctcaatataattatctgattagtgcatagttttaaatctttaactttgccactagaaatacacttaatttttaatttagctactaattgtgaaacatttttgtttagtattttgttgttttattcatgtaaatcaatttaagccttttcttatttaaattacttaattctacttctataatctattctaatactgaattccgaactctcctaaattattcttgatttagataaaatggttttaagctggtaactttaaaaaatacaattacttcaaaataatacacatacatgacagaaaaaattcaaattgtgaaagggcataaaatggaaagaatattttataacattcttattatctaagccaggcaaaggttggcagctttctttcagttggatgtcactcagcctattgagtatgcaaatgtcttttgtttgcatgccacccaactcagcagtagtgagtgaaggagaactgatgaagattgccaacagtacctcacatctcatctccccttttatataagagtaaaattagatggcatgtggtggcaatacctgaaaggaacatggttctaagagtgaatttaaatagtttatcatttgtattaatagatgttttttactccagtaggtgcacatttttctggtagtggatacagacaattacagtgtactaagaactttgctgaagcatttcaaggcaaaggtattaaaataaaaatagataaaagtggtttgttttgctaatgaattttggagataatgatcagtagaccgcatttaccaagtgtggcacgccaactgaaatatcttcatcttctgtataggttgttaatccttaatacatatgtaatacttagtcttttacttggtataagtcaatgagatggttaatcttcattatataacattttaagttgatataaatgagcagtattttgggggttttatttttaaagcaaaaggtgagccaaaatattaatctttaacaaatatagtggacaaaaatttgttgagaaagtttcagattaaggaatcatgcagcatcaaccaaggagcctcaacataataattaacccagcttcttaacaaagatatgatttaatttttgttgttgaatgatttcaagactacattttccttttgggattgttctgtatgatgcagtaaaatgttggaaatcacagtgattgcttaaaatgaacatgctgcaaaaagggctcaaaagtgctttttgtaaagagctctattgttagtacaattttgctcgtgggtcctctgtcttttaggggaaggctgtaatgcctaaaagttgccagtgcttcattaagctaatgctgaattatagccagacattcagtgatccagaccccagacttccctgccatccaagaggagcagttggggaagggaatgaggtggaggtgggaggtggaataggccttttttacgtagtaactttatgtatttattgtgtcaaatgagtttagcatacttgtgttattagaatcaatttggccgggtgtggtggctcacacctgtaatcccagcagtttgggaggccaaggtgggtggatcacaaggtcaggagttcaagaccagcctgaccaacatggtgaaaccctgtctctactaaaaatataaaaagttagccgggtgtggtggcacacgcctgtatcccagctactcaggaggctgaggcaggagaatcgcttgaacccaggaggcggaggttgcagtgagctgagatcacaccactgtactccagcctgggcaacagagtaagactccgtctcaaaaaacaaaaaacaaacaaacaaaagaaagaattaatttaagccttgaatgctctctaactttttctcccattagcctttccattttttttttcagttaataagaaacaatactgatagcaaaacttgcattgtgtgtgtgtgtgtgtgtgtgtgtgtattttttttgagacagagtcttgctctgtcactcatgctggagtgcggtggcatgatcttggcttgctgcaacctccgcctcctgggttcaagctattcttatgcctcagcctccctagctgggactacaggtgcatgccaccctgtgttgctaatttttttttttttttgagatggagtttcgcttttgtcgtctaggctggagtgcaatggcgcgatctcagctcacagcaaattccgcctcccgggtacaagccattctcctgcctcagcctccggagtagatgggattacaggcatgcgccaccacgcccggctaattttgtatttttagtagagatgggatttctccatgttggtcaggctggtctcaaactccggacctcaggtaatccaccctcctcggcctcccaaagtgccgggattacaggcatgagccaccgcgcctggctgtcctgctaatttttgtatttttagtagagatgaaccctctccctccccttcccctcccctcccctcccctcccctcccctcctcttttcgagacagagtcttgctctgttgcccaggctgaagtgcagtggcgtcatcttggctcactgcagcctccgcctcccgggttcaagcaattctcctgcctcagcctcccgagtagctgggactacagttgcgcactgccacgcctggctaatttttgtattttttgtagagatggggtttcaccatgttggccaggatggtcttattctcttgacctcgtgatcctcctgccttctccttccaaagtgctgggattacaggcatgagcctttttttctcgtataattttgaacaaaataatacttagtttttcattcaaattagaaatttaagtaaaagtgatacctctagaaagttaacgtttgactcattttaagaaagcaagattataatagggtcatcttatttgttcagattctttagatttcatatttttatattttaaaaagtttcaaacctactgaacattttactttatgtggatgtacactcacttaagagtgagatattgcagggcgtggtggctcacgcctataatcccagcacttttggagtccaaggcgggtgatcacatgaggtcgggagttcaagaccagcctgaccaacatagagactccctgtctctactaaaaatacaaaagtagctgggtgtggtggcacatgcctgtaatcccagctgcttgggaggctgagggaggagaattgtttgaacctgggaggcggaggttgtggtgagccgagattgtgctattgcactatagcctggacaacaacagcaaaactccgtctcaaaaaaaaaaaaaaaagtgagatattaagggcttttactttctatattttatatttctatgatacttgaatatcattttaccaaatttgtaagtcttataattactgtgattagaaatataattttaagccctaataaaatgacttattgtcattttagagctaaaatttgtcttgtttctttgggttgtttttttttttttttgagatggagtcttactctgtcacccaggctggagtacagtggcatgatctcggctcactgcaacctccacctccctggttcaagcaattctcctgcctcagcctcccaagtaactgggattacaggcatgcaccactgcacccggctaatttttatatatttttttagtagagacagggtttcaccatgttggccaggctggtctcgagctcctggcctcaggtgattcgcccgccttggcctcccaaaatgctgggattacaggcgtgagccactgagcctggcctaaaatttgtcttttgctaggtatatggatttgtagatgagtgtgcagtagcaatgatcatagtttattttatgaattaatagttaatgaacatcagatattggtgatacagcaataaacgagataaatatatttccttttggagttcatagttaaggtttgttacatgggttgggtatattaggttgggtatattgggtggtgctaaagtttgggcttctactaatcccatcacccaaatagtaaacatagtacccaataggtggtttttcaacccgtgccctcttccctccctgcttttggagtccccagtgtctatcgttccaatctttatgtgggtggagactttttttttaagacaggatcttgctctgccaggctggagtgccaggttggaggctcactggcacctcaaccttccaggctcaagcaatcctcccacctcagcctcccaagttgctgggagtacaggcgtgtgcaccatgtccaggtactttttaaattttttgtagagacagggtctcgctatgttgcccaggatggtatcaaacttctggactcaagtgatcctcccatctcagcctcccaaagtgctgggattacgggcacgagccatctcacctagccctgtgcactttttaaactccatttacaacattggtcagctttttcttattgtactataaattggacattaatgaagttttgtggtcctgaagcctgaaaaaaaagtcagatacagtaattagaactgtttaactgttccatcatttcctctgctatcttatttttattcattctgtagaagtccagacaggaaaaggttgattgttggtagggtgactatataatttgcaagtcccagggcaaaataaaaatgggggctcccttattcaaaaagcaggaaaaggggcagggcgtggtggctcatgcctgtaatcccagcactttggagggctgaggcgggcggatcacgaggtcaggagatcgagaccatcttggctaacacggtgaaaccccgtctgtactaaaaatacaaaaaattagatgggtgtggtggcgggcacccatagtcccagctactcaggaggctgaggcaggagaagggcatgaacttgggaggcggaacttgcagtgagccaagatcaagccattgcactccagcctgagcaacagagcgagactccgcctcaaaaaaaaaaaaaaaaaaaaaaaagcagggaaaatgtgctgctaaaggtactaaaatatataccttttttctttctttgtagtgtctccttcaacttgtcatattttaaaaaaatttatcatctaatgtcagtctaagcaaagaaaaattagaattttaaatcattagcctgtattttactgttcatccctatatgttgtgtagtgtccatttaaaatgcaaatataagaatatttacctcatttgtggaaactgaaattatacagtcattttgtagttgcacttgcatgtgtagtttgtttttgctagaacagtagaaactctgtacaaacgaactcagtggtttgtatttcacttcttgatgaatacatattctaccaacattctaccttctgcttactgatgagtagggaaggactgagaagaaaaggaattatgggtggccctatctctacctttacttttatgttattatatccagcataagtggttgattaatataggcaagtaataggagaaataaaggatataatagggttccttcattgttagtttcataaaacaccattgccttctttctgtgttccgagtaagttgtagccccttggggctgtgagcaaccccctccagtgagaattaatacaattttctttgtactctatggcagagaagatgctcttactttgttttgttttgagaaccctggctagtccttgtcaggaggatgctaggctttatgggtttaaggaaattggttatatgctgttaaccatttatacagtaataaattgtttaataggaatttaaggcccaggccataacaggagtcctactgttttattttctggaaagtgaatgtagtttcatgagtgtggaatatttgtagcatattaaaattgctctctaggtacagttagcttatcccttatggttttaccctgctgtaaggggaaaccatacagaattgagcatcaatgaataaataaacctctgccagagattggcaggctttttggatcatggtgtcattccaagttagggttaggcacacactagaggctgtgacttggtaattcaagtgtttcacttggttgctactgtgccctggctgctatgcaaggatggcaagaatggcgtaataaacttaaagctgtagtaatgctataattgtctgatagtagtgattaaggtctgggttagtatacccgaggagtcctgttcaggtgttattcttttttcttttttactttttctttttcttttttttttgagacagagtttcaaacttactcgattgtcacccaggctggagtgcagtggtgtgatctcggctcactgcaacctctgcttcctaggctcaagtgattctcctgcattagcctcccaagtagtttgaactacaggcatgtgctaatttttgtattttttttttttgagtagagacagggtttcaccatgttggccaggctggtttcgaactcctgacctcaaatgatccgcctaccttggcctcccaaagtgctgggattacaggtgtgagccactgcacctggcctaatttttgtatttttattagagacgggactttgccatgttgctcaggctggtcttaaactcctgacttcaaactcctgatccatccttcttggcctcccaaagtgctgggattacaagtgtcagccactgtgcctggcctcagctgttattcttcatgcgtatatttgttttgttcatttggggcaccttgttggttatcataaattttggtgtgatcaggtactgctccttaataatactgtatttggctgggcgtggtcgctcacgcctgtaatcccagcactttgggaggccgagacgggtggatcacgagatcaggagatcgagaccatcctgacatggtgaaaccccgtctctactaaaaatacaaaaaaatcagccaggcgtggtggcgggcgcctgtagtcccagctactcgggaggctgaggcaggagaatggagtgaacccgggaggcggagcttgcagtgagccaagatccagcctgggcgacggagttccgtctcaaaacaaaaacaaaaacaaaaaaaaaactgtatttatactttattctgcataacttcttttaactcaggatttctttttctttttcttttcttttttttttggagacggagtctcgctttgtagcccaggctgaagtgcagtggcgtgatctcggctcactgcaagctccgcctcccaggttcactccattctcctgcctcagcctcccgagtagctgggactacaggtgcccaccaccacgcctggctatttttttgtagttttagtagagacggggtttcaccgtgttagccaggatggtctcgatctcttgacctcgtgatctgcccgcctctgcctcccaaagtgctgggattacaggcgtgagccaccgtgcctgggctttaactcaggatttcataaagaaaacaagattgagaaaaaccaaatctgtttgttgtataaaataatgtatagctctgaatagtcatgtctgattttgggtaaaatgctaaaagactattcttctatgaagtgctttttacttttgcagttttaggtggcaaaataatttcatattcttatttcctcacagaaaccatatgtctgtggttgcttcttagctctatcaaatatccacctaagtgcaccagtaggttaaattgtttctcataaaaggttagttttgacaaatttttgctgttagcttttcattatcaccagatcttgactgtactggcacaatggtgtataaaatctagagaggaaacaaatcaatgtgaaccatagcatagttaatgggtcttctccaaagcacttatttggttagataaaagtacataaagcacttctcactgtgtctggtacagaggggaggcatgcaacaaatgtttttagaataaataaaaattcagttcttgtaagcattagtattaattacatgaaggacttccaggcactgtaatcagtcttctatctttgagatttgaaagaagcaggaaatagggcgtaggacctacaaggaaacaggaagattatccatgtttttatttcgcattccacttgaactatcttggaaacacagggtataacatcaaacaatggtcatataagtattttttaaaatttgtttttatctgttgctttatctgctttgtggtatattattgtattctatgtctggacatgtctggacgttttcagttgattcattaatatcaggagtagtgtgagtgtttccttgtcaaggagatactgcattttcttcctagtcccataattagccaaaggaacaaactactcttcttaaatgttcatcaaaacaggtatatgagtctgggcgcagtggctcacgcctgtaattccaacactttgagaggccgaggtgggtgaatcacttgaggccaggagtttgagaccagcctgggcaagacggcgaaaccttgtctctataaaaaatacaaaaattaatcaggtgtggtggtgcacacctgtaatcacagctatttgggtggctatggcatgagaatcacttgaacccagaaggcggggaagttgcagtgagctgagatcgcgccacttcattccagccttcatgcagagcaagactctgtctcaaaatatatatataagattacacatatatttcaaaaaaattatattttccaaaaccaaaaaccccacaggtatatgatctgtaaaacaggctggacatggtggctcatgactgtaatcctagcactttgggaggctgaggcaaggaggatcacttgaacccaggaatttgagacttgcctgggcaaaatagtaagactctgtctctattaattaaaacaaaaacaaaaacaaaaatgacagacatatgatctccgaaacaaacgaatcatgcaggtcaaccaggatgtggggagaactcaaaaaggtatataaacaataacacacaaacctaattgtattataaatggataatacactgaaggggttggggaagaaaataacttgtctaagatactttggaaaattataaggctaaagacaaaaagaattatatgcaaatattgtggtgtcattagtaagtttctttctcataggggcaggggttagcaattctactttatatatatacttaacagtaaacaaattagaaaatattgtggataataagacctaggttcctaactctctccactgagaggacctagaattaggaataccacagtagcagtgaccacaatagtgccccagatcttgatttcttttctttttctttttttttgacagtgtctcaccctgtcgcccaggctggagtgcagtggcacggtcttggcttactgcactctccacctcctaggttcaagtgattctcctgcctcagcctccctagtagctaggactataggcatctgccaccacgcctggctaatttttgtattttctgtagagatgggatttggtcatgttgtccaggttggtctcaaactcctgacctcaagtgatccgcccgcctcggcttcccaagatgctgggattacaggtgtgagtcaccatgcccggccccagatcttggtttctaaataacattctccactaataagaacccttgagaaatgactgattccaggactgaggcagggaaaatcaaaatgaacctgaaacatttaatggtatcagaaagtaactaaaaaatgataggggcatatgaaaggatctaaccaacttgaagagatagttccattggtcaaagctaagacaaaataaataatcatagtattggattcgaatccatagaatataataaatatcagtgagtccatactaatataaacaagggagaaaggacagcctatctatctagctagctagctatctgagacagtctcttgctctgtcacccaggctggagtgcagtggcacgatctgggctcactgcaagttccacctcccgggttcacaacattctccttcctcagccacccgagcagctgggactacaggcgcccgctgccacgcccggctaatttttagtatttttagtagagatggggtttcactgtgttagccaggatggtctcaatctcctgacatcgtaatccgcccgcctcggcctcccaaagtgctaggattacagacgtgagccactgcgcccagtctttttatttttaaaaataataataaaaaatagtaaactttatttttagagcaattttatgttcacagtaaaattgagaggcagctctttttttgtttttacagtagaatttcagttaataaatagaaggagtgatggaaatagaaaatcatcattaggcgatctccatggcaggttcttgttgcaggcaagaatcaaccaatggatgctaaaattagtgggtgaaagtgtggtaagaaacacggtatttaaataggctctaagtatctgccctacaaaatacttattcattacaaaggggaacctttgtaatgtaacactggagaaatctggatataccactctaacctggtgacacattgacatctgtcagaagacaaaaattttgacaaaccaagtttaaagattaattggcttttattagcaattcatgaatcaggcagcatcccatctaaagatttacaaaggcactccaatgagctgagcagtggaggcaggctttattggtagaaaaaagctgaagaaggcagaaacaaggaaaaagagtgattgctcattacaaaattactttccttgtagggttaaaacagaggaacttcattatcttgctagcacaaataaactgggccccttctgattggttgctgtgaatggcctgtttgttggaaaactggcccattttattgttcagtttgattatgtggtgcctagcaggagtgactccattcaggttttgtgtgctctgttggagtctagtgtagaaactcagcccaaaacagtggctttctatacgtttatttaacacgtcagatgcttcctgatgcagtgcactgagaaggacatagcatcgcctctgtggtattttttgccaggaaaggtaatttttgtctaatcatgagaaaacagagataaacccaaattgaggaacattctacaagataacttcccagtactttaaaaaagtctcaaagtcataaacaagaaagaactgagggactattgcatattggagcgatctaaagaagtattacaatttgtggaattcttgattaaatcctggaccagcaaaaggacattagtgggaaaattgatgaaattcaaatgagatcttatattgaagttaattgtgtcagtgtacatttcctggttttcataattgcaagtgattatgtaaggtttgttaatattaggagcagctgggtaaaggttatacaaaaactctatactatttttgcattttttctgtaagtttaaaacattttccaactaaaaagttgaaaacacatgtattagagacacatgcgtatgtgtctctaataatcttaaatatatttaagatgatagaaggaattcttgagatagtaaaatgaagtcaccaaaaaacaaacaaagaaacaaaacgaaatcaccaaaatctatcaataaatttcaggtaatacttttggcagattcattctttgagatggagtctcactctgtcgcccaggctggagtgcagtggcgcaatctcggctcactgcaagctccgccttctggattcacgccattctcctgcctcagcctcccgagtagctgggactacaggtgcccgccaccatgccctgctaatttttttgtatttttagtagagatggggtttcactgtgttagtcaggatggtcttgatctcctgacctcgtgatccgcccgcctcggcctccgaaagtgctgggattacaggcgtgagccaccgtgcccggccgtttctgttatactttaaaaaatataatttatatttggcacctatatttctcaataaaaatataagcaggaatttttagttttgtaaattttataatctgggtctaataaatcttaaagggatactagagtttatgtaatcattaaccacattattttagacatttttttgtgcaaactgattttcttatgtttatacctatggtcttcagtaattactatttcactgatagttgtaagaatatgaaattaaggcaggaagaggagaagtattagtttaatgtgtactatatgctgtgtgtgtgtgtgtgtgtacacacttacatgctgttgattctcattgttcttggattccatatttgtaaatgttcctactcactgaaatttatttgtaacccccaaattaatatgcatagtgtttttgtagtcatataaggatatctatagagctgtgaaaaatgtaagtcacctgatgcacacgttctcagctgaggtcaaacaaggccacattctgacttcttgtttcaggtctcatgccataaacaaatgtcctgttcgtggcccatttagtgccatatttttctcatttttgtgctttttgctggtgatttcactgttcaaaatggcccacaaatatagtgctaaagtgttgtctggtgttctaagtgcaagaaagctcttttccttagggagaaaatacctatgttagataatcttcagtcagtcatgagttatacaggcatgaattatagtgctggtagccaggagttgagtgtcagtgcatcaacaaaatatattaaagtgactttaaacaatcacacgcacacaaaacaacattatatattgatctgttaatgcaaatgtggtgagcacaggcttatagcaatctaaccttgtatttctcctagaagcaatggttcattgttcactaattcagtgtttgcaataactatatagaacatacaagaatcatttgtatgtgtgtgatacccatctatctaatatatattacatattgttcattatatattaaaaatgttattaattatattactttttttttttgagatagggtctcactctgttgcccaggctggagtacagtagtgttattttggctcactgcaacctccacctcccgtgttcaaatgatcctcccacctcagtctcttgaatagctgggaccacaggcgtgcactgccacgccgccaaattttttgtatttttagtagagatgaggtttcaccatgttgcctaggcggtgtggaattcctgagctcaagtgatctgcccaccttagcctcccaaagtgctgggattacaggcatgagccaccacgcccaaccttatattattaatatatgtttcatatatacatatacatacacaggcataccttgtttattgtgcttcactattgcacttcacagataactgtgttttgaacaaattgagggtttggggtaactctgcatcaagcaagtcactcaacaccatttttccaacagcatgtgctcttttcatgtctgtgtcatattttggtaattcttgcaatgttgcaaacattttaattattacatttgttatagtgatttgtgatcagtgatctttgatgttactattgtaattgttttggggcaccaggaaccacacccatataaaatggcaaacttaataaatgtttgtgttctgactgttctatcagctgttgttcccctgtctccctgttttcaggcctccccgtttcctgagacacaaatattgaatttaggccaattaataaccctgcaatggcctttaagtgttcaagtgaatgacagagttgcacgtttttcactttaaatcaaaagctaaaaatgattaggcttagggaagaaggcatgctgaaagccaagacaggctgaaagctaggccttttgctccagttagccaagttgtgaatgcaaaggaaaagttcttgaagaaaattaaaagtgttactccagtgaatacaggaatgataagaaaattaaacagctttattgctgatagagaaaaagtttaagtggtctggatagattaaactaactacaacattcccttaggtcaaaacctaatctcagagcaacaccctaaccctcagtcttgtttttttcttttggagacagagtctccctctgtcgcccaggctggagtgcagtggttcaatcttggctcactgcagcctccacttcctgggttcaagcaattctcctgcctcagcctcctgagtagctgggactacaggtgtgcaccaccatgcccggctaatttttgtatttttagtagagatggggtttcgccacattgtccaggctggtcttgaactcaggtgatccgcttcccttggcctcccaaagtgttgatattacaggtgtgagccaccgtgcccagccccctcagtcttctgtgaaaactgagagaggtaaggaagctacagaagaaaagtttaaagttagtagaggctgaatctcaacagattttcaatgtagatgacacatttttatgttggaagaatataccatctaggacttttataactggagagaaattgttgggctcagtggctcacacctgtaatcccagcactttgggaggccgaggcgggcagatcacctgaggttgggagtttgagaccagcctgaccaacatggagaaaccctgtctctactaaaaatacaaaaaattagctgagtgtgttgctgcatgcctgtaatcccagctacctgggaggctgaggcaggagaattgcttgagcctgggaggcggaggttgcggtgagccaagtttgcgccattgcactccagcctgggcaacaagagcggaactgcatctcaaaagaaaaataaataaataaataaacgtaactggagagaaatcaatgcctggcttcaaagcttcaaaggacaagtcagctctcttgttaggggctaatacagctggtgactttaagttgaagccgatggttatttaccattttgaaaatcctagagcccttaagaattatactaaatatgctctgcctgtgctctatgaatggaacaacaaagcctgaatgacagcacatctgcttacagcatgacttactgaatattttaagcccaccattgagaactactgctcagaaaaaaagattgctttcaaaatattactgatcattgacaatgcacccgatcacccaagagctctgatgtagatgtataaggagatgaatgttgttttcatgcctggtaagacaacatccattctgcagcctatggatccaggagtaattttaactttaaaatcttatttaagaaataatatttcataggctatagctgccatagatagtgattcctctgaatctgagcaaagtaaatgcaaaacattctggaaggaattcaccattcaagatgcctttaagagaatcagtgattcatgggaggaggttaaaatatcagtactaacaggaatttggaagaagttgattccaacctttatggatgactttgataggttaaagacttcagtggaggaagttactgcagatgtggtggaatagcaagagaactagaattagaagttgaacctgaagatgtgactgaattggtgcagtctcatgagaaaatttgaatggaggaagagttgcttttttttttttctttttcagaaagggtctcactcttgcccaggctggagtgcaatggcgtggtcacagctcactgcagcatcaacctcctgggctttatcaacccacctcggccttccaagtagctggaactacaggtgtgcactaccacacctggataatttttttttttttttttgagatggagtcttgctctgtcgctaggctggagtgcagtggtgcgatctcggctcactgcaacttctgcttcctgggttcaagcgattctcctgcctcagcctcccaagtagctgggactacaggcacgtgccaccacgcccagctaatttttgtatttttagtagagacggggtttcaccgtgttggccgagatggtctctatgtcttgacctcgtgatccgcccgcctcagcctccctaaatgctggcattacaggcatgagccactgtgccctgtttaaaagttgcttcttatggatgagcaaagaaagttgtttcttgaggtggaatctacttgtgcagacgctgtaaacattgtttaaatgacaacaaaggacttttttctttttctttttctttttttttttttgagacagagtcttgcgctgttggccaggctggagtgcagtggtgtgatcttggctcactgcaagctctgcctcctgggttcacacgattctcctgtctcagcctcccgagtagttgggactacaggcacccgccaccacgcccggctaattttttgtgtttttagtagagacgggatttcactgtgttagccaggatggtctgaatttcctgacctcatgatccacccgccttggcctcccaaaatgctgggattacaggcgtgagccgtggcgcccagcctagcacatttttcttttttgaaatggagtctccctctgtcgcccaggctggagtgcagtggcacgatcttggctcactgcaacctctgcatcccaggttcaagctattctcctgcctcagcctcctgagtaactgagattacagggacctgccaccatgcccggctaatttattttttttgagacggagtttcactttttttgcccaggctggatggagtgcaatggcacgatctcggctcaccgcagcctccgccttccgggttcgagcgattctcctgcctcagcctcctgagtagctgggattacaggcatgcgccaccatgcccgtctaattttgtattttttagtagagacagggtttctccatgttggttaggctggtctcaaactcccgacctcaggtgatacgcccgccttggcctcccagagtgctgggattacagacatgagccactgcgcccagccttccatgaagtatttttaaattaaggaatgtacattacgttttttgttttgtttttttgagacggagtcccaaggcaggagtgcaggggcctgatcatggctttttctatattccttttttttttttcttttttgagacagcgtctcactctgtcacccaggctggagtgcagtgctgccatctcggctcactgcaacctctgccttctgggttcatgccattcttccgcctcagcctccccagtggctggaactacaggtggccgccaccacgcccggctaattttttgtttttttagtagagatagggtttcaccgtgttagccagggtggtcttgatctcatgacctcctgatctgcccaccttggcctcccaaagtgctgggattacaggtgtgagccaccgtgcctggcccgtcatgtttttttttagacctaatgccattgcccacttaacagactacagtataaacataacttatatatgtactgagaaaccaaagaattcatgtgatttgccgtactgtgatatttgctttattgcagtgttctggaactaagcctgcaatatcactgaggtatgcttgtatttcttatctaatctttctaaagcatccaggcccttctacatgaggagtgagaacagacaaaattaagtgatttgcccaatataatagccagaactcagggtctggttccaaagtctgcagattaaaaatctctttttagatgacattatctgttttgcctaagacatacagtaaaggcatctgtaaatttatcttgacatttaattagatgtgttgacaaaaagactcaaactctgtaaaatatttgaagagatttattctgagccaaatatgagtgaccaagggcccatgacacagccctcaggcaatcctgagaacatgtgtccaaggtgcttgggttacagcttgattttatacattttagggtggcagaagttatagataccagtcaacacatgtaaggtgaacattgtttcagttcagaaaggggggacttccaggtcataggcagattcaaagattttgtagttaagttaccctctgaagacctggaatcaatagaaggaaatgtctgggttaagataaggggtgggggagaccaaggttcttatgcaaatgaagcttccttgtagcaggcttcacagagaatagattgtaaatgtatcttatcagtctttaaaaggtgccagactgttagtggattctcttctggatcagggaaaagacctggaaagggaaggggattctctgcagaatgtggattttcccaagagacagctttgtaggctatttcaagatatggcaaataaacatatttggggttaaaatattctgatttctttccttatctgtcatgtgatgttatgtcagagtcaggtaagccacattatgtagggttaaataaaacccctctgatgagactatggtttgtaaggcgtgactccccaggtccctcagatagaaatttgaggagaagaaaaaggtcagagtttagtcctcagatggcaagaatagtaagatttccctcatatctttctatttgaaaattaaattgccttcattttaaagtcaaatttaacattatgtatttttgttttaacaatttacttttttattcagcgattcacttatttaaaatgccatgtactaattagcgtaacattttctaggtagtttttaaaaatttcttttgggatttatgtttatttttgttcatttatttatttttattttctattttttgagatagagtcttgctctgtcactcaggctggagtgcagtggcaagatctcagctcactgcaacctctgctgcccaggtttaagcgattctcttgccttagcctcctgagtagctgggattacaggcgcgtgccaccatgcttggctactttttgtatttttagtagagatggggtttcagcatcttggccaggctggtcttgaactcctgaccttgtaatccacccgtctcggcctcacaaagtgctgggattacaggcatgagccactgcacctggtgtatgttttttttaaatgaagtcttaactgggaaatgtgaaacagtgaagtatttcagtttccataagtaagatcttaaatgtttagagtgtcaaatgtctctagaagaaaacagcgtcttgttgattctttagcttttcactactctttacaatgcttttccccgaaaagcaatatgagaaattagaaaaaaggttattaaaaacccaagggggccagacacagcgattcatgcctgtaatacgcgcactttgggtggccaacgcaggaggatggctttaggccaggagtttgagaccagtctggccaacatagtgagacctcgtatctattttacatattttaaaaattatattaaaaaattaaaaaaatcccaaagggaatggaatgatagtcatttgctgtaaagaaatcagaagattttcataataatgcttttatcccttccatttttcctctagagttataattgaataattaattgccttatgttgcttattgcttataataattagggaaattaggatgtatctaacaaaaaataaaagactaagaaaaaaatacaaaagactcttgaccatcaaaaggtagctttataaacatctattcaaaatacatttattcaaagaaataatgagcaattacaaaattaaacttgagaatatccttattaaataagatagtatagttaattaaaataatttatacagagaaactgtgaattttattgctttgtcttaaaacattcagactcctttctaacattgtttacagttaaggtttttgggtttaagttgaaggatgaggcctgctaacattactaaatatgcgtttataaccctatacgtcctgtctggagtatgcaaacatctgtagaagcatgatttttttttttttttttttttttttttttgagacagagtcttgctgtcgtccaggctggagtacagtggcatgatcttagctcactgcaacctccacctcccgagttcaagtgattctcttgcctcagcctcctgagtagctgggaccacaggtgcatgccaccatgcctggctaatttttgtagttttagtagagatggggtttcaccatgttggccaggctggtcatgaactcctgacctcaggtcatccacctgccttggcctcccaaagtggtggaattacaggcatgagccaccacgcccagccaggatgaggagtttttaaggcaatataatgcaatatttagtaattgattcctttaatctatgaggtccaacttagaaggaacaaaaatgttaccaggcttcatttaaaaaagagaaattgaggccagccatggtggctcacacctgtaatcccagcactttgggaggccgaggcgggtggatcacttgaggtcaggagttcaacaccagcctggccaacatggtgaaaccccgtctctacaaaaatacaaaaaaattagccgagcatggtggcacacgactataatcccaggtacccgggaggctgagacaggagaatcgcttgaacccaggaggcggaggttgcagtgagctgagatagtgccattgcacaccagcatgggcgacagagtgagacttcatctcaaaaaaagggagaaattatattgaggccagcctggacaataagaccacatctccaaaaggaaaaaaaaaaaaaaaaaagtttaaaaccaggtcaggacctatttgcagatgtacagttatcatcacagaaggctttcttctccagaaatttaactttgtaactagtattcttagcactatagtatttgatagcaaagctacccgcccccacctttttttttttttttaaaacaagttttgcattatacaagactgaatggtgcttggcagagaggaattttaagaatttggaagggcaggagaatggcgtgaacctgggaggcagagcttgcagtgagcggacattgtgccactgcactccagcctgggcgacagagtgagactccgtctcaaaaaaaaaaaaaaaagaatttggaagtagggaggtgaatggaactagactttaactgtagactagaagcttccctttcccagtctctgcccattaaaaaaaaaaaaaagtcacttccactagaagattcatagatgttgggaaaacacaactgggggaacttttgattttcttttttaatgtgggatgggttgagcaggagtactcaagaaattgataggtaactgtagagtaaataacatgtaatgtcattttaaagtttgtattttgttgtggtggttgttttgagatggagtctcgctctattgccaggctggagtgcagtggtgcgatctcggctcagtgcaacctccgcctgccaggttcaagcggttctcctgcctcagcctcccaagtagctgggataacaggcacaaaccaccacacccagctaatttttgtatttttagtagagacagggtttcaccgtgttggccaggctggtctcgatctcctgacttcgtgatctgcccgcgtcggcctcccagagtgctgggattacaggcgtgagccactgcacccggccgttaaagcttgctttagtaagcagaaaacactttcaaagatacatgtgaatgacagctgctatttgtcttgtagctgattcaaagtactcatcataaagttgtttttttgttttttttgagacggagtcttgctctgtcgcccaggctggagtgcagtggggcgatctgggctcactgcaaactccgcctcccgggttcccaccattctcctgcctcagcctcccgagtagctgggactacaggtgtccgccaccatgcccggctaattttttatatttttaatagagacggggtttcaccgtgttagccaggatggtctcgatctcgtgacctcatgacccgcctgcctcagcctcccaaagttctgggattacaggcgtgagccatcgtgcccggccataaagttttttaagttagccatttccagtgtctgatcttcagtgaagtttgtaaattgtttttgttttgttttgttttgctttgttttgagatagagtctccctctgtctcctaggctggagtgcagtggcatgatctcagctcactgcagactctgcctcgtgggttcaagcgattctcctgcctcagcctcctgaatagctgggattacaggtacatgtcaccacacccagttaatttttctgtttttcgtagagatggggtttcaccattgttggccagactggtctcaaactgctgacctcaggtgatccacctgcctcagcctcccaaagtgctgggattacaggcatgagccactgcacccggcctgtatattcttttaaaataataaagatagggagctagatattagtaaaaagtagcaacaaagatgtaaggatcagatgatgacccaaggactgttagtggagggttttgccatgttggccaggctggtcttgaactccaaacctcaagtgatccaccctcctcgcccacccagagtgctgggattacaggtgtgagccaccatgcccagctgacaggtgaaatactaaaaaataacatggctaggctcaaaaatgaagcttaacacctccttggaatagaaaagcaaagtgttctacctaactgaactctggggccagaagttggcagtttttcccatgatttcttgccaggctgacagggtccaaaagtgaccatgtgagaaggagatcagaacttggctcccacttcagacacgggggctgtgtctccttgaaaggatgccagaaagagaacagcatcttgcttcttggtgttaaaaacttttttcattggccaggcactgtggcacacacctgtaatcccagcagttgaggaggatggggtgggaggattgcttgagcccaggagttcaagatcagcctaggcacagtggcaagacccttttctgtctctacaaaaattttaaaaatttctcgggatgttggcgtgcgcctgtggtcccagctactcaggacgctgaggcaggggtatcgtttcagccaggaattcgagtctgcagtgagctatgatggcgccactgtactctggcctgggcaatagcataagacctcctctctaaaagagaaatgataaaaggccaggtacagtggctcatggctgtagtcccagcactttcggaggccggggtggttggattgcttgaggccaggagttcaagaccagcctgaccaacatggcgaaaccctgtctctactaaatatacaaaaattatatttgtttaattacataccacggatgtggtggcccgtgcagacgtcccaactacatgggaggctgaggcgtgagaattgcttgaaccttagaggcggaggttgcagtgagacaagatcatgtcactgccctccagcctgggtgacagagcaagactgtctcaaaaaaaaaaaaaaaaaaaaaggccaggcacagtggctcacccctgtgatcccagcactttgagaggccgaggcgggcagatcacttgaagtcaggaatttgagaccagcctggccaacatggtgacaccctgtctctaatgaaaatgcaaacgttagctgggcatagtggcatgtgcctgtaatccctgccacttgggaagctgaggcaagagaattgcttgaacccaggaggtggaggttgcagtgagccaagattgtgccactgcacttcagcctgggcgacagagcaggacttcgtctgaagaaaaaaaaaaaaacacgttttttataagctgtggccctaggtctggcgtggtggctcacgcttgtaatcccagcacttttggaggctgaggcgggtggatcacgaggccaggagttcgagaccagcctggccaacacagtgaaaccccgtctctactaaaagtacaaaaattagctgggcgtggtggcaggcgcctgtaatcccagctactctggaggctgaggcaggagcattgcttgaacctgggaggtggaggttgcagtgagctgagatcgctccactgcactccagcctgggcgacagagcgacactccgtctcaaaaaataaaataaaaataagctgtggacctaaggaatatgagaattaagagatacccttagtaccagaaatttagccaatatactcacttgctctataaaggcatctgcaatatccccaatgtctttacaaggttggcatctcaaaataccattataagacctagttttggactgagagcaagagatagatatgttaaaataacttttaagataaatttaagacaacttcaagacaaattttaagagattaattgagcaaacattttttttttttccccagagatggagtctcgctctgtcgcccgggctggagtgcagtggtgcaatctcggctcactgcaacctccacctcctgggttcaagcagttgtcctgtctcagccttcctagtagctgggactacaggcacatgccaccatattggtcaggctagtctcgaactcttgacctcaggtgatccacctgcctcaccctcccaaagtgctaggattacaggtgtgagtcaccatgcccagccgagcaagtaattttttatgagtcaggactacccctatcttcaccccttgccccagccagaatagattcagtctgccgctagtgctgctgcatggttggagaggatttatggacagaaaaaggaaagtaatgtacaggaaacagaagcgaggtacagaaatagccgattggttacagcttggcatttgtcttatttgaacatggtttgaagatttggcaacatgtgattggccaaaactttgtgattgatacaagagtatgttataatctgtttacacattgagttgggttacagttcactatatagaaaaatctctgggccgagattaaaggatatgaggagacagctttaggctaaactttatttaacagatatagaggggaagcacctggaaagatgctgtggaggagttggtgagtgggagttggaagatagagaaacaaaccaaaaatccaagttggcaaaatcacattttgaaacatctgaaaaaataaatcttatttaaaaaatctttatgtgaaaaatttaaagcttttagaagaaaaaatatatccttttgaccttggtctaaaaaagaatttatttaaaagggcacaaaaaccaaaaataataaaaggaagattaatacattgaattgcattttaaaattctatacagcaggatgcattacaaagtgaaaaaacagctacagattgagtaagatatttgtaacatatgtaatcaagtaagaattatccaaaatatgaaaaatattttttaaaaaggtaacaatccaaaagggaaatgtgaaaggatttgaataggcaattcacaaaataggaaacctgtatggttgatacatacttgaaaagatgcatccttaaacaaagaaatgcttgaaagaaggataaaaaatgttttggatggtcttacattagcaattaaatgctgtggccagaagtaacactttacttaggccctgagtgattaggatgatcagagcttgcctggtgacccataggaaatagaacacgagcaagaaataaacttctgttatttaaagccactgagattttgggattgttattgcatataatttagtttatggccgggtacggtggctcacgcctgtaatcccagcactttgggaggtcatagtgggctgatcacctgaggtcaggagtttgaaaccagcctggccaacatggtgaaaccccatttctactaaaaatacaaaaattaggcaggcgtggtggcgggtgcttgtaatcccaggtactcaggaggaatcgcttgaacctgggaggtggaggttgcagtgagccaagattgtatcactgcactccagcctgggcgacagagcaagtctccgtctcaaaaaaaaaaaaaaaaaaaaaagtaaattttggctgggtgtggtggctcatgtctgtaactccagcactttgggaggctgaggtaggaggatcactcgaggtcaggaatttgagacccacctgggcaacatagtaagatcccgtctcttcaaatatttaaaaactagctgggcgtgggtggcatgcacttgcagtcctagctactcaggagggtgaggcagaaggagtgactgagcgtgggagtttgaggcttcagtgagctatgacagtgccactgcacactagcctgggtaccaagttagaccctgtctctttaaaagtaaaataaaataaattgctctggttaccatgtagagattggattataagaggatgttgagaaaccactaaggaagtcattaaagttattcaggcgagatatgatgatactcaagactaggatggtgcattggataggacgtggtatatttagatggaatctagtgataatattgaaggcgggcttggcgaggtgtttcacacctataatgccaaaactttaggaggccgaggcgggaggatcacttgagccctagagttcgagacaaacctgccaacatagtgagacccccgtctctacagaaaatacaaaaattagccaggtgtgccaagtggtgatgtgtgcctggtacttcccagctactcaggaagctgaggtgagaggattgcttaggcccgggagattgagacctcagtgagctgagatcgcgccactgcacttcagcttgggcatcaagcaagaccctggctcaaaaaaaaaaaaaaaaaaaaaagggcaggtatattggatttagtgaacaattggatgtgttatgtatttctgcaacaaaatttttacagtaagcaaacagtgcttttgtggaccaaaaatcaaattaagtaaaaagaaaaaaaaaaaacaagaagcaagcccttaacaaggctttgttttcctctgaaccttaaaactttttcgttcctatactatcatttctctgaggtagtttgatttcttcacttcatttacatttttttccattctcacagtatttctctagttaagaattgtattatgcctctactgcaccattataggaaatactttttatggttggacattgtggctcacgcctgtaatctcagcactttgggaggccgaggtgggtggattgcttgagctcaggagtttgagaccagcttgggcaacatggccaaaccccatctctacaaaaaacacaaaaattagccaggcatggtggcacgcagctatagtcccagctattcaggaggcgaggggtgggaggatcacttgagcctgggaggtggtagttgcagtgagctgagatcatgccagtgtgctccagcctgggtgacagagtgagatcctgtcttcacaaaaataaacaaacaaacaaataaaataaataataccttttattatttacctctgatctattcctattacagttccgcattcagtgtaatttcccctaggggtaactgcaatttcatttttttaatatacccaacaaagagctgtagctccctcctgtctgcagatcagtgtttataggacagaatataatattctactatgctaactttaccttttacccttttcttagcacgtgcacacacatgtgtgcacatactgtcagagtccctatttctctctctctacacactgccagtctctctcccttgtcatactgtcagagtccctatttctctctctctacacactgccagtctctctcccttgtccccgcagtcgagtctgtctctctccttctgtttctctctctctctttctctctctcttttttttttaagagacgggcttactccatctgccaggctggagcgcaatggtgcggtcatagctcactgcatcctcaaactcctaggctcaatcagtccttccactttagcctccagagtagctaggaccacaggtgcatgccaccacaccctggctaattttaaaaaagttttttttttggtagagatgggtcctcgctgtgttgccagactggtcctgaactcctgggctgaagcgatcctgcctgctcagcctcccaaagtgttgggattccaggtgtgagccactgcctccagcctttctcttacacatgtgtacacacgcatactgtcttatagtccatgaaaatggaaagatttattccaatggttctgttcttaatattctcaaatgcctttatatctcttgatatcttggcattttcaggttcatcacaaattctccatctttccacatatatctaactgtaagcctttgcatgtgcccatagtgttactggaaaggggtcttgatccagaccccaagagagggttcttgcaccttgtaagaaagattttggggtgggtccacagagtaaagcaaaagcaagtttaagaaagtaaagtattttgtgtgacttcagggcctatactagttccatttggccccataaatatctctagaatctattcctttcttgttttcctctgctcctgcctttatcagttctctccttgtattattgcagtaggtttctagatggtaaatgtccctcttttcttcttcccccaatctctttttcatactccgccagagtacttttctaaaatacaaatctattcattttattcccctgcttaaaattcttcagtggttccttgtggcctacaaaatgaagttcaaactccttatcatggcacatccatcatctggttcctgcttacattttcagcatcatttcctactactactccccctttcccactctgcattccagtaacactgaactatttatggttactggaacttaacacgttcttgctaagcttttgcttatgatacgtcccttgcttggaatttccttctctcctggtctgctttttgaatctttacttatctatgacagtttagctcaagttatatttctgtgatgctgatattttaaaatattccttgatattccctagagagattgggcagtatattagtctgcttgggctgtgtattagtccattttcacactgctataaagaacttccttgagactgagtaatttataaaggaaagaggtttaattgactcacagttccacatgactggggaggcctcaggaaacttacaatcgtggcagaaggggaagcaggtgccttcttcacaaggcagcaggagagagaagcatgaagtgggaacttccaaacacttgtaaaaccatcagatctcttgtgaacccactcactgtcatgagaacagcatgggggaaactgcaccatgatccagtcacctccctcccttgacacgtggggattatggggattacgatttgagatgagatttgggtggggacacagagccaatccatatcaggttgcagtaacaaaatactgtagaatatgtggcttaaacatattttcagaaacttactttcttccaatgtggaggctagaagtccaagatagggtgccagcagtcaggttctggtgagagctctgggttgccttccactgtgaaattagagagaaagaaatctctctcttataaggccatcaatgcatttggattaggaccccatccttatcatctcatttaacctaaattagtacctaaaagccctatctccaaatatagtcacactgaggggggatagggcttcattatatgaattttgggggaacacagttcagttgtagcagtatgcagtatttgttgaaagaagtgctacagtctttttgttttatgattcactgtttacatgattgtctttcccattagattacacatttcttgagagttgggattgtttactttttaaaatattcttcagactttgaatatgtggaattgttgaatatgtggagttgttgaatgggctaagttaattgcattataggatgggattaatgatgtatatttaagtaaggtagacgcctagagtaggtcttctggactgctaactttgactgacattactgatgaatcattttgacccattctttttgcctagcttgccaactggatgggtcctttggttatatatactttcattcaaagcattttataacattaacaacttggacaggcgcggtggatcacacctgtaatcccagcactttgggaagctgaggcaggtggatcacctgaggtcaggagttcaagaccagcctgaccaacatggagaaaccctatctctactaaaaatacaaaattagccaggtgtggtggcacatgcctgtaatcccagctactcaggaggctgagacaggagaattgcttgaacccgggaggcggaggttgcagtgagctgagatcacgccattgcactccagtctgggcaacaagagcgaaactctgtctccaaaaaaaaaaaaaacttgatgaacttaatctatattttaagaactctaaatgattaaaaactttagaaagaattgggatttttcacgattagaggagaccaagatatatttcctcagctgttaaacaacttcaatctgctaaaatatgctacttcattaagattttgggaaagaaattttaagtaacagtttaatgttttggtgtccatcatgtctcctttgctggagcaataatagattttgcatatattttattgtcttttgtgtagaaagcatggtataaagataaatacattagaatacaaaaattgctccctctggatgatgttaaaaataagacacatgtttttcaaggtattctgttgctgttgatgagttttgagagtaatacaaacataggtatgaattttgttaatactgcttttcagtgagcctggtcaattaaacctctttgagtctcagttttctaatctgtaaagtgatacatttatattacaatttggtttatttaaatgcattttaaaattgaaaatgtaaaacattcatttatagtcatgcaccacttaatgatgttttttggtcaacagcagacctaatgaatatatgatggtggtttgtaagattgtaatattgtatatttactgtactttttctgtgtttagatacataaatacttaacattgtgttatgttagtattgcctacaatattcagtagtatagtaacatagagtacaggtttgtaacctaggagcaatagactttataacctaggtgtgtagtaggctataccatgtaggtttgtgtaagaacactctatgatgttcatacaataacaaaatctcctaacaaggcatttctcagaacttattcccattgttaagccacaatgactgttttaaaattctaacagtacaaaagagtagccaatgaaaaactctttttttctactctagatctctaattctttttcttcatctttaaagtgaccattgttaagtttcttacgtttttccagaaatattctttttatatataaatataggtacttatatattaagtataggtatgtgtgtgcatatgtacaaatgtgtgtttggggttgccattaaaaacaataagttatgtagaataactagtatgaagcaaaacagtacagcagattttaaatgatgaatgttattaactctcttccctttctttcatcaaggcttcttaagggcttatgcagtcagaaaattcctttaagatttgttttcattttgtaatttgaaatgttaattttcagatcacaaaggttgtccatgttcacatataagcagaaaagtaattaatatctaacaccaggtaatgatttattccttgccggttatttgagatttttctttaccatgctgtttcattccattagcacagtggtatttaagtagaggtgattttgcactcaaggacatttggcaatatgtggagacattttttggttgtaacatctaggagatactgttaacatttactggatggaatctagggatgctgtaacacgtcttaccatatgtgggacagcctccacaacaaagaatcatctggcacaaaatgcaagtattactaaggttaaaaaaaccgtaagttagcataaataataatgaattaagtataagttgcagcctcgctcattctttaattatagtttgtgttgactgtttattttgtgattttattattttattattttaaaactaaaatgatcctagattagatgttatctaatatgcaacagataggtacatctgttctgtttctcagattctgatcttaaagtcattttatcatatagcattggcatttgttttgcaagtttttaccttaattaaaaataaatcaaaggcagcagaaatctgtgtgttttgttgtcgttgttgttaactaaaatgataaagggatcctcagctgttaaatctactttgttgttttgaggtttgacctggccttattccatatatagccatctgccagctggtaaggtggtatctagtaaggatatttaagagtgttgccttgccagatctagccgtaagcaagtcctatatctaaattaacctttgaggctgaaaatcatatagccatctgccagctggtaaggtagcatctgtctaggatgttcaagaatgttactttgctagatctagaggcaagcatgctctctgctaaatttcatctttactggacctccaggatctttaggacttgtattagtcaggattctccagataaacagaaccaataggagtaagtagataggtaggtaggtaggtaggtagatagatatatgtatagatagatacacaaggggacctcagaaagttcatggaaaatgcatattatgaaaaaactctgcatgtttttcaaaaattttttgtgccaaaataaacttgaacaggatctagtttgaggcactaaggaaggctaagacatcagtttgaaaaaagctcctatcaaagcaacatgaattctactaaaattgaagcaagaacaaacataaaatttatagtgaaactttggtagaagaatggtgaaatcattgatgctttacaaaaagtttatggggacaatgccccaaagaaatcagcagttttacaaatggataactcgttttaaaaaaggacaggacaggccgggcatgatggctcatgcctgtaatcccagcactttgggaggctgaggcgggcggatcacgaggtcaagagatcaagaccatcctggccaacatggtgtaaccccgtctctactaaaaatacaaaaattagctgggtgtggtggcgtgcgcctgtagtcccagctgctcgggaggctgagccaggagaattgcttgaacccgggaggcaaagattgcagtgagccaagatcgcacgactacactccagcctggcgacagagcgagactctgtctcaaaaaataaataaataaaaaaggacaggacagtgttaaagatgaagcttgcagtggcagactgcaaggaaatttgcaaggaaaaaattaaccttgtttgtgccttatttgaaggggacaaatgattaacagcaaaaacaatagcgaacatcacagacatctcaagtgattcagcttacacaattctggctgaaaaattaaacttgggcaaactttcatctcattgggggccaaaaccattgcacccaaatcagctatagacgagcagtgctttcaatggaatttttaaacaaatgggatcaagatcctgaagcatttcttgaaaaaattaaaacagatgaaacatgtctttaccaatatatcctgaagacagggcataattaaagcaatggctaccaagaggtggaagtggtccagtcaaagcaaaatggactggtcatggcaacagttttttgggatgctcaaggtattttgcttgttggttttctggagggccaaagaatgataacatctgcttattatgagaatgttttgagaaaaccaaagctttagcagaaaaacactagggagaaatttgttaaagagtccttctccaccatgacaatgctcctgctcattcctgtcatcaaacaagggcaatttttaaagagtttcaatggaaaatcaatatagtcctgatttggctccttctgacttctttttgtttcctaatctttttgtttgtttgtttttgagatagtgtcttgctctgtcacacaggctggagtgcagtggctggcacaatcttggctcactgcaaccttgacctctggggctcaagcgagcatcctacctcagcctcccaagtagctaggactacaaggtgtgccaccatgcctggctaattttgtttattttttgtagagatgagatctcagtatgttgcccagtctgggctcaaactcatgcctggtgacacagtgagactctgtctcaaaaaaaaaaaaaaaaaaaaaaaaaaaaaatatatatatatatatatatatatatatttatttatttatttacgtctataatcccagcaatttgggagactgaggtgggcagctcacttgagcttaggagttgcagacccgcctgggcaacatggtgagaccccttctcttcaaaaaaattcaaaaataagctggataggctgggtgtggtggttcctgcctgtaatcacagcactttgggaggccaaggcaggcagatcacctgaggtcaggagtttgagatcagcctggccaagatggtgaaaccccgtctctactgaaaaaagacaaaaaaattagccaggtgtggttgtgggcatctgtagtcccagctactccggaggctaaggctggagaattgcttgaacccatgaggcagaggttgcagtgagctgagatcatgccactgcactccagcctgggcgacagagccagatcctgtctcaaaaaaaaaatacatatatatatatatatatatatatatatatatgtttttgtacagttatacagtatgttcgtgttttaagctaagtgttttattataagagtaaaaatgttaaaaacagttaaaccacaggttaaaaagtttatgaagtaaagttagagtaatctaaggttaatttattatcaaggaaataaaaaacaaaagtaatgttgtctaagtatagtgtttatgaagtctacagtagggtacagtaatgtcctaggccttcacattcacttaccgctcacacactgacctagagcaagttctagtcctacaagctccattcatggtaagtgccctatacaggtataccatattttatctttcatactgtatttttgctctactttttctgtgtttagatacacagatactattgtgttgcagcaacctacagtattcagtggaatagctatacaactatcctatagtctagaagtaataggctatatcatatagcctaggtatgtaataggctatgtcatccaggtttctctaagtacactctatgatattcatacgatgaagtcacctaacaacaaatttctcagaacatatttctgtcattaagccacacatgactgccttaagtattgttccatgaaatttttattttagttttatgtttacctttgcatttggtcatgattcaaaaaagcatttcttatactatgtttctttctatactaagttaactataaaatggtacatcactggtaatagtgataataaaccggccattttcatgaaaacttagttttatcttggctaggcacagtggcttacgcctataatcccagcactttgggaggctgaggcgggtgaatcccttgagcccagagttagagaccagcctgggcaacatggtgaaaccccgtctctacaaaaaaattagttgggcatgatagcctgcgcctgtggtcccagctacttgggggcctgaggtgggaggatcacctgagcctaggtgattgaggctgcagtgagccctgattgtgctaccgcactccagcctgatggatagagtgagaccctgtctcaagaaaaaaaaacaacaacagcagcaacaaaaaaacccacaaaaacaaaagccgaaaagaaaaggaaacttagttttatcttgacaaagatatctaatttgcttctaagctttttaaattgaaacaatgcatggcctatcttttgaatttgtgagtttgccacccctgaaaacatctaagtagatcatctgtcagagatgttacaggtaggatgaattcctgctttattatggaaaatttgacttctagttctttccaagtaatattttataattctaacttatatatgtggtcctattcctagaaaatgatgtattcttttcatacagtttttccagtggtactgaaaataacctcagcccgaattggctttgttaaacttggaagtttttcaagaaacatgactctagaattctttactaggtcttcgcaaaatatttcgccttgcagtaagaattgtgttcctctcatatctctttttttccttatttccatgctttcccattttattcacatggacaatttttagtcaattagcatttattttggggcttcctcaaaaactctaaattttttttttgagatggagtctcgcttggtccgaggctggagtgcagtggcgtgatctcggctcactgcaacctctgtctcccaggttcaagcgattcttctgcctcagcctccagagtagctgggattacaggcgggcgccaccacgcccagctaatttttatatttttagtagagatggggtttcaccattttggccaggctggtcttaaactcctgacctcatgatccacccgcctctgccttccaaagtgctgggattacaggcgtgagccactgcgcccagccaaaaaactctaaatttacctctttaggaatttcaacctgaccatttgtatctcttcttatattttcagttgttgcaataaattttaactttttttatgttattttataaaattgtttccattcatatatacattttcttttttataacagctttattgggatataatctacatagcatataattcacccattaaaatgcagaattcagtgctttttagcgtatccacagagttgtgcaactgtcaccactgtcaattttagaacatttttcttacaccactaagaagtcccatgtccattagcagtaattcttcattcactccctccccaagcctctggcaaccactaatctactttctgtctcaaatttgcctgttctagacatatcctgtaagttgagtcgtatcatataatatatagtctttggtgactggcttctttcactcagcataatgttttcagggtccatccatgttgtaacatatatccagcacttcatttccttttattgcccaataacattctattacggatatactgcatttcctttatcctttcatcaattgatggacatgcggttgtttccactttttagttattgtgaataatgccattatgagtattaacgtacaaatttttttttgtggacatatgtttttatatctcttgcatatacccaagagtgaaattgctgggtcaggtggttaaggcgtaagagttctttttatggccaggcacagtggctcatgcctataatcccagcactttgggaggtgaaggtgggcggatcacctgaggttgggagttcgagaccaccctgaccaacatggagaaaccctgcctctactaaaaatacaaaattagccaggcatggtggcgcatgcctgtaattccagctactcaggaggctgaggcaggagaatcgcttgaacccgggaggtggaggttgcggtgagccaagatcacgccattgcactccagcctgggcaacaagagcgaaactccgtctcaaataaataaataaataaataaataaaagttctttttatattctggatactagtactttgttagttatatgacttgtaaatttttcccccattctgtgagttgtcttcactttctttatggtgtgttttgaagcacagaagttttaaattttgttgacattctatctatttttccttttgttgtgctttttggtatcacagctaagaagctattacctaatccaggatcataaaggatctacacctatgttttattctgagatatttatagatttacttattacgttttgcgtttctgatccattttcagttaatttttgcttatgatacaaggttaggggatccaactttattcttttatacatggatatctagttatcacagcatcatttattgaaaagggcaattttttccccattgaattgtcttggcacccttgtcaaaaatcagttcaccatatatataagggtttatctctgaactctcaattccattccattgatgtgcatgtctgtctttatttcagtaccacactgtgctacagtctttatttgttgctttgtattacgttttgaaatcaggaaatgtgaatcctctgactttgttcttctgtttcaagattgttttggctattctgggtcctttgcatttccatataaagcagcagcttgtcaatttctactcgaaaggcagctggtgtttgaaagagattgcattgaatatgtagataaatttggggagtattgacatcttaataaatattaagtcttataatcagtgagcatgggatgtctcttcatttgtttagataagattactttttttcagtgatgttttgccattttcattgtgtaaatcttgcacttcttctgttacatttattcctaataattttgttcttttgatgctattatgaatgggctcattttcttaatttcgcatttggattgctcattgctagtgtacagaaatacaattgatttttatatattgatgtattctgcaatgttgttgaacttttattagctctagtaatttttttgtaggttccttaggatttgcttatatacaagcaaatttggattttgtagattccttaggatttgtttatatgcaaatcctaaggaacctacaaaaaattactagagctaataaaagttcaacaacattgcagaatacaagaccatgccatcttcaaacagagatgacttgacttcttcctttctaatctgtatgtctttttatttcattgttctttttctttcttctttatttttactttttgtctcctttccctggctaggggaatctccagtacaagtttggataggtttggggaagccaacatttttgtctcgttcctgatcttcgaaggaaagtttttagtttttcaccattaagtatgctgttagttgtgggtttttcttttttcttttttctttttttttagtatttattgataattcttgggtgtttctcggagagggggatttggcagggtcataggacaatagtggagggaaggtcagcagataaacatgtgaacaagggtctctggttttcctaggcagaggaccctgcggccttccgcagtgtttgtgtccctgggtacttgagattagggagttcaagcatctgtttaacaaagcacatcttgcaccgcccttaatccatttaaccctgagtggacacagcacatgtttcagagagcagcgggttgggggtaagattatagattaacagcatcccaaggcagaagaatttttcttagtacagaacaaaatggagtctcccatgtctacttctttctacacagacacagtaacaatctgatctctctttcttttccccacatttccccctttcctattcgacaaaaccgccatcctcatcgtggcccgttctcaatgagctgttgggtacacctcccagacggggtggcggccgggcagaggggctcctcacctcccagacggggtggtggtagggcagacacactcctcagttcccagacggggtcgcggccgggcacaggcgctcctcacatcccagacggggcggcggggcagaggcgctccccacatctcagacgatgggcagccgggcagagacgctcctcacttcctagacgggatggctgccgggaagaggcgctcctcacttcccagactgggcggccaggcagaggggctcctcacatcccagatgatgggcggccaggcagagacgctcctcacttcccagacggggtggcggccgggcagaggctgcaatctcggcactttgggaggccaaggcaggcggctgggaggtggtggaggttgtagcgagccgagatcacgccactgcactccagcctgcaatcccaggcactcggcaggctgaggcaggagaattcaggcagggaggttgcagtgagccgagatggtggcagtacagtccagccttggcttggcatcagagggagaccggggagaccggggagaccggggagactggggagagggagagggagagcagttgtgggtttttcatagatgcctttatcacattgagaatgatcctttctattcctaatcatgaaatggtgttgtatatttattaagacattaaatacacattgactagtatttatttgctttcccacatagaaaatattattattattgttattatttttcttggagacggagtcttgctctggtcacccaggctggagtgcagtggcacaatcttggctcactgcaacgtctccctcctgggttcaagcaaatcaccttcctcagcctcccgagtagctgggactacaggcgcatgctgccacacctggttaattttttgtattttagtggagatggggtttcactgtgttgcccagggtggtctcgaactcctgagctcaggcaatccacccacctcggcctcccaaagtgctaggattaagaaaatattcttaatactagtctttcaaagttttcttctcttattttctctcttctactttgaagggaaagcagggatcaacgtaagagtgcaataaatatcttttttgaaattctaaacactaaggttgaattgtcactaatttactttatttaaaaatcataaaggctgggtgcggtggctcacgcctgtaatcccagcactttgggaggccgaggcgggtggatcacgaggtcagcagatggagaccatcctggctaacacggtgaaaccccgtctctactaaaaaaaaaaaacaacaaaaaacaaaaattagccgggcgtggtggcgggtgcctgtagtcccaactactcaagaggctgaagcaggagaatggcgtgaacccgggaggtggagcttgcagtgagccgagattgcgccactgcactccagcctgggcgacagagcaagactccgtctcaaaaaaaaaaaaaaaaaaaaaaattataaaatgtggccaggcgtggtggctcacgcctgtaatcccagcactttgggaggccgaggtgggcgatcacctgaggtcaggagttcgagaccagtctggccaacatggtgaaaccccatctctaccaaaaatacaaaaattatctgggcatggtggcaggtgccagtaatcccagctactcgggaggctgaggcaggagaatcgcttgaacccaggaggcggaggttgcagtgagccgagatcacgccattgcactccagcctgggggacaagagcgagactttgtctctcaaaaaaaaaaaaattataaaatgcattgaaagtgggataatggaaatgttttcttgggggagtcacgtacttcatctgggttaacctgttacagagggagttagtctaagtgaatcttaaaattgttatcctcaaatttcagtgatcttttactttatagcttgtatgcttctatggtcccccagcaagaaatcttgtactcattagcagttattcccagttcttttccacacacactcccctatcccagctgtaggtaagtactagtttactttctgtttcagtatcttcacctattttgggtgtcttatataaattgaaatctataaattgtagtcttttgtgattaacttcatggttcatccatgttttagcgtatatcggtacttcctttctttttttttaaactatggcaaatcatataataaaattcactttcccaacaattttcaagtatatagtacaatattgccaacaacatgcacattgttatgcaacagatgcccaggatccccctatcctgcatggctgaaagtctacatccaccaaacacaacttcctacttcaccctccctctagctcctggcaacaaaccaccatttgactttctgtttctgtgagtttcactgctttagatgctttatataagtatgcattatttcatcttttgtgactggtacacttctcttagcataatgtcctcaaggttcatccttgttgtagcatatgacaggatttacttctttttaaaagactgaataatattctcttgtatgtatataccatattttgtttatctgttcatctgttgatgtacatttaagttgcttccacctcttgcctattgtgaataataatgcagtgaacatgtgtactgtggactgaattgtgttctcctcaaattcatatattgaaaccctaactcccagtgtgactgggtttgtagataaggcctgtaaggaggtgatgataaaggttaaataagataaggttggggcctaatccaatagggctggttcctttataagaagaggaagacaccagatcttttttctacactgtgggaagacacagcaacaacatggccatctgtaagccacgaagagagctctcaccaggaactgatggatagcacctggatcttggactgctcagataggtttatacgatctagtctgtggtattcagtagcccaagctgactaatataatggctgtgtgtgtacaaatagcttttcaagattttttacaattcttttatacagtgggaaaactgtattctatttatacccagaaatagaattgctagaacatgtagtagttctatttttaattttttgaggaacttccatattgttttccatagcggctgcaccatttttcattcccaccaacagtgtacaagggtcaaggattccaatttctttatatattcaccaacacttactttctgcctctgtctctctttctctctctctctttctttcctttctttctctctctctttctgtctctctctttctctctttctttcttctttttttttcaagacggagtcttggtctgtcacccaggctggagtgcagtggcgcgatctcggctgactacaacctccacctccctggttcaagcgattctcctgcatcagcctcccaagtagctgggattacaggcatgtgccacaatgcccagctaattgttttatttttatttttatttttggtagagactattggtctttgcccactaaattggaagatatattaccttgtaattgccttcagagcagggttttcctcctttagctcattgacatcttgtaccagataattttttttccagataatttctgtgtgtgtatatggaggagccatatgtgcattgtaagattttgccagcatccttgacaaatgttggtggtactaccgactaataacatagtggtacaaatgttagtggtactaccgacaaatgttagtggtactaccaccggttgtagtgacaaccaaaaatgtctccagacatctccaaatatcccctggggcgtaaaactgcatatcattgagaactttatggccctaaagaaagagatacagttttattctctgctcgctttcttttctgttagtcttgattatttgtcatttacaatatttaaccttgctcagcaaaattttaacctttcaaataaaagaagtaggttactgctttaaattattgctaaataattctcagggcaggtttttctaagtgaatttgaacttagaaacatagaatagagatggatgaaagtatcctcattttatttgtttttttataagaaaatttatttttgaaataatttggggcacatgtgcttgtgaagaaatccgtagatattgagagagatgaagtgttaaagatagtttaattcaacaaatttctaaaaaaataacaaaacctagagaaattatgtaatttgttttttgtgttggtgttggtgtatatagttacatcaaaaattttaaagactttagttagatgtgttctacatgtggaacacttttgtgttgaaatgttttgtggaggtcactagtgatttttagaacactatacatgtactaaaatgttctatgtaatattggatggaatgatccattgttttatttacccttctttttctctagaacttaactctacatttggaagtagtgtatcttacattttttaatttttaataacaaagccaaataatcttctcagtgaattagaaacttatttatttattttttgagatggagtttcacccttgtttcccaggctgaagtgcaatggcacgatctgagctcactgcatcctccgcctcccgggttcaagcaattctcgtgcctcagcctcccaagtagctgggattacaggcatgcgccaccatgcctggctaattttgtatttttagtagaggtggcgtttcaccatattggtcaggctggtctcgaactcccgacatcaggtgatccacctgccttggcctcccaaagtgctcggattacgggtgtgagccaacacacctggcctagacattttttaaagtgtagtaaatatgtgacatactggcaatgttgcatcaccatatacttgaaaatgctatccagatgcttttttgtataggagtcccacaagatatgcaaacatttttatttatttatttatatttgtatttatttatatatttaagacagagtctcccccatcacccaggctggagtgcagttgggtgatcacagctcactgtagcctcaacctcccagtctcaagccatcctcctgtctcagcttcccaagtacctgagactacagatgtgtgccaacatgcctggctaattttttaatattttgtagagacagggtttcaccatgttgcccaagctgatctcaaactcctgggctcaagcagtccaaccatctcagcctcccaaagtgctgggattacaggggtgagccactgcacctggcctatttttagttttttgaggaacctccaaaccattctctgtagtagttttattaatttacattcccaccaacagtgtataagggttcccttttctccagacccttgcagcatttgttattgcctgtcttttgccatgttgccagggttggtctcaaactcctgggctcaagtgatcctcccgccttggcctcctaaagtgttgcaattgcaggcataagccaccatgcctagccctacaaacataattttttttttttttttttttgagacgggagtcttgctctgtcgcccaggctggagtgcagtggcacaatctcggctcactgcaacttccgcctcctaggttcatgccattctcctgcctcagcctcccgagtagctgagactacaggcgcccgccaacacacctggctaattttttgtatttttagtagagatggggtttcaccgtgttagccaggatggtcttgatctcccgacctcgtgatctgcccatcttggcctcccaaagtgctaggattacaggcataagtcactgcgcccggccacaaacaattttatacaaagaatttgaaatttgaaaattaacacaggctgggcgtggtggctcacgcctgtaatcccggcactttgggaggctgaggtgggcggatcccctgaggttgggagttcaagaccagcctgacaacatggagaaaccctgtctctactaaaaacacaaaattagctgggcatggtggcgcatgcctgtaatcccagctacttgggaggctgaggcaggagaatgcttgaacctgggaggcagaagttgtggtgagccaagattgcgccattgcactccagctggggcaacaagagcgaaactccgtctcaaaaaaaaaagaaagaaaattatacattgttgaaataattttatttcattagatatgcataataatttttagctctacaattttatgttcgcttgtgtttttgagtctgtaaatcataatgatgggcctattgggcattcatttcaatatagtattagtgtaacagagcaaagagtatatgaatactcatgatcctaccacatttggggatatagtctgtagaccctttttgtgcccatgtgcacacactcacatacatttttttttttttgaaacagagtcttgctctgttgctcaggctggagtgcagtggtgccatctcagctcactgagcctctacctcccaggttcaagtgattcttccgcctcagcctcctgagtatctgggatcacaggcatgtacctaccacgccctgctaatttgtgtatttttagtagagacagggtttcaccacgttggccaggctggtctcaaactcccgacctcaggatccactcactgcgacctcccaaagtgctgggattacaggtgtgaaccactgcacctagccataaatttttaaaaatgcagttacattatgctggtgtttaatacggtctttcccctctaaaaatagattgtagattggctggatgtggtggctcacacctgtaatcccagcactttgggaggccgaggtgggcggatcatgaggtcaagagtttgagaccagcctggccaacatagtgaaaccctgtctctattaaaaatacaaaaaaattagctggacatggtggcagatgcctgtaatcccagctacttgggaggctgatgcaaggagaatcacttgaacctgggaggtggaggttgcagtgatccaagatttcgccactacccttgagcctgggcgatgctgtgagactctgtcaacaaatcacatctaaacaatttttcatgactgcatagtattttattttggggtatagtatgattttgacaacctaaatatatctatagagaactgattactggccgggtgcagtggctcacgcctgtaaatcccaacactgtgggagcctgaggtgggaggaatccttgaactagcttgtgcaagagggcgagaccccatctctacaaaatgtgttttaaaatactagacaggcatggcggcatgtgcctatagtccagctactcgggaggctgagctgggaggatcccttgagcccatgagtttgaagctgcagtgagctgtgattgcaccattgcactccagcttgggtgacagagcaagaccctgtctcacatacacaagaagagagaaatgattaccagtgtttgctattacaaataatgttctagtaagtaagtacacttatacatatttgtatttttttaatataaaaatttgaaagggaatgtggagtcttaggaagatccatatttaaaattgttattttatgatgctctccaggcaggttatagaaaattatgtaggttaagaatgtttctaggatattcaaaatttagtcctcttttaagagtaggtaatgaggatggccacccattgcaacatgggttgaaaaaatagagtcatccaaaaccatctcatggaattcttatttatttgtttatgggtttatgacttatatttacaccattagaatataacaccttaagggtaggtgggcactgtcttattcccagcatttttcctggtttagaatactgccgggcacataacccacacctaataataagtatttgacttttttttttgagacagagtgttggccaggcgcggtggctcaagcctctaatcccagcactttgggaggccgaggcgggcggatcatgaggtcaggatatcaagaccatcctggctaacatggtgaaaccccgtctcttctacaaatacaaaaaaaattagccgggcatggtggctggcgtagtcccagctactcgggaggctgaggcaggagaatggcgtgaacccgggaggcggagcttgcagtgagccgagattgtgccactgcactccagcctgggcgacagaaggagactccgtctcaaaaaaaaaataaaaataaaaaataaaaaaaaaaaagtgttgctctgtcgcccaggctggagtgcaatgacttggtcttggctcactgcagcctcctcctcccgggttcaagcagttctcctgcatcagcttcccgagtagctggaactacaggcacgtgccaccatgcctggctaattttttgtatttttattagagacggggtttcgacatgttagccaggatggtctcgatctcctgaccccatgatccgcctgcctcggcctcccaaagtgctgagattacaggcatgagccaccgcgcccggcctctttaatgactgatttttgtgtagactccaggatatataagcctcttagaggtttaagcgtggcttatgtgcttttctgtggtttagctgttggctctgaattaggagagaacaatatatcttattgctgtttgggaaagcttggattattttgtcagtttagaattggtgtgtgtgtgtgtgtgtgtgtgtgtgtgtgtgtgtgtattttttgttttaatcagcttttgcttgtctttctctttaggtgtacagaaaagagttaaaatagcaggcctggggtgggggtggcagctcacacctgtaatcccagcactttgggaggccaaggcaggcgaggtcgggagttcgagaccagcctgaccaacatggagaaaccctgtctctactaaaaatacagaattagccgggcatggtggcacatgcctgtaatctcggttactcaggaggctgaggcaggagaatcgcttgaaaccgggaggtggaggttgcagtgagccaagattgcgctgttacactccagcctggtcaacaagagcgaaactccatctcaaataaataaataaataaataaataaataaataaataaataataaaaaaataacagacctgagactgctatctttagaatggcctgcttgcaacttggcccttagctggcatttaggaatttagattttgggagtgttcccaccatccccaaaccgatatgagtggtttactatgcctaaagtgtttgtgcaaacagtgtggaaatatgctttatattgaatgcctccctttcttctgggaatttggatacctgctaggctaagtatgcctctgtgacccatgacccaataaaaactttggacactgagtctctaatgagcttccttggttaaacaacatttcacacgttttgtcacaattcactgctagaggaattaaatgcaccctatgtaactccacggaactgatggaagtttacacctggttttctcctgactttgattcatgtcttttcctgttgctgagtttggtttgtattattttgctgtaatatattatagccttgaggctgggtgcggtggctcacgcctgtaatcccaacactttgggattacacccagatgaggtgggtggattgcctgaggtcaggagttcgagaccagtctggcccacgtggtgaatccccatctctactaaaaatacaaaaaaaaaatagccaggcttgatggcatgcacgtgtgatcccagcaatctggggggctgaggcaggggaattgcttgacctagggaggtggaggttgcagtgagccaagatggcaccactgcactccagcctgggcaacagagcgagactccgtctcaaaaaacaacaacaagaacaacaacaaaaaaagcattatagccttgagtacgactttgtgctgaattctgtgggtctcagggatccccaacacaacatcaaatttgagaacatcctgagcaggtaggtaccttatgaagattttgatctctttcctactatgatctttctctgacatcatgagaatgctcagcaaaatgataatttaatctgttgtattctagatacagaaatatgtaaattaagggatgaatattttatttttgaaaggattatttgctttacaaaagatttcaccatgggctgggcgaggtggctcatgcttgtaatcccagcactttgggaggccgaggcaggtggatcacctgaggttgggaggttgagaccagcctgaccaacatggagaaaccctgtctctactaaaaatacaaaattagccgggcatggtggcgcatgcctataatcccagctacttgggaggctgaggcaggagaatcgtttgaacctgggaggcggaggttgcagtgagcccagatcatgccattgcacttcagcctgggcaacaaaagtgaaactccatctcaaaaaaaaaaaaaaaaaaaaagatttcaccataagattgggaaaatagaggactcttgcttgatttatatacttaaatttagaaatttgagtttacactaaattttatagggacaattatgttagattaagatactctgtttttcatatatttcataacagaatttgtgatactctgaaatcccagttgtatttgtcttgagaagtttgtgttctgggaaaggaatactgttgcttcagctatttagttatttgccccattactgcaaggttcctgtgttgtttattttagatagttcattttgacatttagataaaccaaagccaaacacacaagcatgcccagaattagtccctgaacttcattccagggtaaagataagacatttagacttctccagtacagataaatatattacaactactgaaaaatgggtgttatgtgactcttgtatttttagatacagaatgacagtgaaggtcttaaaaaatttctatcagttaaacttatgggaaaatttatattcacttatagatcctacttttcaattataggttatgcctaggattctgtgactcaataacaccttttaataacacgaatgaaaaatatttaaattcccctgaactatatgttgtcctattcagctctatattgtgtcttgcctttgaaaaaatggacttcattgaggtataaactgcatctatttaaaactgtacaattccagccggacacagtggcccacgcctgtaatcccagcactttgggaggccgagacgggaggatcacctgaggttaggagttcgagaccagcctggccaacatggcaaaaccccgtctctactaaaaatacaaaaattagccgggtgtggtggcaggtgcctgtaatcccagctactcgggtggctgaggcaggagaattgcatgaacccaggaggcagaggttgcagtgagccgagatcgtgccattgcactccagcctgggggacaagaacgagactctgtctcaaaacaacaacaaaaaactacaatttgatgagtttttgttttgttttttgttgttgttgttgtttttgagacagagtttcacccttgttgcccaggctggagtgcaatggcatgatctcagctcaccacaaccaccatctcccaggttcaagcgattctcctgtctcagcctcctgagtagctgggattacagtcatgagccaccactcctggctaaattttttgtgtgtttttagtagagatgcggtttctccatgttggtcaggctagtctcaacctcccgaccttaggtgatccgcctgcctcagtctccccaagtgctgggattacagtcgtgagccactgcgcctggccaattcggtgagtttttataattgtataatagtcatgaaactccccaccatactcaacatacagtacatttttatcatcccccaaagattccttatgcccctttgtattctgtttgccccttgcccttagcaccaggcaatgactgatctgctttagattactttgtattctctaggatttcatatgaatggaatctatatgcacttgtgtgtgatgtcttttgctctgaacaatgtttttgatatttatccatattgttacataatctattccttttattgctgagtagtaacttatatggatgtatcacattttgttgatcaccaatttatgaacagttgtttacgtattgtaaataaattgctattgtatgagtttttgtgtgatatatgatttcattttcctgttttgtttttggttttcattaataaaaaagattggttctagtagtcaggcattgtggcttgtgcctatagtcccaactatccagagaccaaggcaggaggatcacttgagcccaggagttcaagtccagcctgggcaacatagcaagaccctgtctcttaaaataattggttctaatagttcttgttagtggcaaaaattaggggaaagaagtacatcaataatttacttattcaataaatacttgttgaatgccaagtataatgccatgtgcttaaaacacaatggtgaacaaggactcagcccctgctcttattttagcttatactttaatgaacaagctaagcacatttacaagtagtaagaattatggggattgtgtgcataagtatagaatgttatggaagtatgtgataggggatcccgcctcagtggtctggggtaattagagtaggagtcttcagagaaatgtttaagaggaacagaaagtaaataaatgaggcactccaggtaaagagaacagaatgcatgaaggccttgatgtgaaaaagagaatggtactttatgtgtgctatctggatgaagctggagggatttggagtttctagattatgtaggtccttgtacaacatcttaaggattttggaaattttcctgaagatggtaggaaatcactaaaatgtttcaagcaaggacgtgacgtgatcaaattgtggatcttatcattgcagtttaatatatactgtcttttttttttttgagtaaattatttatagtcccttcattatcagaaattctgcccattatttaaaattctattacttttaataataatttttagtaatactaagtatatacccaaaaggaaggaaatcagtatatcaaagagatgtttgcactcccctgtttacttcaccattgttcacaatagccaagatttggaagcaacctaagtggccatcaacaggtgaatgaataaagaaaatgtggtacatatacacaatggagtactattcaaccataaaaaagaatgagattctgttatttgcaacaacatggattggaggacattatgttaagtgaaataagctaggcacagaaagacaaattttgcatgttcttacttgtttgtgggagctcaaaattaaaacaattgaactcatggagatacagagtagaaagatggttatcagaggctgagaagaatagtggcagagggggtaaggacagggcagaagtggggatggttaatgggtacaaaagtataattagatggaatgaataagatctaatatttgatagcacaaggtgactacagtcaacaataatttattgtacattaaaaataactaatagagtataattggattgtttgtaatacaaagaataaatgcttaaggggatgcatatgccatttaccctgatgtgattgttaactcattgcatgtctgtatcagaatatttcatttacctcatatatacctactatgtacccacaaaaataaaaaaattttttgtaagagatgctatcaagaaggtgagtaaaatattgcagtaagactaggaccactccccattttattattttatttctgaataagtaaaaaaatttatttttaatttttgtttttgagacagggtctcactgtcacccaagctggagtgcagtggcgtgaacttgggttactgcaatcaccacctcccgggctcaagtgatcctcccaccccagcctcccaagtagctgggactacaggcacacaccaccacacctggctaattttttgtatttttggtagagatagggttttgccacgttgcccaggctggtctcaaactcttgagctcaagcgatccgcccaccttggcctcccaaagtgctgagattactggggtgagccactgcacccagccctgaatatgtagaatttaaatatgcagatgctactggaatactaaagttttaaattcccatttatgtaagagaaggctacttgctggaagtaaatcggggataaagccaagaggcctggtatttgattttcggtaacagtctataaccaagtaacttacctactaacttatctagttacttgttacttgttatctagtaacttgttacgttattgagcactcatttatagtacttgctctgagtctgtgaggaggaagtctttaggagaagcagggattatcagaacaatttacagttgtgctttaatggacaaaaccaaaacatgattacaatttgacaattttgtttatatatagtgcttagtatatttatataaactctctagagctgcactatctaaaatagcactagagacacgtggttatattagttggcttggactgccacaacaaaatacaatagactcgatgtcttgaaacaacagcaatttattttttcacagctctggaagctgggaagtccaagatcaaggtgctagatgacttggatccctggtaagggctctattcctggcttgcagatggccaccttctctctgtgtcctcacatagcacagagagaggaagcaagctctgcagtgtctgttcctatagggtactaatcctatctcatgacgtccttgaaacctagttacctccagaggctccatgtccaaataacatcacattgtgggttagggtttcagtaagtgaatttgagggggacacaattttaagtcttacagcagtggctatttaaatttacattgcaattaattgaaattaaaacaatactaaaaattcagttcctcagtcacactaaccgtatttcaagtgcttaatatccaaataaggtgactgagagtgatggttcacacctgtaatcccagcactttgggaggccaagttaggaggattggttgagcccaggaaattgagaccagactgggcaacatagccagaccccatctctatctaaaaaataaaaataaaaaaatatgactactggttactgtattagacaatgtagattatagaatatttccattttcacagaaaattatattggatggtgctgatatatagtatatggaagtctgtcatgatagctattgatacacaaaagacgttagtcttattttgagtgagatacaatgctgtgattgtgtcttacttgaagtctgctttcctcagtaaaaatccattataatgaactcctttaagaagtggagagttttttgtttgtggggagtgattagttttattttaaagtgttttttggcccaaaatggttagttttattttaaagtgtttttggattattttcatggtatgttcttttgtgtactttttatcttaaaattaaagtagtattgccaggggcggtggctcacgcctgtaatcccagcactttgggaggccaaggtgggcagatcatgaggtcaggagatcgagaccattctggctaacacagtgaaaccccgtctctactaaaaatacaaaaaattatctgggtgtggtggtgggcgcctgtagtcccagctacttgggaggctgaggcaggagaatggtgtgaaccggggaggcagagcttgcagtgagccgagattgcgccactgtactccaaactgggcaacagggtgagacccgtctcaaaaaaaaaaaaaaaaaaaaaaaaaaaaaaaaaaaaaaagttaagtagtattgctaattacctgtttcagatctcatcacaaaggacactatgtttttttgtttgtttgtttgtttttgtttttttgagatgaagtcttgccgtgtcgcccaggctggagtgcaatggctcaatctcggctcactgcaacctccgcctcccgagttcaaatgattcgcctgcctcagcctcccaacttgctgggattacaggcgcccaccaccacgcccagctgcccagctaagttttgtacttttagtagcgatggggtttcaccatgttggtcaggctggtcttaaactcctgacctcatgatccgcccatctcgaccttccaaactgctgggattacaggcgcgaatcactgcgcccgaccgattggttctatttatgtagcacttttctttctttctttcttttttttttttttccagagggagtctcgctctgtcgcctaggctggagtacagtggcacgatctcagctcactgcaacctctgcctcctgagttcaagcaattcttctgcctcagcctcccaagtagctgggactataggcgtgtgccaccacacccggctaatttttgtatttttagaagagacggggtttcaccatattggtcaggctggtcttgaactcctgacctcaggtaattcaccagcctcggcctcctaaagtgctgggattacaggtatgagccactgtgtccagactgtatagcacttttcaaagccctttcatatatctctgctactcacagtgaacccgagtgtggagattgcatgtaaactatacagtatacatggcttcatatgtgggtgtctcttagaagacacacaatagtgtgaactctcctaataactgtatataaatgtgtaagttgaacctgtattctttccttttttcactcctttcttttttttaaagtgccttgggatttttagaaggggatatacctttccaataacccatatactattgtctgccaaattgaccatattttcaaaacagatttattatctatctacctacctacctacctatcaatcatctgtctctctattgagagacactagtattagcatctgatccaaaacaatgaatgagattaaacctcatgtaataagattttgagttagaataataaatagccttatatgtgtttgggttttgcatactgtagctgtcatatcatgtttcagttattcattgcttcagatgattaagggttttttttttgtgctcagccttaatatagctcatttatcatgaacatgatataataatttttcatgactattatctatttctagtgatttcttcatcaatatagatttataatgactttttttagaatgaaagaagaaacagaaaaatgacataaagatcaattatttttagcaagcaataatataaagatatattatttttagcaatattttatatatatatatatatatagagagagagagagagagagagagagagagagtattatagataagccattaaaatctttggaaacctatgctaatttttctgtgtcatactttcatctttttcccccaacatcatatagtagaatgagacacttctactcaaaggacaagacatagattgcaagtttgacttttttggttttttttgaaatggagttttgctctgtcacccacactggagtgcaatggtgtgatcttggctcactgcagcctccgcctctggggttcaagcgattctcctgcctcagcctcccaagtagctgagatgacaggcacacgccaccacgctcgggtaattcttgtagtttttagtagagatggggtttctccattttggccaagctggtcttgaactcctgacttcaggtgatctgcccactttggcgtcccaaagtgctgggattacaggtgtgagccaccatgcccagactttacttgtttttcaagtaaatgattggacaccttcagtttaaatgatatggtaacacatggacaattctgtatagtgatactttttgtttaaagcatttatttgccatatatataatatttaaaaaatttttgagccaggtactgtggctcactcctgcaatcccagcacttccggaggccaaggcaggaggatcacttgagtccaggagtttgtgaccagcctgggcaacatagcaagaccttgtctctgcaaaaaaaaaaaaaaaaaaaaaaaaacgcacacaaaaattagccgggcttggtggcatgtgcttgtggtcccagctactcaggagacttaggtgggaggatcccttgagcctgaaagccggaggttgcagtgagccaaggttgtgccactgcactcaagctgggcaatattactgagaccctgtctcaaaaaaaatttttttttttaaattaaatgcttaattctcttatagtctatctttgttagtgtgctcagttagaatttggcctctgctgtattctgtcaaattgtcctctttatcctttctatagctctgagtttaacagatctttagaatagatgataaccagtggtgattgtttctttaatgtgcacatttttctttattcaaaaagatggctttctttttatttgacgtgtattttttgcattctctaacccaattttcttatacatttgggacttcaatttgtatctgcctataagcaaacttacttataattacaatttttatccctgccaaatcttccctgtgtataaattggttatcattaggttctaaaaagtttttatagagttagtttgaaaagctgttcttcataattgtgtacagtttctagagttttacatttatggacctaccttgcatgcaatatcttgaagacagaaaaagtgtaggctgttctcaaaacgttggagtgagaaagtaagatgtcctgctgccaaatataaagttgtttttatactgtctctctgctgaaaatcctttttatttttctcctttaagccttcctctttgattgagtgcactctcttcttttctaaggttttcgttttttggatacttgtttaacaaactttttgtcagctaccatttggcagctcactttcacaaccctcacactcctctttttacctacttttagttgtttggcaaacatctatatttttgtacaactttggcaaaaatgatttatcaatgtagctccatacctgttgaataaaaatagtagaaattatacatcacaagaaatagaaccttattaagaattttctttacatttaacttttaagttcaggggtacatgtgcaggtttgttatatatgtaaacttgtgtcatgggggtttgttgtacagattgtttcatcacccaggtattaagcttagtatttcattagttatttttcctgatcctctccctcctcccaccctccaccctttgctggccccagtgtgtggggttcccctctatgtgtccatgtgttttcatcatttatctcccacttataattgagaacctgtggtgtttggttttctgttcctgtattagtttgctaaggataatggccccaaaaccatacaaattctggaagacagcctaggcaataccattctggacataggaacaggcaaagttttcatgacgatgccaaaagcaattgcaacaaaagcaaaagcaaaacaaaaaacaaaagcaaaacgagatttaattaaacataagagcttctgcatggcaaaagaaactatcaacagggtaaacagacaacctacagaatgggagtaaatttttgcaaactatgcaactgacaaaggtgtaataaccagcatctataaggagcttaaacaaatttacaagaagaaagcaacctcgttaaaaagtgggcaaaggaaatagatagttttcaaaagaagacatgcatatggccaacaattatatgaaaaaacggctcagtatcactgatcattagagaaatgcaaatcaaagtcacaacgatatatcatctcacactggtcaaaatggctattatcaaaaagtcaaaaaataacatatgccaggaaggttgtggagaaaaaggaacacttatacactgttggtgggagtctaaattaattcagccattttggacacatgcacgtgtatgtttgttgcagcactgttcacaataacaaagacgtagaatcaatctaaatgcctatcagtgctaatctggataaagaaaatgtggtaaatatacaccatggaatactatgcagccataaaaaagaattcttaaaggttgattctacatctgaaaattacttgaaattaaactaaaaaagcccagtgtttaaattttttggcatttgacattagaatatccatgctatggagaaaaagaaaactttaagaatattttttaaacagagaagaagaacatactgtactgatatcttgaaggatttcaagctaaactaaaaattcaatagaaaaaataaaattagtgctaaaggaagtaaagaacagacattgtagtacaaaattgaataagaggattggaagaacaccttgagaaactctcacagaagcagaggaaacaatgagaacgataaaagagaatgtgctgattttggagaccatggatccataatcatatatccataatataatatggatccatgtcatcatttccaaaaaaagacataagaaaaatgaatgaaaacagttaacagagcatacattaatattattttcctgacctgagaaaagaccaaactttttttttttttttttttaagagatagggtatcactctgttacccaggataggctacagtattgccctagtaacccagactctagggtgcagtggtgcgatagttcaccatagccctgaactcctgggctccagctatccatctgcctcagcctcccaagtagctgggactgcaggcatgcactaccatatttaaaaattttttaattccttgtggttaccttactgtgttgcccgggctggtgcaaactcctggcctcaagcagtccttctgcctcagcctcccaaagtgttgggattacaggcacaagacgctgcactcggccacaccaaactttttatattgaaagtattgattatcaaaaacacatataataaaaagagaacaggccaagtgcagtggctcatgcctgtaatcccagcactttgggaggccaaggtgggtggatcacctgaggtcaggagtttgagaccagcttggccaacatgaaacctcgtctctactaaaaatacaaaattagccgggcgtggtgatgcatgcctgtaatcccagctacttgggaggctgaggcaggagaatggcttgaacccgggagacggaggttgcagtgagtcgagatcatgccactgcactccagcctgggcagcagagcaagactccgtctcaaaaaaaaagaacaatacttagatacatgctagtatgtttgttgaataaaagaacatcaataagcatgtgtaattagtctaaccttcctaggttgttgaaaaggaactaaaatcaagcttcacctccaaaaatataatgcttataatgacctgtgcaaacagttttgaacaaaaatgataattccaggaagaaggggaagctagaaaattgagagttttaaatcagaagcagcagttcaattgagaataagaattgactggattcagttgtttagctaatgataagaaaaaaagaaaaaatgacatccctttgacattttcttagttattccacaaacatatctgcataatttatattttattgtatttttcttatctttttaaaggtaagaaatcgtaatatacttttttctttttttatcattcaatttctttttttattattattataccttaagttctagggtactgtgcacaacgtgcaggtttgttacatatgtgtgtagtatacattttctttgttgtttcccgtatgtggttggggtagcattttgaagagatggtctttccacctgcaaagctatttgtatattagaatatttaattctcctggggactggactaaaagccagtgaaaatgcttcaggcattttgacaggtaaaccaaaacaaagtaaaataccacttccacacatttccaaattcttctcccttgcatgcagtcctgccaaaattaggaaccactattttttttttttttttttgagatgaagtcttgctctgtcgcccaggctggagtgcagtggcgtggtctcagctcactgcctcccggattcaactgattctcctgcctcagccttctgagtagctgggattacaggcatgcgcctgcatgcccagctaatttttgtatttctagtggagacggggtttcaccatgttggcccggctggtctcaaactcctgacctcgtgatctgccagcctctgcctcccaaagtgctgggattacaggcgtgagccaccgtgcccaggctagtaaccactgtttatctattaatttgtactcagggtgttaatagagcacgttaattgattttttgaatattgaaccaggcttgcatatctgggataaaccaccccgtacctttttttttttttaactatactttttttttaaatgctgaactatccacaggcccttatggttttgttttttgttgttgttgttgttgtttttgttttttgagatggagctttgctctttttgcccaaactggagtgcagtggtgcgatctcagctcactgcaacctacacctcccaggttcatgtgattctcttgcctcagctcctgaatagctgggattacaggcgtacaccaccatgcccggctaattttttgtatttttagtagaaacagggtttcaccatgttagccaggctggtctcgaatgctgacatcagttgatctgcctgccttggcctcccaaagtgcctgggattacaggtgtgagccactgtgcctggccaacattggatttttcagttgtattaccagttttatgttcaaaactcctttaagaggttctatttttatgcattgtctttacttaacccaatctcttcatttataaatatgtaaatattatgtatttagaaaatatataatggtaaagtttgaaaggatgcctgagtaaccaagaacagtggtttcctggggtggaaggagggcaacatcggaatagacaaatgggaacaagggtatgagtgaagcttttcactatataatcatttataaaatggacagattgatcggctgacactaaagttcttttcagtgttctaatcctatgaatcatgtctagaatatttaaactattgataaaagaccagcatctacaaaatttttaagttttcttattattgttggttaatttcatctccagaatttagttattagttttgttcagaaacattatttaaataaatcagcctcagtgctatggtgcgtatgaattaagccatactaaaggtacacatccaaaataaagaaacaagtcagaagcccccaaggaatatattggccaagtgtattagactattattttagctaatcaaacacattaggaaagcctactgtaagaaatgaaattaaagatcagatattgctttcgataaccttttactttagtattctcagcaatgttggtaaatatttattagctgataaattatgtggcaaatgttctacaaaaattagttaaatcggattatgtgtgtggagaaagattggcattaaaagtacattaggttgtccttttaggataagtctattgagcatttctttttctggttattatattgataatttgaataacagaaagtaatttttttggtcgtgcatggtggctcacgcctgtaatcccagcacttttggaggcctagttgggtggatcatctgaagtcgagagttcgggaccagcctgaccaacatggagaaaccccatctctactaaaaatacaaaattagccgggcgtggtggcacatgcctgtaatgccagctactcaggaggctgaggcaagagaatcgcttgaacccaggaggcagaggttgcggtgaggcgagattgtgccattgcactccagcctgggcatcaagagcgaaactctgtctcaaaaaaaaaaaaaaaaaaaaaagaatttttttttattgaagtataatttatacctgaagttcactcaatttaagtgaacaattcagttattttttttgcaaatgtacacacttgtgcaatggttaccagtttaattttagaacatatatataccctaaaaagaaaccatgtacccattcatagttactctttgtatcattagtttaccatacctaattatgtatgtaactttgtataactgactataaaatatgataaaagtaagtactatgcaatttccagaattattcagccttctaggtttgttttgaagacttggtaattttgaacatggacattttctttgatgatattttttatttggacaccaaaattatttaatagaagcaagagtggtgagaataatttgagtacgaggggattgcttttgggaaatgagaattttaaaatttccttcttgtttggagtttacaaatgaattcatgaacagaagaacgtcattgaatgtaaaattagaaatttatgtaaagatttcagttcaaataatttagtagggaaatttatgaagtcattcggataagacaaagattttatataatattttgaaaacattaaataatttgtcattcctttatttcctttattttagcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggcaagtgatactttccttacctgaaatgactgtgttttatacaattgatatttatctaaaaaggacatgggagtatgttaaaatcctgttcagaaaaacagtgaatttaaaagtgtatatataaagccaggtgtggtggctcatgcctgtaattccagcacttttcgaggctgaggtgggcggatcacttgaggccaggagtttgagaccagcctgggtaataacatggtgaaaccccgtctctactaaaaatacaaaaattagtcgggtatggtggtgtgcgcctgtggtcccagctactcagtaggctgaggcaggagaatcactgaacctggaaggcagaggttgtagtgagctgagatgtcaccagtgcactccagtctgggcaacagagcaagactccatctcaaagaaaaaaaaagtgtgtgtatatctccacaagccccaaatttataaaaggctatttatttttagattatttttaaaacatctttcttataatgttatacatgcccgttctatgaattttggaatatatagagaactacaaagaaaacaaaagtctacaataatatactctttaaaaatatttttactggccgggcgtggtggctcacgcctgtaatcccagcactttgggaggccgaggcgggtggatcactaggtcaggaggtggagaccagcctggctaacacagtgaaaccccgtctctactaaaaatacagaaaattagccgggcgtggtggcgggcgcctgtagtcccagctacaggctgaggcaggagaatggcatgaagctgggaggcggagcttgcagtgagccgagatcgcaccactgcactccagcctgggcgacagagcgagactccgtctcaaaaaaaaaaaaattaggaacatactgtataaacaatttcatatccagttttctccaccttaattataagcatttttccatgtctttaaagaatctctgaaaacctttttaacttttgcacaacatatcattgtatatatgtatcatagtttacttacagattattctattggtagacattatgttattttcatgttttcactgtaatgcatagtgaaacacagttgttcagtgaacaactttaaacataattttttgattgtatgtgattgtttcttgaaatagatcccttgatgtagaattattaggttataagatatatcaatattttaaagactgtataaaaatttccatgtggctttctaaaagtactgttcatttatattctctccaacactgtatgaacgtgtctgtgttactgaatcatttttctttttttatttttattttttgagatggagtctcgctctgttacccaggctggagtgcaatggtgggatctcggctcactgcaacctccgcctcccgggttcaagcgattctcctgcctcagcctgccaagtagctgggactacaggtgcgcaccaccacgcccagctaatttttgtattcttagtggagatagagttttgccatgttggccagggtggtctcgatctcctgaccctcatgatccgcccacttcggcctcccaaagtgctgggattacacgtgtgagccaccgtgcccagccatttttctgatatatattatttatttatttgttattgtatttttgagacagaatgtcactctgtcgctcaggatagagtgcagtggcacattcatggctcactgcaaccttgacctcctgggctcaagcaatccccccaagtcagtaggaccacaactaggcaccaccattcccagctaatttttaagtgtttgtagagatgtggtatggctgcgttgcccaggcaggtctcaaattcctgggctcaagtgatcctcctgctttggcttcccaacgtgctgggattctaggcgtgagccaccgtgcccagccatattattttttaaacctaaaacaatatatttggtatagacaaaaatgaaaccttactcttgctttaataattcttcgattagctgggtgcagtggctcacacctgtaatcccagcactttgggaggccgaggcaggcagatcacctgagctcaggagtttgagaccggcctgaccaacatggagaaaccccatctctactaaaaatacaaaattagccgggcatggtggtggcacatgcctgtaatcccagctactcgggaggctaaggtaggagaatcgcttgaacccgggaggtggagattgcagtgagctgagatcgtgccattgcactctagcctgggcaacaagagtgaaactccgcctcaataaataaataaataattcttagattaatcatgcagttaaaccttttttggtggccttttcccccccatgaaatgtctttggtatcctttaccatttttctgtttcttaaaaatatgtttcctgttgatttgcaaaactgtttcatagcttacacgtactctcacatttattgaaattactgcttagtttgttgtttttctcttagttttctttatcatattgtctccttttttgtattcatattgatttataggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtaagtaaagtaaccaacttttctttgtatttcctttctccaaagatttgcaaaatataaaaaaacttaaaaaacattcaaggttgaagccaggcgtgatggctcatgcctgtaatgccagcactttgggaggccgaggtggatggatcacctgaggtcagagtttgagaccagcctggtgaaatcccgtctctgccaaaagtaaaaaattagccgggcgtagtggtaggcgcctgtaatcccgctactcaggaggctgagacaggagaattgattgaacccgggaggcagaggttgcagtgagccaagattgcaccattgcactccagcctgggcaacaagagtgaacctaaaagaaaaaaaaaattcaaagttgttgggagtgagaggtagagttccagcatcataagattacatctggcaaacacctgaaatccgaaagcgatgcaccaggacttccaaggcatcaatatattactaaataactttggtaaaatatagtactggccaggcacagtggctcatgcctgtaatttcagcactttaggaggccagagcaggaggagcacttgagcccaggaactgaagaccagcctgggcaacatagtgagatcccatctctaccaaaacaataaataaattagccaggcgtggtggtgcgcatgtgtagttcagctatttgggaggctgaggttggagatttgcttgagcctaggaagttgaagctgcagctattgtgccactgccctctaacctaggtgacacagcgagactctgtctcaaaataaaataaaatgtagtactttacaacctgtatggagggaaatttggttaagacaactacatgtgtgcttactctttcacctagctttcatatttcttggaatttatctggaagatacatcttcaatagtacgaatatacatagacattgagttgtttactgcagtgttatttgtaactgcacaatattaggaagtaaatgtccaagaataggagattagttgaaatatactatggtacatacatgtaatggagtaccaactatacagctataagaaaaaaataagatctctatgaactagcacagagtgattttcaccggtaatattagatgcaaaaagtacatatagtaggctgtcttgtataggactggaaggaaaataaaaaagcctatctattattgacttacctttaaaaaaagaaacaaagaataaatagaaaataatgaacttggttatttataagggatccaaggaatgagacagaaagaatatggaagggagtgaatgttctctgagtgtagctttttttttggtttttgtttattttttggttttgttttgttttgtttttttgagatggagtttcgctcttgttgccgaggctggagtgcaatggcacgatctcggctcaccacaacctctgcctcccaggttcaagcgattctcctgcctcagcctccctagtagctgggatcaggcatgtgccaccacgcccggctaattttgtatttttagtagagacggggtttctccatgttggtcaggctggtctcgaagtcccgacctcaggtgatccacctgcctcagcctcccaaagtgctgggattacaggtgtgagccaccgtactcggcctgagtgtagctttttgtatgtagtttttactgttggcatcgtgtcactattctacgtaagcaaacaaaattaagtacctaacaatggaaaggagaaaaattcttcacagtatacgcaaactgaaataaatgaacccaattttatttttattttatttatttatttttttgagacagaatcttgcttttgtcaccctggctagagtacagtggcacgatcccggctcactgcaacgtccacctcccaggttcaagtgatctcctgtctcagcctcccaagtagccaggataacaggtgtctgccaccacacccagctaattgttgtatatttagtagagatggggtttcgctatgttggccaggctggtctcaaattcccgacctcagatggatgatccgcccacctcggcctcccaaagtgctgagactacaggcctgagccaccgcgcccggccccaattgtatttcatattactataataactaccctgataccaaagttattgaaagataagggggggaaaaaaagccctgaagagaaaaagaactaattcaagtgatttataagcacagtatttgactatatacactcttgtgcaagacgtgatataaaggatggaggagaattgcaaacaaatactgaactcttttgagaagatttgtcttttagtagtgtgggcaaagcaattctgaaaccatcgtagatgcattataggattaagaaaataagttgaggctgggtgcaggggctcatacctgtaatcccagcactttgggagactgaggcgggcagatcacgaggtaaagagatcaagaccatcctggccaacatggtgaaaccccatctctactaaaaatacaaaaattagctgggtgtgctggtgcatgcctgtaatcccatctacccaggaggctgagacaggagaatcacttgaacctgggaggcggaggttgcagtgagccgagatcatgccattgcactccagcctgggcagcaagagtgaaacgctgtctcaaaagataaaaataaaaaaaaggaacgaagccttcttagaaaaatgatttatcccaagactggagcaggatagatacaagataagcctgggacatcttgtaatgttttaataatttttgtaagaaagtaaggaaagaggccgggcgcggtggctcacgcctgtaatcccagcactttgggaggccgaggcagctggatcatgaggtcaggagatcgagaccatcctggctaacaaggtgaaaccccgtctctactaaaaatacaaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaagaaagtaaggaaagagcctgtaatcccagcactttggcaggccaaggcaagaggactgcttgatcccagaatttcacaaccagcctgggcaacatagaccttatctcaaaaaaaaattaaaaagtagccaggtgtggcacacgcctgtagtcccagctacttgagaggctgaggtgggaggatcacttgaacttgggaagtcaaggctgcattgagctgtgatcaggcccctgtactccagcctgggtgacagtgagaccctgtctcaaaaacaaaacaaagcaaaaaaaggaaggaaaagtacctaaaaatatcatggagacttgtcataaggacacaggagccagctggaaggaactcccactggctaaatctgggtcaatttgagtgctaaacaagtacattaatgaactgtgaaccactggaaggaaaatgaatcatgagtagaatgtcaagtgccaactggtaaatgtaggattgctggagttggcagcttatcattctgcaaccattgtgttaaggattggatcaggcaagaatcatcaaaggatcctaaatctaggggcagtttcaatgaggagccaggatatttgcatgccttccacatatctcaagggaaaagttagtaattataaaatgggaaaaatggacaccttgaccaggtaataaaagttaacattattaaagaaggacacatggaaatccatgatacctagagaaggacacataactaatatagtactatattccagtcaagaatgcataacctgaatttaatcatgaggtaatatcacacaaaccccaaattaggaatgttctgttacaaaaagggggatcgcatttttcaaaaatgcgaatgtcatataaaacagactgtgggaaaggtctaggtcaaaggaagcaaaaaagactggacgactaggcagtgcctgtcttttactggatgagaagaatgtgataaaggacatgatgattagagaaaaatgttgtttcaatgttaaatgtgctgaagctgataatactgtggttttataagagaataaccatattcttaggaaataatctaagaagtgtttaagaataaaggaccatgattctactgtgtattggttcaaaaaaagattgtgtgtgtgtgtgtgtgtgtgtgtgtagaaagaggtaataaaagcaaacagtaaaatggtatcagtaggtgaataggtaaatctgggtaaaagtatatggtgtattctttgtactattcttgtgactgttgtgtaaggtttaaattatttccaaataaaaattttaaacaatttttaaagtttaaaaagttaaaatatagcacatctcaagaattttcttagtcaaccaattataacagaccatactctaggatcatcagttttggattatttcctttgatttgttgatgaagcactaaactgaaagcaataggaaattttctttatagctgtagtttctacctattgaaggccattagcttctattaggagattgtattgaattggatacatttatttttcacaaacaaaacaaagtctctaattttcacttgtacttctagctagatgaaagagagaaagtggccatgtgcggtggctcacacctgtaatcccagcactttgggaggccaaggtgggtggatcacctgaggtccggagttccatgccagcctggctaccaaggtgaaaccccatctctactaaaaatacaaaaattagccgggcatggtggcgcatgcctgtaatcccagctacttgggaggctgaggcagaagaatcacttgaacccaggaagcagagattgcagtgagccgagattgcaccactgccctctagcctgggcaacagagactccgtctcaaaaagaaaaagaaagagagaaagtgaatttgttcatacatatcctcaaagatctttacagctgccttacatttcagattgttacctaggtcttagtttagtttactataaccttttgacccaaaagtaggaatattgccagctaggaatcagtaatgctattgcaataaaaagggaaagtgttttaagtaaagcgctctaatttggaagcattaactcaatttatatattttgttcttgagacaaaaaaattgagtgaagttaaagttggcaaacaagatcagttttggcttttgcactaacctcaagaaaaataactactgtaatatcaaatgtcagacatttagtctgcaattgctaggtgtttaaccaaaataaaaataattttatttgttgaagtttaaagaaagaaaatataaaaatcagaaacagaacttttgctcatggccatataacaataaatagaaagtttggtgatggtgagttttttctcctttaaaatttttcattatggcagggcacagtggctcatgcctgtaatcccagcactttgggatcgcttgatcccaggagtttgagaccagtctgggcaacatggagaaaccccatctgtaccaaaaatacaaaaattagctgggcatagtggcgcacacctgtgatccctgctacttgggaggctgagatgggaggatcacttgagtatgggaggatcacttgagtttgggaggcggaagttgctgtaatccaagattgcgccagtgcactccagcctaggctacagagtgagaacctgtcttaaaaaaaaatgaacataaaaattttaacaaaaacacattttaaaattacaaaaaactggccaggcgcggtggcttacgccactaatctcagcagtttgagaggccaaggcgggcggctcacttgaggtcaggagtttgagacatcctggccaacatggaaaaaccctgtctctactaaaaatagaaaaaattagctgggtgtggtagtgggcgcctgtaatcccacctattcgggaggctgaggcacgagaatcgcttgaacccaggaggcggaggttgcagtgagcagagattgtgccattgcactccagcctgggcgacagagtgagacactgtctcaaaataaataaaataaaataaaataaaataaaatagccaggcgcagtggctcatgcctgtaatcccagcacgttgggaggccgaggcaggcggatcatgaggtcaggagttcaagatcagcttggccaatatggtgaaaccccatctctactaaaaatacaaaaattagctgggcatggtggcacacccctgtagtcccagctgttcgggaggctgaggcagaagaattccttgaacccaggaggcagaggttgcagtgagccgagatcatgccactgcactccagcctgggcgacagagcgagactctgtctcaccaaaaataataaaataaaaaataaaattactaaaaactgtgcaaacttagcaaagaaataagtggatcgccgggcacggtggctcacatctataattccagcactttggaaggccgaggcaggtggatcatgaggtcaggagttcgagaccagcctggcctatatgacgaaaccccatctctactaaaaatacaaaaagtatagccaggtgtggtggcatgtgcctgcagtcccagctactcaggaggctgaggcagaataatctcttgaacctgggaagtgaagcggaggttgcagtaagctgagatcgtgccactgcactccagcctgggcaacagaaagagattccgtctcaaaaaaaaccaaaaacaaaacaaaacaaaaaagtgggtagtgtgggaagactgtggaaaggttattttttatttttttgaggcggagtctcgctctgtcgcccaggctggagtacggtggctcactcggctcactgcaagctccgcctcccgggttcacgccattctcctgcctcagcctcctgagtagctgggactacaggcgcctgccaccacgcctggctaatttgtttttgtatttttaatagagacggggtttcaccgtgttagccaggatggtctcgatctcctgacctcatgatccgcccgcctcggcctcccaaagtgctgggattacaggcgtgagccaccgcgcctgctggaaaggtcacttattattcctatagttttgtattgtttgaatctttaatttaaaatgagaatatattcatgtattatttgtgtaaccaataacctgcttgtttatttggaaaaagagaaaaatgacataagtagcaaggaaaaaaataatctccaatagtctctacacccatatacaaccattgttaatatttagaatgtttctttccagtcttttctcttttatttttgcgtagctgtatttgtaatatacatccattttagatcctgcctttttgtttaacataaatattttccaggttactatatatgtttcatagttgtcaggtttttgttttgtgttgttgttttttgattcggtctcgttctgttgcccaggtgggagtgcaggttttttgtatttgtatttttagtagtttggccaagctggtctcgaactcctgacctcaggtgatccacctgcctcggcttcccaaagtgttggaattacaggcgtgagtcaccacgcccggccacatttttatactttttcaaaatactagtgtaacatctcacgtaccccataaatatatatacctactatgtacccacaaaaataaaaaattaaaaaatatatattaatgtagaaggcacaggataagagaaatataaggttgcatcctttaggaaaatattaattctttaatgcagtagtaacaaaattccatttacacattatttattgttcatcagacagttttcattctgaagttttgctagctctgcacttctgaatgccagcctctatcccgtatctaccctacctacctaccttgctcctcttctctcaaaaagtaatcctttttcatgttggggtttttaaaattttacattacttatttgcctgatgaacaaagcaaaacctgttaactgacctggcttttactgataaactcagtggaagcttttcgtctgtaaaatctaagtcccggccgggtgcagtggctcacgcctgtaatcccagccctttgggaggccaaagtgggcagatcacctaaggtcaggagtttgagaccagactgatcaacatggagaaaccccgtctctactaaaaaaaaatgcaaaattagccgggcgtggtggcacatgcctgtaatctcagccacttgggaggccaaggcaggagaatcgcttgaacctgggaggcggaggttgcagtgagccaagattgcagcattgcactccagcctgggcaacaagagtgaaactctgtctcaaggttaaaaaaaaaaaaaaaaaaaaaaaaaaatctaagtcccaagcatgtatggtggaattgaccagtgtttaataaatatcttctgaaatactagacagaattggttgcagactatgaaataatttccatgtctttatttcaacaactgcaatttttattgtctttttaggatttccaattccatgtgtccctctcttcctgccttaactgtgtctcatttccttataatgtgctctctgattactgagcattttctgcgtattttcatatgcaaaaactaattacccatctaataattatttagtggtttcagatacagacgtactataatagagtcatagatacatggaaacatttaaaatacattcaaaaccaagatgagactagccatgatttgagtaacaagcatctttaaaataatgttaaataggctgggtgcggtggctcatgcctgtaatcctagcacttggggaggccgaggcgggtggattgcctgagttcaggagttggagaccagccttggtaacacaatgaaacccgtctctactaaaatacaaaataattagctgggtgtggtggcatgcgcctgtaatcccggttacttgggaggctgaggcaggagaattgctggaacccgggaggcggaagttgcagtgagctgagattgcgccattgcactccagcctgggatgcagagcgagactcaaaaaaaataaataaaataagttaaataatagttgaacagacacaactttgactaagaatacacggacaacttcaatatactgttttgagcacttctcaaaatgtctcattaaaaacaacacattttgtattagctgtaatatgaaattagcttaatcaactgccaaaaaaaaaaaaaaaaggataatttgagggagagaagcataaggtttcacttgattgtttggaatgttatatagtgtaatgattaagagcataggtcatcagtcgtagtgcctgggttaaaaaccttgctgttaaacttgctaaacataaccttgagcagattatttagcctctgtgcatcaattacttcatatgcaaaataatagtatccaatttatgtgggtgtttagattaaacaagataatacactaaagtgcccacatagagaagacattcaataaataacagttactttcttaggaaataactgtctttaagtcattttagaaactattacaaacatcctcccccatatcattttccttttaccataaaggatacttttctgctaatttttatttattatgtatgaaagcctatattctgtgattttttttttaatttgaaggattgttattgagtttcctatgatatttgttgtttcctatgtccttatacttgagaaacagaacacatactatttcctgcatctttcatacacagaaaaaaaataaaagctaagccgggagcggtggctcacacctgtaatcccagcactttgggaggccaaggcgggcggatcacaaggtcaggagtttgagaccagcctggccaatatgatgaaacccacctctactgaaaatacaaaaattagctgggcatggtggcaggtgactgtagtcccagctacttgggagactgaggcaagagaatagcttgaacctaagaggcggaggttgcagtgagctgaattcaccccactgcactccagcctgggcgacagagtgagactccatctccaaaataaataaataaataaataataaaagctataggaagttgttcctgaaaaaccagatattctgccttttttcctccaattgtatatttgtaaaagtgtttagcaataagtaagaggcagtggatcctcattgttcctgaattccgttttgccccccttttacttgctaaaatgtatttgtaaccccaaaaccaatattcacagtgctttcatggttattcctagacatgcacagagtggcaaaaaattcaagtcacccaaggtgcacgttcctagcttaggttgaagaaggctatgctctgccttcttgtttcagttgtcatactgtaaacaagtatctttttcagtctatttagtggtattcttttgcatttttatgctttttgttgcttttgtggtttgaaatggcctgcaagagtggtgccaaagtgctgtctagtattccaaagaacaagaaggctgtgatacaccttcaggagaaatacgtgtgtgaggtaaaattcattcaggcatgagttatagtgctgttggccatgagttaagtgtcaatgagtcaaccatatacaaccatatacagtatgttaaataagttgtctttaaacagaaaaacataaaagaaggctatgtatttggaatgggttgacagaacgttgtgacttgaggctctttttaagttaacagggcatggtggcatgtgcccgtacttccaaagtagtcccaactgtttggaaggctgaggtgggaggatcatttgagcccaggagtttaaggctacactgagctatgatcactctactgcactccaggtggggcaacaaagcaagaccgctctaagaagggccaggcatggcagctcacacctgtaatcccagcattttgagagcctgaagttggtggatcacttgagcccagcagtttcaatagtaacttgggcaacatagcaaaaccccgtctctacaaaaacaaaacgaaatgaaagaacaaaaagattagccagttgtggtggtgcatgttgtagtctcagctatttgagaggctgagatgggagaattacctgagcccaggaagtcgaggctgcagtgagccatgattacaccactgcactccagcctgggtgacagaccgagaccctgtctcaaaccataaataaaaataaaaaagaagaaaaaaatcaaaagtgtatatattgtggtaggcagcttctgacatggttcccaatgatccctgcctcctggtattctcacccttgtgtaatcctgtccttctgaatgtgagctagacttaataacttgattttaacaaattagacaaaagtgatggtatatcacttctgtaattaggttttaaaagaccatgactgttattttgctgatgtgttctctctggctcttcttttgtgcttgctctgttgaagagggccacttgacaaagaactgaggtcagctaacttgccaatacccagcaaggaactgaggcccatagtccaacaatttgtgaaccctgccaacagctattgagtgagctcagcgatagatactgtcttagttgagtcttgagatgactatggcaccagcctacaccctgattacagtcttgtaaaagatcctggcagagcacttatataaacagtatgtagattcccatagaaactgtgagataataaaatttttttaataaaaaaaagtagagcagtttaggttgatagcaaaattgagaggaaagaagagaattcccgttatctcccctctgctcccacacatgcatagcctcccccattatcaacattcccaccagagtggcacataatacagttaagtatttgtatttacacattaaaacctccaaacacatgcttgagatggggtgtgcagtaataagcactactgtgttttaacctttggcagcttttattctttcctcccaactttcaattattttcttttcatttccaattttttaacctttctctacttgaaaatagtgaccagtttctttttggttatagtcatcctaatgtgtatgatgtaatatctcattatggttttggttttcatttccgtaatgaataatggtgatgagcatcttttcctgtgcttcttaaacattgtatattttatttggtaaaatgttaattcaaacccattgcccatataaaaattgtgcatatttgtctttttattgttgagttgtaaaagttctttttacatagtagatacaagtctcattctttggcttgtcattttacttagttggtggtattctttgaggtacatagttttgacatttttaatgaagtctaatttatctttttttattttgtcactctgaaaccattttctttttctttttcttttttttcttttaaatggagcctcactctgtcgcccaggctggagtgcagtggtgcgatgtcagctcactgcaacctccacctcttgggttcacgctattctcctgtctcagcctcccgagtagctgggattacaggtgtttgccaccatgcctagcatttgtatttttagtagagatggggttttgccatgttgggcaggctggtctcaaactcctgacctcaggtgatctgcctgcctcggcctcccaaagtcctgggaatacaggtgtgagccaccacgcccaacctgaaaccattttctaatacacagtcacaaaggtttgctgttgtgtttttttcttggggttttatagttttagctcttacatttaggtctgtgatccattttgagttaatttttgtatatggcatgaggtagggagtccaacttcattcttttgtttgatatccagttttccagtatcttttgtggaaaatattatttttcccaattgaaaagtcttggtatccttgtcaaaaatcaattgacaggccgggcacggtggctcatgcctgtaatcccagcactttgggaggccgaggcgggtggatcatgaggtcaggagatcaagaccatcctggctgacacggtgaaaccccatctctactaaaagatacaaaaaaattagccaggcgtggtggcatgtgcctatagtcctagctactcaggaggctgaggcaggagaatggcatgaatctgggaggtggaggttgcagtgagccgagatcgtgccactgcactccagcctgggcgacagaccgagactccgtctaaaaaaaaaaaaaaaaaaaaaaaaaaatcaattgaccgtaagtgcaaaggtgtatttctgaactcttaattctattccattcatcaatatgtcaaggatccattgatccttatgccaggaccacactgtcttgataactattgctttgtaattagttttaaaatagagaaagctgagttctccaactttgttcttctttttctttctcttctcttttctcttctcttctcttctcttctcttgagatggagtttcactcttgttgcccacactggagtccaatggtgtgatctcagctcactgcaacctccgcctcccaggttcaagcaattctcctgcctcagcctcccgagtagctgggattacaggcttgcactaccatgcccagctaatttttgtatttttagtagagacagggtttcaccatgttggccatggctggtctcgaactcctgactcagctgatccgcctgcctcagcctcccaaagtgctgggattacaggcgagagacaccgtgcctggcctgtttttctttttcaagattattatggctgttttgggttccttgcatttccatatgaattgtgatcagttttccatatctgaaaaaagacaactgggattttgataggcagtttggggagtattgctatattaacaatagaaagtctcttaattcatgaacacgatatctttccatttatttagaccttatttcatttatttcaacaatgttttatagtttactcagtgtacaagccttacagttcttttgttaaatttattcctaattatttttcagagcagtgttttctgtcttagtcaagacagctgcatgtagtgtatgtacgttacaataaattattttgtaaaaattttagctgtggtaaaatacacaaaatgtgaaatttatcgtcttaccatttttaagtgtacagttcagtatagttcctattgtcgtacgaccaatctccagaactcttcaccttcaagtactgaaactctatacccattaaataacaactcactattaccccttcttctcaggccctccagccaccctctactttctgtctctatgaatttgactactctaagtatatcatataagtagaatcatatcatatttgtctttttgcaactagctcatttcacttagcatagtgtcatgaaggttcatccatcttgtagcatgtgttagaatttttttgaaggctgaataatattccattttacgtaaatactacatttattcatccattcatccatcgtggacacttgagttacttctacctcttggctattatgaataaagctccaatgaatgtaggtatacaaatatctctttgagaccctgctttcaattcttttggatgtataccaagaaatagaattgcagaatcatgtgataaaaatgctatttttaattttttttaagagacagggtcttgctttgttgcctagactggagtgcagtggcacgatcatagctcactgtaaccttgaactcctgggctcaaatgatcctcctgcctcagcctcccgggtagctaggattacaggcacatgaccccatgcctgtctaattttttttttttttttgagacggagtctcactgtgtcgcccaggctggagtacagtggcacgatctcggctcactgcaacctccgcctcccaggttcaagcgattctcctgcctcagcctactgagtagctaggattacaggcacccgccactatgtccagctaatttttttgtatttttagtagagacagggtatcaccatgttagccaggctggttgcaaactcctgaccttgtgattcacctgcctcggcctctcaaagtgctgggattacaggcatgagccaccacacccggctgctacctggctaatttttaaattttattttagagataggatcttactatgttgtcaggctggtcgtgaacattcagcttcaagtaatcctcccacctcagcctcccaaagtgcggcgtgaaccactacgcctggcctagttttaattttttgagaacctacaagggttccagtttcttcaccttcttgccgtcacttgttattttttttaaatagtcgctgtcctaatgggtgtgaggtggaatgtcattgtggttttgttttatatttccctaatgattggagatattgagcatctttttatgtgcttgttggccatttggaaaaatacctattcaggtcctttgcccattttttaattgggtcatttgttttatgttgttaagttgtaggagttctttatatattttggatattaaccacttatcagatatatgatttgcaaatattttctcccatagcttgccgtttcactcttttgattgtatccataatgtgcaagtttttatttttgtttttgtttgttggttggtttttgtttttttgtttttgttttttttttgagatggagtctcactctgttgcccaggctggagtgcaatggtgtcatctcagctcactgcaatctccgccccccaccccgcctacccgcccaggttcaagccattctcctgcctcagcctcccaagtagctgggattacaggtgtgtgctaccacatctggctaatttttgtatttttggtagcgatggggttttgccatgttggctaggctggtatggaactccctgacctcagtgatccgcccacctaggcctcccaaagtgctgggatctattataggcatgagccaccacgcccagcccaaagtttttactttggatgtagttcaatttatctattcttttgctgcctgcaagaggtaattctttatttggtattggaacttgttactcaggaatgtgttcttttgaccgggtacagtggctcatgcctgtaatcccaatacttcaggaggctgaggtgggaaaatcatttgatgccaggaacttgagaccagcctgggtaatatagtgagaccttgtctctgaaaaataaaaagaaaagttagctgggcatagtggtgcacacctatagtcctagctactccagaagctgaggcagttggatcacttaagcctaggagtttgaggctgcagtgaggtgtgactgcactcaggcatcatgagagagtatcttactctatataactaacccagaagatgataaaaatttgaagtaagatttctatacattgcttttaagctatggtaaagtcaaaaaattttaagtcgggaagcatctgtatttctcattttcaactgttacaggaactactttaaacagcacagatattctaaacacatcactttggttgttcccccaatacttgtctgttgtttaaaaatcaaggctttgtgttataatatgctgttcagtgtcagtgtctaatatttccttccttccttccctccctccctcccttccttctttccttccttccgaaaaaaaataaggccgggcgcggtggcttacgcctgtaatcccagcactttgggaggccgaggcgggtggatcatgaggtcaggagatcgagaccatcctggctaacacagtgaaacgctgtctctactaaaaatacaaaaaattagcgggcttggtggcaggcgcctgtagtcccagctgctggggaggctgaggcaggagaatggcgtgaacctgggaggcggaggttgcagtgagccgagatcgcgccactgcactccagcctgggcgacacagcgagactctgtctcaaaaaagaaaaaggctgggcgcggtggctcacgcctgtaatcccagcactttgggaggccgaggcaggtggatcacgaggtctggagatcgagaccgtcctggctaacacggtgaaaccccgtctctactaaaaaaaatgcaaaaaattagccaggcgtggtggcggttgcctgtagtcccagctactcgggaggctgaggcagaagaacggcatgaacctgggaggtggagcttgcagtgagccgaaatcgtgccactgcactccagcctgggcgacagagtgagactccgtctcaaaaaaaaaaaaaaaaaaaagaaagaaagaagaaaaaaaatagagatgaggtctcactctttcacccaggcttgtttcgaactcctgggctcaagcaatcctcccgactcggcctcccaaagtgctgggattacagacatgagccactgcgcccagccaatgccctaatagtttctaattatttttgaataatataaatggtaattaatgcctctgttttttaattatagaactttaagatgtgtttagtgatcctaagtatgactggtttttacctgaaacttttttttgtagggttgccataataaattatcacaaatagggtgactaaaaataacagaaatttgttcttggacagctttggaggccagcagtctaaagccaaggtattggctgagttggttccttctggaggctgtaaaggagaatctgttacatgccttgagatctcctagctttgacaggtttcagtaaatcattggtgttcctcggtttgtagctgcgtaattctaatctctgcttctgccttcacatggccttcatctctatgtgtctcaaatctccctttgcctttatctttttttttttttttttttgagacagagtctcactctgtcacccaggctggagtgtagtggtgtgatctcagctcactacagcctctgcctcccgggttcaacggattcttctgcctcagcctcctgagtagctgggactacagttgcacacgaccatgcctgcttattttgtatttttggtagagttgggctttcaccatgttgaccaggctggtctcaaactcctgacctcaagtgattcgcccgcctgggcctcccaaagtgctgagattacgggcatgagccagggcacccagcccctttgcctttatcttataaggacatctgtccttgaattcaggaaccaccatatgcaggatgatctcaagatccttaattgctaagtgagggcttagtgcctagggtgagggcaagggcagttctctaaagaactgccattggcctttaggataaaacatcagttgtaccagaccatcccaagcattgaaggattttaaagttcctggtctacactcattaatgccaatagccctctaaccctaatatgacaattaaaaaaaatgcccccatacactttcacatccctttcccagcaggaggaggaatgcttgtcttaagaaagaaaggatatttagaacatatattgccttacttctccatgctaatggaaggcataatgtcatacagaaaagtagaaaacagacacagaattagtgtctctcttttgaaattgtctacttacctatcaacatgagttctgaaatatttgtattattttgaaatagcaaaataatgagacaggccgggcagggtggctcacgcttgtaatcccagcactttggtggggcaaggcaagcggatcacttgaggccaggagtttgagaccagcctggccaacatggcgaaaccccatccctactaaaaaatacaaaaaaacttagcctgcctggtggtgcacgcctgtagtcccagctactcaggcggctacagcacaagaattgcttgaacttgggaggtggagttggcagtgagccgagatcgcatcactgcacctgggcaatagagcaagactgtctccaaaaaaaaaaaaaaagacacattaaaggcttattgcacatgttcgtagtcttatttcaatttttattcatcttcagaatgaattatatggaccattctacttagaataaagaactttaagactgggcatggtggtttacacctataatcccagcactttggcaagccaaggcaggagaattgcttgagtccaggagttcaggatcagcctaggcaatatagtgagaccctgcctctacaagaaatttttaaaaaaattagctgggtgtggtggtgcacgcctgtagtgccagccactcaggagtctgaggtgggaggatcacctgagccccagggagatggaggctacagtgagctgtgtattctcatgggtcttatattttgaaagaaattatgctgtacaaattatacttattataattgatttccccatttttattaataaaaaaatgcctgcctaatagagctttttatccgcatgatagcaaactattttttaattatgttctgaaaataaaattttacttaagcaaagacacctggcatatgtaagcctatgaagctttattatgcataaataagtttgattttcaagaggtttttttttctaacactgaaagtaacttagtctgttttataatagtcatctaggaacttaatggctaaagaagaccccaggttgggcacttctaatgaatttgtagactgaaaattgagaattctgtataatgaatcagattcatacatcagagttaatactaacaagaatttgaacataataattttcctggaatagtaagtagtttgtctttatatcactaataaataatgatcagatttccatgaaacttgaattacagttaaaaaatcaataagataaaaacgtagaggataatatttgaggctgcttctctatcacaaatcaatgcaaacgccagaacactgctataaagtcaagtgttctattctgaagggtttactttgcctgtattgcaccacaatcaagttatactttttgtatttttctgaactggtctgggttcagtttcctcgaagaaaataccacctagctagtttatgtaagaaaggacagcaaattattaaaatgattgcagaattgttgagagcacttgaataatgatcctcaaactttagcattaatcagtatcagtttggaggcccttgaaaacagattgttggccccaccctcaagatttttttactataggggtgcaccaccaacacccggccaatttttgtaattttaggagagattgggtttcgctattttggccaggctggtcttgaacttttgacctcaggtgattagcatgcctcacccttccaaagtgctgggattgcaggcgtgagcctccgcatgccactgcgcccagcctatttccagtataatcttgtcattagtgctccccatcatgtatttattcatgtatccattcattcattcaacaggtattgaatacacactatgcatgcaagccactttcaaatattggcaataaagaggtgaatacgattttgtttctcattctctttattatccctatccgtgaactcctgttgagggtataaaggtgaatatgtcaggaaggaatatgggtagattggaatattgtaattatgccaataattacaatattatgacataagtgctgacagtattataaagcattttataaatactgaaaattgtgtgagttcaggtgtttatatgtatattcttaatattttaaaaataaaacatcttttgaaaaaggtgagaaccacccttagactgttttttaaaatgtgaaatttactgtcttaacctttttaaacaaaaaaacaaaaaaacagagtcaggttctcactctgtctcccaggctggagtgcggtggcatgatcatagctcacagcagcctcaaactcctgggctcaagtgatcctcccacttcagcctccctagtagctagaatcttttttttaatgttttgtagagacagggtcttgctgtgttcctcaggatggtctcaagctcctggcttcaagcaatcctcctgcctcggcctcccaaagtgctagaattacaggtgtgagccagcatgcacagagtttaaccatttttaaaaatataaaatttactctcatagtaatttttaagtgcacagtttagtagcattaagcacattcacattattgtgtaaccaacctccagaactctttttgtcttgcaaaactgaaactctatacccattaaacaactcaccaatctcccctgctcccaacccttggcaattaccattccactttgtgtctgatgaattttactacttgagatacctcatataagtggaatcataaggtatctgtctttttgttactttttttttttttttttgaggtggagttttgctcttgtcgcccaggctggaatgcaacggcacaatctcagctcactgcaacctctgcctcctgggttcaagtgattctcctgcctcagcctcccgagtagctggtattacaggtggctgccattacacccagctaattttttgtattttaagtagagatggggtttcaccatattgaccaggctggtctcaaactcctgacatcaggcgatccaccctccttggcttcccaaagtgctgggattacaggcgtgagccaccacgcccggcctttgttgttcttttgtaccattttgtgtactgtttttcagattttaaagtaaatggagatatgaaaaaagaaaaacaaagttaagggaacgaaaagcaaggaataagacaattataaaagtaaagacagtggtgattaatttaagtcacaatagatggaattcctatataacctagagagaaagttagaatataattggactaagaagaaggtgctgaagatagaagtagatttaaagttgtagtttaaggtttatacatctcacaagtggtaaataaatgttgatctttaggaatattacatatcttaccccacaaaacaactgaagtgctgtgttttaaataaacaaacatgattaattttaacagtgttaaaaattcattttatagttagtagtgggattctgggcattacttacagactcctttgtttggataaaattttgtctacaattgtgagaaaaacatggacagaatttttagaaaattgaaagttttatatgttgacacacacctacgtaagatgttacatgggcagtagtaggcatactaatatatcagtcagctgttgctgataatacttcatcagcaagccacccctaagctcagtggctttaacaacaagcatttattctcataatcataggtttgtagaacagctggattttggctgatctaggcaggactcagcttcaggcttcaggatcaattcatatctttttgtctgggacccacgatcaaggggcaacatttactcaagcttctatcaatagtggattgcctgctcataagaagtgcaaacgcagctacccaagcatattttagatttctgctcgccttatatttgtcagcttctcattggtctgatcaagttatgtggccagattcaaagtcaaggggcaaggaggtacactccatctatcacgaggccgtggcagaaggtggatatattttcattatagggaagtgacaattttaggaagtaaagagagttaccttctaaagtcaaaaggtatgtacacacacacacacacacgaggttgtactaaatatatagctactcaaagatatgtatatatacacaaatgcacacacacaagtatgtattggaacctatacatttagtaccacttattttttgtgtatggtatacattcatttccttgaaaatgaaaataagttctttgcatgtaagaatggacatccaaaatgtacccacaatgatataaataaaaaatacttttctcactctgctagcttttacttttgtctgtttttgttttattttgttttaaaaccaagatagagttggattaaaaatagaacttcctgcatatgccagaatttctccagtgcttctaagcaggacatgtgaatgcctctgagacaggtttgcagacagaaatatgtacagggagaaagaagagaacataaaagaataggaagggtaaagagtaggattagggaaaagaagtgtctgttttagagatcaagtaccagcaacaattaatctaaactccccttagggtcatcagtgcccttgatattgttacttccttactctcactatataaggagtatggtttgtaggatctgagcaatgtttttttgtttttgttttttgttttgttttttgttttttgtttttggagacagagtcttcttcttgcccaggctggagtgcagtggcacaattttgactcactgcaacctcagcttcccaggttcaattgattctcctacccgagtagctgggattacaggcatgcaccactatgcccggctaatttttgtatttttggtagagatggggtctcgccatgttgcccaggctggtctggaactcctgggctcaagcagtcctcccacctcagcctgctgagtagctgggactacacagatgcgccactacacccggctaatcttttaattgtttgtagagatggggtcttggcaggttgtctaggctggtcttgaactgctgggcttaagtgatcctcccgccttgggctcccaaagtactgagattgcggtcatgagccactgctccgagcccaccctacctctttattcccaagcttttctgtctattctgttccttccctaagtacgtctctttttttattttttatttttttttgagatggagtttcactctgtcccccaggctgaagtacagtggcacgatctcggctcactgcaacctccgcctcccgggttcaagcaattctcttgtctcagcctccagagtagctgggattacaggcacccaccactacacccagctaatttttgtatttttagcggagaccaggtttcatgatattggtcaggtcaggagatccacccgcctcagcctctcaaagtgctggaattacaggcatgaggcaccacgcctggccaggtgcatcttttactaactctggcctgccttattgctgactactgcctctagtgccaaaagagaaacaactagaggatgtacagcctatttgtctgcttcatttaaaattcttctcttagcaacaaaattaaagtcctaaatataactaaaaaatcaaatgtatacatttgtggaatgtaaaaggaattacacacaatgttctttttattgtcattatagtccccaggctccttacaaggaaaagtagctacatttgttacatagaaaaacagccctgaattattttcagctacatacaaacaccatggttaaatcttcaaaacatattactgaactgaagaagcaaggcacaaaaattccatttatataaaattcagaaataggcaaaaaaactcagcattcagtgatagtaatactattaagaaaagcaaggaaatgattaccacagaagtcagaatagtgactatttctggggcagaggaaggatgttaggaacaggtaggagcaggtaggagacttttgggacccttggtgttgtattttgtggccttggtgctagttacataagtgtttgcttcatcatgattcaccaagctctgcattttgtattataaacattttcgtgtataatgcttatacattatacacgaaaatgtatataattttgtgggttatattttgtaaggtttaaaaaatggaagtcaggatgggcggttacaagtggtgactcacgcttgtaatcccagcactttggtaggcctacgcaggcagatcacttgagaccaggagttcgagaccagcctggccaacatagcaaaaccccttctctactaaaagtacaaaaattagccaggtgtggtggcaggcacctctaatcccagctacttgggaggctgaggcaggagaatcacttgaacccaggaggcagaggttgcagtaaacagagatcccgccattgcactctagcctgggcgacaatagcgaagctctgtctcaaaaaaaaaaaaaaaaaaaaaaaccaaaaaaaaaaacaaaaaggaaatcagtgtgcgaagtgggaaagctagagcaagggaaacaactaggaaacagaccaggagaaatttaatggggaaaaaaagttatttgtttttctccaaatatctatcttgttttccttataagagagcaaaggttactatgataattaaaataacataaaatgaattgagggagttgcctgctgatgtgattcatattttgttgttcaatcagtaaataactggaagatacagctttcactttgatagtcaaattagttcatggtcattttctgaaaacagttcttgagtatggattctgaatttagaactgtcattttgtagagcagttaggaaaattgacgagggatctttgagtgacatagtctttggtttagttctatattgtgagtctcgtgaattttctgtattgtgaattttatttttaatttgttttgttttaaataatgactattatagtgactaggtttccatttttctagtggtaactttaggcttaaatggacatttcttactcaattaggttattggtgttttctaagaatcattaaatactttttttttaaagttgtatagagtaacagactctgttctatcatatctaaaaagtacaatcttagtacaatagaggtaattaaagtagaattataccaaaaatactttgagagcatatttaatggtgttttctttattcttcgatgaaatgttttgatgtacaatggtctgcaaattaattcttctatttttcttgtatttttaaaattcctagtctgtttacttaaatgtgatctttccattttttatttaatgattttattccaatcaaatataattaactgttttaattcattctttaataaaataaacaaattgctgaaattgtctctcctaatcataaaatagctatttaaaatacactctaaagaaattaaaattgtaaatacttatggagctaaaagttaaggaggaggggcactgaatgtttttcccattttttcatgtcttttctaaccttttggcgggggtggaatttaactttagactgttatttctctctcttcttcagtttttcactgtttctttcataattcactcatcgaatgccttgattcaattagccaagtatgggctattttttttgttgttattttttgctttttcttccaagctagatctattcaaaatgattaacaagttaaatttaaaccagtctttcatattcagtattaactacttgtttgaaaaaacaagaaatctgccccctctcaattttttagggcattaaatgtaaacattagtctgattatgattactgccattccaaacatattaattaaaagcaacgtttatttcctataaaaacatttgttcaaaacattgagctccacaataaatcatagtacagaaacaatatcataacaatttggattattttgctaatgaattcacttaactgatcacatcgttttggatttaaatgtttttctctacttgtatgaaagctacattgcttgaaaactacaaaaactaatccccaatttgcctttctacacagtggtaaaagattaaggagctgacataaccactagtgtgttatatttaagcttccctttgctgcttgctgcacatgttacaatgttgttctttctttgacacagacccagacaaaagctgagtgtagcaaggaaacagacagaacgcctccagtagtggcccccgcctggctccaggatttgtaaacagaaacatcccaggctccaatgagacagacagaggttccctgtctgttctgcattcaggaagtgtttgcttgtataagcccaactattgcacaggcatacatagtagtgtttacatttggctgagtatttaactgagaaaacttaatagggaagaaaaagagggtttattagaggtaggagaacaagacaattcaggtataacatagatgtagcatatgttatgtaaaaaggtttttttattttgaagaaatagacaacaaaaaataggagttttctagttaaaggcctcttttgcacgtacacgtgaatacacatattgaaatatttttcctggcagtttttcagggatctcatatttttagaccatgtgacagaggcttggaaagtttttatttgaaatttaaccaatcatatggtttataatgaaatgggaaaagttcccttgtcctgacagggtgcgtgatgcggggtgtggctcacttcttaagtgccccgctgctcagacctctaggggaccatacagacaggtaggctgtggggctccgacctcacaacagtgtctaggagtgaatgtttacagctcctgaatccgcagtgggcgtgtgttacagggtgctcttttagtttgccatctataggcggcttgtgttagctcaattagacccccttccttatcacaaggacagagggatttctgtatcccagggtttcctgccttggtgtacgggaagagtcggctcacacctgggcttggagaatgagtgcaaggtttattagtagaagtagctctcagcagatgggggaaccagaagggagatggttttctcctggagttgggccgcttggtggccagggctctcctccgtctgccccagccaaactccgcgtcgttgtcgttctgtcgacggcctgccggcgtgcgggtgcctatcgttgtgctcttctgctggcgtgctcctctcgacgaccagccactttcttccgccgatgtgctcctctttacgtctggccgcctgtgtgtctgcctgctagggtctcgggtttttataggcccaggatggggacatggcgggtccgggtggtcttggaaatgcaacatttggacgggaaagcaggagtgcctgtcctcacctaggtctgttggggtggagccctagtcagggacgcacctttctctacccattacttacctccccacttccgtgtcatttaaggagggcacactgttcccttcccagcactataacatgtttaaaatgttttaaaacttttttcattctctccaatatatgaattaataatccatttcagattttgaattaatgaatgtttaatgtaaaagttttgttaaattttcttttataaatttgagaataaaagcaaagaatgctgagccttcaaaaaactgtatgagaagactcattatacagagttttggaagtaggaggaccttaaaagtcacttacaagatcacttatttttattttatagtttaatgtattttagtaacaaacaggaacagcaaaaagacagcgttaaaaacgtgcttgaatgtaggacaactcaaaaaagtagagtgaacagatggaacctactctatgattaaaatgctgcaaacatcatttagttgctgtcaataagaaatttacttattttccaaaaatccaaatgcaggcattatccagaaaaatttaacaggtttatttataattgttatggccaggcatggtggtttatgcttgtaattccagcactttgggaggccaggacaggcagattgcttgagcccgggagtttgagaccatcctgagcaacatggcaaaaccctgtctctacaaaaaataaaaattagccagacatggtggcatgagaccagatgcttgggaggctgaggtgataggatcgcttgagcctgggaggctgaggctgtagtgagccatggtcataccattgcactccagcctgagcgacaaagtgagaccctgtctcaaaaacaaaaacaaaaaaaaatcaaaagaacaaattaaataattgttatgaagttgaacttctaaaacttgttcactgaaatgttttgacccgcattaatgctttatgtcccacatttatattgaaaatccacatgcaaataaaaatggaaaaaccaccaatacctcatttctgttccttattttttcacttacaatcttatacttaggtgccttttgaccctatggggaaaaaataatgttcagaactactgagaggtgacagcgtgctggcagtccttaccgccctcgctcgctctcagcgcctcctctgcctgggctcccactttggcagcacttgaggagcccttcagcccaccactgcactgtgggagccactttctgggctggccgaggccggagcccactccttcagcttgcagggaggtgtggagggagaggcgcgagcaggaaccagggctgcgtgccacgcttgcgggccagctggagttccgggtgggcatgggcttggcgggccccgcactcggagcagccggccagccctgccggccccaggcaatgaggggcttagcacccgggccagcggctgcggggggtgcactgggtcccccagcagtgccagccaaccggcactgctcttgatttctcaccgggtcttagctgccttcccgcggggcagggctcgggcctgcagcccgccatgcctgagcctcccaccccctccatgggcccctgtgcggcccgagcctccccgatgagtgccgccccctgctccacggcgcccagtcccattgccaagcggtgagacaatcgctgagcggtgagagcatcacctatccgcaagcagtgagtaccatcggacccctttcgcttgctattctgtcctgtctttccttagaattcgggggctaaataccgggcaccttattggccagttaaaagtgactagcgcagctgccagagtaaagacacgggtgtcaggctttctgggaaagggctctctaacaacccccgactcttcggagttgggaccattggtttgcctagaaccagcttccgcttttcctgtacttctggactgagtcaagggtcgacaaagaggaaagccatgcagctccggggtcccaacaacaagttggttgaccctgcggccatgggcagaactctcaaaggcatgtcacccaagtgagacttgcccatctatcgtatctatcctgacccttgccccctgggtcctaatgcctgccagacaaacttcctctcacctcttttctctgaggctaattagacccacttctaaaaattgctacctgtctctggtgcttttctagtttctcctataagaatgatttctagtataaactccaggactctgttaccttctttaggcacctgggctcaccaatcagaaagacataatttttgcccaaagccctgtcacagtggggactacctggaattttaggatccctcctcagactaacaggcctaacaaaagctattcctgaagctaggatatggggagccttagaaattgtatccttcctattcatataagtgaggacaaaaggtgtcactcttccaaccctggagatcccttccctccctcagggtgtggccctccacttcatttttggggcataacatctttataggacaggggtaaagtcccaagactaacaggagaatgcttaggactcttaacaggtttttgaggatgcgttggtaagggccactaaatctgatttttctcagtcggtcctccttgtggtctaggaggacaggcaagggtgcaggttttcaagaatgcgtcggtaaggaccactaaatccgaccttcctccgtcctccatgtggtctgggaggaaaactagtgtttctgctgctgcgtcagtgagcgcaactattccgatcagcagggtccagggaccgttgcaggttcttgggcaggggttgtttctgctgctgcattggtgagcgcaactattccgatcagcagggtccagggacagttgcatgttcttgggcaggggttgtttctgctgctgcgtcggtgagcacaactattccgatcagcagggtccagggaccgttgcgagttcttgggcagggggagaaacaaaacaaaccaaaaccacgggcggttttgtctttcagatgggaaacactcaggcatcaacaggctcacccttgaaatgcatcctaagccattgggaccaatttgacccacaaaccctgaaaaagaggcggctcatttttttctgcactacggcttggccccaatattctctttctgatggggaaaaatggccacctgagggcagtacaaattacaatactatcctgcagcttgaccttttctctaagagggaaggcaaatggagtgtcttaccttatgttcgagctttcttttcattgagggagaatatacaactatgcaaagcttgcaatttacatcccacaggaggacctctcagcttaccaccatatcctagcctccctatagctccccttcctattaatgataatcctcctctaatctcccctgcccagaaggaaataagcaaagaaatctccaaaggaccacaaaaacccccgggctatcggttatgtccccttcaagctgtagggggaggggaatttggcccaacctgggtacgtgtccccttctccctctctgatttaaagcagatcaaggcacacctggggaagttttcagatgatcctgataggtacatagatgtcctacagggtctagggcaaacctttgacctcccttggagagatgtcatgctactgttagatcaaaccctggcctttaatgaaaagaatgcggctttagctgcagcccgagagtttggagatacctggtatcttagtaaagtaaatgatagaatgacagctgaagaaagggacaaattccctactggtcagcaagccatccccattatggatccccactgggaccttgactcagatcatggggactggagtcgtaaacatctgttgacctgtgttctagaaggactaaggagaattacaaaaaagcccatgaattattcaatgatgtccaccataaatcagggaaaggaagaaaatccttctgccttcctcgagcggctacgagaggccttaagaaaatatactcccctgtcacctgaatcacttgagagtcaattgattctaaaagataagtttattacccaatcagccacagataccaggagaaagctccaaaagcaagccctgagccctgaacaaaaatctagaggcattattaaacctggcaacctcggtgttctataatagggaccaagaggaacaggcccaaaaggaaaagcgagatcagagaaaggccgcagccttagtcatggccctcagacaaacaaaccttggtggttcagagaggacagaaaatggagtaggccaatcacctggtaggtcttgttatcagtatggtttactaggacactttaaaaaagattgtccaatgagaaagaagctgccccctcatccatgtccactatgccgaggcaatcgctagaaggtgcactgccccagaggacgaaggttccctgggtcagaaggcccaaccagatgatccaacaacaggactgagggtgcccggggcaagtgccagctcatgtcatcaccctcactgagccccgggtatgtttaactattgagggccaggaaattgacttcctcctggacactggcgcagccttctcagtgttactctcctgtcctggacgactgtcctcaaggtccgttaccatccgaggaatcctgggacagcctgtaaccaggtatttctcccacctcctcagttgtaattgggagactttgctcttttcacatgcctttcttgttatgcctgaaagtcccacaccgttattagggagggatatattagccaaggctggagctattatctacatgaatatggggaacaagttagccatttgttgtcccctacttgaggagggaatcaaccctgaagtctgggcattggaaggacaatttggaagggcaaaaaatgcccgcccagtccaaatcaggttaaaagatcccaccagttttccttatcaaaggcaatatcccttaaggcctgaagctcatacaggattacagaatattgttaaacatttgaaagctcaaggcttagtaaggaaatgcaggagtccctgaaacaccccaattctgggagtacaaaaaccaaacggtcagtggagtctagtgcaagatcttagactcattaatgaggcagtaattccactatatccagttgtacccaacccctataccctgctctctcaaataccagaggaagcagaatggttcacggttctggacctcaaggatgccttcttctgtattcccctgcactctgactcccagtttctctttgcttttgaggatcccacagaccacacgtcccaacttacatggatggtcttgccccaggggtttagggatagccttcatctgtttggtcaggcactggcccaagatctaagccacttctcaagtccaggcactctggttcttcaatatgtggatgatttacttttggctaccagttcggaagcctcgtgccagcaggctactctagatctcttgaactttctagctaatcaagggtacaaggtgtctaggtcgaaggcccagctttgcctacagcaggttaaatatctaggcctaatcttagccaaagggaccagggccctcagcaaggaacgaatacagcctatactggcttatcctcgccctaagacattaaaacatttgagggggttccttggaattaccggcttttgccgactatggatccctggatacagcgagatagccaggctcctctatactctaatcaaggaaacccagaaggcaaatactcatctagtcgaatgggaaccagaagcagaaacagcctttaaaaccttaaagcaggctctagtacaagctccagctttaaggcttcccacaggacagaacttctctttatatgtcacagagagagctgggataactctcggagtccttactcagactcgtgggacaatcccacaaccagtggcatacctaagtaaggaaattgatgtagtagcaaaaggctggcctcactgtttaagggtagttgcagcagtggccatcttagcatcagaggctatcaaaataatacaaggaaaggatctcactgtctggattactcatgatgtaaatggcatactaggtgccaaaggaagtttatggctatcagacagccacctacttagataccaggcactactccttgagggactggtgcttcaaatgcgcatatgcgtggccctcaaccctgccacttttctcccagaggatggggaaccaatcgagcatgactgccaacaaattatagtccagacttaggccgcccgagatgatctcttagaagtccccttaactaatcctgaccttaacctatataacgatggaagttcatttgtggagaatgggatacgaagggtaggttacaccatagttagtgatgtaaccatacttgaaagcaagcctcttcccccagggaccagtgcccagttagtggaactagtggcacttacctgagccttagaactgggaaagggaaaaagaataaatgtgtatacagatagcaagtatgcttatctaatcctacatgcccatgctacaatatggaaagagagggagttcctaacctctgggggaacccctattaaataccacaaggaaattatagagttattgcacacaatgcaaaaacacaaagaggtgggaatcttacactgacaaagccatcaaaatgggaaggagaggggagaacagcagcataagcagctggcagaggcagcagaaaggaaagaaagggacaggaagtcaaagaaagagacagagaagagacaaagaagtcagaaagaggaacagacacagaaagagagttaaaaagagaggaagagacaaagaagaagttgaagagaaagaaagagagatggaagtagtaaagaaaaaacagtataccctattcctttaaaagccagggtaaatttctatctacccagccaaggcatattctacttatgtggatcttcaacccgtatctacctctcaaacagtttgcaagaaataacaaaatctatccttactgtataatcccaaatagactctttggcagcagtgactctccaaaaccgccgaggcctagacctcctcactgctgagaaaggaggactctgcaccttcttaggggaagagtgttgtttttacactaaccagtcgggggtagcacaagatgccacccagcgtttacaggaaaaggcttctgaaatcagacaacgcctttcaaattcttataccagcctctggagttgggcaacatggcttctcccctttctaggtcctgtggcagccatcttgctgttactcgcctttgggccctgtatttttaaccttgtcaaattcgtttcctctagaatcgaggccatcaagctacagatggtcttacaaatggaaccccaaatgagttcaactaacaacttctactgaggactcctggaccgaccctctggcacttcccctggcctagagagttcccctctgaaggacactacaactgcagagccccttctttgcccctatccagcaggaaatagctagagcggtcattggccaaattcccaacagcatttggggtgtcctgtttagaggggggattgagaggtaacagcgtgctggcagtcctcacagccctcgctcactctcagcgcctctgcctgggctcccactttggcggcacttgaggagcccttcagcccaccactgcattgtgggagcccctttctgggctggccaaggccggagcccactccctcagcttgcagggaggtgtggagggagaggcgcaagcaggaaccggggcggcgtgccgcgcttgcgggccagccggagttccggttgggcatgggcttggcgggccccgcactcggagcagccagccccgggcaatgaggggcttagcacccaggccagcagctgcggagggtgtactgggtcccccagcagtgccagcccaccggcgctgctctcagtttctcactgggtcttagctgccttcccacagggcagggctcgggacctgcagcccgccatgcctgagcctcccaccccctccatgggcccctgtgcggcccgagcctccctgatgagtgccgccccctgctccacggcgcccagtcccatcaaccacccaagggctgaggagtgtgagcgcacggtgtgggactggcaggcagctccacctgcagcccaggtgtgggatccactgggtgaagccagctgggctcctgagtctggtggggacatggagaacctttatgtctagctcagggattgtaaatacaccaataggcactctgtatctagctcaaggtttgtaaatacaccaatcagcaccctgtgtctagctcagggtttgtgaatgcaccagtagacactctgtatctagctactctggtggggccttatagaacctttgtgtcgacactctgtatctagctaatctggtggggacgtggagaacctttgtgtctagctcagggattgtaaacgcaccaatcagcgccctgtcaaaacagaccactcggctctaccaatcagcaggacgtgggtggggccagataagagaataaaagcgggctgcccgagctagcagtggtaacccgcttgggtccccttccacactgtggaagctttgttctttagctctttgcaataaatcttgctactgctcactctttgggtccatactgtttttatgagctgtaacactccccgcaaaggtctgcagcttcactcctgaagccagcgagaccaggagcccaccaggaggaatgaacaactccagacacgccgcctcaagagctgtaacactcaccgcgaaggtctgcagcttcactcctgagccagcgagaccacaaacccaccagaaggaagaaactctgaacacatccgaacatcagaaggaacaaactccagacgcaccacctgaagagctgtaacactcactgcgagggtccgtggcttcattcctgaagtcagtgagaccaagaacccaccaattccggacacactaccaataaaaggaagaagataatatttttttaacaggagttttccatcatagtagattctttttttttttttttttttttgagagagtcgcactctgtcactcaggctggagtgcagtggcgcaatctctgctcactgcaacctccacccttcgagttcaagcgattctcctgcctcagcctcccgagtagctgggattacaggtgcctgcccccgtgcctggctaattttttgtatttttagtagagacggagtttcaccatcttggccaggctggtcttgcactcctgacatcatgatccacccgccttggcctcccaaagtgctgggattacaggcgtgagccaccatgcctgacccatcatagtagattcttaaggatgctttctacaaatgcattgtgctagttggatatcttttggcatgattgttacacgtttggcatggataacatacaggttaatgtcttcaaaaaggccaaccagataggcctactgaaccaaagagatagctattttcaaaacaccaatagctgtactctagatgtgccaatctattttgaagtcccaaacaatttctcacctcagacactggaagaaaatttgccaatcagaagttcaggggacttctgattaggacttattacagagtgcctcgcaaataggtctgtaattctgaggtttcttcacctatcctgtagaggacactctcttaggagcagctttttttttttttttttttttaataaattttggaaacaggattttactctgtcttctaggccgcagtgtagtggcgcaatcatagttcactgcagcctgcaactcctgagctcaagcaaccctcccaactcagcctcctgagtagctgggattacaggtgtgagcactgtgcttggtctcttatgagcaacttttgtaaccacttgcttactggatgctttacttccagttgatttatggacattgttgtgccttttatgagccatggtatagagacctccttacttactctcctcctttggctggagcttggcaagctagaggtggtgctggcactctataaccactttattttatggataaagaagtaagagcctagaaaaattatataatttgtccacagtggctaaagtgggactaaaacttatgagctcttttcactaaactactttaccactgttacctgaaatattttgggagtgtaatattatcaataatagactacttatttcctaacaactggttgttaatgataatgttaaattatagttaaattttgaagttaaatcactgttcgtcatggttgctaatatttgatgtaatgccttaggacaaattttcctacctaggtgtcttagtcaaagtagtgtggactgggtacttagttctagagtctgggaagtccgtgtccttaatagtgcctgcagatggttgtcttctcattgtaacttacatgttatgtgtaactcacatgccaatgttctcacatggcagagaacagaaagatagatcctgtgtctcctcttttttaatttttaattaattaattttttttttgagacagagtctcactcacccaggctggagtgcagtggtgtgatatcagctcactgcaacctccgcttcttgggttcaagtgattctcctgcctcagcctcccaagtagctgggattacaggcacacaccaccaagcccagctaattttttgtatttttagtagagacagggtttcgccatgttggccagcctggtctcaaactccttacctcaaatcctcaagtgatccacccaccttggcctccactttacagacatgagccaccatgcctggccttttgttttgttttgttttgtttttttataagggcccaaacccattcatgagggctctaccctcattatataattaccttccaaaggttctacctccatatactgtcacgttggggatttaggcttcaacatacgaatttgcagggcacatattctgtccataggccgggtgcggtggctcacacctgtaatcccagcagtttgggaggccgaggcgggtggattacgaggtcaggagtttgagaccagcctgaccaacatggtgaaaccctgtctctactaaaaatacaaaaaattagttgggcgtggtggcatgtgcctgtaatcccagctacttgggaggctgaggcaggagaatcgcttgaacccagaaggcagaggttgcagtgagctgagatcgcgccactgctctccagcctgggtgacaagagcgaaactctgtctcaaaaaacaataacagcaaaaaaattagccgggcatagtggcgtgcacctgtaatcccagctactcgggaggctgaggcaggagaattgctagagcctgggaggcgaaggttgtagtgacccgagatcgtgccattggactccagtgtgtgcaagagagtgagactctgccttaaaaaaaaaaaaaaaaaaaaggaattcattaaatgttcagctgtttcttcctcctcacatgtacagtggtgtcctcctccactcactgctttacctaggataagagcagccttgggtctcttcactcttggaagagtcttttcatattctacttttaaatccatttagtttccttttgtccttagatcttatttttaaagaaaaggttatgatttttaggttttctgacttgttatcagggaagtgttttggcttgttactaagatgggaataaaattctttgcatctttgtatactctaagcagaagtgggagtcactttttttcacattggtcgagacagcatcttgctctgtcacccagactggagtgtggtaacacaattatggctcactgcatcctcgaactgctgggcatgagcagtcctcctgcctcagcctcccaagtaactgggactataggcatgcactaccacacccagctaattttttattttttgtagagacaaagtcttgctctatcacccaggctgatctcaagctcctggcctaaagcggttctcccagcttagcctcccaaaatgctgagatcacaggcatgaactactgttgcctggccttttttcatcttttttttttttttcctgagatggagtttcactcttgttgcccatgctggagtgcaatggcgccatctcggctcactgcagcctctgcctcccgggttcaagcgattctcctgcctcagcctcatgagtagctgggattacaggcatgtgccaccatgcccggctaatttttgtatttttagtagagacagggttttaccatgttggctaggctggtctcgagctcctgacctcaggtgatccacccgcctcagcctcccaaagtgctgggattataggtgtgagccactgtgcctgtccccttttacacattttaacatatgtgatatgataagtcattttatcttatctaaaaagctgtcatttgaggctattattattattattattattattattattattattattatttttgagtctcagtctgtcacccaggctggagtgcagtggtgtgatcttggcttactgcaaccttcgcctcctaggttcaagcgattcttctgcctcagcctcctgaatagctgggattacaggcacgcaccaccacacctggctaatttttgtatttttagtagagatggggtttcaccatgttggtcaggctagtctcaaactcctgacctcgtgatccacccgcctgggtctcccaaagtgctgggattacaggcgtgagccactgcacccagctgagtctattatttccttatcaccaagaaaaagaaataccatcaagtaattttacaatgccacaaatatgatatatcccactgtaggagattttaaggtgtgatcaatgtatgtattaaaattgatgaaatatgggagttgtcacctatgtaaatgtgaacttgattgttaactctggcagaatgtccactcagcagcaacccttcagtgtttctgtcaacaaaccatatgagaagtcagatgagttgtattgtttgaaaatgtttcattggataacaaaatgttgatggttgctaacgcttagtgatgggcatttggaatttgtatgtacactccacttctgtatatagtagtaagttttttataataaaaagattaaaactagaacaagcaaccttccattggcactttctggcatgatcaagaaagcatctgcattaaaattttcagtgtcgtgttagtggatggaaagaaaattccagagacaaaagtcaaaagaatgttttaaagaaatgttgggttatgatctcagtgatgtttttaatgacacataaggtagaaatgtatggaaaaataggacacagttgacaaatttgaaaagatattcagaagaatctaactctaaatatgaaaaagttttaggaatacctacaccaatttattttgcatctgtttttctttttacaggctgtatgagagtgattttaataatctctgtccaaataagtctaaaggagcttatcaagaagtaaagcataacattctaggggataagtcatagttggtcgtagtttaagcagcatactttttagtatctcttattttgaataaaaaaaaattaagtaccatgtatatagttaatcatttttagtgtttccaagatactgcttttcttcataggctataaaaagcttttgttgcttatattagtaacaaaaacaattttgcaaatggaaacatttctagaaaccttactatttatattagtattatataaatttatccaatttccagaaatttgggtaatgctaaaatcactttccaacaactaagactaggaaaattgtcatttctattttgtaataaaagcttgataaaatacacattagttagctatatgcaatgttctcataatttagtaaaagcaaaaaaaagcctagaaagctaaatcttagtggaaaaatctttattattaaattttcaaatgtactaattctgtgctttttatgtacaacttttggtttttcaggtttttccaaaatctaacctttgttacattaaaattttaatattttatttaattggtaatgtcctttaaataacattaatctaaattttcaatactgaaatttaaacatgtccacatatttaagaattaaaaattagatttttaaaaaataaaattagattccttatcacttctcattcctagttgaattcaaaatacatttttcaaataagtaatatggttcagttcttttgggaattataacattggatatcttaactcatttccagagacagttttatctgtaatgccatattaatattacatttaatatttaattttattttttatacagaagacaagataatctttattaactcatatttacttgaattacacaagaatgtaagaacacatttaaatattcagtgtttctcatttggatgtggcaaaactttgtttcacgttagactacgaatttttttattgtaacaaatatttaaagaaataccagtttttggctgggcgcggtggcttatgcctataatcccagcactttgggaggccaaggtgggcagatcacgaggtcaggagttcgagaccagcctgaccaacatggtgaaaccctgtctgtactaaaaaatacaaaaattagctgggtgtggtggcgcgtgcctgtaatcccgctacttaggagtctgaggcagaaaaatcacttgaacccaggtggcggaggttgcagtgagctgagatcgtacatctgtgacatggataatattcagtgataaaaggaaatgaactgctaagccacaaaaagacatggaggaacctaaagtacatattgctaagtgaaagaaggcagtctgaaaagtctgtatattgtatcattccaactatatgactttctggaaaggaaaaactataggcacataaaatatccttgtatagtcatgaatctataaattatttagttttgtgtgtgtgtatgtgtatgtattgaaaatagtttatcttttaggtttagcaaattctaaaatgaggttttttttgtttttttttgtttatttgtttgtttgcttttgagacggagtcttgctttctcacccaggctggagtgcaatggcatgatcttggctcactacaatctctgcctcctgggttcaagtgattctcctgcctgagcctcctgagtagctgggattacaggcaagcgccaccatgcccagctaatttttgtctttttagtagagctgtggtttcaccatgttggtcaggctggtctcaaacccctgaccttgtgatccgtctgcctcagcctcccaacgtgttgggatgacaggagtgagccaccgcacctggctttagttttttttttttttttttgattgaagtaaaattcacataacttagaattagtcatattaaaatgtaccactcaacacattcatagtgttgtgcaactattacctctgtctagttccaaaacattttcatcaccccacaagggaaaccctgtatctaataagcagtcactccctatttcttcctctcccagtccctggcaactactaacctgctttctgtctatgaatttggcctattctgagtatttcatttcaatggaatcatagaatattcaaccttttgtaaatcctttgtaggaatataccacattttgtttatccattcatcagttcatgaacatttgtgttgtttccactttcgggtgttgtaaatagtgatgctgtgaacatgcatgtagaagtttttgtttgaacacttgtttttggttctttctgatatatgcctaggattggaattgctgggtcttatggtaattccatgtttaactttttgaggaactcacaaactgttttctactgtatacttaccatttcatatcccacttgcaatgtacaagagttataatttatccacatccttgccagcgctttttattttctttttttttaattgtagccatgccaatgtatgtgaaataatatctcactgtggtaaaatgagttttatatgtagcttttctgcctgtaacttactctgtatgttaaaaggaggcacaatgatcaatgtgttaaaatctattaatatctgaaaaatgggctgggcacagtgactcacacctgtaatcccagcactttgggaggccaaagtgggcacatcaacttgaggccaggagttcaagaccgatctggttaacatggtgaaaccccatctctactaaaaatacaaaaaattatccaggtgtggtgctacaaacctataatcccagcaactcaggaggctgaggcacaagaattgcttgagtctgggatgtggagtttgcagtgagctgagattgcaccactgagctccagcctgggcgacagagcaagactctcttaaaaaaaaaaaaagaaagaaagaaaaaagaaaatataataaatggtctgcaaattaagagtatttcagtgttgtttcaacatatccttctatagaaatatagtttagacattttaataagcaacttctacttaatttgattgagacaaataaattcattaaaacaggaatgcccattagaggaactctttgccgtagaggcatcctactttgccatagaagcttctaatttgagtataatatgcttgattttgattgaatataaagaatgaataaagatgctggcagtcatcaagcgcagcttctgatcagtattaccaaacattgcataactacatctagttaaacaatgaacagctctttcatagggcaactcattctgttttagacaggtctgtttataagccatgcttttctgtatgctcaactaaaggctcttatccttgaagatacactgattggaactggttatttgatgtgaagacagctatcatatcctcccaagttttcttttttttcctcatcagatgctttcagttctttctacccatcacagttcagaggtctcaaaccttcatagttgtacttgctctcttttggatatgctctagtttgtggccatccatcctaaagggtatttgctctagatgcgatctgacccacagaatggaacttaacacataaaatgtttacatgtttgtgatagccctgtgatttacctatgtgtgttcccattccattctgcaagtgagtaaacttgggctcagataggagaagaaactttcctaaggtcatatgttaagtggaagaagtgagcttcaagtcctattcagatttaactgcctccaaagccatgctattttcattaataaaaataccaatattgataagtgtaactaccatttattgcgtagataatatatgcttttttaaaaaaaaactttaattttttttttttttttaaagaaacagagtctcacttcatcacccaagctggagtacagtgatacaatcatggctcactgcagcctcaaactcctgggcccaagcaatcctcctgccatagccccctgagtagctgggactacaggtgcatgccaccatgcctgactaatttttttttttaatttgttttaatgtctggcattttgctatgttgtccaggctggccttgaccttgtggcctcaagtgatcctcctgcagcagcctcccaaagtgttgggattataggcatgagccactgtgcccagccagataatatattcttgacgttgtgttaagtacttagactaccatctaaatcttacagctaacttgggaaatacagagtactatttttataaatgaggaaattgaggatttaaaaccaaatgtgattctaaaactgttagattctaagactcttgatattatactatcctgtctaatctgtttcatggtattgttgatgttttaataattaggagcacatctacttggtgttttagtgttccaaatctatacagaatagtctgtatgattaaaaaatataatttgtaattatcacatttattactaattttttctttcatttcctttgatgcaaaaacattactaatttgattatacatgggtacagcctttctaaagggcagtctgtcagtatttaacaaaatacttttttaaaaaaaaatgacatttcaaaatttgttttcttttaggtccacctcattcatttaaccgagatgagacaataatcattgctttggcatcagtctctgtattagctgttttgatagttgccttatgctttggatacagaatgttgacaggtaaaaattaccattttttgtcctattgtttattaaacatgcaatttaatcaatttatttgctccttttaaattccgtatgttaaaaaaaatagtctcaaagttatgcaaaatacacccagcctcaatagtatcacgtatggacagtattgtttcatttaaattatcagtcactacccctttccatgccactggattattttgaagcaaatcacagatatcatatatctgtaaatatttaattagatattatatatctataaatattatctctacaatacaagagctttttttaaaatttattttattttattttattttatttttgagacggagtctcgctgtcgcccaggttggagtgcagtggcgcgatctcggctcactgcaggctccgccccccagggttcacgccattctcctgcctcagcctcctgagtagctgggactacaggtgcccacctcctcgcccggctaattttttgtatttttagtagagacggggtttcaccgtgttagccaggatggtctcgatctcctgacctcgtgatccgcccgccttggcctcccaaagtgctgggattacaggcgtgagccactgcgtccggccaatacaagagctttaagaatacatatccataataccattttcacatctgaaaaaataacagtaattcctcagtatcatcaaatgtcaagttggttctaatatactttaggtttgatggactgtttaggaaatcagcgttcattgattcatttgaataacttctatacaatcttctttaaagtttttataatattgcttagggttttaaacttttaaagtaagtcatcatgggagtgtctcccagaatttggctttcatgctattctgcattcatcttaatttataggtattacctagtttagtaaatagctttactcctattgacattaggcataaatcttgctgctaatctttctgcagctcttctttttaagtgtaatattataaaaagtgtaaaaagatattcattttaagaaaaccatatattagtaacctgtttcctgttcttataggagaccgtaaacaaggtcttcacagtatgaacatgatggaggcagcagcatccgaaccctctcttgatctagataatctgaaactgttggaggtaagtttgccgttagattatggactgttgtttctactgtgatactagacctggaacagtgacttcattcaatcattaagacattcattcatttatttaaccctatttactaaattacaattttttgtcaaggcctattctaggcactaggaacataggtgaacaatgtctcctggggcttctatttgaattggggagtctacagacaggtacaggaatgtataatataattgcaagtagtagtaagtgctatgaagaaaagtacagtggataagaaagtgatgaaaagggggttattaaagaaaatatgggccaggcgcagtggctcatgcctgtaatcccagtactttgggaggttgaagctggtggatcacctgagatcaggagttcaagaccagcctgaccaacatgaagaaaccctgtctctgctaaaaatacaaaattagccaggcatggtggttcatgcctgtaatcccagctactcaggaggctgaggcaggagaattgcttgaacccgggaggcagaggttgcggtgagccgagatcgcaccattgcactctagcctgggcaacaagagcgaaactctgccacaaaaaaaaaaaaaagaaagaaagaaaaagaaaatatggccaggtgcagtggctcacgcctgtaatcctatcactttgggaggctgaggcagggggatcacttgaggtcaggagttcaagaccagcctggccaacatggtgaaaccctatctctactaaaatacaaaaattaactgggagtggtggcgcccgcctgtagtcccagctgcttgggaggctgaggctagcgaattgcttgaacccagaaggtggaggttgcaatgagccaagatcacgccactgcactctaggtgacagagcaggaatccgtctcaaaaaataaaaaagaaaaagaaaatatatttagaaagaggttgacctttgattagagatttgtacagggtatgagaataaagacatgaaagtttgagaagagtgtgccacaagggatccataatagacaacaaataaatactccttgtctgcatatattacatatttttatagatacataaggctcttttatatagaatttaagtttcatttggtgatatctcagaagctacattaaaagtgttaccatgatgagtgtttttatatttattaagaatgacttgaaaactatggtccccaaaccagagactattaaataatagatgtgatagatttgactatataaaaaattgtaagaactttctgttttgggagagacataccataaacaaagataaaagccaaatttgaaaaataaatttcaacatttcaacatataagggaaaacttgataaagaactgatataaatcaagatgaaagaaacattctatagcaaatggacaaaaaggctgagtgctgtgactcacacctgtaatcccagctcttttgggaggccaaagtgggtggattgcttgagcccaggagttcaagacaagtcatgggcaacatggtgaaaccccatttattttgtaaaaaatacaaaaattagctgggtgtggtggcacatgcctgtagtcccagctactcgggaggctgaggttgaaggatcacttgagcccaagaggtagaggttgtggttagcctaggtgacagagaccctgtctcaaaaaaaaaaggacaaaaggtattaactgccaattcacaaaagaagtaagtgtggctaagaaatgtacagtaagatgtccaatttacaaggctgaaagaaatactagttaacccatggaattttagccatgattaagtgatagaaacacttccaaacattgctgaattaactatatattgatataacctttttaaaggacactttgtataattttgatctggaaacagtgtatgaaacacaacatatatccttaaataaatgatggtaaatccccaacctgttttaataaaaagtaaaagcaatccccagaagccaaaaataacgagaatgggttacattttgctggttctttgggtgttgagtaatttttttgtattctggatattgtgaatattgtattgtggaacactgaactcaaaaattagctgggtatcatggcacgcgcctgtaatcctagctactcaggaggctgaggcaggagaatcacttgaacccgggaaacggaggttgcagtgagctgagaccgtgccactgcactccagcctgagtgaaagagcaagactatctcaattaaaaaaaaaaaaaaagatttttttttgttgttttagtaagcaataaacttggttgaacacataccacaaatctgtttggggcagaagctcaaatctcagttcagttattttatctttttttttttttttttactctgtcatccaggctggagtgcaaggcatggtctggggtcaccgcaacctctgcctcccggtttcaagtgattctccagcctcagcctctatgtagggatctttatgcaagtatttaagtctccacaaaagtgactacaggcgcatgccaccacgcccagctaatttttgtatttctagtagagatggggttttactgtgttggccaggctggtctcaaactcctgacctcgtgatccacccgcctcagcctcccaaagtgctgggattacaggcgtgagccaccacgcccggcctcagttattttatctttagctggaaactctcttgtatattcactgggctttcctctctctgaatttctcctttctagggttctcccctcattttctagcaactgtggctgtccaaaatatgtcctgagtttcccaaggccagaacaattttctgttcttcttttttcttttttttttttttgagacggagtctcactcggtcacccagtctggagtgcagtggcgcgacctcggctcactgcaagctctgcctcccaggttcacgccattctcctgcctcagcctcctgagtaagtgggactacaggcgcccaccaccacgcctgactttttttttttttttttttttgtatttttttagtagagatggggttttaccgtgttagccaggatggtctcgatctcctgacctcatgatccacccacctcagcctcccaaagggctgggattacaggcgtgagccaccgcgcctggcctcttttttttttttttttttttttttttaattgagacagtcttgctctttcgcccaggctggagtgcagtggcgcggtctcagctcactgcaacctccgtttcctgggttcaagtgattctcctgcctcagcctcctgagtagctaggattacaggcgtgtgccatgatacccggctaatttttgtatttttagtagagacagggtttcaccactttggccaggctggtctcgaactcctgacctcaagtgatctgcccacctcagcctcccaaagtgctgagattacaggcatgagccaccacacccagcctagaatggttttctttagcaattttagttccactgcacagtgctgatttcagcctgccctcaggataaaagtcataaaaatgggtagcttgccccataccacttttttctcaaagctttaatgcctctcaagatctatctgcctttagatctttcttttttttaaattttgtccagcatttataaatgttctctatgggcaggctgggtctggtaggagcttcatcagccatactagaacagaatttattaatttcttgataatggaataaactgtaagcaacagagagctgtagcattctgtttaaatttgtactttattatttagtaaatttgattgttcaattgtgatattaataccttgctttctttaaaacacttgcagctgattggccgaggtcgatatggagcagtatataaaggctccttggatgagcgtccagttgctgtaaaagtgttttcctttgcaaaccgtcagaattttatcaacgaaaagaacatttacagagtgcctttgatggaacatgacaacattgcccgctttatagttggagatgagagagtcactgcagatggacgcatggaatatttgcttgtgatggagtactatcccaatgtaagttcttcatagaaaataaactgaggccaggtgtggtggcttatgcctgtaatcccagcacttttggaggctaaggcaggtggatcacttgaggccaagagttcaggaccagcctcgccaacatggcaaaactcccgtctctactaaaaatacaaaaattagccgggtatgatggcacacatctgtaattccagctacttgggaggctgaggcatgagaattgcttgaacccggtaggcggaggttgcagggagccgagattgtacagccgtactccagcctgggcgacagagcaagacgcaatctcaaaaaataaaaaaaaataaactgacatttatattagttgttaatcagacttcagagaggaccactgtattacagatagagcattgctgactcacaaactggattattaatggtctgcaatgaaataaggatctcacaccagaatgtgaatcaactaattatactgtttgtttcgctgtctcctccttctttctgtttttctcttctttatttaattttttgataacaagttttttgatgaaagaagcagtactttgattgacattcattctgatgcaacattcttttctcatcagcaactggtaatagtttgtagataagcactttgagtggcaccaatacataaatgaatatatttacaaaatccttttgttttctacttattaaccataacaatataatttgtattcatactggtgaatgatacacttttctatcttaatttgatcaaagaattgtttaaaaggaaataatcattcataatttttaatattagagacataaaaatttataatgtttaaattcccctttccatcccttcctctcctctctacacacagaaatgtcatactaactctttcaagattctgaaatgtagtagttcattagatcttcatggaatcctagcctatttgcaaattctttataaggatgctaatttactcttcatgttaaagtgagttaattctaccttttttttttttcgcattttttcctctatatagggatctttatgcaagtatttaagtctccacacaagtgactgggtaagctcttgccgtcttgctcattctgttactagaggactggcttatcttcacacagaattaccacgaggaggtaagatagtcaatagatgaaattgacactcatgtgggttcaaaattcacaacaggaaattttaattatatcttcaaagtaaaagtataatttatattattggagatttattattagtcagttgtttgaaagattcagcatgaaatgcatttgaaatgtaacagaaagagctttcccacgcagctgccaagatggcagaggggcagtcctggtgcttgatagctgagtaaaactcctgggctacctggaggctatcatgacccagcagagaaagtagtggtcatgtcctgtgaggacatcaacatttctggcagtttctacagaaacaagttaaagtatctagccttcctctgcaagcggacaagcaccaacccttcccaaggaccctaccatttatgggtccccagccacatcttttggcagaccacctgcggtaggctgccccacaagaccaagcaaggctaggctgccctagatcacctcaaggtgtttgatagaatccccctgccatatgacaagaaaaagcagatggcggtttctgccaccctcgaggttgtacgtccgaagccttgaagaaagtttgcctacctggggcactgggctcagaaggttgactggaaataccaggcaatgacagccaccatgggggagaagaggaaggtctattatcagaagatctgttaccagaagaaaaacagctcatgaggctataggaaaaggctgaaaagaacatagagaagaacattgacaaatacacgaaggtcctcaaggcccacagactcctagtctgagtccaataaagactgtttattcctcatgcttgtcctggcctgctcttcctccattgttgccatggggatgtaggggacccaggggcagcagtccaggtgctctaggcagcctgggacttacaaagctggagataaggaatgaatcttagtcactgtctttctattaggttactttaaacaactctaaaagttgtgcagacataatttgtctatgatgtacttgtttgcaagagagtttcataaaatcattagtaaaaacaacctgctacttcagttggaatattggcagcccgggcgtgattgatggctcatgcctgtaactctgacactttgggagaccaaggcaggtggattgcttgagctcgggagtttgagaccagcctgggtaacatggtgaaaccctgtctctacaaaaaatataaacattagctggacgtggtggcatgcacctgtagtcgcagctacttgggaggctgagctgggaggattgtttgagcctgggaggtgaaggttctagttagctgaaatcacaccactgtattccagcctggctgacagctagactgtctcagaaaaaaaaaaaaagcaaatgtgaactggaacactaattgaagagtttccctaccttgtgaatggggaatctgtttgtatttcctaccttgtcatatactgtactctgcagctgttaggatgtgagaaaatgcctgtggggacagtatgagcctggtgttgtacagggtatttatggatgtgtaggctaggaagatatgcaaccaagggattacagccattgcattctcttccctgtactttgtgatgagaaacaaataaattaattttaaagaaaaaaatataacaggaagaataagagaaagaactttggctggcatggtgactcatggctgtaatcccaacactttgaaaggccaagtggatctcaaggatcacttgagcacaggagtttgagaccagcatgggcaacaaagtgggaccctttctctacaaaatataaaaaagttagccagatgtggtgacacgcgcacataatctgagctacttggatggctgaggtgggaggattgcttgagtccaggaggtctaggctgtagtgagctgtgttcaccccactgcactccagcctgagtgacagagtgagaccctgtctcaaaaaaacaaaaaaacgaaagaaaaagaacttcaagacttacagggaccattaagaatttaattcttggccgggcacggtggctcacgcctataatcccagcactttgggaggccgaggtgggcggatcacaaggtcaggagtttgagaccagcctgaccaacatggtgaaaccccgtctctactaaaaatacaaaaaattagccaggcatggtggcacgcttctgtattcccagctactgaggaggctgaggcaggagaatcgtttgaacctgggaggcagaggttgcaatgagccgagatcacgccactgcactccagcctgggtgacagagcgagactccctctcaaaaaaaaaaaaaagaaattcttgtccattaataatttctgagttgggtgcagtgactcacatctataatccgaacaatttgggaggccgaggcaggtggactgcttgagcccaagggttcaaaaccagcctagacaacatagtcagacccccatctctacaaaaaaagttttaatcagctggaggtggtggcacacacctgtggtcccacctactcaggaggctgaggtgggaggatagcttgagcctaggaattctaattgcaatgagctatgatcatgccactgcacttcagcctgggtgacagagtgagacatcgtctaaaaaaaaaaagaaaaatgaattccttttcatactctgaacattcttcctctaagatatacatgcgagcatacttagaaaatgttcttttcaaaagaaactatccacggagtaaacaacctacaaatgagagaaaatatttgcaaacttcacgtccaacaaaggtctaatatccagaatgtataaggaacttaaacaattgaacaagcaaaaaacaaatagccacattgaaaagtggacaaatgacatgaatagacacttcccaaaagatgacatacaagcagccaacaaatatatgaaaaaatgctccatatcactaatcatcagagaaatgcaaatcaaaaccacaatgatatactatcttacaacagtcagaatggctgttaatgaaaagtcaaaaaacaacggatgctgttgagactggagaaagcggaacacttatacattattggtgggagtataaattagttcagccactgtggaaagtagtttggagattcctcaaagaactttaaacagaaataccatttgacccagcaatcctattactgggtatatatccaaaagaaagcaaataattctaccagagagacacaggtcttctgtttttcacagcactatccacaatagcaaagatacggaatcaacctacttgtctgtcagtggtggactggatataaaaaatgtgttaaatggccggacgtggtggattacgcctgtaatcccagcactttgggaggctgaggtgggcggatcacctgaggtcgggagttcaagaccagcctgagtcaacatggagaaaccccatctctactaaaaatacaaaattagccgggggtggtggtgcatgcctgtaatcccagctactcgggaggctgaggcaggagaatctcttgaacgtgggaggcagaagttgcggtgagccaagatcgtgccattgcactccagcctgggcagcaagagtgaaactccatctcaaaaagaaaaaagaaaaagaaaatgtgttacacatacaccatcgagtactacacagccataaaaatgaatgaaatcatatcctttgcagcaacatggatggagctggagtaggttatgctaagtaggaatagaaaaccaaataccacattttctcactttataagtgggacgtaaacatcgggtactcatggacatgaagatgacagcagtagaaactagggactactagagtggggagagagggagaggggcaagggctaaaaactaactgttggggccggacgcggtggctcacgcctgtaatcccagcactttggggggctgaggcaggcggatcacgaggtcaggagatcaagaccatcctggctaacacagtgaaaccctgtctctactaaaaatgcaaaaaattagtcgggtgtggtggtgggcgcctgtagtcccagctactcgcgaggctgaggcaggagaatgccatgaacccggtacgcggggcttgcagtgagccgagatcgcgccactgcactccagcctgggcgacagatcgagagtctgtctcaaaaaaaaaaaaaaaacaactacctgttgggtactatgctcattacacgaataacaggatcatttgtacctcaaacctcagcatcatactataaacccagataacaaacttgcacatgtacccctgagtttaaaataaaagaggccaggtaccatggctcacacctgaaatcccaacactttgggaggctgagacgggcagagagcccaagagttcaagaccaacatggtgaaaccctgtctctgcaatagccaggcatagtagcatgcatctcaggagggtaaggtgagaagattgtttgagcccgggaggcggaggttacagtgagccaagatctcgccactgcactccagcctgggcagcagaccaagactgtgtctgaaaaataaggctaggtgcggtggctcacgcctgtaatcgcaacactttgggaggccaaggcaggtggatcacctgaggtcaggagtacgagaccagcctggccaacatggtgaaaccccatctctactaaaaatatcaaaaaaaaaaaattagccaggcatggtggcaggtgcctgtaatcccaggtgcttgggaggctgaggcaggagaatcaacaagagcgaaactccatctcagaaaagtaaataaataaaagaaaaaaatgttcttttgattctagggcattttcagactttttaaagcccatttttggatcttaggttaagaacctcttagctaggctatattatattttccttgtattaattttgtttaagtgaactacaatgcatcattaatttttttaatttttaatttttgtgggtacatagtagtgtatatatttatgaggtacgtgagttttgttgttgttgttttttgttttttttgagatgagtctcgctctgttccccaggctggagtgcaatggcgcaatctcagttcactgcaacctctgcctccctggttcaagcaattctcctgcctcagtctcccaagcattacaggcatgcacccagctaatttttgtatttttagtagaggtggggtttcaccatgttggccaagatggtctcgatctcctgacctcaggtgagccgcccacctctgcctcccaaagtgctgggattacaggcatgagccagcgcacctggctggctttcattttcaaagtcacctcattgtccatcatgccagtcagggaaaagtaagggaaggtaaaaggaattgtccctttctgtctccataagtcccactcctatgcttgtttgtttcccagaacctagtgcacacttagctccaaaagaggctggtaatatagttgttgttgatgttgttgtttcctgcttgtattgctgcctcaaataatattgggttctgttactaggtaggaagagaagaatacattgtggggatcagcctttgctcgtgtttcagagctatgtagttatattccctgttgtaactgtggtcttcctcacctttcatgcatatttttgctagttgttcagagcatctttttttttttttttttttttttttgagacggagtttagctcttgctgctcaggctggagtgcaatggtgcgatctcagctcactgcaacctccgcctcccgggttcaagcaattctcctgcctcagcctcccgagtagctgggattacaggcatgcaccaccacgcccagctaattttgtatttttagtagagatggggtttctccatgttgactcaggctggtcttgaactcctgacctcaggtgatctgcccacctcagcctcccaaagtgctaggattacaggtgtgagccacagcacccagcctggagcatctctttaatacgtttgctttctcactttgtttcaatatacacctcacctcatagataccccaaagttacctttgctataattgtgtctttgtgctttcttctaccctcatcccttgctacatttccttgtcatattatagccctgacattattttttcagtctctctgacatctttagtgaagagaactttaatatatcagttttcttagatctttgtttcattgtatattagcatggatcatcttttctagctgatgcttcatgtataaataatttctcctgaataatttatccgttcatttatcttgacatcttgcttctcctaaatacagaattgtccaaagtattgcctgtgtcagcaacttgatgcacttgctgtagtgctttagcacattaaccattggactgtgtccacttagctcttcaatattatactgcctttaaaaagttggcttagcacagaacttaaaataccatcctaatctcccttttcaagacttgcataatttagcaaggtttcaagtcaaatgtaggctgaaaagaatgattgccatcagatataagttttatttaaacagagctgttactctgaaacattagctaatgttaccactaaataagggtaatacctttttaaaaactaagtacatagatgctgctattgcatataaatatagtagctatttgaatttatgggatttttcttttttttggagtctcactctgttgcccagggtggagggcaatggcataatgttggctcactgcaacctccgcctcctggattcaagcgattctcctgcctcagcctcccaagtagctgggattacagacgtccaccaccatgctgggctaattttttgtattttagtagagacaaggtttcaccatattggccagggtggtctcaaactcctgacctcaggtgatccacctgcctcgacctccaaaagagctgggattacaggcatgagccactgtgcctgcccagaatttatgttttttacctgattatttaaaaaatattccctggccaaatgcagtggctcaaggctgtaatcccagcactttgggaggccgaggtgggtggatcgtgaggtcaagaaatcgaaaccattctggccaacatgtgaaaccctgtctctactaaaaatacaaaaaaaattagctgggcgtggtggcgtgcgcctgtagtcccagctactcggtaggctgaggcagaagaatcgcttgaacctgggaggcagaggttgcagtgagctgagattgccgccactgcactccagcctgggcgacggagcaagactccatctcaaaaataaataaataggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgacattgcgccactgcagtcggcagtccggcctgggcgacagagcgagactccatctcaaaaaaaaataataataaaaaaataaataaataaataaaaaatattcccaagtacagatgtttcttgacttacaatgggattacatcccaatgaactgattataaattggctgggcatggtagttcatccctgtaatcccagcactttaggaggctgaggcaggagaatcaaactcctgagctcagaagtttgagactagcctcggcaacatagtgagaccccgtctctacaaaaataaaaaaattagctggctgtggtggcatgcacctgtagtcccagctatttaggaggctgaggtgggaggattgcctgagcccaggaggtcaagactgcagtgagccaagatcatgccactgcactccagcctgagcaacagaacgagaccctgtttttatttatttatttacttttgagatggagtctcgctctgtcgcccaggctgtagtacaatggcgtgatctcggctcactgcaagctctgcctcccggcttcatgccattctcctgcctcagcctccagagtagctgggactacaggcacccgccaccacgccgagctgattttttgtatttttagtagagacagggtttcactgtgttggccaggatggtctcgatctcctgacctcgtgatccacccgcctcagcctccccaagtgctgggattacaggcgtgagccagcacgcctggccagagaccctgttttaaaaaaatgaaagaaagaaaagaaaaaagatcataagttagaaatattgtaagttgaaaatgcatttaatacatttaacctactgaacatcatagcttagcctaaactatcttaaatatgctcagaacacttacattagcctacagttggccaaatcatccaatacaaagtctactttataataaaggattgaatatctcatgtgatttattgaacactgttctgaaagtgataaaaaggaatgaagtatggtttctactgattgtttactgctttcccaccactgtaaagttgagaaatcataaatcaaaccatctgtaagtgaaagatcatctgtatgcctatactatactatttttacttgaagtgctctttcactgaattctatccttcccagcatcttcagatataactttgttatttggagtagaaatttggtagtaaggaattatactgttattacttattcagctgtttgttgcttccgaataaggaagaattgaacctatttatttatttgtaataagatctccctatgaattttttccatattataatagcaacgcatgcttattaccaaagaaatatctgaccaaaaaaatagatatagacaactcagacttcaccagaaaattactgttaagtagtttgtatatagtctttcatgtccttgggagggcagggggatagcactggtgataatatgtataaatatccatagattgactatttttggtcaggttttaaaaatacatataactaatatcttgttgtgctttcctttgagatatttgcctactgcagtgttctgcccagggcaaaattattgtatgttccaccctccctccatacccaaataaagaaaattaaaatgagtacagaggggagtttaaaagggaaaacttttctcaaaagggcagtctatagttctgcccattgatttggtattattatataaatatattccaatgtttccatgagttttcctatataaatattagctcaagattgtacgacatatatttatgttgtggctttatccagagtaagaaatgcagctcttgcaggaattgagtaggagccaagttaatacaagctttggaagactggagaacaggaagtgggtaagggaggaaatgagaaagaaatcaactcttaggtgaagaaattggtaactcctattttttcttcaaattgtactgttgcttaatttttttaaatcaatgattattataattatctatagtttcattattggtgaaattgcatttgaatgctcattaatgagcgtaatacatctgaatactgagtctatttgtgccaaaatacaaatcctcagtaaatgtattgactttgttctgattgctttgtttttctctatacctaagcagatattttaaatttcagaaattgtgctatagaattttttttcagttccagagctatggttttatttaatacaaggtttatataagatttccttatagagaagaaaaatataatgtacttatatttggtgagaggcttaggttagattcattctttcagtcagcaatcatttactgtgtgtctactctgtgccaagccttttaaagtcaggtgaaagatgttctctttctgccttcatggagcctgtagtcctatgataaggataaaaaagtaatagaaggagcataatactactttgcttctgtaaaatcagaaaaacaagttttcatatcttggtgagagataccacttcctccacttgtttttccaaaccattgtaaaactatttgtggttagatttgaaaagctgaggtgggcttagagatatggctaaacctcagggcagaactggaatgtgctgtcacagatttgatctgttaagccataggagagcagtttaagatttacgttaaaattttggagctccattagtttttcactgatacttattttagacaagcagactttttttttttgatgtttataccaaatattcctttctgtattgcctccttttacagccctatactataaatgaagagaaaaaacaagtgcgtgttagaatctgaagtggcagcatgtttgttagttttagttaatgtttaactatacatgcaacaggagttatattataaaatatattagaaaatagtgatgagtgtgagttgaaattccgatttctctttttttgttattagaaaattaatgggcagaaaaataatactacttctatatttatgtatgttcatttcatgttcaatagtcccttttattcattgataaatatttgaaattatccaaacagatcattataaacctgcaatttcccatcgagatttaaacagcagaaatgtcctagtgaaaaatgatggaacctgtgttattagtgactttggactgtccatgaggctgactggaaatagactggtgcgcccaggggaggaagataatgcagccataagcgaggtgagtgtatacaaaaggtatcacactgatgtactttgaaatgataatttaattaaaacatctactggccaggtgtggtggctcacgcctgtaatcccagcactttggtaggcccaggtgggtggatcacctaaggtaaagagttcgagaccagcttggccaacatggcgaaaccccgtctctactaaaaatacaaaaattagccgggcacagtggcacgcacctgtaatcccagctactcgggagtctgaggcaagagaatcgcttgaacccaggaggaggaagttgcagtgagctgagattgtgccactgcactccatcctgggtgacagagtgagtgagactcaggacaattatcctcatatactgccaattatagaatactaggaattacaaaattaggaaatataaaagacatctcataaaggcctttgtaaagttcatcagtttattttggaactcactgccattccaagtcatttttacaagcattaggaacaaatttgtaggaactgatttttgaggcaagggtaaagttaccaagtttaagataacacagtccaccttctgataatcaccattacagtgtggaacgtatccttcccaactttgttctctgcattcatatatacttgtctgtgcacaacatatatgtatttttgtgattttaaaaatttatttatttgtttattttgagatggagtttcacttttgttgcccaggctggagtgcaatggtgcaatctcagcccaccgcaacctctgcctcccaggttgaagcaattctcctgcctcagcctcctgagtagctggcattataggcatgtaccaccatgtctggctaatttttgtaattttagtagatacgaggtttctccatgttagggtggtcttgaagtcctgaccttaggtgatccacccaccttggcctcccaaagtgctgcaattacaagtgtgagccaccacgcccagctgtatttttttttttttttttttttttttttgagacggagtctctctctgtcacccaggctggagtgcagtggcgcgatcatggctcactgcaagctccatctcccgggttcacgctattttcctgcctcggcctcctgagtagctgggactacaggcacccaccaccatgcctggttaattttttatttttttttagtagagacggggtttcactgtgttagccaggatggtctcgatctcctgaccttgagatccacccgccttggcctcccaaagtgctaggattacaggcatgagccactgcacccggccacccagctgtatttttgtgaattttaaaaaatattaagttgtatacatattgttttgcaattttctcactgtatcttacagattatttatattgatatacataggaaagtctagctcattctttttgattgattaatagtattcactaaaatggatttaccacagtttacttattcaggaagggcattttataggtaaaaaataagttatagaaaggtttaatgacatggttagggtcaaataacattgacatgactaagatttatatataacttctggtctaatgtctgttcttcagaatatgctacgttctctctctaaaaaatatcactctaatttatcaggttggcactatcagatatatggcaccagaagtgctagaaggagctgtgaacttgagggactgtgaatcagctttgaaacaagtagacatgtatgctcttggactaatctattgggagatatttatgagatgtacagacctcttcccaggtaaaaactactgtcaaaagttgatattttttgaagtgaagcagttatatcttctttctctacctatagtacctaactcaacttttatgtaagaatctttttactttcatttaaacctttagttcattgctatctagtgtttagaaacattattagcagcaggatgcaaattaggaatttttttttttagagtactccaggttttcatctgagtgaaatttaattaattgccagtaatagcttatctaactgtattttgtttggtctctgattgctttagcagtaaacattttccttatgcaccatctgagtgtttgagacaaggtacacttacgatgtttactgagttgaacccagaaggaattagaagcaatgaattatttgtaaacactttttccttttctttttttttcatgctccctttctccctccttccttctttccttctttcttccttccttcctcttctctcaccttatctccttcccttcctcctcttttctcttcttccttcctttcaatgaaagaatactcattggccaggtgcggtggctcatgcctataatcccagcactttgtgaggccgaggcttgcggatcacctgaggtcaggagttcgagaccaacctgaccaatatggtgaaaccccgtttctactaataatatgcacctgtaatcccagctgctcaggaggctgagataggagaattgcttgaacccgggaggcagaggttgcagtgagccaagatcttgccgttgcaccccagcctgggcaacaagagcaaaactctgtctcaaaaaaataaaaaaaggcctggcgcggtggcttacacctgtaatcccagcactttgggaggccaaggcaggcggatcatgaggtcagaagttcgagaccagcctggccaatatggtgaaaccccatgtctactaataatacaaaaattagccaggcgtggtggcgagcacctgtagtcccagctactcgggaggctggggcagaggaattgcttgaacccagtaggcggaggttgcagtgagctgagatcacgccatggctctccagcctgggtaacagagcaagactccgtctcaaaaaaagggaaagaatactcatttaagtgaatgtttgtttgaggcttacttgaaatagccaaatgaatttatagttttcccttcttagggattacatcgttgtagtatcatctaaaaactttaactataaatctggcattgcattcttctaggtgctatacagatgatttgatctgtgtggccactgtcttttaggagtaacaccattaaaagcatagaaaaaggaactagcattggacaaatttatgaaatagagctatttaatttaaaaagattaataatggagttgaattgtttggctttaaagacattaggcattacacattagtttatatatatcaagtgtgtgtatatatatatacacacacacacacatatatatgtatcgtgtgtgtgtgtatatatatatataaataaaatttttatttatttatttatttatttatttattttttattgataattcttgggtgtttctcacagagggggatttggctgggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtgggacacagcacatgtttcagagagcacagggttgggggcaaggtcacagatcaacaggatcccaaggcagaagaagttttcttagtacagaacaaaatggaaagtctcccatgtctacttctttctacacagacacggcaaccatctgatttctcaatcttttccccacctttcccgcctttctattccacaaagccgccattgtcatcctggcccgttctcaatgagctgttgggcacacctcccagacggggtggtggccgggcagagaggctcctcacctcccggacggggcggctggccaggcggggggctgacccccccacctccctcccggacggggcggctggccgggcggggggctgacccccccacctccctcccggacggggcggctggccgggcggggggctgaccccccccacctcctggccgggcgggtggctgaccccctgccacctccctcccggacgggtcggctggccgggcgggtggctgacccccccacctccctcccggacaggtcggctggcctggctgggggctgacccccccacctccctcccggacggggcggctggccgggcggggggctgacccccccacctccctcccggatggggcggctggcctggcggggggctgaccccccccacctccctcccggacggggtggctgccgggcggagacactcctcacttcccagacggagcggctgctgggcggagaggctcctcacttctcagacggggcggctgccgggcggaggggctcctcacttctcagacggggcggttgccaggcagagggtctcctcacttctcagacggggcggccgggcagagacgctcctcacctcccagacggggtctcggctgggcagaggcgctcctcacatcccagacggggcggcggggcagaggcgctccccacatctcagacgatgggcggccgggcagagacgctcctcacttcctagatgtgatggcggccaggaagaggtgctcctcacttcctagatgggatggcggccgggcggagacgctccccactttccagactgggcagccgggcagaggggctcctcacatcccagatgatgggcggccaggcagagacgctcctcacttcccagacggggtggcggccgggcagaggctgcaatctcagcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggggctggagaccggcctggccaacacagcgaaaccccgtctccaccaaaaccagtcaggcgtggcggcgcgtgcctgcaatcgcaggcactcggcaggctgaggcaggagaatcaggcagggaggttgcagtgagctgagatggcagcagtacagtccagcttcggctcggcatgagagggagaccgtggaaagagagggagagggagaccgtggggagagggagagggagagggagctaaataaaatttttttaagagacagagcctcactctgtcacctaggctggagtgcagtggtgtgatcacagctcactgcagccttgacctccccaggctcaggtgattctcccacctcagcctctgagtagctgggactacaggcatgcaccaccaagcctggttcatttttgtatttttttgtagagacaaggtttcaccatgttgctcaggctggtctcaaactcctgggctcaagtgatccacccacttcagcctccaaaagtgcctggattacaggagtgagccaccgcaccaggccaaacattagtttgtaattcaaaaatataatgaaataaatcagtgattagtagattaagtacaggttaatcagttatctagaagtatattttctagttaattaaaagtacagagattcaattgaggcatttttctgaaaatagcagtaattgcagtagtatcaacaagtactttttttggccgggtgcggtggctcacgcctgtaatcccagcaccttaggaggccgaggcaagtgtatcacctgaggtcgggagttcaagaccagcctgaccaacatggtgaaaccctgtctctactaaaaatacaaaattagctggatgtggtggcacatgcctgtaatcccagctacttgggaggctgaggcaggagaatcgcttgaacccgggaggcagaggttgcaaggctgagattgcaccattgcactccagcctgggcaacaagagtgaaactcggtctcaaaaaaaaaaaaaaaaaaaagaagtactttttttgttttgtttttaagagacagggtctcactcctgcccaggccggagtgcagtagtgcaatcatagctcactgcagcactgaactcttgggctcaagcagtcctcctgctcagcctcctgagtagctaggactacaggtgcatgccaccacgcccggctagtattttattttttgtcgagacagtgttttgctgtattgcccaggctggcctcgaactcctgggctcaagtgatcctcctgcctcagcctcccaaaatgctgtgattgcaggcatgagccaccacacccaaacccacaagtattgtattatcagaactttgaccacagtttggtaatttctttgttaatagtctcatgtaggatttttgttttagaagcatgtctgactgaaatgattttttcatcagattagtacactgctacaaacaatatattttgaaaaactactgtgttcaaagaatgactatcgcttttgatctgataaataataaagaatgatattaaatgtttgaatagggaaaggcaattaaatcttgttttcagaagattattttagcaaatatgtaggattaattaaaatagaaatagaactagaaggggcttaaaaaggaaaaagaaatggagagttactgtttaatgggtacagagtttcagtttgggaagatagaaacagttctagaaatggttagtagtaatggttgtacaatagtgtgaatgtacttaataccacagaatggtgcacttaaaaatggttaaaatgatcagttttatgttatgtatattctaccacgataaaaaaaaaataaaggaataagaagagagttgctttaaaataccccgtaatcttggatatggaaatggggagaggcaaatctgggagaaaatgcagagaagaaatctgtacttgtggttatctgttaaaagaatgagatgtcaggccaggtgtggctcacgcctgcaaacccagcactttaggaggctgagaggggtgggggtggatctccaggtcaggagttcgagaccagcctggccagcatggtgaaaccccgctctactacaaatacaaaaattagacaggtgcagtggcacacgcctgtaatcccagctactcaggaggctgaggcaggagaatcacctgaacctgggaggcagaggttgcagtgagccgagatcgcgccactgcactccagcctgggtgacagaacgagactccatgtcaaaaactaaaaagaatgggattcaaaggaattgagaaatattcagaggttggccgggcacggtggctcaggcctgtaatcctagcactttgggaggctgaggtgggtggatcatttgaggtcaggagttcgaaaccagccgggccaacatggtgaaagcctatctctactaaaaatatttaaaaatcagctggtcgtggtggcagtcacctgtaattctagctacttgggagtctgaggcaggagaactgcttgaactagggaggcggaggttgcagtgagccgagattgcctccattgccctccatcctgggcaacagagcgagactccatctcttaaagaaaaaaaagaaggaactattcagaggtcttaaaacacagtgagggtgggccaggcacagtggctcacacctgtaatcccagcactttgggaggccaaggctagtggatcacctgaggtcaggagtttgagaccagcctgaccaacgtggtgaaaccccaactgtactaaaagtacaaaaaaattagccgggcttggttgtgggcacctgtaatcccagctactcgggaggctgaggcaagagaattgcttgaacccgggacgcagaggttgcagtgagcagagatcgcgccaccgcactccagcctgggtgacaaagcgagactctgtctcaaaaaaaaaaaaaaaaaaaaaagtgagggtcagagtggcaaccagaaagatgagttaatcctggagactgttcgatggggtattgacagacaactaaataaatttttaaagacaattaaaaataataaataagatggaaatttaagattaaaatggttatttgggagttgtctacatagagatggtaactgagaagttatgagtcgatgcactcctttaactggaacataaaaagaaagaaaaataggtgaataatgactgaatattggggtactacccccatgaagtaggttaattaagaagacaaatgatcagaaaagtagtgagaaaactgaaaaatcctaatgccttgtaagtcagtattagaaaactttaagaactaagatttcagcctgaggaagctgattaaaaaataaaaataaaaaaccacaccaagattgatggcaatagatgtaattgaaaagaggaaacagaactgaggaatgatttttgaatttgagtaggaggaggtcattggtatttttagaagagtttctgtggaatacagaacacagaaatcatgttacagagtgtatataggaggggaaagtatttaaaaagcacagtcaagggatacagggcactcttgaaaattttaacaattaaatgaggtggaagtagaaaagaaaaaaggatcatataaatatattaataaacctagagaatagtgtatactaactataaaattcttataaaacattttttaaacttttatgatatacctcaaaatgcagtatgtgctgtattattaaatggaaacactatgtaatgaaggttacttctctataaaatgttagtaaaataaatgatttatctgtattacagaggaagagtgaaatgctacaaagtttaaatagaagggggagaaggaagaaaaaaagaagagatagaaaaaggaagaaagaataagtgtaatttgagaagggagctaaaaaaaggtctgtaactggtagagacatagttaacaagtggcacatggggtgagaagcaggtaatggtatctgatagtgctagatattactataagatattttgggcagttctaaagaaaatgagattataaaactttccttgagcaatccagcgatagtaaggaaattcagtaaggttttaaggaaatccaataaggttattatcttccatgatgatgatttttgtcattaacattcacctttgtatctctaatacctaacactaagttagcactaaacaagtttctattgaacaattagattttgaactgtgaagatttagtggaaatttatttggtaattcttaaccattgcattcataaaagattgtgcttcaatttcctttagcaacttttaaaattataatttggacctaattttttaaaagagtgaaattgtgaatttttagttattctactaaaccagcatttgaaaaaaaaataataaataacacttggaaggtatgtgtatgtgttgtgtgtatgtctcagagacagatcagatacattagtaaataccttgcaattcacagatggtataggataaggttttatcacatggggtttcaaggaagaaagtgatatactaactgccatgattattaaatcctttaattttatctctcaagttcaatgttgatgttattgatcaacactaagtatctgcttaaatgtttacagtatgtgaaactcacttgtatttatacataaggcagtattacaacaaacttgggcgatgctgcacagataatagaattaatctttgtaaatcttttttaatattggtggagggcaagtatttattagttgttttgagtattcaaatagaaacaaaacttaaatgaaacataaacttatttgtaatgtggtttccatctgggtcattataactttgtattatctccatgtaagtgatataaggaaggctgcagacattgccattttgcttacaggaagtctgaaacacagaatagttaaatgacttttccaaggtcaagatgaagtgaagattagaacctaaatgccttatcctctgtcttggcgttcttccttctaatttatcttgtcattttaatagggtgggaggacgggtaaagagacaggaacagtctctgtgttctttgccatggtttctactagatcattgagtgttggtcccaggggtcttctatgtggttcaatatattatatacataaacttaattttattatcatattttgtaaaaatcaaaagcctaacatcagagttgattgtgcttattggcaatgaatagggttattaaatagtgataaaatagttaataatatttaagtccatgatctaaatactacctgttagttaaaaggaatttttagagctgggcacagtggttcacacctgtaatctcagcaccttgggaggctgaggcaggaaaatcatttgagggcagaagtatgagaccagcctgggcaacacggcaagaccttatctctacaaaaatatttttaaaaattagctgggcatggtgccacactcttgtagtcttagctattagggaggccacttgagtgcaggagttcaagttacagtgagctatgataatgccaccgtactccatcctgggcaacaaagtgagagcgtttctttgaaaaaaaatttttttaaagtatattgatttttctttcaaatgaccattatcataaatatttttgtaacatttgatacagtctggctggactataatagaaccaatgatgtaatgagacatagtgactgttcaacccacccacttacatttggttctgtaggcatatttgttgtactaggtcctggagtttttcctcatctttacccgcctccatgggatcagtgttcaggcatgttttcaagtattaagtatgccttataaacataatagtcttttttccctgaatttagtaataccagaaaccatttaaaaatacctatccatcattgaaactaccatttgacttatcaacaaatatttgagactattctaagcaaaacattcattaataatgcattagactgggcatggtggctcacgcctgtaatcccagcactttaggaggccgaggctggtggatcacctgaggtcaggagttcaagaccagcctggccaacatggtgaaaccctatctctactaaaatatgaaaattagctggacgtggtggtgtgcgcctgtaatccaagctactcgggaggctgaggcgagagaatcacttgaacccgggaggcagaggttgcagtgagccgagatcatgccactgcactccagcctgggcaacagagtaagactccgtctaaaaaaaaaaaaagaaaaaaaaatcattaaacctacagcaaggtctctttaggatttccaaatgtgcctgaaggggatgaaaaaataaaaagattgtgacacaattttttttgcttacttggtatcagaaatacccctgttattctatcatttatgatagttagaaattttattctgtcattcttttctacaaatccacaggggaatccgtaccagagtaccagatggcttttcagacagaggttggaaaccatcccacttttgaggatatgcaggttctcgtgtctagggaaaaacagagacccaagttcccagaagcctggaaagaaaatagcctggtaagaaaaaactaagttattaaagagaggacttatgactgaatatgttttaatgttgtttgaaacaaaaatagactgttaataacgttaatagtttttggagttgcctaatgccacaaatcaaacttgatttttatgatgttttcaaatttttcaatatgaaaaaaagtcagttttagttccattttgtttttttccaagcttaaaatactatttagagagaataactaatgtgtcataagtttgccagattaggtaacagctggataaattaacatattaatattttaaatattattgaaattctatcttactctcttgagaatagtaccaaaactgttaagtagtgcaggcttacataaccaatggctaatgaaaatttaggctagacctgaaaaaaaccaaggcgcagcctatgaattctgctaattattaaaaatataattcggctgggtgcggtggctcacacctgtaatcccagcactttgggaggccgaggcgggcagattgcctgagctcaggagttcgcgaccagcctgggcaacatggtgaaaccccacctctactaaaatacaaaaaattagccgggcgtggtggcgtgtgtctgtagtcccagctagttgggaggctgaggcaggagaattgcttgaacctgggaggcagagattgcaatgagccgagatcacaccactgcactccagcctgggtgacagagcgagactctgtctcaaaaaaaaaaaaagcatatatatatatatttatatacatatatatttatatatatatttatatacatatatatttatatacatatatttatatatatgtaaaattcacaacaatgaaatatctcaagtcccctgccatttgagtaagttgttgttacaacactgaaaacatcttacaaattaacaaatatacactcatataatcttttagtataaataggataatctaattatctactatcatttctgaagtttatttttttacttaaacacatttttttaatgtcagtacctctagatgtatctatttctctccatttggtcagtattctattgataaaatcatataatgattctattggatgatatatgataattattgtattaaaaaggaaaaaactacctctccctactatcactctccgtaagtaactccctttagcaatcttttgggttttttctcttccaaagattaccattataacttcaaatactctatctattcttaagttatctctcgtttactttctcccagtttgtaatattctattattaaatgatttatgttttgtctgtaaattcatctaatatttaaatacaataacgagaaatttttggtattatgattatgtaagcattcactgcacaacaaagtattgtgcttggatttataggaaataaaaattctacattagttactaaaatctcccctgcgctttggggagaatgtttcaagttatcatccatcacttgagcccaagggtttgaggctgcagtgagctatgatcacaccactgccctccagcctgagtaagaccctgtctctttaaaaaaaaatgtcatcaagtctcagctgcccaggaggctgaggtaggagaattgcttgaaccccagaggtggaggttgcagcgaggcgagatcgtgccactgcactccagcctgggtgacagagtgagaccccatctcaaaaaaaaacaaaaaaaaatttgaaaagtcatcatcaaatgatttctttttggtttcttgtcatctttctttgtcttgtttttaggctatactcagaagcgcattaaaaatctcatgtcattctctttcttgtaaacgattgtttttttgatgaagttcctccttaagtaatgtgtattagtatgtgtatggtggtaaacattatgaatccttgcatgtttaaaaatgtttttatcttgccctcacactcgagtaataatctggctggataatagtttcaatatcataattattttcttcacaactttgaaactactactccatcattctctagcctacaatctccatgtgctctaggccctagtctccagtctaatgagaatttcagtgccatcctgaatcgtttcattgctttttgtttcgttatgtttttgttttatcctcttaattttttttctctataagcttttaagactttatcactagaattgtgaaatttcaccttgatgtttgtaggcatggatctttacacacattttgcttggcactgggtaggttttcagtttgaaaattcaaaagtttcttaaattcagaggaattttcttttttctttttctttctttttttttttttttttttttgagacaggatcttgctctgtcattctggctggagtatagtggtgtgatcatggctcactgcagctttgaactcctctgcttaagctattctccttcttcatcttcctgagtagctgagacttcaggtgcataccactttgcctggctttttaaatttttggtagagacagggtctcgctttgtttcccaggctggtctcaaactcctgaattcaagcagtcctcctacctcagcttctcaaagtactgagatcataagcatgagccatcatgcctggcctggtatttttttttaattatttcttacctttcaattcttccttctggaattcccactagacaaatattgtaccacctgacattctaagaatcatttttttcttatattttccattttttctccctctatgtttttcttcctcccgtccccctcccctccccacacacctggcctcccttactacatttttcaagatttactcagctttatcttcaaatgacccatttagttttcactattacccttgtatcagttatctattcattaaagttttagcttccacgatcataattatatttccagaaactcgtttgccttttccatagcaatctgttcttatttccagaatgtaataagagtgattcattctgaaggtgttgtttttatgctttacacaaattaattttcttgactataataaaaggacaaaaagtgaaaaaataagcaacttaaattattttactatgtattttcacatttcaattttagattgtcttggtaggactaaaataatatttccattttggatcctgatttaagtggggtgatgtcatgtcagagacagggtagagacacattatagtttccatacagatttagaatgagcactgtcttcattggttatcttagtcactaggttactttcaagtttggcttctgtttcaagtcagattgaaatatttaagtatgtggcaattaaggagcctattgtcaagcacatacgtccaagattgcttccaaaactacagtccctgctatgggaactgggacagatttttgagaggtccctgatagcaagtgagaggctgaatactttactaggattaattagaggtgccagcctcacaatagagtatccctaaaagaaaaatctgtgaaattttattctagtaaaatacaacttcatcttccttaaattgttttatttcaccagcgcaaatgggatctattattttgaaatatctctcggcaaccctattattatgagatatgcatcatatgcatatttacctgaaaactttttacttccagtatagagtaggttgccaagtaaggaattcataatacttggttcacttccagggaatccatttaaatctaatgtgctacagtcaataaactgcttctctgcagtgacaatccaatactagagttaggtagcaagtacatagtttataaaaagagagaaatgcagctatgtctaaagaagccatttttgctttcatagttgcattgagattaagaaacattcctttagtagtaaaactcagaatctttcaaatattaatgaatataaaaactagctttaattttataaattgccagggactcaagcatagtttagtcaataaaggggggaagaatagtttcctgataaaaatgaaagcatagaaaatagtctaaaggaaatacatgaaaatgttaaaccatagttatctctgaatattgagttcataaatgactttttcttcctatatgtttcagaatttacagtaaaaatgaactactttaacaatcacatacacatggttttgtttttgtttttgtttttgtttttttgagacagagtctcgctctgtcactcaggctggagtgcagtggcgcaatctcagctcactgtggcgtctgcctcctgggttcaagcgatttttctggctctgcctcccgagtagctgggactacagtcacgtgccaccatgcctgactagtttttgtgtttttcgtagagatggggtttcaccatattggtcaggctggtcttgaactcctgacctcatgatccacctgcctcagactcccggagtgctgggattacagacatgagccaccgtgcccagccggtgttttgttttgttttgttttgttttgttttgttttgttttgttttgtttttgtagagacagggtagttgccaagactagtcttaaactcctggcctcaagcaatcctcccacctcggcctcccagagtgccgggattacagtcatgagtcagcatgcctggcccccacacacagtttaaggcttttgttttatgttaaaatattttaaattggtaaaataaaaaattataggccacgtttattttaaagtagcttttttcctcctacataaaattttcaggtataatttgtttaactgtactaccattcttcatgttttccattcttttccagttttttgtcacccatactatagtgcagggggacaataatagctcactgtagcctcgaactcctaaagtgctgggattataggtatgagcccagcctcttttccaaatgtttatactccatttcttagtctgtcttgaattcttttctctcccctgttaaaatcacttgcctggcttttctttattccttagtgttagttttgtataacctcttgtaatcaatggttttatcctaatatattttcacataaaaggtggcaacttagccaggcacggtggctcacgcctgtaatcccagcactttgggaggctggggcatgtggattacttgacgtcaggagttcgagaccagcctggccaacatggtgaaaccccatctctactaaaaatacaaaaatgagctgggtgtggttgtgcatgcctgtaatcccagcaacttgggaggctgaggcaggagaatcgcttgagcccgggaggcagaggttgcagtgaacagagatcatgccactgcaatccagcctggacgacagagcaagatccatcacaaaaaaaaaaaaaaaaaaaaggccaggcacggcagctcatgcctataatcccagcactttgggaggccgaggtgggtggattgcttgagatcaggagttttagaccagcctggccaacatggtgaaaccctgtctctactaaaaatacaaaaaattagccggacatggtggcaggtgcctgtaatctcagctactcaggaggctgaggcaggagaatcacttgaacctgggaggtggagattgcagtgagccgagattgcaccactgcactccagcctgagcaacagagtaagattccatcttaaaaaaaaaaaatgcggcaactcttcctcagtttatgtttgccctctggtctttttaagaaatatatagtacatttcagaagaaactaccagttcttttcacatagttttagtttttccattttctcttttggacaaaatctatagacttctgtgatctagaattcaacattttacatactttttcatctgacacaacccacattaagaaatacaacttcagccaggtgcaatagtgcacacttgtagtctaagctacataggaggctgagggaggagtatcgcttgagcctaggaatgtgaagctgtagtacacaatgatcccacctgtgaataaccactgcagtccagcctgggcaacatagtgagaccccatctcaaaaaaaaaagcaaagtttacatcattacatatagtataatacttaaccttaccacctactctatgtcctagtgttttctattctagtctagagcatttcagttttggttagagttgtttgttttaaaccactgagctgattttatgacccacccatgagatccaacttacgttttccttcctttgggtaggaaagattgaaaaagttccttgtttatcttttctacttttttttccccctacttgtctttcctcattagtgttaataatgccactccctttaacttatttacacaagcattaaggtatcattatttacctattcctagagttagagtcccctttcaaaggacgcatcagattttgcctgaatatttatgttttcacttctgatttattctcaatttttgtacatttaaagagctataattgataaactgcacgtattaaagtgtacatttaggtgtgttttgatatatgtatacacccataaaaccatcatcacagtcatgattgtgaacatgtcaattacccccagaagatttcttgtgcccttttgtaatctctcctcaactttctctatcccccatgagtccccaggcaaccactgatctgctttctgtcactagagattagtttacattttctagaattttatataaatggaatcatataaatgtactgtttttctggcttctttcagtatgattattttcagttataattaactattagttataattattcatgttcattattagttataatattattattagttataattattattcatgttcttatgtgtagccatagtttattaattgctaagtagtatttcattgtatgcatatgatacagtttgtttgtccatccactcgtgatggatatttgacttatttccagtttcaacttttataaataaagctgctgtgaatattcatgtacaagtctttgtataaacatatggtttcatttacttaggtaaatatctaagagtagagtggttgaatcatgtggtaggtatatgtttaactttttaagaaactgccagtttttgtgaccgggcgcagtggcggagttcaagaccagcctggccaacatggtgaaaccccatctctactaaaaatacaaaaattagccgggtgtggtggtgcatacctgtaatcccagttactcgggattgaggcttgagaatcgtttgaatccaggaggcagaggctgccgtgagctgagatcgcaccactgcaatccagcctgggcgacagagcaagactctgtctcaaaaaaaaaaaaaagaaaagaaaagaaaaaagaaactgccagttttctaaagtggttgtgccattttacattctggccagcagtgcataagagttccagtttctctgcatctttgccaacatttggtattgccagtctttttaattttaaacattcttttttgggggtggtggagggagtacagagtctcattgtatcacccaggctggagtacagtgctgccatcatagctcgctacagccttgacctcccaggctaaagtgatcctcccacctcagcctcctgagtaactgggaccacaggtgtgcacaaccacatccagctaatttttaaaaatttttggccaggtacagtggctcacgcctgtaatcccagcactttggaaggttgaggtgggcggatcacgaggtcaggagatcaagaccatcctggccaacatggtgaaaccccatctctactaaaaatacaaaaacaaaattagccaggtgtggtggcgggtgcctgtagtcccagctactcgcgaggctgaggcgggagaatggcacgaacccaagaggtggagcttgcagtgagccgagatcgcgccattgcactgcagcctgggcgacagagcgagactcctatctccaaaaaaaaaaaaaaaaaaaaaattgtagaaatggaatcttgctatgttgcccaggcttgtcttgaactcatggcctcaaacagtcctcccactgcagccttccaaagtcctgggattacaggcatgagccaccatgcctagcctagatttataattatcattttatgcttttctctcttaaataagaaaaaaggaggaggctggatgtgatgggtcttgcctgtaatcccagcactttgggagaccgaggcagaaggaacattttggcacagtggtgccttagtcaggcacagtggtacttgcctgtcgtcccagctactcaggaggctcatgtaggaggattgcttaggtccaggagttcaaggctgcagtaacctgtgatcatgccacagcactcgagcctgggcaacagaatgagacctctttttttgtttttgtttttaaaaaggagttacaaaccaaaaatataataatagtggcttttatagttacctaagtaggcttttgggttctacttattatctaatgtcctttgagggactccctttaacatttcttgtagagcatatcagctttttttttttttttttttttttttttgagccagagccttgctctgtcgcccaggctggagtgcaatggcgcgatctcggctcactccaacatccgcctcctgggttcaagcaattttcctgcctcagcatcccaaatagcagatgtagatatatacaagtctttgtataaacatatggtttcatttacttaggtaaatacctaagagtaggatgattgaatcatgtggatgtttaaaaacaaacctagtctgtttttaaaaagggagttaaaaccagctttcccctggccaggcgcagtgactcatgcctgtaatcccagcactttgggaggccaaggcaggtggatcacgaggtcaggagttcaagaccagcctggctaacatagtgaaaccccgtctctactaaagatacaaaaaaaaaaaaaaacagccgggcgtggtggcaggcgcctataatctcagctactcaggaggctgagggaggagaatcacttgaacccgggaggcggaagttgcagtgagcagagatcgtgccactgtactccagcctgggcaacattgcaagactctatctcaaaacaaacaaacaaacaaaaaactagctttcccccaaagggagactattatagggagactattgttcattgctaatagataggaatactgcagaatgggactgtttttgatactactgttttggaactagtttaaagaagagatgtctgtaagttttaaggttgaaatgaggcactcttttttttattcttttgaggcggagtctcactctgtcacccggggaggagtgcagtggcacgatcttggctcagtgcaacctctgcctcccgggttgaagcaattctgcctcagcctcccaagtagctgggactacagatgcataccaccatgctggctaatttttttttttttttttttgagacagagtctcactctgtcgcccagtctggagtgcagtggcatgatctcggcccactgccttcatggttcaagcgattcttctgcctcagcctcctaagtagctgggactacaggcgcatgccaccacacccagctgatttttgtatttttagtagagacgaggtttcactgtattggccaggctggtctcgaactcctgacctcgtgatccacccgacttggcctcccaaagtgctgggattacaggtgtgaaccaccacgcctggccaatttttttatatttttagtagagatggggtttcaccatattggccaaactggtctcaaactcctaacctcaggtgatcttcctgcctcagcctcccaaagtgctgggattataggcgtgagccactgcgcccaaccaagtatccttaactgggggtaaaggagaaaagctcacctagagatagaagacagccaaatgtccccaagttccatcaaactcaaaacttatttttgaagcagaattagtggctattgattgacataacgtaactgaattagcaacaatgacctaaacctgtggccttgaagaaacatctacgacttattgttgcttttacttttatgaataattcttcaaggagttaaggtaaatcttgcttgcttacttgttcatcaccttttgagcatgttccgtaatccttgaagcctaaaatatgttattagagctatgtaaaatactggttaaggtaattgatttttcttttacctcatgtggtaaactgaaaagctcaatacatttttttttttaaagacacatggtttgacatgtactttgtcttacaggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacggtaagaccctaaggggtgtggcatctatcaatcagtattagaaactgagacccaacaaagaatagaaaataaatacttttaaaccagcctaatagttcaatgattacctcatacaatctaaagttatcatttttctttcaatattcctattcttctattgaacatttttgtttggtacaagtgcaagatgaaatctgcattttttaatatgtaaaggtatagtgaaagaagttagtctttctctatttatggtccaactttcctgcaataataaaggtaaaatgtttttataactccaaaagttcataagcacttctatataaattgtctcatttatcctttgttgttattccttcttcctctgcttttttttttaagtaaatggaactatgaacttgcctatctaaccactgtttcactgacactaaggtttgtagacttcctatctaatgctctttcttatagaatatactactactacttttatatgaaagcaattcaaaggtctttctgttccatcattaatattattttacaagacattttctttgttagaactatgatttttggttctaaatagaaaggctttttaaaaattcctacaatttggaactttctacatctgtatttcttttttccatgtttggggtaaaaaagcctttctatgactttgtcattttgtctaatacatgtttaaaactttcagaaaggcatccaggaaagggttactggagaaaattgaaataaaaataaactcgattcttgaaactttttttttttctgtgtggtttttgtttttttttgtttgtttgtttttggaaactgtgtcttactctgtcccccaggctggagtgcagtggcgtgatcctggctcactgcaacctctgcctcccaggtttaagcgattctcctgcctcggcctcccgagtagctgagattacagtcacgagccaccacgcccagctaattttgtatatttattagagacagggtttcaccatgttagccagactggtctcaaactcccgacccctggtgatctgcctgccttggcctcccaaaatgctgggattataggcgacaggtgtgagccaccgtgcccggcctattttctgttctaatttgtgaaagctatttgtattagccataggtgaaaaatttggtttgcactacttttgtataggtcaaattagtttcaaatataaactcttataccttgtatatcagcaaatcaagaaagttagacactggcaattctaattataaattttctcactttacacatacctgaggacagtcttctgcttttatctcccctcatctctgtatttcccatgtcctctagtatgatgtttttacctctctcaaaagtcagctaaagcttttattttgaatgctttcaaacttttcttgaatggtaagaaaaaaaaaccttgatggcccaccttgatttggccacttttcgcctcctgtgtcattcggctcaaccttctgcatgcatcttctcatctccagtctctactaataatttcctcaaaattataattcatcccatagttacgctaactctaggttttattttcctgagtcttaccctccatgtctccttagcttccttttcttgtactgtataacaatttttttttcttcttttccttctatcatctcccttataaataactgtcactcccaaggaatgacaatgacagcaaagaacccatgataattggagagcagttctgaatctttgatcctttatttgaacatcatattctgccttataccttaggctcaaggacttttactgatatgactcagactaccccagaaagatatgtgccattactagggcatgcctcttaatggaggcctttggaacaacctaaaagcttatattctttttactatttggccattggaacttaattgataacataccttttgagtaggcactatgcatctagaattatggaaatacagaaaacatataccatggttcttcctctcataaaacataacgtctggttgtatgaatatacattccataaatatatatttcatgatgttataaaactataggggagattttttaattaacttataaaccaaaataatgaacatttataaaaattatatctcatccacatacatttttcagtaggcttaattcacataaaactaacacttatcaagttattaattgacacttgattatttgattagactttttaacctttagaaaaatgtacgtttggaagaaaatgaaaaacaactcagactttaaaatcagaggtgttaaatttggagagacagtttgtcataaatgtacgttctcaatgtgatactttttttctttctttaagcaacctgtcacataataggcgtgtgccaaaaattggtccttatccagattattcttcctcctcatacattgaagactctatccatcatactgacagcatcgtgaagaatatttcctctgagcattctatgtccagcacacctttgactataggggaaaaaaaccgaaattcaattaactatgaacgacagcaagcacaagctcgaatccccagccctgaaacaagtgtcaccagcctctccaccaacacaacaaccacaaacaccacaggactcacgccaagtactggcatgactactatatctgagatgccatacccagatgaaacaaatctgcataccacaaatgttgcacagtcaattgggccaacccctgtctgcttacagctgacagaagaagacttggaaaccaacaagctagacccaaaagaagttgataagaacctcaaggaaagctctgatgagaatctcatggagcactctcttaaacagttcagtggcccagacccactgagcagtactagttctagcttgctttacccactcataaaacttgcagtagaagcaactggacagcaggacttcacacagactgcaaatggccaagcatgtttgattcctgatgttctgcctactcagatctatcctctccccaagcagcagaaccttcccaagagacctactagtttgcctttgaacaccaaaaattcaacaaaagagccccggctaaaatttggcagcaagcacaaatcaaacttgaaacaagtcgaaactggagttgccaagatgaatacaatcaatgcagcagaacctcatgtggtgacagtcaccatgaatggtgtggcaggtagaaaccacagtgttaactcccatgctgccacaacccaatatgccaatgggacagtactatctggccaaacaaccaacatagtgacacatagggcccaagaaatgttgcagaatcagtttattggtgaggacacccggctgaatattaattccagtcctgatgagcatgagcctttactgagacgagagcaacaagctggccatgatgaaggtgttctggatcgtcttgtggacaggagggaacggccactagaaggtggccgaactaattccaataacaacaacagcaatccatgttcagaacaagatgttcttgcacagggtgttccaagcacagcagcagatcctgggccatcaaagcccagaagagcacagaggcctaattctctggatctttcagccacaaatgtcctggatggcagcagtatacagagtaagtggagggatcatataatctctcctgtgtgtcttttggggccatttaaataactatttagaatcaactaatagatatatttcaactagtgattatttacctttaccacttttgtaaatgatccatttgaggcggggcacagtggctcacacctgtaatcctagcactttgggaggccaagggaggtggatcacctgaggtcaggagttcaagaccaacctggccaacatggcgaaaccccatctctactaaaaaataaaaaaaattaggccaggcgcggtggctcacgcctgtaatcccagcactttgggaggccaaggcgggcagattacttgagatcaggagttcaagaccagcctggccaacatggtgaaaccccatctctaaaaaatacaaaaattagccaggcgtggtggcgtgcacctgtaatcccagccgagatcacgacacttcactctagcctgggcaaaaaagtgaaactccatctcaataatgaaataaaataaaccatttgggccaggcgtggtggctcatgcctataattccagcactttgtgaggccagggcaggtggatcacctgaggtcaggagttcgagaccagcctgaccaacatggtgaaaccccgtctctactaaaaatgcaaaaatggccaggcacagtggctcatgcctataacccagcactttgggaggctgaggcaggtggatcacgaggtcaagagttcaagatcagcctggccaaggtggtgaaacccctgtgtctactaaaaatacaaaaaattagccgcgtgtggtggtgggcacctgtaatcccagctactcggaaggctgaggcagagaattgcttgaacccaggaggcggaggttgcaatgagccgagactatgccactgcactccagcctgggtgacagaatgaaactctgtctcaaacacacacacacacacacacacacacacacacacacacacacacacacacaaattagctgggtgtggtggtgcccacctgtaatcccagctacttgggaagctgaggcaggagaatcgccttaacccaggaggcggaggttgcagtgagctgagattgcgccattgtactccagcctgggcagcaagagcgaaactccatctcaggaaaaaaaataaataagccatttggttgggcctcaaaggtaattagactattgtaaagaaaaaagtaatatttttgtcattgataattaaaaagtcagtgtcacaatagtcagaataattacccaatttaatatgtgctttatgtggctgctgctttataatgcaactcacatacttgctatgaaaagttgaaataaagtaaatacagttcaagagctccaagtaatgttataccagtataatctttgaaacattttattgcatatattaatattgattatgtctgcatttaggttttatcaaactaaccttaataaatcttaaagatccagagaaattttgggaaaattactataaagaaactgtaggctaggcacggtggctcacgcctgtaatcccagtgctgtggaagactgaggtgggtgggtcacttgaggccaggagttcaagactagcctgggcaacatagcaaaactccatctctacaaaaaatttaaaacttagtttggtgtggtggtctgcaacctctgcctcccgggttcaagtgattctcctgcctcagcctcccgagtagctgggattacagacatgtgccaccatgccctgctaattattgtattttagtaaaggaggggtttcgccatgttggccaggctggtctcgaacactggacttcaggtgatccacccacctcagtgtcccacagtgctggcattacaggcgtgaaccactgcgcccagcctatttctcttttagactaaggcatttatgaaaaaaagttatgttttattgtcaagggctacaaaatgggcttgaaggaaggatacaggtctcaaaacacaatcaggaaaatttagccccttgcttgagtggcttgtattacagatcagttgacagacctttattgcagggctctgagtcagtaagacatcgtgtcagataggccaggcatggtggcttacgcctgtaatcccagcactttgggaggctgaggcgggcggatcacctgaggtcgggagttcgagaccaacctgaccaacatggagaaacccggtctctactaaaaatacaaaagtagccagacgtggtggcacatgcctgtaatcccagatacttgggaggctgaggcaggtgacttgcttgaacctgggaggcagaggttgcggtgagccgagatcatgtcattgcactccagcctggcaacaagaatgaaactccatctcaaaaaaaaaaaaaaaaaaatcttgtcagatataggaagaggaaattattagaatgtttgtactctaatatttctgttattcttctgaaaaatattgtatgccaggtgcctttaaaatttgatccaggctgggcatggtggctcacacctgtaatcccagcacttagggaggctgagtcgggcacattgcctgagctcaggagtttgagaccaccctcggcaagatggtgaaaccccccgtctctactaaaatacaaaaaattagctggtcatggtggcatgcgcctgtagtcccggctacttgagaggctgaggcgtgagaatcacttgagcccgggaaacagaggttgcagtgagtcaagatcatgccactgcactccagcctgggctacagagtgagactccatcccccaaaaaaaaaaaaaaaatttgatccaccttgagcattaaatacaattaaatacaataattaagtacattttaccaagttaagatcgctaccaaaaccagaagatttgagaatacagctgagaagtttaaatgttctcctgtgttttgtgtgtgtgtgttttcccttgccttataaaataagtcaatcagttattaaaacatttgggttaaagagtctcaaaaataagttggttaagcttttcctggaaaaacattgtctggcattatgaatttcaagaaatgttcattagcaccctcctgagacattggtttgaccttttcttgagttacatcccttacccgttatttcttaagtttgttaaatagctcatttttctgcacttttattttcagtaggtgagtcaacacaagatggcaaatcaggatcaggtgaaaagatcaagaaacgtgtgaaaactccctattctcttaagcggtggcgcccctccacctgggtcatctccactgaatcgctggactgtgaagtcaacaataatggcagtaacagggcagttcattccaaatccagcactgctgtttaccttgcagaaggaggcactgctacaaccatggtgtctaaagatataggaatgaactgtctgtgaaatgttttcaagcctatggagtgaaattattttttgcatcatttaaacatgcagaagatgtttaaaaataaaaaaaaaactgctttatcctcctgtcagcaccccctcccacccctgcaacaaagacttgctttaaatagatttcagctatgcagaaaaatttagcttatgcttccatatttttaaattttgttttttaagttttgcacttttgtttagtctcgctaaagttatatttgtctgttatgaccacagagttatatgtgtgtgtatcaaaagtggtctcaaaatatttttttaagaaaaaaagcaaaaacaatgtattgctgataatcagtttggaccagtttcttaaggtcattaaaacagaagcaaattaagacaggtttgactgcagtggtgtctggtatccatgttttatttctgggcacaagctagtttttatgttgatacgttcctgaacatattatcttgttggacatcttttctcttgtgttttgtttgaatgtgcaatagtttataggccacaaataagctttcttgtaagctctcttcctaacagggcacatattcttccataatataaacacttttctgccccatctcccatacttttgaaggtcagttctatgacagtgaattttgcacaggagaagcagctacctgatttcttactttctctctccttatcatggagaatacagaaacattgtctgaaagggctctaaagaaggaactaccaaaacctgacttgaaatgccatttcttttaaccttccaaatcctaaatgtttccttcaaggcatcttaataaacttatttgcttctggttttgggagttcataagagagaatagaacaaaatacaggacatcaaatattagccatttcccattttattttatttttctatgtaggttcatgttccatgttcatttatttaagaaatacatttttattggtaagcttatagagctacacttatggaatttttaagtaggtaaataaatggttaagacaaaatagtgttatagccttcattctctgaataggccatctttgactcataaaattacccttactgtttattataacttcagaagtaatttatagttctgaacctatagtatcttttaccctgttcccaagcaaagactggtgactttatctgaaaatgattcctcttcccatgacctaaaacactgtgaggaaaaatcattcaagtggcatgccaagtccctatgaaggaagggctgctatcaaacctaccttttttgagcaaactgagactaaacttctctcttttcaaaattgtgttatcttccttaatcctattttcataatttttccttttgccagtttttcacattatctttgatatgtgagcaacatttattatttacattagagtataccttttagtaataaaatgacttgaaatcatattatttttaaaagccctttgcttctttcattacttataatctcctctaaaacaacctctgcatgttttttttaaataaagcactttctgtcaaataatggacttttttctaaacagaaattattttctattaatttgcaaactgatgatttcacttttttttacttttttttcgattatcagagtacttagtaaatgttatatagtttagttctaagatagttccagggattaaaaggttaagaggaaaacacaaatcaccaaatttctgatttatgtttttatctcctgaacaatattttctcactcatattcctctatcttatcacttagctaaagacagcctaaatttcccaattttctgtccaaaatatttgtgatttacttgtatataagccttctcatttgccatgtgctgtgatcttacaagttagatgttactatacctaccatttattcagctggattgctgaacacagttctggattcatagaattaagaatatcttgttagtgcccaggatttccacgttttgtgttttattggcccttttctttattcagccccttaatctattttcagtcttctggcacgtaatttttttcacagttattattcttctattaacaaattatttttatctttcctagtacattttcacttagttctcttgcccttaaatatctttcacatgcattttaggatattcttttcaaatatttgtaggacaactttgaatcaaaataaattatgttccttctccaatttgaagcattgaggataaatgaccatttgaggtctaactgatcttttcctgccagaagagttatcttacgttctgctatatttgtatttgggccagttgattgtaggttgtccaacattttttaatattgggaaaattatgataaaatgctttaaaaattaatatgccagattaaaataactgaatagtttactatttcattcaagcatgtttaaaacaaataatttcctttcaccagtttttcttagtaaactcctgaaaaagtaggaaaggtggaaagtatatatcatttttataaattttaaattgtacatcagacttttaaaatctgtaatatacaagcaagcaaaattattttaaatgacttaattgtatgctaatactcatctgataataaatgcttcttaaagttgacatttaactgctatcacaaagttttatatgtagaaaagtggggtccttttgaataaaagatcattcaactaaaaatattaaaatttatttcactggatggtaatgtaaccttaaaagcatcataataggtaaagtctaatattagttcccttaacaaaatcctaactgtataccagaattaggtcactgaaagaacttgatttgaattacgtttagacaaaaatgatttaattgtaaattcttaaaactttctaaatgcataattggcaaaaaaaaaaacccactgttaccagtgtaggaagttacaagaaggcacatactgaatgctgaagtatacatatgctatttctcttaaacctcagagcaaccatatgagcattgtaattaatattcccattttacagatgaggaaactgaagctaagagaagctaagtaatatgcccaaggtccacatctagtaacagacaaagctgggatttcagtctatgtctgcctctctccacatctctttcatccataccacactgcctacatgccatatgacaggatgtgtaatgggctaacgtttatttaaaaagttcaggccaggtgcagtggcttatgcctataatccccgcactttgggaggccgagccgggtggatcatgaggtcagacgttcaacaccagcctggccaagatggtgaaaccccgtctctattaaaaatattttttaaaaattaactgagcgtggtggtgggcgcctgtagtcccagctactcaggaggctaaggcaggagaatctcttgaacccgagaggtggaggttgcagtgagctgagatcgcgccactgcactgcagcctaggcgacagagcaagactgcctcaaaaaaaaaacataaaaattcagtcactatactctggcacaattttcatttgtatatgagccaaaccacataccttaatgatttgggaagttaggcaaatatgagatatgtagacatatctatgctgattgttgcttgagaaataattactaattctagacaaaactcaatcctgtatcttccatcatgaatcttaaaatcatttcacttcactcctaacatttcttacattgcagaactaatggtaaagtaaattttacggaaaaagttaagatagctttgggaacagagacctttccctaaattgattccatagcagatttgggggaattaacaaagaatttcagtctcatcaatcctttgaatccatcttcaaaacttctgcttttaataactttagaaaatttactaatctatagaactaattgagtaggatataggaaggatacaaggatataatgtcctttttataaaagtttagtatagcttctttacatgtatccacttgttccagaaaatgtgcattggttctgaatgtgaaaatatttaaagagagaaaggaacactcaagtaagtgtgggcttcagtgggaattatcacaaaacattggcaagtatttttatttaaattattttcaaatttgacttctacagccaagtggaattggtaggctgtagctgttacactgaaatttctagtctttgtaagtgcctcctgaaagtcatttaaaatggaaaaatatttcaatgagcttttccttttttcatatttatggacatgaatattttattggagatcattaactcctagaatttgagattatatttccatacaacattttataaagttatgttgaacttactacctgttatgtgcaggttattatgtaactattcacagattgcttcatatattgctttatcttcccatctaacttcttaaagttaaaatccggacacacatgttgattatctagaccagtcattctggaaattgtaacactcccacataaaccccaggagactttttcagaatgcaatgtttctaaatgtactgttactggcagtttactctccagcatataaggttgcattttaacttttagattatgaactgtgcaaactttacccaaaactatcttgcatgattccctcctaaatatattccttgattaagtaaatctggcaaatcactgtttgagctagttacataaaatttgttatcaagagaaggcttttctacaagtttccagattaacataaagaaaagagggaatcacagggcatttaagtgcaccttcccattactttccttaaatcacctcatagttaggctgggcgcggtggctcacgcctgtaatcccagcactttgggaggccgagacggtggatcacgaggtcaggggactgagatcatcctggctaacacgatgaaacctcatctctactaaaaatacaaataattagccaggcatggtggcacgcgcctgtagtcccagctactcgggaggcagagacaggagaatcgtttgcacccgggaggcggaggttgttgcagtgagccgagatcgcgccaatgcactccagcctgggctacagagtgagactccatctcaaaaaaaaacaaaaaaaatcacctcatagtttatgtctgacttactccaaacctcagttatctgatttgtagtctgtgtcaggaaagttttcttcatatctattctgtctccctcctctttgattttaaatttttttcttttacccagtaggacaaaaaagagcagttggtcatcatccccaatattcttagtcttcagtatgcttcaggcctctcaatgaacacttaagtctcaattcttcagacaaaattgcttaagctcttctcctcagtcctattttaatgactttatatttaagaatatagaattatattttcttttatattcaaattcattactccagttaagtaatagtttgatagtttgatagaatcgagagttaagatgtttctatttgaaagtggattcaaccatcagaccaccagcaaatcggcacttaatttttgtgttatctaacattttctattgtggaattttatgattttatattctcattagttataactaaaaagccatgcacacagaattgtatatcattttgccattaaaattttttaacatattgcagcaagcttagttttatgattgagccacaaccttttacatattttttgtatgaaatattaaacactaaatgcaagattaactttcaaaagcaaaccctacattaatcaggtattatctatggacatttttgtagaccacttttgaaatacttattattttgcaacatagactggactatacaactttcatttaacttttaggtgactgatttaagttgagtgtgcatatagagaaaaacctagaaatttatctcatggcagatacatttgaaagtacttcagaagaatttatgctgtatattaaaactaggctcaaaataaatctatcgtatctttaaaagtccaattctgttattactgtgatgtttgtagtgttactattaaacattgtgaacatacacatttttaaaacaacttgaaacccattttaaaatctgggtaagagagaaggaatcttcagaacaaaatcacatcattagggtgtccagtttatgattgaatttttaagcaaattactgtatttgaaactacaacttgatttggttttcagttttaaaaggcaacatgtgggttttatccattttatttatacctttagatttcagaaacatcttcatgttttagatgcattctacagacatcatgttacttaaaaactcagggcccctttcatccctttgtacactgaaaaagttcaattgttagcaagtaagcaattagatccagttgaatatttaaagtgtttgttgcacagttcatttaatgtttcatcttatttgactttttcacatagatataatatcagatttcattaattataaaaagttgcccagttctgtaattactgaacagagggaatgactcaactaattggctacatgttgcaacaaatttaggcctttagagttgaagcactgacttaaaacgacttacatttctgttctttggtcaaatgaccatacatgatatgggacaaattgtttcattttgtttgttttttaataagggaacttggtaaagtagttcctgtcagataggattttctcaagagacaatttaacgttataaagccttctaaaagtgaactaaatattttataactttagtaatagcttggatggttttgagaaaataacctgtatttatcacattgtcaaacagaatttttctttgaatcagacaagttcaagctctaaattgatgtgctatatacttaaaatcctaggaagttatctgtaaccagtctcttgtctcaggctcttcaccttgttaccaatcctcgtaagtatgtaaaggaaacatatttttaaagaagcttaacagtaagaaaaaattactaaaagatgcaattcaaagataggtcccagtttaacactgaattgcttgacttctgtggcttttctttttctggccacatttatttatttaagcaatttttgtatgccttgttatttcatttccatagagattatattgtatcagtgtttatgtaagctggaatcatcctcagttttttgctgataatttttcaaataaagatacatggataattgtaaaatacactaactcttagggtgttgtagtagctgaaacatggagatgcgtagctgtcatgctttttctgaatggacaggagaaacataagctacggagtattcacttctgaggatgcttttccggaaaaagaaaggctagaaaatactcgcacttcctcagaaccctctttcttgttaacgggtatcttttgttggtgtgttttgctcttacattacagatagactatcatatatgactttatgaataatttcagttattttgcttttgtataagctgtctgaagccttgctatgctgtataagttgtgtttgatggatcagtgtgagtataaaataaagcaaatcacttttcttttgtattatctatggatgccactatgaaagctgacattaagccactaaagagttttctatgaataagtgtaagtaaatgctttgatatatataaacctaaataaaaagattgtattgatacagagacattggagaaggagattttaaggcagttctttaggtttaaaaaggcttgctgtaaaatggtgcgttattccgtttattaaagatcatattaatgacaata

SEQ ID NO: 214 - DNA, 356942 bp, Homo sapiens
tccttgacttgatcacatttattcaatatggttggaaattagcaagaatcagaagaagcacatatcaatcaaatacagccacaaaaacatcctggagataaataaagctgcactatgagaaatactcactactgaaggaaccagtactctcttacatttactacctcttagcaacaaacaactcaaatgtaaatttaatttactcacaatatagaacccttgactttttaaagaaaaatatagattcaaatcaatcagaatttgcctcgctaggccttttcgttacgtatgtttttgaggcctagttcgacgactgttacgaaaatgacaaaaacaaactcgaaagaatgtttccacaaagttcaacaaaacagtgcagaaataagttacttacccatgcacagaataaggcaaaggctaatttcattcgggttaggaatagtaaatttaactagtttcttttccacaaaacgaacatttcagacttctttttaagtaacgggtatactctattatacatcatatgctacgttacgtggttttcctaactctactcagaaagccggcactcaaacgtcaaacagaaacttctccttgattagacttattctgtaacaaccacagaaattaatctgggtctcgtgatagtgtctacagtgaaaagagcacacactagtagaagcacacagtttagagagctgaaggtacattaaaacatcgtctataggtttcacaaattttgtttttaaaatattttttccaaactaaaagctgcagaaaattagttcttaaatattctactgaaaactcttgagcagctagcattttaaatttcttaagctttttattttcttaaaaatatttaaatgagtgtagtatctcatctttttgaaaaataatccaaaaaaagattacaaatctttagttttaatcagtgtgaccaagggtttgtcatcaggactgtaatcttcataggcgatggggctcacatcatacattgcaggccgggatttctttccaaacctgaaatcagagagaaaggactctggttagataaatactagatctcaagtttaattaaagcaagtgatgagaataatttatatgcatgaattaaatgaaactgtaaaaacatattctatagcaagcatagaaactttagacatcctaatattaacactgaatgtgtataaacattagtctttggtgttcgaggcaaaaaaacatatttcacaaaatgtagagctcaaagttggagcttgcaggttaaatcttggcaaagcagtcaagcatgacagctccacaatagattttaagaaaatgtgtattgatttgtctttttcttctgaggcccataaatatttggagaggtgagtttattttatatctactccagtgcctggaatatagaacaccagggcagtcttccccgggccatggacagacagcctttcctgtgggattttcaggggataagctgtgaaggtttaaggtcatctgagatcccaacacaaaagggcagaggtgggaaatgacttcagatacagaggtgtctgtccacaaactatgccagaactcaccattgaatcccacccacctatcacctcccaaccttatggacacagaagccaatgttttcctcagagcacaaagccattgtcccaacagatttgtatgtatcaaaattgcctcgacagcaggactgcctctcagaagccaagggagtcaaaatccaatttcaggacttcctgtcaaacctgtcgtaaggtggcaattattaaaataaagccaattcaacttctgggtggtctcttcccattcaagacctcaccttccctacaagccctggagtgcaacaggattcaaacgatcttccacactaacccatcctccctcctcctttgtctggacaacattttttaattgtttcaattccaccagggctctttaaaaagacattttaaaagaaccttaaattttacaaggttcctaggatggggtccctaggaattaaaggggcttatttgccatggctcctgtcccaactctcctcttttcctattttttcctttgatatgttgaaagtctgtcttctcatgtatggagatgggaagtagaatcaagcgggaaatgagaaaacagtgcgttcttcatgtgatctttcattttaaacagtcatcaatcttgtattccaatcctctcaaattttactggccttgaagagcacaaaggcatatgctatgccagacaggcaccaggcaaaacacggggttaaagagttaaagcattctaccctcagaaaaacccacagctattactgcaatatgacaaaagacttcaataaatactttctaaaatgtgaagcctcactgaaggtccaccattgtgctcacatagatgtgggtcaggctctagcctgcagtttgttcacctaaattgagtgaggcctgcataatctaaggataggaaaagtgtcaacagagtaaaagtgtcaacaggcctgttgggtcttacactttctcccaagtctgacaatttcctaggctgctttaagatgcaaacattttgacaatttatttctcataaaatacctagatacaccaccactaataataatttaaccaaaaatatccagcaacccagtgaagagctctccatatctaacatagtaggatatagagagctttgacttgagggccaacaaattatattaactaactaattattcgattggttggctgaaaggaaaaacccaattgtatatatctttaaaacatccttttttttattttttatttttgagacagagtctcgcactgttgcccaggctggagtgcagtggcgtggtctcggctcacgcggcaagctccacctcctatgttcgtgccattctcctgcctcagcttcccgagtagctgggactacaggcgcccgccaccacgcccagctaattttttgtatttttagtagagacggggtttcactgtgttagccaggatggtctcaatctcctgacctcgtgatccacccgcctcggcctcccaaagtgctgagattacaggcgtgagccacagatccactgagtatgacaaggcaagggctgatgcctctcaagagtgagccacatggccacctatgcatgttcaaggtcaactgaagagcaaggagcaccactctgtgtccacactggttaactgagctgtgtggcccggtcctaatgggattaactccaaacaagtatgggtcataaagtataatgctagttacgaaggtggttaaaataagactaatagccccagcaccagaagagagagcaggcaggcttggagctggaatccctgcatttcaacttactagctgctgagaactttgtccaaattccttaggagaattttggaggtttccacctgaaatgctgtatctaccatatggaagctaaaatgacgtcgtttatagaaacaccacagttttaaaacacacagtacaatgaaaagactttgtttgaatctcctacacctctcacagtagcaggcttacacttgttggtaaacgaatgtgcattcatgtctacatttaaaagactaacagtgtttttttttttaatatctcaggcactaaatcaatgtcagaggctgtttattttattgcaggcattttcatgcaagtgttcattttaaaaataactactactttttatcataaaggtacattttaaatgtaaaaaaaaaccaaaataaaattggaagctagagaaaattataaaatagactaggggttagcaaactatagtccacaggccaattccagcctgatgcctgtttttcaaataaagtcttagttgaacatagtcaagcctattcacacttcctctggctgcttttgcacaacaaaggctgagttgagtagtcaggacaatatggcctgcaaagtctaaaacattttacaggtccctgatgaagaccacaagaatcgcccttagtgctgctctccaaaggacgtgtcaatgttttgtgcattattcttcagtctgcccatccctcaatcccacatcccttccattcattttacaaatatgtatgaagcccctctgaaagtattatatataataattatattacatattttaacaaaattgagaaaatactctgaatactgtattgagactgacttttttcaatcgatagtctgtgtaatgttttactcagcattcttgttaagtaaaaaaaaaaaattcctacaagttaaaacattaataagaaaatgtttcttctgtgctgggtggggcgggctgggtggaacacttagtgttcatagtaacatgttcccacctgaagtagctcatggcccacgacatgaccacagaccatgacacttgggaaatgtctgctgatggtccatgaggaagccagatctttaaaagatgggaaggagttgacacactccccctcctcctgaaaaaatagctcaaataccctaatgtggtggctccatctgcggctccttcctagcccctcgaggggtgatgcatccattgtccttggtgctcactcaacatcacattccattgtcttgttttcactgattgatcatctcatctcatcatcataacaacctcgtgaagtgagtacatctcatttatcctgtattacagatgaggaaacagacacttaggaataattttcctaaggtcacacctggtgggaggtggagctttctggcttccaagcctagatgctgaacacttcgttgcaaccttcatgcatgtgacgaccccataaactgaagctctcacttaacctgtgcctgacaagaggctatgtacttctgcattgaaaggcatcaccttcaaatcagcacatcctccttctcattaacaaactctggcttacaaatctcacttacaagtcctggttttctcacaaactctgtgacccttgtgtaaattgtattatctcactaagcccaaatttcttttgcctataatgggggactaatgatacatggtcccctacattcttgtgagatgcttgccaatgagttatttgtgaatgatttagcacagtgtctggcccacgggaagctttcagtaagtgttggccatcacagaggcactaacagaaatgacagcaccagtaatatcagttagcacggacatctcaaacatcctatttggtgacaagtcttgtgtgtctatttcttcaaagaaacaaaagatactgtaaccagttataaggcaggtcaaagagccgctagttcatggtcctctgaaagtcaaccactaaaacaatgccgcagaaagaatgtcagatcttgagaaaggccaaaattggaaggttttgagctattggggaaaaaaactgaacatgtcctccattgtctttttcccgtgatcaggcacttctagctcgtagagcagtcaactgagtgggacctcagtgtcagaacttggagaaccctggctttgctcctgctggtcagttacaagctcttccctgcctgagtacaagcaaagcaagcatgttgcagatgactcctgggatgaggaagagagggaggggtctccttctcaaccctactaggagttacaaccaacagactctgacatcagaatcacccgacacagcctcagtcactcgtgtgacccactccatgtgccctgtgtggctgctgggctgcagtcattctgatccaatgtcacctccaggatagtagcagtgagacagcccataaaatggacactggctgctgaaaactatggagaggataacatcaaaaggtctaagtttttgccaatgcctttctagggtttccaggaaaagagggccaatcagcctgagacccagccatggcctctacacagccatgctgtagaaaccccaggttggagctgaataaacgttcagaagagaagttttcctaaagggaaagtattgttttaatgtcaatagttttatctgcagtcactggtgcatgcaggagcttgcccgttaggaattccgcagtaaatatttttgatataaatcagcaccaaataagagccaggtttgtaaatgctttcaagtttattctttccttccaagagtattcagttaaatatcttccccatgggccatatgagcagaaggctcagcagaatctatcttaaactattttggggctgagttaaacactccaccacttgagccctgaaggatcgtagccatggatgcctgtaggggcagagggaatcctaattgtctcccaacacatgagaatacaatgccatggattctgctccctcctggtaaaaaagcccctccaggaatgatgaggacagaaaaggttcttgggcaccaaagaaacttgtcaattctctgcttttttttttttttttttttttttttttctgagacagagtctccctctgtcgcccaggctggggtgatggagtttcaccttgttagccaggatgatctctatctcttgacctcattatccgccctcctcagcctcccaaagtgctgggattacaggtgtgagccacatgcctggcctcctctgctcctttttaagttcttcatctccaatccagtaatttcaggatactgcaaatgttcctctaggctggggccacttactgagttggtgccctgggatgagtctacctctcaagccggtcaaggcaccctattccaacccctaactgagatcatccattcatttcaaacctcaaatgttaatgaggtctactacctgccaggacccactggagacatagaaataaaagctactaccctttatttacagggtagtggcataaagagtcaaataaacaattaaggtggggcttgcaagggttggtatcagggcttcctggttgttgtattgcctcagttcgctctgaaaggaaggcgctaagatgagcagccatgcagggtccaagctggaggagggttgagttctctgtcctccctcgcagttacataagcaagactgggtgcagctcccacctcagcactggtgcagatgctcagggtctcccaagttctccctcccactggctcctccccatggaagctgagttctggcttttgcttctattagaatgacaagatcactgtaagatctgagaattgggtttggggaatttcttttggagaaagcaaactcttcgaacctcttagcttctatgccattcagatagaataatttgggttttctcatgtctctctctctctttttttttttttttttttttttttaggtagagtcttgctctgtcacccaggctggagtgcagtggtgtcatctcagctcactgcaacctccacctcgtgggttcaagtgattctcctgcctcagcctccagagtagctgggattacagtgcttatctttgtcgttgctgttatgatacatttaggtagatataagaaaacattcatgatatttcacttttacttcttatcattcccactgtaaccagaatctgaagctacactttcccaatatgtacctagtaaaagctaagtagaaattcaaaagaaacacagaacccattgatgaaggataaaaatctcagtgaagaagggcagacgtgtcccaaaggagcacagctgtgaaggtgactgcagctgactcttaggctgcctgatttggaactttggaaatgaggaggagtcacagagacagtacccaggaaggatgctcaacctctacgggcctgcccaggtcagataataaaaagtccttgatggaaacaagacggagatgaaaaggacagaaaagagaaaggatgtggatatgtgctgttgagatagaaaacccagggatttttgtttttgttttgagacagagtctctatctgtcgaccaggttggagtgcagtggtgccatctcagcttactgcaacctccgattcccaggttcaagcgattctccttcctcaccctccagagtagctaggattacaggcacccgccaccatgcctggctaatttttgtattttagtagagacagggtttcaccaagttggccaggctggtgtagaactcctgacctcaagtgatccacctgccttggcctcccaatgtgctgggattgcaggcgtgaggcagcacacccagccaggtcttctcatgtcttgaccgataccaacataggacatcccaagatagatcatatagcacccatttcccttgagccccaatcttaaggcaccaagctcagcccacttttcactacagcacacttactttctgaattgtgtgcttgagattattcaattaacaaaagaagagatggcttacttcaacaaacaatattgctatttttggaacacatactctgcaaaagtcagtaaaatgttatcttagttgattgtttaatgttatataatagatttggagaagtaaatatggggttttctgttcataccatctttaatatttgtaatggatgctgggcttaatacctaggtgatgggttgatctgtgcagcaagtcaccatggcacaagtttacttatgtaaccaacctgctcatcctgcacatgtatcccagaacttaaaacaaaagttgaaggaaaaagtatatatatttgtaatttaatatgactgtcatgactctccaaggagggagagttatccctttatacagttgagggagctatatttgtggaaagttaaaagatccgtctaaactaccgagtcaggtaacggagtcattaagactcaaagctatacctcaccagaacttacactctttctatgacaccacactaactccttgtccctctggagtccttcttccagaaaaggatactgatttataaatattcactctaaaagtagaaagatagctctttatccttcttttgctaggcccttacgtcaaatgaaatcatttatatgttgactgtttgaagagcaacagggcaaaagacattccccaaaaaaattcaacaaaaaaagttttcaatatacagcgattacgaatcagatatttatagtcacagagcaacccaaattagatgaacaaatatattcaatgtaaacaaaacaaagcaaaaggaaaagctagcagcaaattaaaaggagtttgcttatcaagtggtcgaatgatctatccccaaatacaatgtggaacctattttccattctttaaaatctcctctttgcaaatggaaagtcctgtgtataatatgaccctgttcccaagaatgcacatgtgaaggcagcattccccacgccgcccccacagccaacctggcatgccggatggatgcaatggcattgctgaactcgctgtcgatgctgcggcagttgtagaactcctcataggctggcctggaagaaccctggtattcaatgcggctgatgcggcaaatccccacgatcaggatgatcagcataaggatgaaggccacgcagagggctccaatgatgatgtagagggagtgccgtggcatgttggtgaggctctccgccatgtgcccggacttccattggaggtctgcaggcaaaaataagcaaatggctgggtatgagttgtcacctttgagaatgagaaggcctttttcatctttgcatagataacttaaaacctaagggccattcaaacttggaaggcttattttctacggattatccagacccagggttaatatccttactacataaggacttcttaagaataactaagaaaaactacaggccgggcacagtggctgacggctgtaatcccagcactttgggaggctgaggcaggtggatcacttgaggtcaggagtttgagaccagcctggccaacatggtaaaacctcatctctactaaaaatacaaacattagctgggcgtggtggtggatgtctgtaatcccagctactcgggaggctgaggcagtagaatcacttgaactcgggaggcggaggttgcagtgagccaagattgcaccactgcactccagcctgggcaacagagtgagactccatcaaacaaaaaaagaaaaaccagaaatatgccacagaaaaacaaaggatataaggaggaattcatcaaaaaaatacaaatagaaaattacttggcttcagaattacaaaaaagtacaattcctctatcagctcccaaatattactttaaaattataaccacagttggaagggtacccagaaataaggactacaagttgatacataaccgtttcatttactaattagcatatgctctgacccagatattcccattttaggatttatgctggggaagtagctcaggaaatgcataaagccttatgtgtgaagatgcttatcttcatatcacaatttttcaatgttatcacctattccatatttagaaaaaggctcagaaaatcacacagacaaccatgtactcactgctcagttaataatgttaatattttaccatttttctttagattttttttcagatagttttttaaaaagaaataaaatatggctgggcatggtggctcatgcttgtaatcccagcactttgggaggccaaggcaggcagattgttttgagcttaggagtttgagaccagcctgagcagtatggcaaaaccgtttctctacaaaaaatacaaaaattagccaggcatagtggcacatgcctgtggtcctggctactcaggaagctgaggctagagaatcacttgaacctgggagatggaggttgcagtgagccaagatcacaccaacacactccagtctgggcaacagagtgagaccctgtctcaaaagaagaaaaaacacacacacacaaatatagctagacttccctcaccccatactctctctccattccaccagcaacagcataatttattaaagtcaaaaaataaaaatctaaatatttaacactcagtgagatgaaaagatatccactaaacaacaaaagaataaaagcatgttaccaaacaggatctacttggacagtacaataatttcacaatatcttatgagtttaaaatgtctatatacacattgaaaaggtcaaaaggatagtatgataatgatggcaaacatatattgatttcttattataaactaagctctttaaaaacagctcatttaatcattataaccaccagaagatacattattctctctccccactttacaaaggaggcctagagaactgacatcacttggagtgaatgcctctgatacaagtcagaatctgaggtcttggcctttgcacagcaacatactaacaacagtgatctctaaaagacaggattaaaaatgattattttcctctgtatatgtctgagtcttttccagatttttaaaaataagaatgtattccttttccaataaagaaatatgcaatacattatttaaagaagacatttgtaggatcatcttccagcataagagtggaaatagtatcagccttgggatcacaccaaccttgctttcaatccagctcctacatttacttgatctccttgagcttcggtttctttgtttgtaaaatggaaataacaacatataccccattggcttgctgcagcatgagttaggaaacatgtttttaaaacatttaaaactttttaactttctaaaaagttaaactttctaaaaagttaaaaaaaggttttaacttcctaaaaagtttaaaaaaaaagttttaactttctaaaaagttaaaaaaaagttttaactttctaaaaagttaaaaaaaagttttaactttctaaaaagttaaaaaaaagttttaactttctaaaaagttaaaaaaaagttttaactttctaaaaagttaaaaaaaagttttaactttctaaaaagttaaacaaaaagtttcaactttctaaaaagtcaaaaaaaaagtttcaactttctaaaaagttaaaaaaaaaaagtttcaactttctaaaaaagttaaagagtccactcctggacatgtggtggtggtccctaaagaggaccagctgtggtggtggaggagggaaggataaagggtcacatgctgttccctaaggcacatgctctgagctgaggattactgagcatggccctgtgtccttcctaaaagcaccaacctgtattagcaggaaaaactggaaggacacaatgtaatctctgtgattggcgtaggtcaagaacatcaagttacttcctgtttatagatctgcacccaaatgaaactatctagatagcgtatacaagatttgaaaagaaattgtggaaattttaaagagctaggtaagaccaaacagaagctgaactcatatggaaaaaaggatgctttctctactttactcacaccaccaccaccaccattccacacttccccacccacaccaggacatcattttcatggtagaattccaagtgcctgcaaatgagattcagaggttagtggaaatggaaatgagcctgtctttccatgaaatccacaggactcttctcactgtccattatcgttgagagtatttgtggcctctggatactcacaccttcatcttagctgtatcttcagtcatcatagatctaagaatcacaattagctattccttaccttgaaaagctgcagtcagtctgaagaagagcacagatagacacccaaacagggggccaggcctgcagacccactttctagaagctaacagaaaaatgacccacgtgcccatcctggatgcttcctgagaatctgagaacagatgaataatgtgatttctgagtttgcatccagaccctcctgaatatttcaccaaaacctttgaagcctggtttgtcatttgagtctgcctgcctgagctcataaggcccacggagcttagtaaaactaaatgaccattactgcattgactgcttcatttaagccaactcacatacaggcagactgagtaacataaatcaccagaaacagtcacgatggaagggagaaggtgtttggggaaagcagaaccaaggctcaatccccaaatctgcagccatctcatttggcaatacctggtgtgcactgagagagacaactcatttttctggctgaaaaagcaagcgtgattcacttcatttccaagtattataacattctctaaaaaattcagttgcaggcaggagtccaacactcagcagagtatgttataacatccatttagcatcaacacaagggcagccagtactatgtttctcctccaactcggtagagtgctcagatctgatcactatggaagatcacatgagttcttgatgagttcttgcagtctacgcataagcttcatagcattaacctacacatcacatcaattgtgtatacacagtgagtgcacaaccacatggccactaaagtgaaaaaaacaaccatactgggctatgtgctcagtgcagtgtcccaggtctgactgcttgcatttatgaccatctgctccgtttcccaaaactctgtattccaagctgttcggacttttggaaaaactttctcaagatttctcctaaaagctctgctttcctctctccccctgcccttttctttaaagctagattccacctcactgtcatctaaaacttttttgatacaaatgactgtggctgctttacaggctaattggtttagtagctgggatggatctggctaagtccaacgctaggtctgagagacagcaaatttatctatgccaggtgcctgcaaccaccatctctcagtccagatgctatcctcataagtcattgctttgctgcatcccaggagtctcatcacatgaattgttgactatgtttgctacagcatggcactgggaagaattgtgaaccagaatatgccagatgggttcatctcatcagccccagcaggtgcatgaccaggaatgcatgtgcacgagctgctcaagaaaaatgtcacgcttgtgagtctgacagatcattttcatgtttttaaactagatttgtttgaggtgttgtattttccaaagtgcttttgcattaagcatttcagttggccctaaacaaacaccttgagctaggcagaggtgctaaacttggagcagttgctcaaggtgaggcagacagtcagtggccaagctgagaataaaatcagacccacctccactctgccaaaaagagactccagtcaatttacatattgcatctaaaatacatagcccatatctattttttaatttacctagatgaatgtagctacactagttaatttgcttacctatgttatttttaaaaagagcaagttatttttaaaaagagcaagttaaaaatacctatgttatttttaaaaagactgtttcttaagaagatgttacttagcttaagaatttttaagactacttgttgcctagaacaattgtgaggagggatgtcaaattactttgttttctatagttaaaggttagcaggacaatcaaagcagtcagtgagattgaaaaagattaacaactcttgttaatctctggaagaggaatgaatgcgaaaagggaatgaaagagatcgtctcctttatggggatccattcactgagcacattaattaaggacctactatgtgccaggcacagtgctgagtgacagggatggaaagcaagggaaaatagagagaaaagtaggctcatgtagtccccagttttctgagggatgcagggatcaggcaaatgatccccaaaacaaagtaaaagtacaactgtgctatgtctacaagggacgagctcttcagtgcagcaggaggacaggagatattttacctcactgactgccaagagagcttgcacaacaggagcccttacggagttaggttatgagtgggcactaaccagggacgggcaagagcagaggggagactgcacaggcaaagaaccagagtgagcacaggcctgtgggaggggggtgagggagaagaacaagggctggaagaacagcatgactgcttgagagagaggcagagagtggctgcagcaaggagaagggatctccttgaaggatagggcagtgtggccttgggtctttagtaacttatttattttaataggagcttggcacagtcagtgttggaaacagtgggagggagggtctgagtgttccaatttgcactttgaaaagatccttctggctgtgcatgaagaaagggtttgaggagcaaggacagaggctggttcagaggctcctgtaggacggggcagggttagtggtaacttgacctatggtgatgggcatggagacagagagaggggaatggatgtgagtgctgtgttaggggggaatcaaccagactaaatgcagcttgtacagataggccaatgaggggagagaaaccaggaggccaattcctggtttcctggcttttatcgttggatggatgaggtgctgtagccgagtgagacgaccagatttgagaggaagattctgagtttggttttatacatgttaaattggaggtaccaattctggacatgggctttgggaaagaacatataactaaatcctcaaaagcaatcgcaacaaatgcaaaaattgacaagtgagacctaattaaactaaagagcacagcaaaagaaactattgacagagtaaacagacaaccgacagaagaggagaaaatattcgcaaatgatgcatccaagaaaggtctaatacccagaatctgtaagaaacttaaacaattgaacaaacaaaaaccaaataacctcattcaaaagtgggcaggagatatgcacagacacttcttaaaagaaagcatgtaagtggccaacaaacatgaaaaaatgctcaacatcactaattatcagagaaatgcaaatcaaaaccacaataagataatcacgtcccaccagtcagaatggcgatgattaaaaagtcaagaaacaacagatattggcaaggctgagggaaaaagggaacacggtgttggtggaaatgtaaattagttcagccactgtggaaagcagtttggagatttctcaaagaatttagaaccactattcaactcagcaatctcattactgggtatgtatccaaaagaaaacaaattgttctaccaaaaaagcacaggcacttgcacgttcactgcagcactattcacaatagcaaagatacagaatcaaccaaggtgcctgcccatcaaagatggattgaataaagaaaatgtggtacatatacagcatggaataccatgcagccataaaaaaagagtgaaatcatgtcatttgcagcaatatggatgcagttgaaggccattatcctaagtgaattaacataggagcagaaaaacaaacaccacatgttctcacttataagtgggagctggccaggcacggtggctcacacctgtaatcccagcagtttgggagaccgaagtgggtggatagctttgatcttaggagttccagaccagcctggccaacatggaaaaactccatctctactaaaaatacaaaaaaagtagccaggtgtcatggtacatttctgtaatcccagctacttggaagcctgaggcacaagaatggcttgagcctgggaagcgaagggtgcagtgagctgagatcgcaccagtgaactccagcctgggtgagaccctgtcttaaaaaagaaaaaaaaataggagctgaacatcaggtacttgtggatatagaggccacaacaatagacattagggactactagggagtaaggaaaggaaggggggaaatggttaaaaaactaatggggactatagtcagtacctgggcgacaggatcattcatatcccaaacctcagcatcacacaatgtacccaggtaaaaacctgcacatgtgctccttgaatctaaaataaaagttgaataaacaaataaatgaattggaagtacctttaagacacccaagtagttatgtctaatagttaaattttgatgtttagctcatcattttggttagtaagagctgatatttattgagggttccatttgtgctggacactaagtgttaaggcgttaactcacctattcctcctacaatgctttgaggtagacactattattgccttcattttatataggaagcaactgagactctaagaggaaagctatgtgcccagggttacacacagtaagtggcagcccctgagtttaagcccaggtgccctggttctaaagccacacacttcaatcaataaggaatgttttgcaaactgtagattgtagaaatcaatgtaatggggccagactcacatttaaaaaaaaaaatttagagaactatttcagagtttgtacacttataaaaagttaagtattattttatgttgtgtgtgtttgtgtgtatattaggctgtgtgttacatgcagcgtcaagatgtaaaacatactacttactgtgggttgcactcaaaaggcatgaaaagcatttccctatgctgtacacatccatcagagctcttcagagaggcaatggaatgttcctcctcatgagattttttggaataaaaaagtcaagatcgaatcacatcaataacaactacctatctgtataatgcctgtggtcctataatattctgtacttgcagcaaattggttattaacccaaaagtatctagtttacccaggttccatcagagatgggaaatttcattttcagcagatgcccagagacttttagttgttcaaagagaaagacagctgatgataataattaaggtaatcatttattaagtatctactatgtaccagtcactgaacaatattggttacatttactatcccatttatcaaggcctaaggctcagagaccttgttttctggcccagggataaatacctgagttagaattcaaaacagctcaactcacagaattgagttatcaaccacaaaactccacaacagcattctttccactcaatcagtatgctttccccacatctagccacaatccctccctgagaaggagaggatgcattcctggtgttccaagtatgtactaaaggtaattatggattcagtgggatttgcaagttacccttggaccccaccaccattgcttccaaggggaaaagttctaaaaggcaaaaagccaacttataatgaaatgctcatgaaaagttaaaagataatcaccaaccaaaatcaaaatattaaatgcaaaaaccctttgacaattttatctttgagaatttctactattgatattcttacataagcacaaagatgctgctatgatctgaatgtatgtgactcccaagcttaaatgttgcagcctaatccatacagttaggctttgtgtccccacccaaatctcatcttgaattgtaatccccataatcctcataatccccacatgtcaagggagagacaggtggaagtaactgaatcatgggggcgggtcccccatgctgttctcatgaaagtgagttctcacaagatctgatggttttataaggggttcttccctattcactcaacatttctccttcctgccaccttgtgaagaaggtgacttgcttccccttcgccttttgccgtgcttgtaagtttcctgagaccttcccagccatgctgaaatgtgagtcaattaaacctctttcctttataaattaccctgtatcaggcagttctttataacagtatgaaaacaaactaataaactaatcaacgaagcgatggtattaagagatgtagtctttgggaagtgattaagtcatgagggctctgccttcatgaactaggttaatgtccttataaaagaggcccaagagagccaccttgcccttccactatgtgaagacactgccagaaggccctatctatgaggaatgagccctcgtcagacactggatctgccagtgccttgctctcagacttctcagcctccagaactgtgagcaattacttactgtaaggtattttgttatagtatcccaagcaaactaagacaggtgcatatatagaatattcattctagtattgctttaaatagcaaaacccctcaaatgtattatctatcaatgggggtctgattaaataaattttggagatgctaaagaatggaaataccatgtgacattttaaaaagtgtcgtagatctgcataaggtagtgtgggtgcaccttcaggatatactgttacaataaaagcaatatgttgaagagtgtgtataaaactctcatttgtacaggagaaaataggaacttatctattgactgatgcatctagaagaatatgcaataaatgtctaacagtagttacctttaaggagtgaggtggggatctggataaggagagatattaattaattttattttttaaacatcttggtttatacaaaaatgagaaccaaagagccaacctatttgtataataagaactgcccatataatataatcatttgatacatttctttaaccattattaaattccatctattgttaaaggaagaggcccaagacatccatctatacctctggccccaggatgagttactttccctttccctggttgtctagaggtggctgtgcaaagccttacggtgactcatcatatattcaaacctgccctcagattacaagctcccaaaggcagggtatgtttcattaacctttatattccagaactacactcaatgcctgacaataaagagccactgattcctgattgaatgcataaatctaaaatagcctatttgcctatttctcaactgcaaaatatcattaattcaatagtttaactgtatttaaccatagattcaactgtttaatatacaaaactggccaactgtcagtcaatgaggttaactataactctaactttataaagcttactcaaacaaagcaaaacacaccaacactgctatgtcaagattcatagaaattttgatttttagaccttgattctaggaaggcatattttccttttattataattcagaaaaaattataatcagtcccaaggtggtaaaaatgaatggcagaaaattaaaacttcactgatgttctgttaatttccagaactgtgggttttcatttgccttaaaacatgtgtaaatcactacagctatttgatcgattctattaggatggtcctggatcaatcttcttgatagttttgataaatctgtgtggtctgttagatttctgcttcttattactgactggcggccagataattaccccaaaggggcaaataactagggtgatgcgttaacagataaaattaattctacctcatccccaaatattgtaatatttaagaacaaagagagaggaatgagataccattggtgggtggtacgaaaggcagaataagggtctcctgaagatgtcctaatgcccagaacctatcaatacattatatggcaaaaatgactttcctaatgtgattaaattgagatcttgagatggagagattattctggattatctggacaagctcaatgcaaccagaagagtcctaataagtgaaagaaggaggtaggagagttgacaattgagtgatgagaatgaaagcagaggtcaaaatgacatttctgactttgaagaaggcagaaggcaccacgagccaagaaatgtgagcagccttaaggttagaaaaggcaaggggagacaagttctcccctagagcctccagaaagaagacagccctgctggtctcttgattttagcccagtgaggcccattttgcacttttgccttccagaactgtaacgtgatagatctgtgttgttttaagccactcaatttgtggtaatttgttacagtgacaagaggaaactaatacagatggtcagggaaggcacctttgaactgagacctgaatgagaagaaggcagctgtgctaaaatctgaaagaagagagctccaggcatagggaacagcatgggtgaaggtcctgaaggcagggatgaccttgacctgctcaaggaagggaaagcaggacactgtggctactgcagaggcagcaaggaagacaggcaagcaatgtggcctctgaaggcagtgatcgagttaatggaagcctcctttacttcctcaggtgactcagcagccctccagcaccatgtagctatgtgggccatggttctctgtgtacatctgagcttttctgtttagatctactgactagactttgagatatccaggcatcctcctcttggtttctggatacttcagaggatcacagatgctcagagttagaaagagacctcagaggccgtggttcccatggctcacgcaggactagaggcctcttacagcttccctgcccaccaaatgtacgaattctgtgtgcactctggatcctcagatccattccattgattcagacccaattatctagacacgagccactggtttcagctatgtgtcatccgcaaacctcatacacacggtctcctttccatatactcaggtcatggttagaaatatccagtgctgggacctggcagagcctaatctgtaattaaatttagttttgatacctttggccctatagagaaatataaatgagatcatcaaatggaagatgatagagttgagtgaacacggcgtccaggtatgcactgagatgtgtaatgtaccctatcacacccagccactcagaatagccactgtcctgggctgtaggcagcatctaaaaagacaattgctgaaggttaatccttcctgggagtagctcatagcataagaggtatagtagtacagaaaaaataaaagaaagatcaaccagtatttatttagtgtctactgaacagcagaaatctggacatttgcctcatgtaatcctcacagcaaccagcatgggaagccttcctataatcaagtgagaaagacaaggctcccagaggtaaatttgtttttccaggttacatagttagaatatgatggagcttgaatctgaagtcgactttgatccttttgttattccatattttgcctacattatcatcaccagaagaagtaaactttagattttttacaatgataggatttcacttcaaaatttcttgatgatatcctgtgtgttcctgacttttcatctatactctcctatatatttatcttcatgaatcccattttaaagttataagtagatattactctgccctaaaggcacaaagtgtgtcaatttgtcatactaaactttagaatgaaaactgatcccattttctggaaaagtaaactgaggctcagcacaagcaaatgcagtcataacgagtgccttggccaggataagaaccaaggtcctgctgacccaagtctggaatcctttccaccagcagattccaccagactggacttaacatcctataactacagtcccttagaattttaccattgaaatccttttcagtcccttgtctctctcttcaacaagaaagtagttctcacccatctttagcaaggaaagttaattcgaagcccattctgtatgagagcaattgagaatgctaagggggaggcctataacaattacacacttcacactttggctgcatgaaccaagaagaaagacagtgagtgagcaggtaagaagctaaatcatatcctcagcctcttatcaagttgatcaaattgacgttggagaatgtggtcaagttggtcaagttgatgtcagagaatgtggtccacatttggacaagagagtttcctaataccggccaccctctacattagaaaacactgagaatgagatgaccctatccagccataggcagccagaaccaccagtgagggcctggtcttgtgacatagagaggagtggagagagcagacagatcaggccaagtgacacagacagacaggcagaagcaggcaggcaggactgtgggtactgatttgcatccttccaaattcacacagaagacaagttttctttatctgtcaaaaggtgagtgagcaggtgacagagcgcggaagggagttcttatgcaactttcccaggaaaagaagcaatctggaatagggaggaaactttcacccaaccagcatggttagctctcttcggctatgaaagatcaaattgccccagctaatttaaataagaagacaatacctttcaaagttgaatctttaacagttccaaaacaattgaaaactcgattgcagtcaggcacggtgactcacacctgtaatcccagcactttgggaggccaaggcaggtggatcatgaggtcaagagatcgagaccatcctggccaacatagtgaaaccccttctctactaaaaatacaaaaattagccaggagtggtgccacacacctgtaatcccagctactcgggaagctgaggtaggagaatcacttgaaccgaggaggcagaggttgcagtgagctgagatcataccactgcactccagcctggacacagcaagactccatctcaaaaaataaaaataaaaaaataaaataaaataaaaaaagaaaactggaggggaggctggcaaaatggccgaataggaacagctctggtgtgcagctcccagcaagatcaatgcagaaggcagctgatttctgcatttccaactgaggtagctggctcatctcattgagactggttagacagtgggtacagcccatggagggcgagcagaagcaggatggggtgtcgcctcacccgggaaacacaaggggtcaagaaactccctcccctagccaagggaagccatgagggactgtgtcgtgaggaacggtgcactccagcctagatactatacttttcccatggtcttcacaatccacagaccaggagattccctcgggtacctatgtcaccagggccctgggtttcaagcacaaaactgggcagccatctgggcagacactgagctagctgcaggagtactttttttttcctaccccagtggctcctggaacaccagtgagacaaaaccgttcactcccctggaaaggtggctgcaaccagggagccaagtggtctagctcagcagatcccacccccacggagcccagcaaactaagatccactggcttgaaattctcactaccagcacagcagtctgaagtcgacctgggacactgaagcttggtggggggaggggcgtccaccattactgaggcttgagtaggcggttttcccctcacagtgtaaacaaagccgccaggaagtttggattggacggagcccaccgcagcactgcaaagccactataaccagacagcctctctagattcctcctctctgtgcagggcatttctgaaagaaaagcagcagcctcagtaaggagcttatagataaaactcccatctccctgggacagagcacctgggggaaggggcagctgtgggtgcagcttcagcagacttaaatgttcctgcctgccggctctgaagagagcagtggatctcccagcacagcacttgagctctgttaaaggacaggctgcctcctcaagtgggtgcctcctgacagagagacacctcccagcagggatcaacagacacctcatataggagaactccggctggcatctggcaggtgaccctctgggaagaagcttccagatgaaggaacaggcagacatctttgctgttccacagcctccattggtgatacccaggcaaatggtctggagtggacctccagcaaactccagcagacccacagcagaggggtctgactgttagaaggaaaactaacaaacagaaaggaatagcatcaacatcaacaaaaaggatgtccacacagaaaccccatccaaaggtcaccaacatcaaagaccaaaggtagataaatccacgaagatgaggaaaaaccagcacaaaaaggctaaaaattccaaaaaccagaatgcctcttctcctccaaaggatcacaacttctcactagcgagggaacagaactggacagagaatgagtttgacgaattgacagaagtaggttccagaaggtgggtaataacaaactcctctgagctaaagaagcatgttctaacccaatgcaaggaagctaagaaacttgaaaaaaggttagatgaattgctaactagaataaccagtttacagaagaacataaatgacctgatggagctgaaaaatacagcaagagaattttgtgaagcatacacaagtatcaatagccaaatagatcaagcagaagaaaggatataagagactgaagaccaacttaatgaaataaagcatgaagacaagattagagaaaaaagaatgaaaaggaatgaacaacgcctccaaaaaatatgggactatgtgaaaagaccaaacctgtttgattggtgtacttgaaagtgacggggagaatggaaacaagttggaaaacactttttaggatattatccgggagaacttccccaacctagcaagacaggccaacataattcagaaaatacagagaacaccacaaagatactcctcgagaagagcaaccccaagacacataatcatcagattcaccacaattgaaatgaaggaaaaatgttaagggcagccagagagaaaggtcgggttacccacaaaaggaagcccatcagactaacggcagatctctctgcagaaaccctacaagccagaagagagtggaggccaatattcaacattctgaaacaaaagaattttcaacccagaatttcatatccagccaacctaagtttcgtaagtgaaggagaaataaaatcctttacagacaagcaaatgctaagagattttgttaccaccaggcctgccttacaagagctcctgaaggaagcactaaatatggaaaggaaaaaccagtaccagccactgcaaaaacataccaaattgtaaagacaattgacactatgaaaaaactgtatcaactaacgggcaaaataaccagctagcatcataatgacaggagcaaattcaaacataacaatactaaccttaaatgtaaatgggctaaatgcctcaattaaaagacacacagtggcaaattgcatagagtcaagacccattggtgtgctgtattcaggagacccacctcacatgcaaagacacacataggctcaaaataaagggatggaggaatatttaccaagcaaatggaaagcaaaaaaaggagggatttcaattctagtctctaataaaacagactttaaaccaacaaagatcaaaagagacaaaaaagggcattacataatggtaaagggatcaatgaaacaagaagagctaactgtcttaaatatatatgcacccaataaaggagcatccagattcataaagcaagttcttagagacctaaaaagagaattagactcccacacaataatagtgggagactttaacaccctactgtcaatattagacagatccacgagacagaagattaacaagaatattcaggacttgaactcagctctggaccaagcagacctaatagacatctacagaactctccactccaaatcagcagaatacacattcttctcagcaccacttcgcacttattctaagattgaccacataattggaagtaaaacactcctcagcacatacaaaagaatggaaatcataagaaacagtctctcagaccacagtgcaatcaaattagaactcaggattaagaaactcactcaaaactgcacaactacatggaaactgaacaacctgctcctgaatgactactgggtaaataacgaaattaatgcagaaataaataagttatttgaaatcaatgagaacaaagacacaatgtaccagaatctctgggacacagctaaagcagtgtttagagggaaatttatagcactaaatccccacaggagaaagtgggaaagatctaaaatcgataccctaacatcacaattaaaagaactagagaagcaagagcaaacaaattcaaaagctagcagaagacaagaaataactaagatcagagcagaactgaaggagagagagacaagaaaaacccttcaaaaaatcaaggaatccaggagctggttttttgaaaagatttacaaaatagatagaccactagccagactaacaaagaagaaaagagagaagaatcagatagacacaataaaaattgataaaggggatatcaccgctgatctgatagaaatacaaactactatcagagaatactataaacacctctatgcaaataaactagaaaatctagaagaaacagataaattcctggacacatacaccctcccaagactaaaccagaaacaagttgaatccctgaatagaccaataagaagttctgaaattgaggaagtaattaatagcctacaaaccaaaaaaagcccaggaccagatggattcacagccaaattttatcagaggtacaaagaggagctggtaccattccttctgaaactattccaaacaatagaaaagagggactccttcccaactcatttcatgaggccagcatcatcctgataccaaaacctggaagagacgcaacaaaaaaagaaaacttcaggccaagatccctgataaacattgatgcaaaaatcctcaataaaatactggcacaccgaatccagtagcacatcaaaaagcttatccaccactgtactccagtctgggcaacagagcgagactccatctaaaaaaaaaaaaaaaaagcttatccaccacaatcaagttggcttcatccctaggatgcaagggttcaatatatacaaatcaataaatgcaatccatcacttaaacacaaccaatgataaaaaccacgtgataatctcaatagacacagaaaaggcctctgataaagtttaacacaccttcatgctaaaaactctcaataaactaggtattgacagaacgtatctcaaaataagagctatttatgacaaacccacagccagtatcatactgaatgggcaaaagctagaagcattccttttgaaaactggcacaagacaaggatgccttctctcaccactgctattcaacatagcattggaagttctggccaggtcaatcaggcaagggaaagaaataaagggtattcaaataagaagagaggaagtaaaattgtctctgtttgcagatgacatgattgtatatttagaaagccccattgtctcagctcaaaatctccttaagctgataagcaacttcagcaaagtctcaggatacaaaatcaatgtgcaaaaatcacaagctttcctataaatcaataatagacaaacagagagccaaatcatgagtgaactctcattcacaattgcgacagagaataaaatacataagaatacaacttacaagggatgttaaggacctctcaaggagaactacaaaccactgctcaaggaaataagagaagacacaaacaaatgaaaaaaacatttcatgctcatggataggaagaatcaatatcatgaaaatggccatactgcccaaagtaatttacacgttcaatgctatccccaccgagctaccactgactttcttcacagaattggaaaaatctactttaaagttcatatagaaccaaaaaagagcctgcatagccaagacaatcctaagcaaacagaacaaagctggaggcatcatgttacctgatttcaaactatactacaaagctacagtaaccaaaacagcatggtactggcaccaaaacagatgtacagagtaatggaaaagaacagaggcctcagaaatgatgccacatatctacaaccatctgatctttgataaacctgataaaaacaagcattggtgaaaggattccctatttaataaatggtgttgggaaaactggctagccatatgcagaaaacggaaactggaccccttccttacaccttatacaaaaactaactcaagatggataaaagacttacacgtaagacctaaaactgtaaaaaccctagaagaaaacctaggcaataccattcaggacataggcatgggcaaagacttcatgactaaaacaccaaaagcaatggcaacaaaagccaaaattgacaaatgagatctaattaaactaaggagcttctggacagcaaaagaaactatcatcatagtgaacagacaacctacagaatgggagaaaatttttgcaatctatccatctggaaaagggctaatatccagaatctacaaagaacttaaaaaaatttacaagaaaaaaaaaacaaacaaccacatcaaaaagtgggcaaaaggtatgaacagatacctctcaaaagaagacattcatgcagccaacaaaaatatgaaaaaaaagctcatcatcactggtcattagtgaaatgcaaatcaaaaccacaatgagataccatctcacgtcagttagaatggcgattattaaaaagtcaggaaataacagatgctgcagaggatgtggagaaataggaatgcttttatactcttggtgggaatgtaaatttgttcaaccattgtggaagacagtgtggtgattccttaaggatctggaaccagaaataccatttgacccagcaatctcattactgggtatatacccaaaggattataaatcattctactataaagacacatgcacacgtatgtttattgcagcattgttcacaacagcaaagacttggaaccaacccaaatgcccatcaatgacagactggataaagaaaatgtggcacatatacaccatggaatactatgcagccataaaaaaggatgagttcctgtcctttgcagggacatggatgaagctggaaaccatcattctcagcaaactaacacaggaacaaaaaaccaaacaccacatgttctcactcataagtgggagctcaacaatgagaacacatggacatagggagaggaacatcacacactggggcctgtcaggtggtggggagctaggggaggcatagcattaggagaaatacgtaatgtagataacaggttgatgggtgcagaaaaccaccatggcatgtgtatacctatgtaacaaacctgcacgttctgcacatgtgtcccagaacttaaagtataatagaaagaaaaagaaagaaagaaagaaagaaagagagaaagaaagaaagaaagaaagaaagaaagaaagaaagaaagaaagaaagaaagaaagaaaagaaagaaggaaggaaggaaagaaggaaaggcaagcaagctcgattccatgttagttctcatttttcacttcaatcctagtagatatattgttttaaggtataaaatcttgattaagacatttatcaaacttctattagttcaccctaagagatcactcagctttaagcagcccaaaatgtttttcagcctttcttttaagcttgtcttcactgaacttttctcgaggcaatagaaggaacttaatacatttgaagacacttgaacacataaataaaaaggtaatttgcattctgtgtgtgtgtgtgtgtgtgtgtgtgtgttttttaattttcaacacaaagactctatttttttgatacgattctaatgcttttctgttcagcacatttttggctgcatgagtagcagtgaactctggatgacatctgaaaattctcatcctggggaaaggctggcttcagactcaggagggagtgggggcagcagaatgcagggggcaaacatgctaaactgggtattgagcaccaaaatggggcaagtgtagctccggttgtccctctgggactcactgcctcatctgccagtgactcgggggctttctggtcacagtcggcatcttcttcatgaaggaaaatgcttaagtaacagctataaatgttaaataacagtggctgagctgcagaaatacttacggatctcacagtttgctcccacccaaccatgcgggcagtggcagttataaccattgggctggtccaggcagctcccaccatggtggcaggggttactgtcacattcatttatgtcaatgtcgcactcttcacctagggagataagaaaaagcagtggtgaaaccgctgcacccatggttcctgtcatttttctggccaaaaaataaagatccaaggctaggggtcataacctttagcaatagagcccaacctgctgtttgtataaagtgcagaactctcagaaaattccagacgagggatcttttacttcagtaaaactaaaaaggaaatatatatatatatatatatatatatatatatatatatatatatatatatatatagcactggtaaaaagaatctttcctttagtgtacttaactagttaactagcttcatttagctagttaagtgaggttgattcccatgtctgaataaatctttccgggttgatcagaaaaagtgaagtcgggatcttgatattattaaagaagtctattttattttggatttcatcagctgcatctcgttatttttctgaaactccagaaagctgaaaactcacagttcgtgattattctgtagccaagtatttgagtatgtgagagtggacatttgactcttctctggatagttctaggacatagctgtgcacccagcctgaggcaatttggagaggttactccacttcccaaatccctggatgtgattctgcttgaagctgggggacctgaaatgctcaggaagagcatcaggcccacctaaggagagaacttgtgaagtctggggttagtctaaacctgacctaatctcttctgagaaatggtggtccaagggaagctgtctgtcattctcccataaggaagaatgtgatcttcagctcctgaccctggctagacccaacttttcaggacacctttgcgtgcttcagagagaacctgatagaaattacaaaccagggtccagagccaatgtcacggtgattcaaacaccaccttagaacaaagccatcttcaagtgattttaaagccatcattaagagtcattacaaaacgcatacacctcttaaatttaaaggcatctcattaaagctgaagagaagaggatatttcaaattgaggcactccctctgtcaaaagtttgaaaacgagaaaaagaaattttcaaaataagccctcctttgcttagataaatgcagaaagtgatgagaacaaaactcctagcatggctatggtcatggactaaagcatatggacaaaatcagatatttttgtccattttcaaaagcaatgtttcagtgtacactcaagtgattacttctgggctcatttaattagcattaaattgcttttctatctgctattggtttaccttacgtttataaaaccactttatgtcactcaggccattttagaggaggaatctcacactaatatattccatgtctgtttcatctcacactgtttctatacctggcatcttactattttatttttaaataaaatctgttgaacaaaacatttacaacttctagatcctactaggttgattataattcagtaatatatacgtgaatttgtttcctgcaacaaatattgtcacttacatcaatagaaaaaaacatgaaattgattgcctatttcaaaggctgtctttccattaatggggcaatcactcttagtagaaatagtcatagattaaactattacaaatggcattacatggcagactggttgaagggacatatgatcaggaacatgctgagaaatgttaaaaggatgaaatcaaagaccttaacaagtatatatgtcagtactaatttccaaccatctaggaagataagtgtaattggagatatttactaaacaatagctttctttagctggcaatctgaacactgcaaattctgaaatgagatgctctgtaacctttacaagaatagctacagaaacagcccacatttccctactgctatggtctggcaaaactcaaaagcctcactctgcttcacgaagtccaatgtcaatgacatatgcttttcatttcctaaactctatgcagtcccagggctatcagttcagtccatccaggcctgctccagtccagagcttctccaaaaaggcaaatgccacattcaggagccagggcagcccccatgcacgtattaaatcacttggatcactaaggggctctaacatagtcaggggaagcccaaggtccctagaattgtctgttcttgggatccactagattggacggatttggtaagaatggagatggtggggaaaaaaataggatgacctctttctgtagacatttatcaaatacagtatctaaaatccaactagggccaaacctatctcattctggttttcatcaccataacattcttacagttacactggggattaaatgacgcaaattaatgaaataaaccctatgccagtcagggccccacttagctgacagctatttctgcaacatatgtgctctggcagaaccctggagtgatgcacagttctcagatacctttaggtttattctaatggcctcttttatagatggacactcctatgcatctagttgaatcagttattccttgggtttattgtaatggcctcttttatagacaaaccctcctacgcatctagttgaatcagttattcctcaactggctctcagtttgaggcctttgctgtgttctatgctggctggcaataggagcatgaggtgactcaaatgatggagcccctcaagggagttttcaaccagaagacacccaaggatgactgttgttctctgccttacagtgatcatgctttttgctatcagtcttacgcaaagtgtttgaagatgcactatgaattatagaaaagtttggcttcatttacgtttccccatattaacggcattatgtttgtatatgcatttcaacaccacaacattccattctcaatcaatattcgttttaacttattttattataagagttcttagtatacagtattatctttctttgctaatagttaactaataaatctttaagcttttgctgccctgagccaattgaccttttagttggctcacttactctttttaaatttgagttcaaaaaaaacaattattcttaaaccactgttcttgaataacatctattgagaaaatacaaaatgaaatttctacttgactaaggctagcaatcaaggtctgaactttaaatcttttataattcttttttcttttttctttttttttgagacaaaaatctcactctatcacccaggcttgagtgcagtggcacaatctcggctcactgcaacctccgcctcccaggttcaagcgattctcctgcctcagcctccccagtagctgggattacaggcgtgtgccaccatgcccagtgaattttttgtatttttagtagagacggggtttcaccatgttgcccaggctgatcttgaactcctgacctcaggtgatctgcccacctcaccctcccaaagtgctaggattacaggcatgagccaccatgcccagccaaattttttttcaatgtactaccttctgtgaggcaatatgtaagtacagtgggtatcacatttggtagtacttatgtagatttacaagcatactgattctgcttgctttccttgggtaaattaagaaatgcaaaaagacaaaaccatccaaagtcaccgctgttagtaaatccttgggttaacagagtccccactaaaagatattgatgacaattactataatcataatatctagtattaaatatatgcctcctacatgccaggcactgattgggtgctttgactataaatctttcatatacttcactaagagtttattcaagataaagtgagttttaaaaattatttctaacttttttttatcatgatggaataactggcacctgtcttgccttcccactgtaaacaactagacaactagatgaaatatatgaaaaaaaaaaaaaactatgaagacattggacaacaggaagtccatgactgtgattgctgcaagaagggaaataaaacagctgagcaccacaatcattctggctttcttcctggaattaatttagaacacagtggtttcactggcttgaggagacaaagatcagagtgtgtggaggccaaggtagctgtaatttgtaggaaagaccacaacacaagatagaaccactcagaaattgagcaccagaaatctgctgcatcccgtaggctgttgctgaagacgtgtgtgtgtgtaacttgaagcttggcaaacaaaatgacagatgagcagttcccaaactcacagaggactgagaaatattcagatttgcactgccagagtggaactatttaatggattacccagtacagtcagtgaagccacaaaagatcacaccttagtaatggggcacaactatccctagagtaaggctactctacattcacctccccaaaatgtacaacaaaccttgaaaggattaattaggtcagcaagttacttacctgacacaaaaaaagtccattactttttttaaaaaagacaataaaatccaatcactcaacaacttaatccacaatgaccatcattcaaacaaaaattattagacatgcaacaaagtaggctcacgtgacccataactgcatgaaaatcagtcaaaagacacaaattcagaaacaatggatgagagctagcagacaaaaaatgtgttcaaaatgtgaaataaaatataaaaaacaatgaacagaaacatggaaaataaaaaacaagcccaatggaacttttagatatgaaaaatacaatatctgaaattgtttttagaacccaatggtcttaatagtagactagtgactcacacctgtaatcccagcactctgggagtctgaggcgggctgatcacctgaggtcaggagttcgagactagcctgggcaacatggcgaaaccccgtctctactaaaaatacaaaaattagccaggtgtgatggcacatgcctataatcccaactactcaggaggctgaggcaagagaatcttgaactagggatgcagaggttgcagtgagctgagatcacgccactgtactccagcctgggtgacagagtgagactccgtctcaaaaaaaataaaaataaaaataaaaaaatagtagattagacactgcagaagaaaatattagtaaagttgaaaacagaacaatagaagcttgacaaactgaaactcagaaagaaaaaagactttttaaaaaactaagtagaagctgagcacagtggctcacacctgtaatcccagcactttgggaggctgaggtgggtggatcacgaggtcaggagatcgagaccatcctggctaacacggtgaaaccccgtctctactaaaaatacaaaaaattagccaggcgtggtggcgggcgcctgtagtcccagctacttaggaggctgaggcaggagaatggcgtgaacctgggagttggagcttgcagtgagccgggttcatgccactgcactccagcctgggcaacagagcgagactccgtctcaaaacaaaaacaaaaacaaaaacaaaaacaaaaactaagcagagactctgacccattggacaattttaagcagtctaacatagatgtactcagaatcctagagaaaggatatgaggccaaaaataatatttaataaattaatggctaaaaatttccaagtttgatgaaaactgtaaccacagattcaagatgtgcaacaaaccccaagcaggataaacacaagaaaaccacacacacacacatcatagtgcagaagcgaaagcaactgcatcttggatactgattaaccccagttccaggaatgcctctaaggattccagtttatgtactgttccttgtacaagaacagatacttaccataaatcctgcccttcggtcaaaacaaccttgatgttattgtacttcgattgtcctgcacatcccttctgaaccacctctccctctgtggatcataagccttgggtccgaagggtaatggtgtgggtgtggggatccgccatcttgtttccccactgcccaagacacagacaggcttctcttcgtaagtccctattaaacatttctttctgataaactggatatgtcagcctctttcttcagcctctcagcttcctcagactttgggggcaggtttgcagaggcctgcaggagctgagagaccaagaaatgggtaaagggaatgaagcgtctgtgtgggtaatcccaggtggcagccacttctatgtggagtggtgtggctcaccttttagacgcttgtgtgtgggtacagggacaccccaaaaatgccagcgtctttagagtgacttttaagtgggagccatctgtcgcactgcagtaaggaaggatggcgagcagccactgctctaacatggccacttctgtggccattgaggacgggagcccatctagcagcaaaagcaaagtaaaatggcttgagggggaattaaaattagacaagattttctaaagagctctattgtcaaacatacatctgtattgttttaaggtctctgttctctctccgtaaaacttctcagtcaaatgaattctgttttctccatttacatctgtctgtccctccttcctcttgccaccctcgatgccacatgagggacctacaaaaaggaacttctgacagtctgggatcccttggagacagaaaatactcctctttgtgggaggtacctctatttttctttatggaaccgtaagagttataagcagacagattcctcttgggtccaaaacatgactctcttttgtgttgcgttacctgatctgtttggtttttgggggtgccagagattactttgtaccatgagaggacttgcctttgctgtgtgtaataactggcaggtgagagatacagtcttagaggtggttgatggcacttggccgaaaatgattattactacaaggggatactcatttctttgggaatttacataagaaaactgtggtttggatacctaaaggctacagaaacatgccctactatgggataaaacaccctttgggggatgggctgatcacagagtgggctgatcagcgttgagttgcccatcagcctcaggggaatgtccttgcagtgacgtgcaccgtggaagcattgcactgtccaatcctgtagtgtttccctcttttgggggacccaggattcagtgtaaaatgggatccttggttttgagggatctaaatattctgcctttttgctgtacctgctcaagtgttcagccctacaaactgcatgctttaaagggctccatcctgggcctggtgcagtggctcatgcctgtaatcccagcactttgggaggctgaggagggcggatcacctgaggtaaggagttcgagactaccctggccaacatggtaaaaccccatctctactaaaactacaaaaaattagctgggcgtggtggcacacctgtaatcccagttacttgggaggctgaggcaggagaatcacttgaaccggagaggcggaggttgcagtgagcggagatggcgccattgcactccagcctgggtgacagagcaagactctgtctcaaaaaaaaagcttccaccctaaagccaataatctagataagaaataaactaagtgaaaaagaagacacttttcctggcaatcttgttttcagataacaatggcagcctaagttctctgcctttgagatgtaaatttcctaccttgtttcacctaagagtcatgtctttggattgacagtctaaagggggaaaagaaactgaaaactggcaaataaaaaatcttataaatctataagatctgcttctgtgtgtctgtatgtctatattttatatgtgtcatgggtgatatatccctaccaaaatatataaaagagctctaattacttagcttaaagaaaagtaagtgcttcagacaaatattttaccaggaagatagaaaccaactcaaatgccttttagtttacacgactttagtaatctttggtaactaaaactagtttcaagattttttcagtaatttaagagttaaagagttaaaatactagttaatatggaaaagtaatatcacctagtttagaggctatttaaagtttgtttcaaagtgaaggaaaaaaatgatataggtaaaactaagtggacagaaacagaaagaataaaagggtggggaatgaggaatttttgattccacagtggtcacatggtcaccacctaaggtatggagcccatctgtgctgtactcagttgctaaaggtaaaagttaccaatggaacttaggaatttaactctgggggagatggttcactggatgtgtaagaaaatgcaaactaataaggaaaaagtgaaatattaaaccccttggtaattgttatctgtcatagctaaaataaaagtacaagagagtgatggttgggccttgaggctgaaccaacctcagatgtgggtctgtctgagcataggtcactagcctcaaagcaacccacaaaggggaaaattatgccagggcaacaaaaagtacctctgagactctggttaccaagagggtagtcaatgtgagggaagggcaaaaccaagtaactactgaaatcagaaggtctagtgtgaaggaattgtgccattttgtaggtaggtattattaccttcctcagactttgggggtgggtttgcatagacctgcccaccgtggaacaaacagatacatcacaatcaatttgctaaaacctagtaataaaggaaaacttctaaaaacagccagagtgagagttctgcttttggaaagatggagcagatatattttccctatccctcccaccaagtacaagtaaaaaccctagacattgtacataaaataaacataagaaaattccaagaagttgagagaaagagacagactggctagtaatctcaggacccaaggaacaacatgattgtgagctctctgagttttcttttgacctcatatattccagattaggtgctggagaaggcagcaacccggaaatgtcaaaagatgcagaaaacaaaactcccacgaaagcctgttctctgtaaccaaagaaccaagataggggcagcctaacaagacaaaaaattatagctaataactgctccactccagccaaacactacaaaaaaaaaaaaaaaactgcaagtcccctcacccatgccaccaaaggccgagtggagagcatggacttccaccctccaaagcacctcagccaccaaacaataacagaatgcacaatcttttcaagtactcacaaaacatataccaatataaaccatattctgggctatgaaacaacctcaacaaatttaggagagttgaaatcgtagagtgttctctcaccgtaattaaatcaaactagatatctatgataaaaagtaacaggaaaacctcaaaacacttgaaaaataaacaacatgctcataagtaatctatggatcaaagaggaaatctaaagggacattaaaaataaaaattaaattgactgaaaatgaaaatacaacataaactttgtgagatacagccaaagcagtactgagggggaaatttatagcactaaaatgcatgcattagctgtgagaaaaagcctatatcaatactctaagatcttacccaaaaaacctagaaagaaataacaaaagcaaattaagcccaaagcaaaaagaagaaaatcatagacataagagaagaaatcaatgaaactgaaaacaaaaacaatagagaaaatgaatgcaacaaaaagctatttattaaaaagattaacaaaattgacaaaactctagcaagattgacaaaggaaaaaagagaaagacacaaattagccatatcataaataaagcagaaaatatcaccaaagactgcagatgtcaaaaggataacagaaatactatattacaactccacaggtaaatttaacaacttaaaaaatgcactacttcctcaaaaaaaaatcacaactcatcaaatataaaatagatgatttaaatacttttataactattgagactttaaactttaaaactccccaaaaagaaatctcaggtccaaatgctttcactggtaaattctatcaactatttaaagaagaattaatagcaaattgatacaatcggttgcagaaaacggaatacaaaagaacacttcgcaacttattccaagaagctagttttacttcaataccaaaactagacaaatacataataacttttttaaaaagagaaacaaaactattttgtgtctacgttcatattaaatacttgtttctcacaaaacacaaaattgttttctttcttttttaaaacaacaacttgagaaacaacttgtttctcatgactatagatacaaaaattctgaacaaaatattaggaaatagaatttagcaaagtattatataaaatgagttatacactatgaccaggtggtatattccaggcatgcaagactaattcaatatttgaaaatcaaccaagcatattaacaagccaaagaaaaaaatcacatgatcatatcaatccattgacaaaattcaataccaatttatggttaaagttatcagcaaactaggaatagagaggaacttcctcaatttgataaacagcatctaaaaaaaaacactacagctgacattatcattaatggtgaaagactgaatgcttttcccctaatgttgaaaacaaagcaaagatgtctgctcttactgaacctagtgttagaagttctggctagtgagacaagacaaaaaataaaatttatacctatcagaaaggaagaaataaaactgccgctcttttcagatggcatcattatttatgtagaaaatcccaagaaatctacaaaaaaaaaaaatcctaaaactagtaagttcagcaaggtcacaggatacaatttaaacatacaaaaatcaattatatttctatatactagcaagaacaattctatttacaatcactaaaaatacaccatacacacacacacacacacatgcatatatacatacctacttggatacttggatatacatgtacagggaaaaaatgttgatgaaagaaatcaaagatctaaataagtggagagtcacactgtgttcatgaattggaaaactccaaatagtaaagatattgattcttccccaaattgatatactggtttattgtaattcctcagcaaaatcttttgtaggtatagacaagattattgtaaaatttatatgaaaaggctaaggatctagaatagttataacagttttggaaaaaaaataaggtggtaggaattattctgcccaatttcaatagttattatgaaactacagttgttatgacataataaaggtagaggaatagacacataatcaatgaaaaagaagagcccaaaatagacccacataatatggccagctgatttttgacgaaagttcaaaagcaattcaatgaagaaaagatagccctttcagctaatgatgcttgaaaaattatacttacataagcaaatgtaaataaaagagcctcctctagttagaagattcaggaaagaatgcaaactgtgagaaaagattctaactatattacaactgtatggaacaacctcacaaaggggtctgggggggagctgacctaagtgactttggaaatgggtaggattgataagactaaatgcaaaataagtggtacataaacacaatactctagttcataaagttgttttccacaagggtataagttaacaattctgatactgctatacctggatactgaaattgaacaattaagtaaataaatgatggatgatgaaaggcagtatttggttgttggtgtgaagggtttacaaataagcaaggggagaaggctagaaccattcatgctgtaacaaactagagttggagacatcactgtgaattcatgtttagcttaatatagacaaagataactacatcatgcaatatttatggataagcacatgtccatgggttagtatacacatgcacttcctcactttgtcagctgagaggacctaaaagcaatgatatcccagtaaaaacaagcacagcttagcacccaaatcttgtttttaatactattctccaattaaaaaaaccagagatccttagagaaatgaatgactctagaactggagcaggaaatacacaagatgaggctgaagcatcttgcagtgccagaacgtatatatgttttaaaaaacaaaacaaaaaattagccacaaaacaaaaaattaaccacattaatggggatgtggcaaagaggtaataggagccaactgaaagaactcccaatggccaaagtattggattataacctaaagtataaaataaatatccatgaacccataaataaatgattaaataaatacacaaatggaggagaataaacaaatctttcatccagaagaattccaaataattcatgtagctactttacccttaaagagcaagagcataactcccttcttgataagtgtggactacacaacactttctttggaaggaagtcacttcctcccaaattgttaagtatggaaagggagagaaggagtaacattatagtagagaaacttgacaaacactacctcagctaagtgatcaacatcaacgtcaatgatcataaatctcattgacagtatgtagccttgatgtgatgtgataggattagaaaatggacaaaagacagaaagaaacatttcttcacaggatatgcagatatcaaataagcacaggaaaagatgctaaacatcatttatcattaggggaattcaaactgaaaccccaatgagctatcattttacccctatcagaatggcccaaataaaaaatagtgataacaccaaatgctggcaaggatgtagagaaactgaatcactcagacatcgttggtggggaatataaaatgcataagccactctggaaacattttggctctttttataaaactaagcatgcaactaccatatgacccagcaattgaatttctgggcaattgtcccggaaaaatgaaaatttatgttcacacataaacctatatatgacagtttacaccaccttttttataatagctgaaaactgaaaacaatccagattcctttcaacaggggactggttaaacaaactctgggacatccatactttggaatactgctcagcaataaaaagggagaaattattgacccaaaataacctggatgcatctccaaagaatcacgctgagtagaaaaaaaaatcaatctcaaaaggctacacactatatgattccatttatgcaatattcttgaaattacaaaaatgcaaaatacactagtggtttccaggaattaaagacagttgtggcgcaagggaaaagggtaaccagtatcctggttatgaaattgtactgtagttttacaatatgttatcattggaggaaactgggtgaagcttacattggatctctctctattactacttgcaactgcaggtaaagcttcaataatctcaaactaaaattttgaaaaactagccagagaaaaatagacccatatataatcaattgttttctaacaaatgtagcaatgaaatccaatggggaaaagactgtattttcaataagatgctggactaactggatgtttacatgggaaaaatattttccatccttaagtcacaccgtaaacaaaaattaactcaaaacagactctacacctaaacttaaaagcagacctattttaaaaacactttagaagaaaacatcggataaaatttcaccatcttgaagtagacaaagatttcttacaataccagaaaagcacaaaccataaaagaaaaaaaattgataaattagaccaattaccaaaattgaaaactttactccccaaaagataccattaaaaaaatgcatggatgagcaaaatgtatacctgacaaagaacttgtatccagaatatgtaaagaattctttgaaatcaatagtatgacaaacaaccaaaattttttaaatgggcagattatttgaaaagataattcacaagtaaagacatatgaagagcaaataaccacatgaaagatgctgagcatcaaagaaattcaatgaaaatgtcaatgaaattaaagcactgatggtattttaccataaaaattgaactagaaattgtaatattctattgtgaactgaaagacaaatatcaaaaaatagttgagttaaaagacagagagaaagatatagtaacatcattctacctttaataatgcacaaggatttcctgctctggtgagaaaggaatgggtcacttgtgtcccagctgttcaaatgacaatgtcaatgggcttggaagaatctttggcttccctgttgaagtacggttaccttatgtccagtctatggtttcaggtaaaaaaataaagcaaatcctagagaattaatgttgcatcagggtatctttccttccatccactggtcctcagccagataattccaagggggcagaattgcaaagcttcggtgacaagagtggtcccaaagtaagacagtaactgaagggtggacaggacctaggccaggacagtgggccttatggagagaactgtgtagaaggaatgaaatgcttgaagagcagggaggctctctgttcagatgactggaggaagcgtattttcagccagaagcctaggttcagcaagagaggacagagtcccccacataccacaccctatactttatctgatggcctaagaaagccagtttaatatggtaaatatgacattggattgagtatctaattatatagcaatgatttgcccgattcactccactcggtcaagcagagagtttttgaacactcagtagctggccaagtgtaacttctgctaaacctcaggtacaatgaaagagtatttgattccaaggtagctcaacctcaagagcagaagcaccatactccttgtatggaagcagttaatattttatcagcctctcctgtggaacactagttctcaggaacaatagattctctttaaggaaaaaaatggttctatgatcaaatagatttgaaagataaatttactgttaagacctctgagaaccttgagcacacagacatcctttatgaatctgcacgtgggatgtatcatgtcccacatttatttggccacagaacacttttttccatggagcatctcctgggaccagttttctgttaaacgcattaacagcacaacccctaaatgactttaggaactattctgtggtcctctgtaggctgaaaaactatcagggctgaatagaatagaccacttgttttcaaaaagcagttagagtgatgtttaaacctacttcagtgagtcccactgcgccctgagatcagggtgggtctcatgaaaaaatgcctaagggtgagattgctggtggggtatatatgggtatggtgggtgtaggggtaaagggatgagcagaggggggctgagaggcaagagatggaggaaaggcaccttactgagaagagcgtgacatggtatgttcagttatgcagcaagcagaggggcccaggacaaggctggaaaggctggatggggccagaccactcaggtcttaaagattatgttaaggactttgatctttttcctaaggacaataaaatgccaataggtgttttaggtaaagagtgataagattagatgatcatgcataaggtctctgcagtatgaaaaatggattaggagtcaggaggaataggtgtgaggagaccagataggaaggcttgtagtggtgcaggtaggttggaggtgaaggcagcatggtgctgactctgcaaagaagtgaaaagatctaagaggtttttaggagtccttggtagttggatggaggtaagagggaaaaagaggaaggtatattagtctgttctcacactgctatgaagatactacccaagactgggtaatttagaaaggaaagaggtttaactgactcacagttctacatggctggggaggcctcggaaaacttacaatcatggcagaaggcacctcttcacagggcggcaggagacagaatgagagccagcaggggaaatgccagctacttataaaaccatcagatctcatgagtactcactcactatcatgagaacagcatgaaggaaactgcccccacgatccaattacctccacctggcctctcccttgacatgtggggattatggggattccaattcaagatgagatttgggtgggaacacaaagcttagccatatcagatgatatcaaaatggttacccagtttctggccagaatgactgggagtgatggtaatgccatttgatgagctagcagatatttaaagaaggaaaggagaagaagatctgagtttggggtgtctctgagattttcaagatatatgtggagtagatagttggagttttgctaaatattctggagaaaacatgacattttctcataaaatactgaagtaaattttaaatgcattagagacttaaatgcataaaattaattcatacatgattagcataatagaggagaatatttctaaactcttgatatatagaatctttcagcatgaaacacgaaaagaaatcaagacctcaatatgtaattatggactaaaatataacatatggaaaacaaaatacttttgtccagatttaaaaggcaaatgacagtggaaaaatatgtgtaacctatggcagataaactgttatatacttaaaataaagggctatttcaaataaagaagagtaaagattagcatgaatggtctcataaaaaatcagacaaaggatatgaatagagagttcataaaggaagaaacacaaccagaaacatatttaagaagtattcaaccttactataagtctaagatctacaaatttaaacaacactaaaatgatatttttgaccactagaatgacaattctcagtatttgtgtcaagacaaggaaataaatgctcctgtgcacttttggtaggagaaaatatcggttcaatgtttgtttgttttttctcctcttagagagtaatgtcgaaatatgtatgtattctcctgtaccctgggattctatttctgcaaaattatactaaaaataataagataagtacacaaagatgtaaatacaagaagattccttgtaatgttgtttataatggggaaaagttctcaactgcccaaaagttgaattgtggatggaacttttaaaaaatcatatttcatataatggactatagggcagccagtaaaaataaaacagaagctattccttgatgtaaaaacacatttatgatatacatatatttttaagtaaaaagtaaattataaaatagtatgagtggtatgactccttttatattcaaatatgtatgcatatacactatacactatatactacacacacacagaccttcaggaaaatttctggatatcagaatgtatcaaaatcttaataacagttacctcctagcagatcaattttcagtggtgggattttttttccatagtcctatattttctaattttccttctatgctttttttactcatgggataagaatatctggggaaaaaaaacccgggatgcttcccctaatattatttttgcctccactggtgagtataaatgtctgcgtgtgtttataagcaaaacaaagccatctgcgaatcatttttggagtgagcccacttctcagtcccaagaaaagccagaaggaaaacataagctgtgacactgataaatagaaggaaaatcagaagttgcttttcctacacttcggcttttgtcaccttcaccagtagcacagatgaggctcccctgggatggcttagggaccaaggctctgtgaaattctccggggcttgggaggtggccacagtggcttagcaggggagaggtggacacagcaagatgctctccagtcaatgataacatatgtttttctttggcttcagagcccaccttcttctgtgggtacttgatatgtcatcctcttccaatttgcaatccagagtgacccttaagcttttgttggttgagcaaaactctaaaaacatagactttgtcttactctctacatttcaagatccctgggttctgttggaaaagcaggggatggaacattttgtctccggtggtttagtttctttcacctgtactttatctgcctacgtgtcccaaagcctggggaacagaaagttaaaagcctgagagataaattaatcaataacaaatgttttctaagtctccaaaagaatctgataaacatttgagaggctacgctcagcacatacacgtacaaaccacatttcacatctgtttttgagattcacaaagtccttgaagctcataagggggtgactttgaagaaggaccccaagttaggctggaacccccaatctaggagtggctcctcctgttcggtgttcagtggccaccaagatttctggagaagccagtcctgccccgccaatctcgcctcccatcccactctcccttgacacttttatatcttgcaataaaaataaatatggcagctgaaagcagcatctacagaagacacacctcttccttctttccatcttctgacttttattaacccatcacctttctcaagtgttcatgtaatggctcatttctcatgtttcatagtcctagcctgggaaaggtacagtaatgatagtctttgtaagtctagacgccaaacaaccatctcagaaaagcctcatttaatgaggctcacacaatgggttgttttaaaatagatcttcatccaagccatgcctccttacattttgtaatggtgtttatattttgcaatattttattcatgatggatttgggtttttttaacatctgcaatctcgggcactttgtggtaaatttgaaaactcagtccctggaatcacttgcctgtaaacccgggtgcacagatgcacgtgccattcaggccgtcgctgtcacaggtggctccgttcagacagctgacgttagcgcagggatccttgtacaattcacagtgtgttcctgcagagaaacaagcaaaacaggatgactcatccaggactctctggctcccatggcctctgaaagcaaagtcggaactctctggaacaatgcgagggagattcccagcgtgggtgtgtgtgggtgagtgtatacacacgtgcccactcatgattttagattgttgtaaaaacttgccttatgagaaagtaacacattcgatcactgtccataggtcccaccatagtcttttatctgtactttctctgcctacgtgtcccaaagcctggggaacagaaagttaaaagcctgaaagataaattaatcaatagcaaatgctttataagtctccaaaagaaacagaaaatatctagatggccttgagaaaatataatattagcaacctgaaagtgaagatttggaatcagatatttaagtgagtcccagttctactttgaagaactgcaggggagaggggaagccgtgtgatacttagacttcattctcaaagacatcactgcatgctttatgtctaatttattcctcacaacaacactatgagacaattatccttattcctccattttacagatgaggaaactgaggaaagagtcgaagatcacaagcctggtaagaaaggagctgggatttgaagctgcccgtaatcccatcccagagtctgtgtttgctaagtaggctgttgagagtgaccctgaattgactgtggaaatatacaaaactctatggagctcagcactcgtttaacaaagaagaggcattttttaaaaaatctgtaaagtaaaacagacagcttctcatttactttttttaaaaaaaaaagactgtgtgtgcatgtatgtacgcaaatgcctgaagtgggactggattacttccaggagacttgattactttgattttcacatctgtgtatttctacattactggcaccttttttacaagtatctatttttttataattttattaaaaactttaaaaatctaatgctatttgaaaggtgggatatctgctgatgttacactggatgccaagatggatgaatagattagtgtctctctctctctcctcctcctgcccctcctccctctctcccttcccctatccccaccctttggagagaaagataaattacattctaccttgcctaagaacgtacataatgatatgcccacacttcccaacagcctcaagaaaaatatgcataaagcaaatagtaactgaatggtatttacttaattttctctgcacttcattacttagctcatgttgtgcaagggactgccacacccaatgactcatcctttaggcactgaaatcatccttgctgggcttttcccttatttatttctcaatgccttaagaatagggctcaggaaggaggaaaggaagtaagagaaaatagaaatggaacttcctatctatattcacactaatgacttatttgagccaggtaaagctcaaattttagaataaatgacctgtaattctttttcatcctttgcccctcctagccaagccatcaacaatattctgtcaggtatttttctgaagtgtctttcagatctttgcctttctttccttcctgagaccacccctgtgatcccactgcctcgtgcctggtgggatacagcatcccgcagccatgtcttagtttcctctgtctccagggacttgaacgagcctcctcaacttccttcatccctaacccaggttgcatggtaacataaaagatcaaaataatgttaagattagcataaatctggtcattcttcttcatttgggtgtgtacagcctcttctcccaggagtctcttatttttactttcctactgatacacaagtagcctgggctcaattgaaagaataaaaagcagaagagtcttttctgctttaaaatgtttattgcaacacaaagactcacatatttacaagttcccactgggctgatcaatgggagccaagtgacaaaaaagacttttggttgtagtgggaaatacggccaccaccaaagttcagaggtgcctgaagcctagaaaacatttccattagacctgaagtcaaagaaatcaaatgattgtcactgagtttctagtaatacattaacatcactaacatattagcacccaaactaccacattttaaaaaccagactgaaaagcaaattctaggccaaatatttaagcatcttaccttttatttaaagtcttcaacaaaataagacttgatgaaaacacccaagataataagcaatttcaatcttttgggtgtttggggtttttgtttggatagatggctcttttttggagggcggggagacaatacttttttcccttgttaattttctttttcaaatggtgagacatttggtcccttgagcatctattgagagttctctggcagcaagactggacaaaagctaatcttcacagaaacctgattacggacaagcaagatggtgttaaaagtccctggagagcactttggtgactcacatttctatatcgtaaaccttgctaatccctatataaaatatatttgtcatattgctcagcttgtcattagaactgaacaactctgagctaaaaactttaaacacggagaatagacaatcatggacactactgatgtgccaagttgtatccactcaaaccctcctcctctggaggtccctaggccccctcttcctgccctcctcaccactcccattcccagaaaacatcaagtcttgggcatcctgtttcctctgaggagtcaccttctttcacacccttcccccaacctgatcttcgcatatttaactaatctctcaattcccaatccaaacaccctctctctgcaaagctgaaccttgattttctcaacacagaccacattcttccaccactgtgccttgagagcatgccgggactgtcattgtcacggagttcactgtgccaaatcataacttatctgctctcctgtctgattctcccacaaatctctgaagtcctgtagagcagaggccgtatcataatgcgtggaagaaattatggacctaacaccggaatcctatcctttcaagaggggcgacagccagtgtactttggctgacacacaggtgaggctgccagaggagagattccaaattccaaatctgcctcaaaaacaccctattttgtcagagaaaaccaggtccacacttcaaactaagtctgtggaatgacacatgcatcacccattggcagaagacacagcacgtactattacaaagctgatgtttagtctcaagcaaaaataaactgtaattcagtcaaaactaataaaaattcatacttttcgtattaagggatggagaagaaatgtttctaaaaagactttgattccaacagcattctttacagaagttaattttagaattgaaataagctagaattcaaaaagcagtacaccaattataagtctttgttgttgtaacaaatttagttacaattaatatttgaaaaatgaaaatcaatattttatctccaagaaacgaagccagtaaagaagtgttattacacttaatatttactttaagacatcgtctcatttcatccaaacttacttcctctatgaaaactttttccagtatttcaatctttatagatctcaacattttctaaaccatctcagaaattacaattgacatctcagccttagcctcattattcctgtgtgtgtcactcagtctgctcgtctggttaaataacagcccaaagaaggaagaaactctgacttatcctttttgtatttatcacagtacttgaaaggactaggtgcacaaaataaccagaaattcttgttccctggctaagtggaatctagcaaaggcaataactttatccaacaaagaaggagttctcttccttcccattaaaatttctgtagcctttaaaaataaataagtaggtacaggccaggcagagtagctcacgccggtaatcccagcactttgggaggccaacgcgggcagatcacttgaggtcaggagttcgagaccagcctggccaacatggtgaaaccccgtctctactaaaaatacaaaaattagccgggcatggtggcacacacctgtaatcccagctactcaggaggccgagacaggaggattgcttgaaccagggagacagaagttgcagtgagccaagatagcgccattgcactccagcctgggtgacagagcaagactctgtttcaaaaaaaaaagtaggtacaatgtacaatgtaattaaatctataatccagtgatctcatttctgagactctatccctagaaagaaatctggaaagtaggaaaacaatgtaaagatattaattccagaaatatttgtaatagccccacatcacatgtaacaacaaagcaatggataagtattctctcatgggaacattacaaagccatttaaaataaaactagtaagacttcctagcaatacataaatcaaacataatatcctattatgagtgagcagaacaatataaaattgtaggtatactcaattattgaacagtaaaaacatggatactaaaatcagaatggaagcaacacagattattatggctcatgttatgttgtaaaaacatgagtaattatgaattttctcttttcttctaaatatttattattgttatattattttcaaaattaaaaatcgaattttttttctaaattgtatcaccaaaaatttcaaatatatatattgttgatcatttcattggatcttctagaaataaaaatcaatcactatggggctgttccttaaccttttgacaatatgaggtatgaacacttaacaaagtcttagacgttccgtcacaaaccaggcttgaactagttttgaaggacacagcagtattttggtttgtctgaagacgggttacacagaggtcctccatgaattttgctttctaacaattccataatctacagtgaagacttacattccatgaaaatgtttaagttggtttcctttacttaattcatgtgttaaacagtagttctaactcaagtaaaggtagccattgagcatttgttctgtgcgagccaccatagtaagagctgtagagaatttaaaaagaaaaagagcctatgtagtcactgtctttccagagcttatgatttagtatagggaagaagaaagtctgaaaccaaaaagaatttaatacaaggctaaacataattgtcatggcaaatagaaagaaaatagagagttaaaggaggaagaagccacatctctttgggggtcaacatttcagacagtggatacagccataggagtggatgaaagcaaagaggagggagagagaaaggggcctggagacccacgtcattcatggcatctgggagaccaagacttagtgagggcagagaggagaaccccgtcaggaatgaagttgcagaagacacagcaaggcgacgtgcaagagggaccccagggctcagtggggcaaagggacaggaacgctggctgagtcagaagtggaaggggaggcttcatagatttcaccaaatgacttcaattacttcaccatgaattttcctgaaacctcttttagtggaatgatgtggacaagggccaagagccatggttgaaaaagcaaaagggaagaaagggactttaagcacagcagggacacaaaaagtcaaagaagaggtttttaaaattattatttatatggaatttacttagaagtctaagaactttttttttctttagcagcccagtttttctagaagggcttatttgaaaagaattcccttctcattcctagcaattcctctctaagagtcttacattattattatagacaatggtttctgggccattcttcagttttggttatctgtccattcttgctagggtaatatatgaatgtaacaataattgcagcattatagtgggtttttcaacatctggcagaagttccccctcattgcttttctttttctttttcttcttctttttttttttttttttttttgacggagtctcgctctgtcacccaggctggaatgcaatggcacgatctcagctcactgcaatctccgcctcccgggttcaagtgattctcctgcctcagccccctgagtagctgggactacaggcatgtgccacagcgcctggctaatttttgtatttttagtagagatggggtttcaccatgttagccaggctggtctcgaactcctgacctcattatctgccggcctcagcctcccaaagtgctaggattacaggtgtgagccaccgcccccggccttttttcctttttcaaaatgttcttagctatatatttggctgactccctattgcactcattctttttaggaggataaatatatatacatagagagggtgttatatatatagtgttatatatagttatattatatatatcctcctaaaaatataaaaactatatatatagtttaaaaaatatcaatattaagcagtaaaaattaccacttaaaaagtatatatataaagtaaaaagttaaagcttaactttatccctaaaatactacctatctaagttctaactccaggtaagtactagttaggaatttaaacccatccatctgacagtttcctgaatgtatacagacatacgatatgtaaatatatattggcaaaaatatttccaaaagggggaaaatgtccatccccccacggagagaaaagcacaggatcatgtggcctctcacttcccctcactcttcctctgggtggaagagcatgattagatcctcctgtctctcctttaattccttctacctaccctccccatgtccccaccactcttagtttagaagttctaccatttactgctacattactagggtttacctccctgttttcagcagccttatttaaacctaaacctaaaagtctttataaatatactaaaattaaataaacactttatctgcccattggatttgtcacccaggctggagtgcagtggtgtgatctcagctcactgcaacgtctacctcccaggttcaagcagttcccgtgcctcagcctcctgagtagctgagattacaggcacccgccaccacacctggctaattttcgtatttttagtagagacgggatttcactgtctggtcttgaactcctgacttcaggtgatctgcccactgcagcttcccaaagtgttgggattacaggtgcgagccaccacaccaagccaggagtgaaatgtttaacacacttgtatgcctttcagtctttcctatcctcacccccttcaacacatggctttgttttaaataatatgaaaccactttacttgttgaaatttttccttaagagcaagagtggtggacacagcctagagtgacccctagggagtcacacccttgtgtaattccctccctttgagtgtgagcttccaaccaagagcaaatggcagttaagacattttgaagatgcaattaaggtccctaatcagttgactttgagttcctcccaggtgggcctggcctaaccaggtgagacctttaagagggtccaggctgggtgcagtggctcatgtctgcaatcccagcacttcgggaggccaagacaggtggatcacctgaggtcgggagttcaagaccagcctgaccaacatggagaaactttgtctctactaaaaatccaaaatcagctgggcatggtggtgaatgcctgtaatcccagctactcaggaggctgaggcaggagaatcgcttgaacccaggaggtggaggttggtgtgagccgagatcacaccattgcactccagcctgggcaatgagagtgaaactccatcacaaaaaaaaaaagtccaggccttcccggaagttcaagactggaagcagtggggtctctgtcatagttgctagctttcaaagagcaagctgtcacaaatcctacagccacgaggatataagttctgccaataacctaaggggacttggaagctgatttctcactattcaagcctcagatgagagctcagtcagtcaatacctggctttcacccttgtgagcccctgagctgggaattgactaagccacacctggacctaggaaactgttaggtaataaaagcatgttgtttaagccagtaccgggtactgatttgttatgcagcaatagatagctgatacagaaggcggatctacttttttcaagagactttccttcaccattatattaccattcacaatcacataaatatcaaatatttagatttatgcctgcatttaaaggcatacatctcttccttccattctccatcttcccctatctggatatctttgttttgatttagttcctatttggtggcgatgcttattaaggtacttatcttagggtatagggtgctatattttctgtatccttgaatgtatggcaatgtctttcttttgccctcaaatataaacaacaaactcctagtccttttcatttaaaagtctgaaacgctgctctgctattctttacctcatgatagagaggggcagtacaatgccgatttgattctctttcttctgtatgtaacctgtgatcccttcgaagaatcttgtaaaaaattctctttatccttgcagttacaaattttaccaggaaatctcaaattgtgtatcatctccttcattaatcccattactgccctgtgagcccattctatttgaaaataagactttcttcacctcacagacacctccttctaggagttagttaattctgcttctatttccacatgctccttcttctggagcacccatcgctcaggcagaagcagatctctcaaatcttttctccatgtttcctgtcttttcactcgtggtttccacttcctcatattttgattctctcatgcactagttcctcctttttattcagatccaaattcaattttgagtagtgtacattactttcttcacttcctttcttgagtgtttagagctgttgttgcaatttttgtttttatttcccaaaacttttctccctctctgagttgctggcgtgggctagtgtactggccaggctagtgggtggaaatcttggcagagacagacaacataacacattccccttcagggatggatgggcagccaatggggccctgtgtactaaggcatgaggcagagagaggcctcccagtttggtgttctcaaggccacaaaaaatgggggggccagctcagcctactgtgcaatttccttagacagcagcccgtagccatgagatcagtacacccctctgcctcctagggtcagacgcagcacaattacagcatgcacttcctctctataagctgaaggatttttttggactaatctgttcattgagtcatcagttctctctggagccctcatcccctgttcttgtggttaagcaaaggctcccagcacacataccctttcttgagaccccaaatcttcagatgaccccattcagggtcatctaccttattgagccatccctagcagagagtcaggagggatcagagatattgaatgtcaatgtgagctgccatcttcctagaatcttcatttgttcagagtaagaaatccatgaaaatatttatacacatggaaaggagcaaggggaaagaaggaggttgaagatatgtagagagaaaggtaatagatagatagactcagaactgagaagcctgagaatgaagccagcacatctgctgttgtgtcctggtagatgttagtggagtttggttctaaccgaacgtcatactccaacagaagcatcagatctgtggaacacaaagtcaagacctggcccagcttcagccctcttatccaggagcttaatcaagttttcagtgtagcctacaaggccatgagacttgccaaaaaggttactaaataaaggtaggttcatccaaagagaagcaacggtgagggcaatgcaaggtctccagccaggtggatggcatcaagcaagcagcaataggagcaagcggttgaatgaaatggctataaatagagcccacaaacgcattccaaaatctaaacccggccccgtagttatggcttagagaaatgtgtgcaacagctgataaataggttctcctggaacagggccgtctgaggatatctgggctccaggaagccttgccatccacaaaacgtggccagaggccagtgaagatgctgggaaagggctttaggaaccacgctgaccaggcttataggggaagagcattactgtccacctcatagggttctcggggggatttagtgagctatgcacattaggggttagaacggggtccacacattggaaacactctgtcaatgtcgcctgtttttaataagcattaacttacttgctgatacatgggactccgcctgcctcctccccaagaaagcacagcattctatctctgcataagaagctttataggacggcatccttcctcttccacagttttcacagccatggtctctaacctatgtctgacagtccatcttaatattactttttgttttcagctttttacacattcaataaaaaagaaagcgaggatccacaaagaacaggacaggaaagggggttgtttctcaatctatcaggaagaaaccagagacttgcaaattggtctccttggaccgattaatcatgccagcttcagcatttgattgttattctgaacaattcatggtccaattagaggtttatgcatttacactgagaaatacatgacgtcatttagagccattctggcacaggaaggccaggcggcctctcacctttgtattctgccaggcacacacactcatagccattaacgaggtccctgcaggtggctgcattcaggcatggagcggagaggcactcattatattcctcctcacagtagaggccatggtaacctgagggacagagagaaaggcccactgtcaaatgcatcccatttacaacccacgcgggaccagcctgcaaggaaggcagttgggggtattcattagaaagtatggtataaacagatgggatttcaggagctagatctcttggggtaaagttgaaaggtggatttgggggaaggctatgaagaaagcgcctgttcttatcacactttttcatgatcccaagtataaaagaagtgattccatttatccactgacattttcatcatagtgcatccaacagtgctggtgttagggtgatccagtcactgagtgtgtctgctgtggccatcagagatagtgaatgagcaggatttacggcaggggaggagcaaacagctcccttcaagagtgagaacctggctcggtgtggtggctcatgccaccacaaagtgctggtaatcccagcactttgggataccgaggcaggttgatcacttgagctcaggagttcgagaccagcctggccaacatggtgaaactctgtctctactaaaaatacaaaaaattagccaggcgtggtggcgggcgcctgtaatcccagctactcagtaggctgaggcaggagaatcacttgaacctgggaggcagaggttgcagtgagccaagattgtaccactgcactccagcctgggcgacaagagcaaaactccatctcaaaaaaaaaacaaaagaaaacaaaaagtgtgagagccacattagaaaagtatatctgtatttccttttcaagtcagaaaagaaaattagctcaaaatgcttaactgaaattattgatgaaatgtgagggtatttttgttgttattgcttgtttaaagatatgattatataaattataatattttaaattgtacctaaatgtttaaattactaaagaaataatcatgtgagtgaagagaaaataaacccacaatttcttgataaagtggattttaccctcctatttgcaaaacaggtgtttattctaaaggacaagaagacaacattctttgagattcattcatgagggttatgctgttttcaacttttgaaaacatgtgttactgccaatttgcagtgaaaccaggccatttttgtccagccctgtccaaacaatgaaaaacatgtgagtgttttcaaaagtcacactgactgtgttcgttctgaattcagataagcagaaaaaataagcccttatccaagtaggaattagaactactagcttttccctagcctttccagctcacaaccaactctcaaactcagaaagtcccattagaacatgctaatatgttgaactgctttgtttcttgtgcctatcataaaagtaggttaagctcatatttgcattattaacagagcacttttcaaatatgttgccatttcagttgtttttgaacagctttccaaatttaggttgtgataatggcccctttgaggagcccttgacctacctaagacaaatatactatagttttcaattcttctgaaaagtagtatgttaccctactttttgtaactttagggaaatatttctattacccttcattagattattttcatcatgtagataagaggtactcaactagcagcaattttgtcccccaaaggacatttgaaaatgtttggagacatttttcgttgtcacaactggaggcagggggaggggttgctgctggcatctagtaggcagagtcaagagtgctgctaagcatcctacagttctacaggaggctgcgcaggacagcctctcacaacaagactatccagaaaaaaataacaatacagccaggttgagaaactctgttctagaccaggggtcagcaaactatggcccacagatgaaatctatcccagcctgtttttgcaaataaagttttattgggacacagccacagtcatgcatttacatattgtctatggccgttttaacactacaacagaggactgagtggttgcaacagagaccatatggcctgcaaagcctaaatatttactgtctggccctttgcgcagaacaagtttgctgattcttgatttagattcaatgaaagatctttcttttaacaagagttttggatattaaccccttatcaaatgtattgtttgcaaatattttctgccattccataggtcaccttttcatgctgttgattgttcctttgttatgcagaaccttttaagtttgaagcaccacttgtatatttgtgcttttgttgcctgtacctcggatatcatatccaagaagtcattcctaaggccaatgttatgaagtttttcccctacgttttcttctagaagttttatacttccaggccttacatctaagcttttagtccattttgagttggcagttatgtaaggtacaaaataatacaaatggccaacaggcatatgaaaataacatcactaatcaacatcactaaaaatcagggaaatgcaaattaaaatcataacaaaatatcacttcacacccattaggatggccattataaaaaacaaaacaaaacaaacaaaaacagaaaataacaagtgttggggcagatttgaagaaattggaacctttgtgcactgttggtaggaaggtaaaatggtacagctgctatgaaaaactacagaggttcctcaaaaaataaaaaatagaaccaccacatgatccagcaattccattgctgggtactcaaccaaaagaatcgaaaacaggatctggagaaggtaatagcactctcatgttcattgcagcattattcacaataaccaagaagtacaaacaacttgatgtccattgacagaagaacggacaggtcaagcaaaagtggtacataatacaatggaatattattcagccttaaaaaggaagaaaatcttgtcatgtgctacaatatggatgaaccttcaggacattacattacatgaaataagccagtcacagaaggacaaatactgtatggttccacctatatgatgtatttttaaaatagtcaaactcacagaagcagaaagtagaatgatgatgattgccagggtctgcggaaggggaaaaatggagagctgctatttaactatgcaagatgttatgcaagatgaataagttccagatatctgctggaaaacagtgtgtgtatggtaaataatactgtaatgtatacttaaacatttgttaagaaggtacatttaatgctgtgtttttttaccactatatatataaatatatatgtattattaaatatacatattttaaccactattatatacagatatatattttaccactatctgtatatctatatctatatctctatatctatattttacctactatatatatagtgggtaaaaaatacacaacataaaaaatatatatagtggtaaaaaacatacaacatgaaatatatatatatatatagagagagagagagagagaaagtgggagagagagtaaaaatatatacatatatatccatgtatatgtaaagagttaagtgtcttttgcttctcctaatatgagaagctttttgaggtcattgtggagtacaatcaccagcagcaccttttcaattgcatttgccctcctaggagatcttttaacaatcaacatggaagggtaatatataaccataaccctgcatgcatctttgacctctgaattgaggtggcatttaaatagacaaaaatcaaacaagcaagttttgcaagatcatctttaattgtttccatttttgaaaacagtatcattatctttttatactagcaatatgaaaagcaaatgaggaagttattttacagagataattaagctggtgatgtttttcttccttgggggggaaaaaagataaagttttcatattctaaaaccgtttcttcagagacggtaacatttaaatgtcttcatggaaatgtcaaggcaccctttatactcagtgccaagcagcctcaatcggacgatttgaataaaaaggcactccttccaaaagagagggcttctgtgaaaatgaggctatcaccccctgctgataattaattcaggcaaacaaattagctcagggcagtatgcccagtgtctgaaaaaaaattaggctaatccaaagattttttaaaaataaaataaacaatcaaagggtgggatcagagtggccctttccaaggcactgatctttatcagcactgctcccatctttgcatgatttgctcccgaataatcagttccccttatttctttcggattgacggggcacagcaaccaaccagatggggggagtgagaaagagcggtggagatggctgccatgtctagctgagtgagcggatgaagtcattatcaccaagaggtaccaccaaaggaaaaacagacttagaggaggaaaaacaggcttagaagaagaccagtttaactttggacgtgtttagattgggcacacttgggcaggtccaagtggcagttggaagtatgcgtgtaaatggcttagaaagagcactttgggaattagttgcctggaagtggttttgaaattttcattaaagaagaaaatggaagggaaagaagaaaatggaagggaaaaaagaaggggtcaaggtcagaccacatgggcaggtggagaacaaagagccagatcaagacactggacaaggattgggcaaaaaggaggagaaaagcccaaggcatgcagtgccatggaagccagaggatgaaaggatatcaaggaaggtgggttagcagtgtcagaggctctaatgagcaagaatgaccactggactagaaaatgaggaggtcactgaacaccctcaaaaccatggttcttaatggtggctgtgctagcccttagatggtgtttagagaaaattaggggtgggagtgatccttatgcaatgattggagggttctactggaatttaggagggtgggagagggcaaagttattaaatattgcaatgccctggatattcctgcacaacaaagaatgcctcctcattcttcacaacaatggactgttccactggaccctcatgtaggcaaaaaccctgttgataactttcccaaactaaaacctaacttctttatatgtacagcaccattttaagatatactgagttttaagccgggcacagtggctcacccctgtaatcccagcactttgggaggctgaggcaggtggatcacttgaggtcaggagttcaagaccagcctgatcaacatggtgaaaccccatctctactaaaaatacaaaaagtagccaggcgtggtggtgggcgcctgtaatcccagctacttgggaggctgtgacacatgaatcacttgaacctgtgaggcagaggttgcagtgcaccaagattgtgccactgcactccagcctgggagatagagcgagactacatctcaaaaaaaaaaaaaaaaagatatactgagttttcctagaatgtactacttgataaaccaagagaagattgtaccaagaattatttatcattttaaaaaaacacttcacaagaacaacagctctagtggaatttaaatctccaataaagaatatctatatccataaaacaaaaacatcaacaaaaatcacttcctcagatagttttctgacaatgctatttacagtagctcttcccaccagcaactcatcacgacactcagctgatttccatcgtagcatttgtaactgtctgaaatcctatttttatcatagttctttacttgattatcacgtctcttcctccactacaggataagcttgagggtagagtctgcaaacgcagtattcacagctgtacctgtggtatctgtgtcggaaaaggctacacaaataaaactgttacataagcacccaaaatgttatcaattgattcgatgcacttttaaaatgtttccatggtgctccaggaccttccaggtgccctgggtactgcctacaaagctaaagaacagggtctccacctacacggagcatccagtgtggtagcaagttagcagcatctgccttatgtcaggccctttagatgtgttaacttgtttaattctcataaaaacccaaggcgatgggcatgaatcatcccaatttatagatgaggaattaagagttagagaggtaaagaaatttgcccaaagccatgtagtcaatcctgtgtgttcttccttctttcccatgttgcctccaaacgcattgtctagtatgttagtttattagggctcccatgaaaatactatagcactggttgaattaaacaaaaacttattttcccagagttttggaggctagaagtccatgtcaaggtgtcaacaggtatggtttcccctgaggcctctccccttggcttgcagacggccgccttctctatgagtcctcacatgtccttttctctgtgtgtgagtgcttctcataaggacaccggtgctattgtattacagccctacccttataatctcattgaaccttaattacctctttaaaggccctatctccaaagacattggaggttacaacttcaacatatgaatttggggtggagggcctaatttagtccttaacacctagaatctgagtttctcagtcacaagactgttggtattttggaccagatcataatcgcggggagcttccctgtgcactgtagaatgttgagtcgcatccctgacctctacacaatagattccaataataccatccttcccaggtgtaatgattaaaaatgtccccattgtcatatgtcccctggaagacaaaaatcccttttggagaaccactgttctagatcctttttataagatgaaaacaacttgaagagatttgagaacatgagggtttcaaattgttgtgaagggtgagagttcattcatcagagcaaaaggatttctggacaatacctaggagggcttctgcccttgtgggtttgacataacacagtccatggggtgactctctcctgtactgctatcccacagaaggaaacaggccctgggtatatctgggactggctcataccaagcaaatgagatagagcggagtaagaagggagaacctgcctggtgatttttgagctaacgagaaccctgttgaatgctgtgtccttggattgggactcctctctgtgccccctatgaagcctccagccacatggtgaagctggtttctagctagtgctcttcctacttttcacatgaaaagaccacagccctacagccttgaccagttcagcaaaggcacggtggagcccagattccagcccacagaccctgacctgctccagaacaggacactttgctgcataaaggtcttaagagtcactcaattcctactctccccagtaaaaggcaaagccttccatggcctttcaccatcttccctctcaacactgtcgcaaggcaggatttaaacatcaatccaggacccaccggctctggttccacagtgtgtttgctcacaggagtactttccctctccccgcccgtccctcatcacactcaaaaatatccaaaactgtaagattctagctgtagccagatggctttcacacttcgtgcaacaaattcccagcgactcatctgtcagtatcacctctggagcgtgatttgtgcttcctgctgcctcaggcaaacaggaccttcgaagaccatggtgctgtgatcaggacaaccagggggaggtcatgccactcactcccctcgtacagactgaattcaaggcaagagtgaatttacggtgtttggggcttttatttgtttttactttatagtcaggctgaagtgagtgcagggctgtgaagagtggttcctttaatgatgcaacacaactcaaaggatgttttcccttcttttcagcatgagtggataaaatgtgaaaacccatgactttctgattcaagtctaggccagttcctgggagatcaaatattccacctcacccatagtagttaaagatatgggggccgggcgcggtggttcacacctataatcccagcactttgggaggccgaggcggatggatcacaaggtcaggagatcgagaccatcctggctaatactgtgaaaccctgtctctactaaaaatacaaaaaattagctgggcgtggtggcgggtgcctgtagtcccagctactccagaggctgaggcaggagaatggcgtgaacccaggaggcagagcttgcaatgagccaagattgcgccactgcactccagcctgggtgacagagcgagactccatctcaaaaaaaaaaaaaaaaaaaaaaaagatatgggtcacagagaaaataatcctattatattaacatgattgtgagctttcaaattctggctaaactcactggtggtcatagagccctttggcgctctggaatgtgggacaagatgcattcattttgctgtgtagagctttatttcaagggaatctgtgtgggtgcgtgtgtgtgtgagtgagtgtgtgcatctatctcccttagcctctcttgttgctggcaggttcataatagaaatcgattaaagaacagaaataagaacagaggcaagcatctgggctcacattaatcctattaagtgttcagatgctctcgtttaaacgaacctgctggttttgataactgcacaggttttcactgagtaatcgtgcttctgtcacacacacacacacaacacacacaataaagccagaaaatacttgtgaacatggaggaagttgtgtaagtcaatgcagagcattcgttggtgtgtggcagacaatagctgctgatgtttcttatttctttagtctctaatttcttatccttttattgctcatggcaactaagccagaaaagaaaataaatgtcagaagacccaaatcagtcaatattttcacttgctgtgatttttataaacattaaattgaaaggactaaagacagaggctaaattaaagtttttgactgtaaaacctccctattatttatgttactgagccatctacaaatttccatctccctccctgggcttccaaaaggatggatgatgaaaagccagctctaaatcatatcctcactgttcacaccatgagtttatattctccctcagtgcagaggctctctggctttaatagccacatggggaaggttggtaattctctgtttctcatatttgcctccttgatcgattcattctttaagtcaacaaatagttattcaatgcctgctatgtgtcaggcactgtgctagtcactggggctatctggtgagtaaaaacagataaagtgcctttactggggcgcttatgaggggaaaaacatcaatcaatcattcaagtcaatggaaaatcataactgggaagtataagcaatgaggggcctggtgttccaggagggaggagagggaggagatgcaggagagctgaccttgccccagggaggctgccaggaagaggggaaagtgagctaagagggaggggtgtgcagaagaatgatgagaaaattcaaggcaggaaaagctgtgggtgcaaaagacccacggtagagggaccacggcttgtgatttgttccagacatggattgcaacccactgtagagcaaagggcagagaagaaataagaacactgggctgggcatggtggctcacgcctgtaatcccagcactttgggaggctgaggcgggcagatcacgaggtcaggagttcgagaccagcctgaccaacatggtgaaatctcgtctctactaaaaatgcaaaaattagccaggcgtggtggcacacacctatagtcccagctacttgggaggctgaggcgggagaattgcttgaacccgggaggcagaggttgcagtgagctgggatcgcaccactgcattctagcctgggtgacagagcgagattccatctcaaaaaaaaaaaaaaaaaagagaaaaaaagaaaagaaaagagaaacaggcaggtgtcaggcctggtggtatctttcatgtgggtggtggggggatacaaaatcagatttgcatttcagagagattgctccagctaccctttggagaatggggataagacctgcaagaatcaatgtggagaaatcagtgaagaggctgctgcaatcgtctcgggaaatcacggctgggatgagagtggtgacagggccatgtggaatataaatgtcaagagccatttaaacagtaaatagaaatacctggtaatgaatagaatgtgaagggtgagaaggaaggagaggtggaaggggaggcccagattcctggctgttttgtccagagatactgcaatttctttcaaaggagtgcaggaattgacatttattgagtccccttctatgggccaatttctcttctaggcactttaaaatacaacagaagctcattagaaggaaggggctggggaggggaatggagtggaagggaaccatattctagaagaagcagatcttaattgaacaaaaagaattgacaggttctcccagaaaaacggaagtgatttgaaaaaaaaaaaaatcagttcattttaatgagtatttgctgaaatctgactatatagccaagcattgaactagttgctgaggggttcaattgtgctgtagttaagaaagaaaggccttatgtaagaagacacaagaagtcagaggtggagggagggcagaaaaagagagagcaggatcaggggagcatgggatgggtagagaggaagagcaaaagagagacccagagttatcaagatggagacagaaaagaaacagagaaagagacatagaaagagaaaaagccaaaaagataaaatagagagaaagaaaaactggtccagaacatgatggaattacactgggcagacagcaaggtcgctgccagaaatgttgtgggcccctgcagagtgatgtctccaactggcgtaatgaccttgagcactgcccttggagggtcaccaagatggtggagcatatgggggctgggggtacaatgtgagagtttgagagacaatgggacacagcaggattcttgcttcccaagtgaaatacatattcttgcttcccttattaaaataaaatgtatttgatgctattttctttttattaagtactttttgtaactcagtattgagagtgtttctagatggggagcactggaccatcaggcatacagttgcagctcagtgccagtgtgtcacatcttccattaaggccattcatgggcacttgtggcaacagaggatacttataaaaggaggagtttctgcctctcccttaggaggacacgggcctggcattgtccgtgaggtggtaacacaagggaagcattaagcacaatgcctggcgtaagcacatcatgatgtgatgtgtggtcacctggcctgtgaggcaaacgtgattttaaaagacaacctgggtgccgtacttctgaaataggtgcccaccttgcagacacagcaaaggccctaagcaccatagccctgaaggacgccattaccctgagccatagtttcacatggtcagcaaagaccgcttactagagaagcacaatagcaccagctcagcactgacatggtgcctggctgattagcccagatttcaccacccaggaacttgaagatctaaatttttccaatacgaaacagcctgtttatgtttggctttttaaaacctaccctttttccttttcatagccccatcccctgagattaacctcggggctggatctggtttcctgcttggcagtaaaacttcgattcactgctcaatatttgattccaaactctgcattttctctttaacaacaggctgttctcctctcatttccttagcacacaggttgaggaatatagaagatgcttgatcaaactgggtaaattgaatttgctagaaaaatagaatcagagggccaaataacctttgcatacataaatacagaagagttcttttctttaccagtgcctgttttgcacaaacatgcattaaaaggcttggaaaaacatcttccaaaattgacaattgttttgttaagggattcttttattaatttaaatatgtatattcatgttttctaattttccattaacagagatatgttattgtgtgatataagcgggtaatatcatccatgctgtgatggttaatactgattaactgatggttaatactgagtgtcaacttgattggattgaaggatacaaagtattgattctagctgtgtctgtgagtctgttgccaaaggagattaacatttgagtcagtgggctgggaaaggcagatccacccttaatctgagtgggcaccagctaatcagctgctagcatgactagaatataagcaggcagaaaaatgtgaaaagagagactgtgacctagcctcccagcctacatctttctcccgtgctggatgcttcctgccctcgaacatcagactacaagttcttcagttttggaactcggactggctctctttgctcctcagcctgcagatggcctattatgtgaccttgtgatcgtgtgacttaatacttagtaaatatatatatatatatatattccattaattctgtccctgtagagaaccctgactaatacacatgttttatgggtattttatttgtagtaacacaactctaaattatgtcaccgattacaagggaaatgatgaccattctttatgtctaacccttgattggcagtaaggaaaacagataatattagaaaaaccctaactttttaaaatatttttttagtggagagataagaacatttcctatagtctataaagggaaaagactagacttattagaggagattttctgagatgcagggaacagacattataataaacgcactgctagtaaagaaattgttttttaaaagaagaattatactttttaatatgcagaaaagaaaatctttgaagatgttaaaaattctgtaacttctgtagatgtactgagtgtaaatcataattaatttatatttggaaaggaaacagttcttaaatatacagtaaaaaccaaacgaccactatctggagttatctccttaaaaatgagcattctccctcaaaaacatttaagaaaatctgggactatatggaagacgacagctcacttgtgactgtgcttatgaaggacactggaagccaggagaaattggcagtgaacctgctttaacggaaacagtgtctaaaggcctttgactttaaacttgtccatcatctggggaatctttctagccatgttgatctaaacatttctgaaagctttctcttggaattggcttcaggactaggttacaaactagtcacactgagaaaaatcaatctcttcacaatgttttagctatgtcttatgacttttttttttaatgttgcttttggccactagagggtggattctacttattatctaggcaagtgaaaaaggaaaaaaaaaaagttactcaggagtttaacaaaagaggaggactaaaaagataagtgtggggaggggggagggatagcattaggagatatacctaatgctaaatgacgagttaatgggtgcagcacatcagcatggcacatgtatacatatgtaactaacctgcacattgtgcacatgtaccctaaaacttaaagtataataataattaaaaaaaaagaaaaaaaagatgtcttttacaaaaggaaatagatggcacagagggatgcaaatgaatctgccaggttatatttaaagaagaaatcccattccctttaataataaaacataacattcaaatatttctctacagcttgcaaattcaccaatatgtcctctataaacatatggtgtctacagtttaaattatccattgtaaagtggcctatttttcttactttttatttaaaatatttttaatgcaaatgtttgtaataccatgattaaagcaccaagattaaatactaagtataatgacaaaataatattttataatttgagttaaagattattgtgctatgtgtgtttacatataaacagtaagaaaagcattttaataaaataatcccataccctcaattgattatctagcatgtttataaacacataaaaatggctggtttataattgaggtgaggaagatgataagaaagtttagaaaagcaaaggtagacatacaccctcacattccagaagtttttcattatgggatgcacaaagatgggtgctggggccagcaaaggcaacaaatgggtgggaggggggaaaatcaaagactaagactctattatggcactttgaagagaaaataaaacctagataattacttttacacaagtatgcatactaacaaagagaaattttaaacggtataaaagtatagaagagttttaaaatgtttatttccttttaatttatttcacaatcaattggttaaatttggtttagttgacctcttagttactaatagacattcatttgaggtatccgcactcatcacacttgggtctcagtgcagtccccagaccagcagcatcaacaccacctgggaactagttagaaatgcgtgttctcaggtcacactcaagacccgctgattcagggactctaagggtagggcccagaactccatgacttaaaccctctaacatggttctgatgagcactcaagtttgagagccactaagctatagaatagaaaagtatacaacgtctcccacaatctctgactctcacaaatgcggggaaatggtaggggttgtccaaggaaaatgctacatatagtgtggttatgggattttttgtgttttgttgttgttgttgttgttgttgttttgagatggagtttcactctgtcgcccaggctggagtgcaaaggcgcaatctagggtcactgcaacttccgtctcctgagttcaaacaattctcctgccttagcctcctgagtagctgggattacaggtgcctgccaccgtacctgactaatttttgtaattttaggagagacagggtttcaccatgttggtcaggctggtctcgaactcctgactatgtgatccgtccgccttggcctcccaaagtgctgggattacaggcgtgagccaccgtgcccagccggttttgtattttaacagccatggcatctcctaagcgcgtttaactaatccaaccgcaaaacatatggtcagaacatgtaccagctatgggcatataaataaaccaacagtgaaacatatagtcaaatgatctaccagccatcggcacatggactaaaggaagctaccctcctctcgaggtttacataagggaaaaaagtaacacaaaggaatcccaaagtgacaacaaatgacgtattggaaaagaaaggccagaatgagggaaagtaataaggatatagctgtggcacaatgtgttctagttcctcactgtatgactaggagtcacacatgcctaagcggaatgaggataaacaagttcatattcaaattcgtgagggcaatttttcccacatctctgatctagcttccttaacccacaggaataatatttttgcagaaaggaatgtcagaaaatggaagatattagaagtatttaatacagcaccaagattaagattttgagtaacatacagaccagtaggtaatattaaaaataatattatagttttgtaaagattaagtgtgtttcaaattgactatcatatactagacatttgtgaattagctttttgcattcctaattatcttgccgaaaatttgctctgaaggtaatttatgttgcttatcttttaaaatatattttgaataaaacataaaagctctactttaaaaaggaaagaaagaaaaaagcataaacaatctaaggtaacaatttttgcaaaccaaaaattgggaaccatgatctgacaaagttgcgctgtttccaattatatatcagaggtggcctcatagatacatagtttggtagcaaagtatttgtgtgatggaaaacaaaatactgtgactgggattattccagaaaattttggtacacggagtccacaatgcagaccacgattatctttctggctgtatttactttcattcccctatcactggggacattcacaggcacaatgcaatcgtgtcatcctctaagctttctattagtcattgccattctcgagtaaatatgctaaatcctaaatattgttaaacaccagggaaatttctcatgatcctttaagaacagttttagaagcacacaccttccacttggccactatccctaagggctacaaatgcccaagggctgaagctgacagtcaggacttcagctaaagaatttcatggggaaattcagccttgatgcaactggattacaaagaaaatttcaaaatgtaaataaatcagaaatgacaactcaattatatgagtaaattctgaattctcttccaactttctttattaaattaaggatgcctaaacacacagcatttgttcatttaagagttgataaagcagtgaaaaatcagaagtgtgtttttatttggtgacttaagattctaggagaatatatatgttaataacctgaagggaaaaatgaaacttctttgaaataaagccaggaacaaggctcaatctatatggaattatgaggtaagtaaagaagttttctcctagacattccttatcacttgagtaggcaagttcaggggacctcaccatttcttttcaagcaaccaaagattaaacactgtttttcaactttctttctcctcaaatctgcttacatatatagagacaatttatatatatatatatatacacacacacacacacacacacacgtgcacacacacacacagacacatcacatcacattcttcacatatttaggtttaaggttatggtagattgaaaaaaaaatagctacaagttctgtgcagctcctcctatcaagaaacagagtctataagcttggccctgtgacttgctcatgccactgggacattggcaaacaacagaagaagcagctttaaagagagcatgcatatgggaccttgtgttctgttgctgctttcggaaccctacaatcgtgggaagaagccccgactggtctgctggatgaagagagacatgtggcttagttgcccccatcactccagctaactgccagcaatataagaggggtcatccaggacccggcagtccccagctggcttgccagctgaccacaaaagcatgagtgggcacatggaatagagaagagacatcccagctaaaccctgcccaaattatcaacccacagaatcacaaacaataagtggttttcttaagccatcaagtcttggaatgttttgttacacagcaatgactaactaatacaaaggttgattgccaggtacaatgtctaacttaaataaataaaaccacaaagataaacttttaggcatcagagacctggtaaaaaaggtatttttacggagtagtaaagaggagtcttctcaaaatagtaccaccaggtactacatattccttagtttagacctactttaattgggcttatccaatctaaaagcaacacctactaatgaattgaacctaggacattcactctgatctgaggcatcagaaaccatctggtagagtaaaattgaaacatgatcttggtaatcatcaacatatcattaagacttcagtccaaccaactaaggacctctttaggcaattcctataaaaccaagtgggattgtaattttttaatgattttggcaatatgtttattcacaatataaactgtttggtaaaagataaacatgtgcctaacaagttaacaacatttgattgtgattttttttaacttttattttaggttcagggatacacaggcaggtttttcatataagtaaattacatgtctcaggggtttggtgtacagattattttctcacccaggtaataagtatagtacacagtaagtagtttttcgaccctcatcctcctccccactcaagcaggatccagcgtctattgttcccttctttgtgtccatatgtactcgaagtttagctcccacttataagcgagaacatgaaatatttggttttctgtttctgtattagtttgcttaggataatagcctgtggatccatacatgttactgcaaaagacatgatcccctgctttttcatgactgcacagtattacattgtgtatatgtaccactttttaaaaatccagtctaccactgatgggcatttaggttgattccgtgtctttgctattgtgaatagcgctgtgatgaacatatgtatgtatgtgtctttcaaattcaggaaatgcagagaacacctatgaaatactacaaaagaaggccatgcccaagatagtcatcagattctccgatgtcaaaaatgaaagaaaaaatgttaaaggcagctagagagaaggagcaggtcacctacaaagtgaactccatcagactaacagcagacctgtcagcagaaaccctacaagccagaagagattggggacctgtattcaacattcaaaagaaaaaaaaattataacaagaattccatgtccagccaatctaagcttcataagcaaaggagaaataagatgctttttgaacaagcaaatgttaggggaatttgtcaccaccagacctgctttacaagaggtcctgaaggaagtgctaaatatggaaaggaaagaccattaccggccactacaaaaacacacttaagtacataaagcagtgacactataaagcggtcacacaagcaagtctgcacaataaccaactaaaaacatggtgacaggatcacatccacacatatcaatactaaccttgaatgtaaatgggctacatgccccaattaaaaggcacagagtggccggttggataaagaagcaaaacccaatggtatgctatctttgagagacccatctcacacacaatgatacccataggccaaaataaacagatggagaaaaatctaccaaacaaacagaaaacataaaaaggcaggggctgctatacaaataggattttaaagagagcattgaggcactgcataaagaagcacgtgagtgagatggaagaggaaatgctgttttgaaaaatcaatacccgctatgagttgacaatgttctgggatttaaagaaaaggttatgtatcaatctgcttcaggcaaacctaagagctctgaatcttcattaaaactgaagctgttctgtaaaagcattcagtgaatgcagcaactttcacagtgtgctttcaaactgcaaattaatgggcatgatagaaaacaatggaagaaatacagggcattgtccccaggttgttgtataaatccaaaccaatgaagaatttaaatgcatagtgaaggctacaagtccagaaaaaagtaggacatgcagcaaatctccttattggtggtctaattgggactcaggaagtagactaccataagtcacaatatatctcaaacatcacctataatggcacattgttacagagtttccaatcctccatgattgacattgacggcaaatcatttccactaagccagtcttgtgggaaggcgtgctactgaaggaacatgtcatcaaagctatctcaaagtagagaactaaaaacaacaaaagtcaaatatgaaaaggaaagaacatttcagggactataatgtcaccagagccaggtgaaaagaaacaacatcaaaggaatccatgacatataatcatcaatgcaggaggttttcagggaatcaggtggtaagaaaaattgctagtaggcattggggaccccagaaatgagaagagctaatcaagagaaactacctaggctgaagggtgcatagctgtcatgtggttatgtctgcatttctcatttgagtcacaggaaaggaagtttctttaattaggtgcatccggcaggcatcaaatcaaataaaatcataagcttcagtcacaggtagttctcagcatcaatttcaaagaagtggattgctggatctacagaatgaagcaaagacagaagaagggggctccctacctagatgcggttcaatacccttggaagtcagagttgcgcttctctgtgctgggaagtaggaaacgtctattggtcaagtatcatccattgaactataatgaaggccacctttcatgccaagctttgaggcatccacttaaagatccatctcaggagctatgctgagacagaggagtctggaatcttgttcttgtgattggttcaaacataagtgagagcccaggtttgcacctaacttggggtgtcacatgtaggcttctgaggattagggttaaaatatcacctccgcctcctgttgtttaaactctcaatgcctccattaccttatccttaaataaaagaataggaatactccaacggggggcaagtaagagaaaataagtgtcaggtgtttggcacacagtctattataaatgcagtaagctttcatagatagtcgctactctagtcaaagccagatgggatgaagtcactctctgggtcaacagagctgaatcaatgtggctgacaaatcccaatttaatatattaatttgaagtggctattaacacagctaccacttgaaaaatctggttagaatacctaatgggtacgatgtacattatttgagtaatggctaccctaaaagccctgatttcaccactatgcaatctatgcgtataacaaaattatacttacacttcataagcttatacaaatttttaaaaacagaaaaatttttcagtcagttatttacccttggtgagtcaaggccacttttgaccccatttgctatttactctgagctaacagaggctccagcaggtcccaattgcctggattcaagtcccagcttcatccttaactggctgtattgtcatgggcagagaaatgacaacaacaatgggtcccacttcataaggactatggggattcaagaagccaattcaatcaaagagctttgcccagcatctggcacttaaatagttatcaccggagtcacagaaagccaccatcaaggcaagcagtcgcttaaccctgcaagaagttgaatgtgcacccattattcaagaatgcccactatggccatttcatctcacctccagtccaactctaaccttgaacctcatataaaaagaataaaaacacaaatgtaaaaatgtcctcagtggtctttcccaagtaacggaatatccaatgtctgcgctaatgctccaccattttatagatttcaaggtggaggaccatctgtatcatttcatttgagcttcacaagccagttatgtttgtctgcattttaaaggtgagaaaagtaatgctgatagaggccaatggcacagctgttcggaggcaaagctggtacttaaattcagctcttctcaacgctaagctcaggcccctttccatccagccaaggaagaaaggcaaggcatgcaggatttcagttctaaaatccagattcacagacattctcaacagtgaaagaaaacagtgattggatcataataattttcaaccacatagtaagagtcaatggctttgttacaaaatagtggtagggaggtccccatctgaccctccagggccataagcttgatgagaatgttctgatactgtgctggcagggctgcaaaacgagctgtcctcagaaatgcataggttagtgacgttaagttgttaccagctgccatttgcaactttcattccaggcaagatgacgtaaaatgatttctgctgtcctcacagactctgctaactcctatttttagtaggcaaatctcacaccttttcaacactactgcagcaaagaatgagttctgaatgatttgaattttgagggaaagtcagggagtggtgggagcagaaatcccttacaattaaagaccagttcattaacgttttcatacatatggattaaccaatttaagtgaggtgaaaaagcagccttgtgaatagatttgtaatatcaggaatctcataaaaatttcatgctccaccagcaagtgcccttggcttaacagcagtgtccttcctccccttgtattaatttctcaggtcagaagcctaaagaaggcaaatatcacgaattctacctgaatgcccccacaacttacaatcaaacaagatgaagatggagaatggctgtggccacagtttggaagcatgcttaggaaaggtaccttagcgtctggacgtctagtggagcctgactcagctcctcacgccctgggcagtgccctctcatcctcctccctcccctgactcccaggataccgccctcaccctgcaacctcccgacctcccaactcactgctggctcctctgccctctcctgtggccactactacctccaacctcaaagcaagaactctgcaactctcttccaattttttcccctttctttttacactctcaccctctcctatcttgatggcttccatgactttctctagcatccatacaatgggaactctctctatattttttcccctggtttcagtcttgttcccacattccagccccaagtaagaaccatttaccgacacatccatgttgctcagcctgctgtacccaagccctaaagagggtgcgtatgcacatttcccatttcctctgaatcacccagaggggtcctttgactccattcacacccttgttccccgcatccaactgacaactgaaccctgatgatcccgatcctcacataaacgtttaacccatcctttcattcccacacacaagttcatgcctttatttctattggtacttgctagaagatctctatcttttcatctctttttgaccataatatatgccaaatactatgagaataatctgtctaaaatacatatcagctcatatatacccaataatgccaaatgtctgcaagtcttcttaatccaaactccttagcatctacattctccccacatgtgtccccatgagcattttcagccttactacctattgctgcatctaatgcatcttatcctgcagcaaactggatccactcttctttgaactcctcccccatgacccaggacttcccccacgtataaatccaaacaatatttcagtgtccaactcattggaaattctgaactattgttcagaattttatatgaactattgttcatataaaaattcaatcaattgccatcctcaatacttcaagcattttaattaattaagttctgtcaatgcccttcaaccaaagactactaaggacacacctgtagttgaacaagttgagtttattacccattgcagttagagagactgcacgccatgggaatcgtggagtgtctcaattagaaggtgttagatgggatttattataggatttgaactctggttaggttatttggggagatttcactctagagtgaatgctggatgctgtcagaaagcaggagcaattcttatctaaagaatgggaaggctagagcaagaccaatgctgtatttggtaaagaggaagctgtcactctacatatgtgacactaagaactgagagaaagtggatacttggtattttgcgggttgcagggtgaccttgtttttgtattggacaaaattataaagtggtcttgttttgcctgactctatcatagcctctgaatggtcatatccaatatccgtgttatgtggaattgttgatgttcttaagtccagcagaagacatcatggcccagctgtaagcatcagaccagctcctaacgacctcaaggtctacctgtaagtgccaagcaagctcctgacatcagcggctgctcttctttttctcagttctcagcatcatcatgatgtcaatatacagatttaaacattctctaaagcagagcacagattatgaagagtaaagcaaactctcccttgctacagatgcagctgggtgatcaggattccatttggggtcccaatggtgaggtgggcatcatattttggaatacagaaaaggaaggacatgagggcaggattaggatctggaggaaaaaggtaatatattctatacaatctacaactctcaagaatagtgtgatatgcagatcagaaaccccctacagcatgttaaatataagaatgccttcatcggccgggagcagtgctcacgcctgtaatcccagcactttgggaggccaaggcaggcagatcaagaggtcaggagatggagaccatcctggctaacacagtgaaaccccatctttactaaaaatacaaaaaattagctggttgtggtggtgggtgcctgtagtcccagctactagggaggctgaggcaggagaatggtgtgaacctgggaggcggaggttgcagtgagctgagactgtgccactgcactccagcctgggcgacagagcaacgctctgtcttaaaaaaaaaaaaaaatgctggtaaactagataaagtttttctggttaataacagatgaaagttgtccactatacttactatacttatccaaaaatgtaaaggcacatgggccttagtgagctaaatgtcttcaaacctttgcaggtatatttatttctttattgctgttcaattgctattaaaatcctgaccattaagtcttatccttgatcctgtttccagcaaatattatcggactactgatattttcaggtctgagtttaacagaaggagcagtgtcaactgtgtctttcgggacatacagaccagaaatgcagctcacatgtaaggcatatgtagaaaatacaaaaaaaaaattacatctaaaatccttacaaatataattttctttcaaaaaatttcacttggaaaaagtctacatttcctttggtttacagcctattatatatctggatgatctaattgagttaccagccctttggtgaagaagaatgggcagaggaacttggttggcaactgtgccatgtctagtctgggatttcaactgcagttgaaatgatgagcatcttagatcttgcttgttaaaaaaaattataaacatatttccacgtaaaaatctccaatgccctgtcccttaaattcccttaaatagtaatatgtgaggcacattctataatggcagggttaattcaattccacaagtttagagtaataactcaagtgcaaactatcttccttcctgccagggactccttccaataccggtcatgtacagctattatctgcagaggccaccattgtattgagaacacaagcaatactgtggctcccacctgcaggggaaatggcacccccaccccagcgagttccacctcatcctgtttgtagcagctccaagttctcactttcttcagcagatttcaatttgcaatttttaagagaacgggtagcctatcacttaacactgtcactggaagataacatttcagtaattactcagtgctgacattttattatttaatcttaaaatcccatcagaaatccctagcccgaaaagctacaaacgaagtttgaaaataaaacacccggcaaatctgatttgcagtaatcaaaatggcattttgtcagatgggaactaattatcaacctgacatgacttcaatctgctgccattttatgaaatgagatccgtttgctctctgtaaagaagatcagccttgctgctccatagctagatgcccaatttcacctattctcgtgagattcttccattatgcaaactggtgttgaagcaattacatgctccaaaagatgaagacgagaaatttcacattcacagacttgtcatgttcacctcttaaaatgtaagttcttgcctggtgttaagatgccttttttattttacacagtcacctaacaatctgaagaaacatcccctctgaaggcagtttcagctcccaggttcaacaagagggccctgtcacgattacaaggctctgctttgagactgctgaacaaatgaagggatcatgttcattccacgaacagaatgcacacgtcttcaggcttttcaaggctattaaggggctactgctggaccacagacaattatcaagtcaaacgctccaagtgggcatgaatgttttagcagagaatagacggaaggaaagtggaaattaaacaggagtgatttcacccccacatagctcgagaatcctgctggaatctccacggacagaaagaaagaagagctttcactagtccatgccaggaaatgggctgcctgcctctcatttcatgctctgacatataactctcctctcttttctgatagaggggaaaactgagtcccagagatgcctgtaaatttcctatggttttagtcaataagcgaggatgttagagaggtcctttctaccactctcggctgcctctcccaatgtggaaagagaaacatcaggcagtatattttctatttggttgcctcacacgtgttgaaaaactctatttggtattattaaaaaacactatttatctctaactcccttcaattttaagttttagaaatcaactaactataagaaaaagtttgggtcaggcatggtggctcaggcctgtaatcccagcactgtgggaggccgaggcaggcagataacctgaggtcaggagttcaagaccggcctggacaacatggtgcaaccctgtctctagtaaacatacaaaaattagcagggtgtggtggtgggagcctgtaatcccaactacttgggagactgaggcaggagaatcgcttgaacccgggaggcagaggttgaagcctgggcaacaagagcaaaactccatctcaaaaaaattttaaaaaagaaaaagtttgatataattaagaaaagaagtcagaggagaaagggaggagaaaataaagttgttttctggtcttacaatatttaattcttctttgtggggcttcacagagagaacggaactctcaggagacaggtaataaagtattaaggaagtttttgttcagaatgctgctgaggggtattttcacatgtgttacgacatccagagcagagctgggaacagcgtgctcgtgagtcagtacgtgagtaagcctctgttcttccagcacaattgcagcttgtttagtttgcaaacacaagttgtctcagtgatccacattcccaataggtaagggccagcgccacactgcctcctcccacaggacacgcagctcacagcatgtgagcccgaatccacatggaagaaaactggaccctctgaggggcagctattcctgtctccaccctggctctgaaggagagcatggaggtcaaccaagaaaaatatcctcatgtcaaacacagtggagaaactgtttcacttcaaggtttatgagatccaaaaatgttactgcgatagttcatttcgggtgtcaacttggctaggccatggttcttagatactcgctcaaacactaatctagatgttggtatgaaggtgtgttttagatgagattaacgtttaaatcagcagactttgaatgaagcagatgactctccagaatgtgcgtgggctgcatccaaacagctgaggaccttaaggacaaagactgaggtttcccaaagaagaaataattcagctcaagacacaacacagaaacctcgcctgagtttccagcctgccagcttccctacggattttggacttgtgagtccacacaattgcatgagccagttacttaaaataaatctctctctctctcctcgctctctgtctcctgtttctccggagaatcctaactactaacattgttacaaagcagattaaacagccctattccctctgaatgtcagagcagagaggaaagaggcacttggcaaaatatcagttgcttagaaaatcggggaattaagagtctatgtgaaaaaaggcttttcaacaccattcaagtgccaaattgcatttctcagtaacttgttgagttattcgttgagtatgagacatgccctttggaagttccaggccaggcactggagcagcaaaaccagggacaccggcattcgaatctgggctcagcccccattctgggtgtgtagccacaggcacatgactgaacctctagaggcatttcaaaccttggtgtaaatgtgacactaaaaagaccagagatgtgaagcacccggctcagaatctagaaagatcagtgctcactaaatagtggcttagggtgattgctgctgatacaaaagctattaataaaacacagttcctcccagccctaaggaggagagagacacatacaaggataattaatgttctgtttccaagaccacaaaagtgatattgtaggtgactgtcggaacccagaggaagggaaactgagtcagccccagaagtagaagtttgtacagtgaggtggggtaacggggagcacgcattccagctagaggccattgcaccagcaaagccagggtcaagccaaaccagatactggccagccatactgactggccagggagatgtgtggggattcattgtgctgggaagctttctaaagagccagctcgtgtaaggatggagacatacacagaatagaaacgagaggaaagggctgccccgtgcattcctttctgactacactagtgggttgtgcacacacaaaattttgactagtaatcactcacttctaggtatcaaaacctccataattaaaaatctgtaatgcaaatgcagaaggcatttggaaattaaatggtaaaagttttaaattcttacatagggagccagtgatataacataatgtgcatagagtaacaattttaatagatgacacaattctgaatgtattgcaccgtgcttttcatgcacgttaagatgaaagaagatattctgttaacttaagcacacaatagtaaaagatacacaacacagtgaaagttctgcagtgacttacagtaaattgataaaaatgcttagcctgtgatgagattaagcctgttttcaattttctttattttgcttgttttttctacaatgaatgtgagttgatcatgaaatgatgaaagagtatttttttaaccctgccaagagtaaatctaaaaaagaaagtgtgtcataaatgagtggaattcacttttattcacaagtatatcagtaagtatacttacttacaagcataccagtaagtataccacttttatttacaagtataccaagatgcaaaagaaaaagtaatggtcttttgagattggtttgagattgagaaaaggaagatgtactgtgtaggggcggtacccacctggatcacagaggcatttgtagctggtgcccacgctgcggcacgtgccatgagcacaggggctgagggcacagaagtcaataagctgggcacaggtcggccctgtgaagcccgggctgcagttgcaggtaaagtgtaccccgtccacatagcaggtgccgttgttctggcacggagacgaggcgcaggggtccaccttttcttcacaagcagatccgaagtatcctgtgaaaaaacacatgagagcttaaaaaaactaaaacacatttgcacataataactaatcaactgagtctgctccactgtatatgcataacaattaattcattcacagcttccagatatgtcacaacccaacaagataggtaggttgtttttcccacctttagtaatgtagggttaaaaatattaagccccacaattccatttttattgaaatataaggtatatgactgtttaggagtacatacatacgtgtacatgaatatatttatgtgcacacatgtgtatatgaacatgtgtgtatactctagaaatatatcaaaaataaattaatggtaatttcctaaaggaatatgggatttggatcagcagagggctctcccctcttattttgtatatattaatggggaacacatttcttattttgctttaatagatatgacataatcctgaattcaaaaaattaaaaccatatcaaatagtaaacaatgaaaaagtctctttttcatccttgtccctttgtctctaattcccttctctacaagcagccactgttaacagtttcttgaatatatgctttttaaaaagttgattgttgtaagagaaacaaaagtgatctacccacacaatgaaataccactcagcaataaaaaaaaaaataagtactgacacatcgtatgacatgaatgaatgtcaaaagcattatgctaagtaaaagaagctaggcacgaaatactacatattatataatcccatttgtaagaaatgtgcaggaaaagcaaatctgtagatacagaaagtagataaatggttgcctatggctgggccggaaagaggagttcactgcaaatggacatgaggagtccactggggtggatggaaatgttttaaacttggattgtggtgatagctgcacaactctgtaaatttactaatatgctttgaactgtactttcaaatgaatgaattttataatgtataaattgtacacttaaataaaattttatgttatataaaattatgtaaggctgttaactttttcttttaaatatggttactgtgtaggtgatttttatcttgtttcctgtgtatctgattcagtatttcttgttaaaaaattatacatgtgcatatgtgtgggtctctacatctgtgcatacatgtaggtatatatgtttaacaatgctttccataaaactatacttctttcaatactttaagagcagtttgaaaattaaatattattcaaattttagaaataaaagttaaataatttcactcacatatagtttgtattctaatagtctattacacgtctcttgtttacatttaagtttctatttactcatcttcttatagaactcctagcaatactgacaatttttgttgttgttaaggacacatttaatatgtaaacaaaccaaaataactcccagatttaattatgtgaagcaccactcataaattggcataatcaacttggtatttctctgtgcagtatagaaatataaaattatcctccaaaaaaatccaatgctattcagcattttataaaattcctggtagcttttaaatcttagaaatcctactaaaaatgtaccatacaatcagttttaataacacttgaattctccaaaaagtttcttggcagcctcaagtggaatataattctacccatcatgagatatgttccattttactctgattgaaaagaagatacttaaacatttttcaacatatgacagtactatatgttaccgtcactatttaacatgatttcaaaaataggatttaatatctcaaatcttttaattttagacaataaaataatttttatctgtctagaaaatgcagcatagctgcttaaaatattaaaaggcccatttgatttcctcgagcatgacactaaaagtcattcaatatttttttcttaatatgaaggaataattttgagaaatgaattgaccaagccaccctacagcttgcatttagttagatagtgacccaagattgcatcttatgacttgagaggaaaaaaaaatggtgggggtgggcggtggccagtggggagcagtgcaggttctaggttaaccttgtggatgcactgatttctttacaagaaattcaggctcatgataaattccatacccaaggctgggtaccagtttgcccaaatcagcagctcaaggtgaatcagaaaatcataaatgttaatgctcagaaatagaaatcaatttattttattttattttgttttgttttttgagacagagtctcactctgttgcccaggctggagtgcaatggcacaatcttggctcactgcaacctctgccttcgggtcaagcgattctcctgcctcagcctcctgagtagctgtgattacaggaggacaccaccacgcctggctaatttttgtatttttagttgagacggggctttaccatgttggtcaggctggtctcgaactcctgacctcgtgatcaacctgcctcggcctcccaaagtgctgggattataggcgtgagccaccgtgcctgggcacagaaatcaaatttaagaggacattttgattatttttgttcctccagaagaactgaactaatgatgacagaaggtgacagttgagaactgtcaactctgtcaactcttttagttgagaacacagagaagagaagtgatcataggaactgtatccttgaaaactctatgagattaggtgggtgagaacttgatggaaagaatatctagggagggtcaaagataagaaaaatcaggaacaagaagcttatacctacgttaggagcataaaaatgaaaattacttagaactactagaacccagtagaagagttaatattaaatatagttctcagtggaggttgatagttaagcattggattagcaatgtcatgggttaaattgcgtccctccaaaattcatattttttaaaattagctttctctggttgagtaaaattcatattttgaagccctaactctcaatacctcagaatgtggcttttcagggatagtgcctttaaagaggtgagtcagttaaactgaagttgttaggttgagccctaatgcaatctgactggtgtctttataagcagagatcaggacacagaaaaagacaccagagatgcctgtgcacaaaggaaaagaccttgtgaggaggaagcaagagggtggccctctgcaggccaaggagagaggcctcagaaaaaatcaaccctgccagcactttgatcctgagcttccagcctccagaactagaagtagatgaactgcttatcagcctccaaagctagaaaaagatgtctgttgtttaaacctgtagtccttggtcacagcagcctgagaagactcatacaaatagggagcataaggagacagggaagcgataattaggatcttgtgtttgattctgtgttcaccaccccagcagtctgagtgaccatggcaaggccccctttctcccatcgtccactgcctctacctggaaaacagggctgaaactgttttctttacaaagtcactgtgggttctgaaaaaaatacatatcaaacttcctagtacggttcccagtccaaggctggaagaatgaatgaattaaaaatgctaataataacagcaacaggccaggcgtgatggctcatgcctataatcctagcactttgggagactgaggcaggcggatcacgaggtcaggagtccaagaccagcctggccaacgtggtgaaatcccgtctctactaaaaatacaaaaattagccgggtgtggtggtgcctgcctgtaatcccagctactggggaggctgaggcaggagaatcgcttgaacccaggaggcggaggatgcagtgagccgagatagtgccactgcactacaggctgggtgacagagcaagactctgtctcgaaaaataaataaacaaataaataaataacagcaacagctaacatccactggaggctgatttgcatcacctggttctaaccctttaggtgaactatttcatttaatcctactattatagtaggatgtaagaactataatagccctatcttacaaatgtgaaaacagtgacatgagaatgtgaagtaaccttttcaagtctaaatagctagtatatggcagagctgggacaccaaggccaagtgcttacacgtctcctacactgcacagaagagaagtgaatgaccaaccaattaagatgttatgatgtgtaagcaaaaccaggacttatgtttctatcctgtttgtgtcttggtgaaagaatagaggatttactgatcaggtcaaaataaaggaaaaagtgaattttagaaaggcaatcactctagctttatgtcaatatactcagttataaatagtaatataagccacacagaatagtccaagtagaaataaaaatgggtaacaaggagacataaagggtcatggctttggagagagccaatatttcaataagaagagaagtgcagaaaatgaataataatgagagcactggtcaggccaggtcacgactggtcttatatgttacacttgggagcttacatttcattctgaggctactggatatcatctattttcattatttatatctctaattataggcaatgtggagagggaatcagaagaggttgagaccggaagcatgaaaccagttgtttactcgaataattgaggttgtgaaggccaatttgtagcaataaacataaagaatgtgaaatatattagagcatgattttataagtaaaattatcaattcagggaccacttggactgtagaagaatggaagagacgacagagcccagagacacaatgtaacataagtcaaaaatgcaaatgccagcaggactccggtagataatgttgatacagagggtggatcaggtgtaatacaatagggactggcagggtctgtggcaaacgggagaaagcatgccccttccaaaaaagacggccgccataacctgcagccaatttgaaacatggggccaggtaccatatcttctgagtgttcaagaaaagtccgaaatccaaattcctgtttgagccttgtctattttattattattttatttatttatttatttattttttgagatggagtcttgctccgtagcccaggctgaagtgcagtggcatgatctcggctcactgcaacctccgcctcctggattcaagcattctcttgcctcagcctcccaagtaactgggactacaggcacttgccaccacgcccagctaatttttgtatttttagtagagacggggtttcaccatgttggccaggctggtcttgaactcctgacctcaagtgatccactcgcctcagcctcccaaagtgctgggattacaggcgtgagccaccacacccagccaaggcttgtcattttaaactgttgataaataatttctccagcaaataaagcatatgtatgggccctgtatatgtgtcttctctgtgtgagttaatgttaaagagctttgaaccaaggggaattggatttaaacaccatctcagcccactaaactgtgggactttgggctagtacttaatcactctgactttctgcttttgtatccatgaaagaaagatattaatgcttacaattttcatttcttatgaagcttaactgcaaaaatctatgcaaagcacttggcacagtgactctccaattgttaagtgttaataagaagcagcaataattataatgtaatttccaggttttcagatggggggacaatgtggatagtgttgttatcaaatgcagtggaaaatacaggaggaggctgctaggggagggttatgagttcagctttgtgcaaagtgagttgagatgcttttgcagttgttcaatagtcattaaatatgcagaacttgtgctcaggagagaggtatgaactagactgttgactgggagccatatgcacatggatgggaattggattcatcataggtatacatgacaccacttggggcaaatgaacagagagacaagaaagctcaaggctggaactctgaacaactgtagctcttgtgagcacaagaaagaagaggaaaccaagagcatgtctcattgagagacctctcctcttgttctgcagctctctgtagatctcactctctcctagcacctaccccaccctttctgcctcctccataagtggtctctgattttcttgagatcagggaatgtaacttacatgtctttgtatccctgttgctcagcatgaagcttggaagatggtaggcatttgaccagggacagataaatggacagacaggcagacagacggatggatgaatagacagctagctaagtttcaagaaagaaagaagttgcagggtttggtcaggaataaaatatattaaaaaaaaaaaaaaaaaaaaaagaaagaagagaaaccaggagagaaaggtgtcactgaaaacaatggaagagagaatgtgaaaaaatggcactgaaccttgcttgtaaatcacatgcacaagcccacgccagcctgctgcaagatgagagacggcatggagcaaaggaagctagcacagccaaggccattctagaccacttgacctccatcagtgtggccagtgaccagctaagcttgcccaaattgctattgcaatgtacaaggactatgagctaaatgagtggctgccattttaaccactacattttgggggtggtttgtcatgcagccaaagttaactgataaaattaataggagctacaggattgtatctatgtgggaatacaggccagagggagatttttgttttgctttgctttatggaacagacttgaaagagtaattgatcatacactacaggaaaatttcactaaagagatgatcaataaatgtttgttgaattgaatatcaaaaagtcccactgctgttgaatcaaggatcctgtgtttttttattattattaaaattttgctttttcttatcaattcaggaaaatataatgcaggatgagaatggaactaatacttaatattttcagagtctgctagcatacctcagtatacatactgaggagagaatacacttttggcatattatccagtctaaaaaagaaagtggaaaatttcactaaagagatatcaataaatgcttgtagaattgaatatcaaaaaggcccactgctattaaatcaaggatctgtgttttattattcttaaaattttgctttttcttaccaattcaagaaaatataatgcaggatgagaatggaactaatacttaatattttcagagtctgctagcatatctcagtatatactgaggagagaatacacttttggtatattatacagtctaaaaaaagaaagtgggatataaaatgctcttctgttacaaagaatgacaaagcaaaaagaaaatgaatgcaaggtatatctgaatacactttgaagagatgaatgtgaggtacagcaattatgagataattttcctggctcacatgattattaatgaccactagaaaaggaatgccagacttaaaggctgagtcacttttgagatgctattgctttaacgagtaaattctccatttccttctatcagctaagctattatcttcttgttcatatgacatccttttacaaatgactcacatctccttcagccaccctctaagtgaccttcctaagagaagcaagaacaggttttataattcaaagaatgcagagccagaaaaccaaagtttgaatcttcttactaccgtgtgacctcaggcttaatcattttttctctaattttcttacctacaaaatggtgttggctcctaccatgaagtcaagtaaggtgacacatgtggtcaataaatgtcggattcttttccctttaaacggtggttctggggtaatctcaagttgcccgtataatcagagtttgtggttagagaaaggaagctggcctgtcagtcagtctgtggaataccatccattttcacatttgtatgaatcccacagggtcatgaccctggatgtctataaacggagatttctggaattgggaggtgctcacatactgctctctaaacacacgaacagttactgggccatgcagtgatgctggtgaacagaggtggggtcccagggcagacagccgtggcaagaggtgggaggtaggagtgtccctgagaacatctctgtacaggctcgaaaggacaatctgctgaagttgtgtttgttaatagcaaacacttgtatgtaccaggcactgttccaagggttttaaatatactaagtcatttaactctcacatcaatcctatgagataagaactatcatttccccattttcagatgagaaaatagggatagaaagatcaagtaacttgcccaaagttacacagctagtaaacggcaggtttgagatttgaacccaggcagtcagattcaggtccaagctcctaaccagcactctgtgctgtggcacccaacacctggggtatagcagtatattagtccatttttgcattactacaaagggatacctgagactgggtaatttataaagaaaagaggtttaattggctgacggttctgcaggctgtacaggaatcatggtgccagcatatgcttctagtgagggccgcatggagtttacaatcatggcagaaggtgaaagggaaagctggcgtatcacagggtgagagcaagagcaagagagaaatgcaggaggtgccacacacttgtaaacaaccagctgtcacgtgaactcagagtgagaaccaaggggatggcactgagtcactcatgatggatccccgtgatccaaacacctcccaccaggccccacctccaacactgggaattacgtttccacatcagatttgaaggggacaaacatctaaaccacaccaagcagaaaggccaagaatgagagggcaggtgctccagggtctgtcaggcctctgtcccttcctgaccatgtgtatcagaaactactttttgtcctaacatccatctctccacttcccatggtcttacacttctggtcacatggcaacatagaacaatgtctacagggaccagcctcttctgcagctacatgtacatctgtgatgaccttctgaataacagacacaagtgaaaatgtcctgaagtcacctctatagaaaattccttgaaagaagttggcaagcaccctttgctctttcactattttcccccttcatccatcctaccatctagaccacacagatgatgaccgagtttttcctaagtttggtgaaaaacatctacccatacacaatatgctcagtgaaccccagggagaataaatcaaatatacaggaatgtcacagacaagctgctgaaaaccaaaaattgagagaaaacattaaaagaagccaaaaagaaaaaaaaagacatgatacacacatcaagcaatagtaagattgacagatgacttgtcaccaagatctacagaagcataagataacaaaatgacatctttaaggcactggaaaaataaactcgtcaaacagaattctagtttcagggaaaataacttctagtaatcaaggttaattaagatattttctgataaagaacagctgagaaagtttgttgccagcagatctagccacactacaaaaatactaaagaaagttatttaagctgaatagaaacaataataggtggaaactcaagtctacaggaagaaattaagggccctagaaatggcagtctgggggagtaaatattcatttttttcttaatttcttttaaaaatggttaaaagcaaaaagaacattgaattatgatgttgtaacgtacatagaaggaatatacataacaagagaacaaataataagggaagttaatagaattttactaccgttaggttcttacattttgcatgaagtgattaaatattgattctaagtagactctcataaattaagggtgtacactgtaattcccagagcagccactaaaactaaaacagacgcaacaaaaaccccaaaccaaaaaacccagcagtatagctaagaagccagttaagaaaatagtatctttttaaatattctatttacccacccacccccaccaccaaagagggcaggaatagaataaaacaaagaacatatgagaaaaatagaaaataaatagcaatgaggtagacttagatccaatcatatcaaggttatattgaatataagtagactaacaccccaattaaaaggcgtagattgtcagactttatttggaaaaaaaaaaaaagatctaactatgtgctctctaaaagaaacccactccagcataaagacacataaaaatggaaagtaaggacaggtgcggtggcttacacctgtaatcccagcacttcaggaggccaaggtgggcagatcacgaggtgaggagttcgagaccagcctggccaatgtggtgaaaccctgtctctactaaaaatacaaaaattagtcaggtgtggtggtgtgcacctgtaatcccagctactggggcggctaaggcaggagaatcgcttaaacccaggaggcagaggttgcagtgagctgagatcacaccactgcactccagcctgggtcacagagcaagactctatctcaaaaaaaaaaaaaaaaaaaaaaaaaaggaaagtaaaagaatagggaaagatacattgtgaaaaagaaagcataagaaaactagtattctctgttaaaatcagaaaaggtagacttcaagactaagaacattatctgacataaaaagggacacttaatatgaaaaagtgagtaatccaacaggaagctttaacaatcccaaatatgtaggcgcctaataagagagcttcaaaatacatgaaagaaaaactgctagcaagagaaacagaaattatcagagaagaagccctttcttagtaactgacagaatcaattgacaaaatgagctagtttatacaatagttaaataacatattcttttcatgtgcacatgaaataagtcattttaatagatacagaaaaattatttggcaaaattcaatatgcattcatcatttttaagaagaaagaaaaactctcagcaaactaaaatagaaggtaacacttgctgtatcttttagggtatatacaaaaaaaaaactatggctaatatcatactcaatgatgaaataataaatattttctccctaagatagagagcaaagcaaggatgtctaccctcagcatttacattcaatattttactggaggttctatatatgcaaaaaaaaagtaaaagaaataaaaaacataaagtgtagaaaggaaaataagacttattattcaacaatctacgattttatacaaagaaaatccaaagaaatctaaaataaaaatttggggaactaataggtaaatttagcaaactgtcagcatacaaagtcaatatacaaaaatcaatagtgtttctatacactagtaataagcaactggaaattaaaaaatgttttactggcatttataatattatcaaaaagcataaaataggattaaatttaacaaaagatatgcaagatgtctacactgaaaactataaaacattacttgaagaaattaaaaatacccaaataaatgaagacatataccacgttgatgggttggaagtctcactattgttaatatttaagttctattcaaattgatttactgcagtactaattatttggggatgcctattgtttataactaaatcaaattctaattgataaattatgtcagcgcaatcaagtaagtagctcttatatgttttatacatctcttatatgtctgttatcttatttgttaaaaatggaaataatagaatagctgtatgcatccagtagttatagttgtactagtagaaatagaagaagaaagaagagaaattgttgtgttaaaagtaatagaaaaattttattgagttcttactacatacgggacattatgccgagcaattggtatctattctttcttacttatcacaaccactggctcaggtaggttctaccaccatctactttttacagacgaaggttcagagacttcgctttagggaactaacctagaaacactcatctagtaactgggaaaaataacattcaatcaggtttgtctgactccaaatctgtgctcttaagccccaatctatttgctgcttctcacaagagagttcgtgtgaaagcatttgacaagtcgaaaacgccgtgctagcatatgaaattatgttcagatcagctgggcatggtggtgtgtgcctgtaatcccggctactcaggaggctgaggcaggagttcaagaccagcctgggcaacatagtaaaactccatctcaaaacaaaaaaaagaggccgggcacggtggctcacgcctgtaatcccagcactttgggaggccgaagcgggtggatcacaaggtcaaaagatcgagaccatcctgtctaacatggtgaaaccccgtctctactaaacatacaaaaaattagctgggcgtggtggggggtgcctgtagtcccaactactcgggagactgaggcaggagaatggcgtgaacctgggaggcggagcttgcagtgagcagagatcgcgccactacactccagcctgggtgacagagtgagactccgtctcaaaaaaaaaaaaaaaaaaaaaaaaaattatgaaatttgagtcctaaggaataaacatgtgctaccaactccttataaaatcagaactcttaaaataattcagatatcaaattaagagccaagatgtttatgtaagaaactttaagagaaaatcataaatgttttggtgttacaagctaatgtgtaatgttgagagctttttaaaaactattacaagccaatgtgtaatgttgagagctttttaaaaactaccagcatacaaagtcaatatacaaaaattatatatgaaatatataaattattatttctttttagagctgattggttttaaatacaaacctaaagccatattttcaggagaactttttttcataaggatgcacaaggcaaccagttcttacactggtaatttataaaatctaacacaataagaaacatctgatgacattataaattttcagaacaaaaattatagccatcaaatttgaatattagtttttaatattcaagatgcaggcatagcctactaatctgctgatggagaccagacgttggttgattggtggctcttagctacaatgcatgttacaggtttgttgatggatatattttgaaattttgagtcaaaactagcttgtcaacctgatagtgatcacaagaaggtcaaatgttacaaacatagtttcaaaatttaacggagaccacatgtgaaacaatgtatattcagaagaagcacctgtgtaagtgatcccaaactcagatacagtactatgtgagtccgattcccccttgtagaaatatagaagtctgcaagtcaaagctaaagcaaagatgagtaaacgcatccctgtgttggagttacagagtgtagggcagtaggatgagtgctagtaaaaagacattttacaacacaaggtggaaaaggctttgggtcatctgtggctgagacggtcagaacagatttcatcttccccaaaaaattctaaaaataaaccaatattctcattcactctattttctcctttccctccttctctctcaatataaatatacagacatacattatatataaagagttttcaattcaatctccagacctagggacctctctgcattgtcctgttcctacataatgttataactctaaaagaaattatttgagctagcctttggtaaagtttctctttttattagcacggctctttaagagctctgaccggtcaacctagtaataatgatctctcaaggtaagtgttttttttaaaattccccttatagaatatgcaaattaaattagttatggtggcaaagggtagagaattggaaaaggaaatttaacattcctgggttcaagcacattcatggacacatttaacctccaaaatatgaaaaacgatagataggagaacaaatacaatactgctacgtagaatgatgtcatataaataataaaaataatagtagtatttatgaaatgactaaaggattaataagctataacagaggaataatatacagtcctaactggaagctaataagcaaatatatttggatttacaatcttccttgaagagtagaaaatgaaaaactatttggtgatggtagccaaaaagtgcaagcagaaagatgaacatagtgatatctctggtgtgcaatagtgtaattcaaatgatacagacctaagatgatggacataaggaaatcttggaaagaaaacacaacagctccagagaaaaggtctatttcaaacacatggaaacaatggcagcagccaagagatttcaaacaactgattttaaaacaagggaaaagtttagaaaaggatgaaagattaaagaattacaatggaaaataaacaaaatagaattacaaaagaaacctactgaagaggaatgcaaataaagtaatttagctagttgactttccttcaaattttgtgtttgaaccaatattaaagtgaacattactgctgaattatttattatgtaagtagaaagaaatcaatacccttgagatacacccattatggaatcagatatttaagaccaaaagaaaacatttctggaagattttaaattgcaagacaatgaagtcactctatgtattgtcagaaagcaatagaggtgtcagaaatttttgcaatactaaaggaaaatacagaataaagtgacactggcattttttgctgacagggtaaagacaattcacatcaaagaaatgatgtgtataggcattttaaactcaactcagcattccattgccttggcaaatggctccagtcagaaacctaggagtcatacctgattgtttttcttctctgaacccccatatccatccaattagtggatcttatagacactatctccaaaatacatcatgaacccaaacactttcttgcaacttggctgctaccatcctagccaaagatacaactattaatatttcgctcccattataacagttttctcttatgagattccctgtccatcttacccctacaaccaattctccaaacagcaataatcattttcttaaaatgttaatattatcatgacttccagtaattcctagaataaaatttgacctcctttccataggctacaagtcctgtgggctctaagcgcagctcaccagtcttacgccacatgcttcagaagctggccccactggcctccattcagtttccagaaataacaagccattcctcaccttgatccttgccacatgccatttccactgtccagaagctgctgctcctacctgcttacagagttgactcctccttatgtcttaatttttgacataagtgttagacaagcaggtctctcctgatcgcctcatcctaggtacatatccctttcttattctgtatcacagtaccctgctcacccctttcatagcacttttatttgcaatgaaataggtgtgtattggtttccctgtttatcacctgtttcccacccagaataagaccacaggcttcctggaggaggaaccaggttctttcctctcaccattgtgccttggcatccagcacagtgtctgagctatgggaagtgtgcagtaaatgtttgtggaataaatgagtggattaaatgaatggtgtaatagagaacatattccaacagatttgcaacacaatatagttaggaaaagcaaattgacaaatatggatggggttttagaaattacaatgagggaatatgaaaggagaaatattagtcattagatgtttttattacagatatataaatgaataatcactagatcaaaatgaaagtagaaaatatatttatttattttgtgatggggtctcgctttgtctcccaggctggagtatagtggcataatcatggctctcagcagccttgaactcctgggttcaagtgatcttactgcctcagcctcccgagtagctgagattacaagcacttccaccacatccaattaaatttcaatttttttatggaaatgtgatctccctatgttgcccaggcttgtcttgaactcctgccctcaagggatcctcgtgctttagcctcccagagtgctgagatcacaggcattgagccgctgtgcccagctgaaggtaaaatggtttatgaagtattctgctgcgtagcacgggaaagcaaggagaaggaagaatcctgactctcagagagctcattcttgtacagaggagaccagaaggacatatttgagataatgagagaacacgttgaggccatttttccttcctgcaaacattgatggaatgattccagcctggcaggaagggttgaaagaccagcccagcctgtcaaaatggaatcagtgtgcgtggcaccagctctaactgtggcagaaattcagaaggaagaaccctatgatgtgtgcaggtcagaaaaatctcatgggacagttggcttttccaactgggcctgaaagaaagcacaggagttgacttggcagaagaggacaaggagtgatgttcaaatcagagaaggggttttggccagtgtgtatggaaaacttaattgggaccacatttgttctggttctaagaaagcagacagttatgcaagataaagagaaaggggaatatctgggaaaatcaattacaaaatcatcagctgtaaaagacccaataggattgcattttaaatgtgactttgaatttttaagaaaatccatttgagagagtaaaaaatatcttaaggactttttcttgagcagaacagaaagtcaaagttagatttaagacaggaaaatgaaaaacagctaggaaatcatcagaagaatgttaaatcaactctcccttaatttggaatacatagaagggcataagagataaaacttatttaaaggatatagttatgtgaacaaaaataattggctattgacaatggagatttaaaggtttggtcagaaggtctgcatttccctctgggtcttcatttatctaacctagactaattgggagcagccatgcatcaggcactgcttcaagactttccattctagtgaggaaaacatactataaaaaaacaagtaaataggtatcctcagtcagggctacaggttattgaagcagggtgcggtgggtagagaatggtgggggctgtgtaagatagtggagtcaggaagacctaagtgacacaagggggagagagagccatgtgagggcccctatgaagaagggtacagggtcaggtgcaaacgctccctgtagcattggatgtaaggtgaatgaatggcttccgcctggaggacaatttctaagcctttggcatgtttgaacaacaacaagaagtcagaatctggagaaaaggaaaggaagagaggaataagaaatgaggttggaaattgtggaagacagtgtggtgattcctcaaagacctagaaccagaagtacgatttgacccagcaatcctattactgggtgtatacccaagggaatagaaatcattctattataaagatgcatgcatgtgtatgttcattgcagcactattcacaatagcaaagacatggaatccactcaaatgcccgtcaatgatagactagacaaagaaaatgtggtacatatacaccatggaatactatgcagccataaaaaggaacaagatcatgtcttttgcagggacatgaatggagcttgaagccattgtcttcagcaaactaatgcaggaacagaagaccaagcaccacatattctcacttataagtgggagctgagcaatgagaacacgtgatcacagggaaggaaacagcacacaatgggaccagggggctgagggagggaaagcatcaggataaacagctaatgcatacagggcttaatacctaggtgatgggttgataggtgcagcaaatcaccatggcacacatttacctatgtaacaaacccacacatcctacacatgtatcctggaacttaaaataacatttaaaaaaaaataaaaaacaaacagaatctcagcccccatcccatacctgctgaatcagaatatgcatttaaacaagatcacttagtgatttgtatgtatcttaaaattcaaaaagcaaaaaataaaagaagaaattaggttggagaggtagccagggatatgttggccccagacaacaccttggatgagaaatcagcagagattcgaaaggcagggaaggaaaacatgtcatctgcattttagagggatcacttttctcatcctccccctcaaaaatgctcagctcccaatagcacccccgtatatcaagtcgtgtaaaacttgtcgaaaactggtgtgtcctctccctggccttctccttgtcctcttatagccaaatctgtccacttctctctatctccattgtcacctctgcaatgcattcagcattaaagctcatctaaagcagtgtaacaggctcctaacaggtttctctaattcttgtcctccctggatccattcttcccccctaaacacagtaatttcttccaagtgctaaaattcttctcctctcctgctaaacccattcatggtgcccttgtccacactcttgggccatgtgcaatccacttagcccactgcttaaaggtctacctgagccgactcctacttctctctctagccttctgtcttccctccatcacattctgcagtacggctctgctgaactgcattttgttcctcagatttctgtgtctccctctccctccctaacctcgccctgcttttctctcttcctgaaagagtctttcctctgcctgcagccctactcattctttaggttactacttagtcttcaagtatgtttgaacatcacttcccttggaacacttcctgactctccctccagccctcagtgtaggtgagtggtccctcttcagactctaccacctgattaccccagaggagccctgtcacacccctgatcatactgtccatgctgtctctcggggccactattccataagacccatgaggccgaagccacatatgtctcgctcactgctgaatcccttgtgatcaacacaataaccactgcaaggtaggtaatcaagaaatagtatgtgaattaagtgttttattaaataaataatgccatattcatatgatagaagcaatcattaataattctttagaataatacttaaaaatatagaacatgtagagcacactgttcagttaaagacactcattacaaaagcgaatacacagtcagatccgattttggttttctaaaaagggcattaataaagtgacctcaaagatgttcacctaaaatgtaaaatgatttttctcctggggttggaattcgaggcattgtttttcctttgagcacatttgagcataaatttctttggtcatcagggaaaaaaaatcacgaaaatgatttaaagtgcggtgtcaagtcttggactgtcacggaaaagaggaccctggtcaaatgcaatgatggtggccagtagtgaacagaaagtcccttgtgagtgtcctgggtcgcagcggccaagggcattgctaagggtaggctatttgggagtagaaagtgaggaagggactctaaacatgacaacttcttcatagaaattataattaaatgtaattaggccaattttaaagaagagcagtgggaaaatgtctttaaaaatgggctaaatgaactgaggagaggcgtcagtatctatcttcagctgccttttatcattatggtatcaggtcacaggagatgaaattagattagaaaaacagagtcaaagaagggtttatttaaccaaaaataatatatgatgaagcaattaacaaaacattcttctactttcccagtcttctgtctgttcaacgttgtcttgggcctgggtctctctgtatgtcccctgccttaaggtggtcagagtcagagcctcgacctgaatagttcagaagaagggccaggactgtatcacatgatattttggtccaagtgaaaaacaaaaatttcactttagcttcccccattgttgtggtctaaagaggggtatgtgtgaggagataattctgctacaagaaaaaatgaaaattatatttactactagggtatttatatttctatcgtaaaggatctttgttgcattcaagaaccatgatataatatgaatgttttgcgtttagcatggagaagttagcttttaataaacagatcctcccacaaaacagctgttaaatctgacaagaaaaaaaataaaaataaaaagcgaaaaacttcttcaaggctctgaaaagtgaaccaaagcaggcaggttttggaagggagtcaaaatacagaggcagcagccagcatgagatcagtttcgcatttggggggttcacatggccggctgccacagccgtgacagtggcacagggggataagacgacagcactgaaccttccgtttcagtccagaggtacccaggaagggaaaccgcctttgcagaatgataactgaggaaattatgacagtgaaagaaatcagacctaaccaactccaccttgcttctaacctttaagctgtccttcttcattcctgggcatgggccaagctataggaaggaattcagttcatggtttgactctgaaataaaattgctaatagccctttcccaaaaggacccctttcttgcctagggaaccagtctgcctttgcaggattaacaaattagctacaagattagacattacagtttggggggtcatgcagcctctggctccaagagtctgaacctccccaagttgttcttggggataacatcactattgtaaaacctaacatcagtgcttgagatattctgcagcccctacactcgatggatcagctgacaccatccagacaggtaatctggctcaaccagttctgccatcccacccaggaacagaagacagcaagaaaaactcactttgaccccctatgattccatctccaacctggtcagtcagcactccccacttcccaagcccctacccgccaaattatctttaaaaactctgatccccgaaatatcagagatactgaattgagtaataataaaactcctgtctcctgcacagccagctctgcgtgaattactctttctcgattgcaattcccctgtcttgataaatcagctctgtctaggcagtgggcagggtgaacccattaggtagttacagaaggagcctggagaaggcataccacgaggagtgagggagggttctgggcaggaagacagccaaagaaggggcctccaattctgaatatgaactctcccggagtctctggatgacccctacaccacccctaaactgggcactggaagtaaccagatgagatgagagctcctgcaccccgcaggcatcatgagtttgcagtgagtctagccagtgagatttgcacatttacttcagtgaacattggttaatgcatctttgtgatatggggagtttcctcatacataaaatgttattgtcaggacagttttgagatatttactcgttcattcattcaacaaatgtctcgtatgtttctacatgccagatgctttaagggatacagaaatgtttagcatccctgtcctcaacgagcccagagccccatgagggacagcgggtgtacatccaaatagctaccacttgaagtaaaactggatcagggaggaattggtgcagcagaaagaacatgaacttcaggatcaaacaaacctgtttagagcctcaggaattatctgacaaatggcataataatacctgtcttgtacagctgttgtgcagattaagtggtgaaatttattaattacttattctctgcgaggtactggtctaagcactgcatattcacagctccgttaattcttataacgacccctttaggtagccactaatactaccctcgctcgatagatggggaaaatgaggcatcgagaatttaagtaaattgttcaaggtcgccagggagtaagtaatcaaacaggttcaaactcagcaaagtctacttgagcctcagctgttaactgctaagttatgctgaataataatgtcaaagtgctggccgggcatggtggctcacgcctgtaatcccaacactttggcaggccaaggcaggcggatcacctgaggtcaggagttcgagaccagcttggccaacatggcgaaatcccgtctcaactaaaaatacaaaaaatagctgggcatggtggtgggtgcctgtaatcccacctactcaggaagctgaggcaggagagtcgcttgaaccccgggaggcagaggttgcagtgagccaagatcgcgccattgcactccagtctgggtggacagactgagactccaactcaagtaataataataataatgtcaaagtgccaagcacagtgcttaacacataggaggcactcaacaaatggcagacagcatcagtactgttataggtactgccgatgctgttgttattactttgaagcataagaaagaaaaccatcgttgaagttcaagacctatgcctgaagttttaaaactaaaatgttgtaagaatgctaaataattgtcacgtgcagatcttgacacacacctttagaaatcaaaatttatgtttatcccttaggtatatcccatctcttttttagaagaaaaccatcaaggtatcatttaagtattcattcattcattcatcaaactgtaacttctgactgccctctgtcagcactaaagtgggcatcggaaccattttcaaaggggaaagaaagctaatgtgggaagagggtcctggtcattcactgaaagttagtgcagccattttccccagtgctaatgaaaaaaagcaggcaactaaaattccttgctgcatttttatttaaacaacctcagagaaactgctatgcaaaaaataataataataataataattcagttgtaaagcaaaattaatgaattgtgtgccaaacataaaaataaaattttggaagggcgcagtggctcacgcctgtaatccccgtactttgggaggctgaggtgggcggatcacctgaggtcaggagtttgagaccagcctggccaacatggtgaaaccccgtctctactaaaaatacaaaaattagccgggtgtggtgatggtcgcctgtaatgccagctattcgggaggctgaagcaggagaatcacttgaatctgggaagcggaggttacagtgagccaagatcgtgccattggactccagcctgggcaacaagagcaaaatgctgtttcaaacacaaaataaaataagataaaattttactcacacttaataaatcttaataccctgctttgattctaaaaggtgaaactatatactactccaaggatctcagctgctgtgattcctaaatgaagtggtgatttagggataatgccaaattttgaaagaacaagaacagcattttattcaggactgttaattttatgagggtatgtggcatgtttcttatgtaaatacatggagtttcatatggttctaatagagtgctttcaccaagatcatacatgttagggtgctggaaaaaaaaaacaactaaatcccaaaactatatcacccttaaatcctgactgggtaacatacccagtttttaaacaatacacattatctgagagataacttttatgacatgtgttgctattgcctgcaaatccctttaagatgaaaagcattaccactgaaatttgagttcgacaaaaggatttatatagctaggttacccaaggctataaaatgaaaaaaaaaaatagttttgtaaatgcttggagcttgttgcagtggaatttaacctacaggacctttgggccaacataaagatttaaaccccaggcattccctagagttacttagaggttatgaaggttttctctataaacatgacttgaaacatgatggatttattgactcagcaagtagcttttaaactgatatatttgaattaaagacttttaagcatagggtcccttaaaggtagtagtcaaccttcatcctttttaccgaagaaaactaagggtggaagagataaaattatgtgacttaaccgaggttagatgactaattaataacaatcatcataatagctaacattaactcagcacctactatttgcaaagcacagtgctaagggctttctccaaccttcacactaactttaaacatgtaaacgagtgttactctactttataaattaaaaaatgagcctcaaagaagccaagaccttgtcaaaagaggtaggtccggatttcaaacctaagcagtgtgaccccaaaccacatgcataaaccactccactctacagcctcgtcacggggcctagactcaaatctactgacctccaggccagagaacgacaccaaatctccatccttggctatgagagtttccagattgtaagatctttgatgtctgacagcaaaatccaacattgcattctaatagttataggactggaagatgtgagtcctctccctggttgtaatacttgacttcataattacagtgcaagagtggttcatacaaaatctatgtattccataatcttatcccataggaatagtgtgagaaaatacctttaatgcttttaaaatgcattggataaaatgatatgttttcaaaatagtgcataaagccccatattctctctttggtctctgattgccatatgtcttccgtaataggtaattgccaggaaggtggttccgtttgaccagctgtgctctccagaaggggatggtcatgctgcagagccaatggatgtcctttattgctggaggctttcatcactactgatttctttttattctttattaatttatgggtattctacttcaaattcccagtggaagggagatggaattaagatactgataatggctagagagtagtattcagactgtatttatacatgtatctaaatacattcatatatttaaatatacatatttaaataccaatatgcagtaatcctaagcatatatagacatcttcagaattaaaatgcatttagtttaaaacttaaggatttcaaagttctaaaccaaatacgaagacaataaattattaagcaataatgccaggttctaagtgcttatctttgtctttgctgttatcattcaattaggtggatattagaaaacattcatgatatttcacttttatttcttatcatccccaccgtaaccagaatctgaagctacactttcccaatatgaacctagtaaaagctaagtcgaaattcaggagaaatacagaacctgttgatgaaggataaaaatctcagtgtagaagggcagacgtgtcctgaaggagcgcagctatgaaggtgactgcagctggctctcgggctgcccgatttggaactttgtgaaggagcaggagtcacagagacagtacccagaacagatgttcaatctctacgggcctacccaggtcagatggaaaaaggtccttgaaggaaacaaaatggagatgaaaaggggggaaaagagaaaggatgcggatgtgtgctgtcgagaactctatctagagggaaaaccccattttaacagctttccagcctgggaggaattggtataaaaggatttgacttgcttaccaaaaataataacttctcactttttccagatttaagaaagtaaacagcagagacatttagaagttttctttgcatgcattttacttatgattatggttacaaagataatctttaaaaatataatgtgatttcttttaaagaatatattcagagatggtataggacagtagttgggagcactagagcccatttctgggtttagtctccatttctggctatgtgacctcaggcaagttattgatcctcttgtgcctcagttttctaatctgttaaatggaaatattaacagtgtgtgcttcctagcatacaatactaatttgattctcattgttgtgagagtcaaattagttagtagacatagtgagtgatagctaagtgttgacttctattattaaattatttaccaaatattaatccctcctgctaacataaaacgcaacccgtaggaaaggtgttggaattaggtgtgggaaacaagatgaataaaatacattccctttcctcaaagaataacacagagaagcagggcagacagaatcaacaaaaacctacaatggagaaatggaaaaggaggcaggcaagggtcagggctggctctgaaccccaggacattctgtgaatttgaggctctgctcagacttgctctcagcatgtctgatgtgagaaacatcctggagacacaggctctttttattttttattttctttttgagacaggatcttgctctgttacccaggctggagtacagtggcacaatctcggttcactgcaacttccgcctcctgggttgaagcaattcttgtgccttagcctcccaagtagctgggattacaggtgtgtgccaccacacccggctaaattttatatttttagtagagacagggttttgccatgttggtcaggctggtcttgtactcctggcctgcagtgatccgcccaccttggcctcccagagtgctgggattacaggcataagccaccacacctggtgacacaggctctttttaaagtgcaaagtgttctataaatatgagttactgccgacacacaaaagcaagcactgtaaggataggccagtgggagaggcagcttaaaaaatgccagtcaccaggtatgagctcctgctaagaggctgccacacattccagcaaattcttctaaactctaatgaaagcctgcttttccctgctcaggcttcattgaagataaaccttcgaataaaagtctttgtagtggaaaattcatcttcatcttgtcaattccagagcctcgcattttctctaggctttatctaggcagcatggaggggctggtgtgccaccggataaaggagaagggttcctagatcagcatccaggatttaaattactacctaaaggccaatgtctctgtgtttagatgagaccaggcttcttccagactcatagagccacagcctagctgacatctccacttgactatcacaagggtctctcacaagggttccaacatagaacacttcatttttctgtttctccatgaacagcacaacccactgcaaagccccagactcgctgcctcaccctccctcacctcccaccaccttgctccttctcaggcctcctccattttctttccaaagttcttccaaatccgtctgcctctctctttttcaaattccacccttccattcctagcagccaacatctatttcttggacttctacaacagtccccaaacttttctccttattcccactcttgtctctctctatgttcaacattgttccagaatgaaaagttcaaagttccctgcttatcaatggtttaatagtaatcattatcatgaaaacaatagtgatgaaatagctactatgaattcagcacttagccaggcactgtgctaggcactttatctgtctcaactcatttaatccttacactgatcccaggacatagacacaatcatcaccccattttacagattaaaaacaccaagatgcagggaggtataaaatcacatgcccatgggacaaagctggtgatagtggaactggccttcaaacctccccctccgactccctcccctctaggatgaagatgaaaggccttgcggggctcacccagccctgcaagccttgccctgcctgcttccacctgctgtcaccatgattcttctcatcctcttagctcagtcatgcccgcaactgcgccatctcctccctctcctctcctagggtctttgtacatgggagtctctcccagctctccaagcccaggcagatcccttctgtgcatcttcaaagcacctattcctgcatgtaattacatacttatctgtgtgtgcactactggaggggccatctcagccttccttagcattatatcctagctcctggcacagtgcctggtatacgtaaagtgctcagcaaatcattaacaactaggaaattgtagtacgagtgcaagcaaaattctgtttttagttcgagggccattgtttattaccagtgtgattttgtgcaaattacccccatctgaacttccagaggcctgattgtaactttcaggtaacaatcccagcaataataggaaagcatgttggagttcttaaagcactttcacaaaaattccatttggtcccaggacgaccctgcaggctgcccttgactaaacactaaacgacaaggccttcaatcagagttaggtggcgactgactaaccaagggcgtgacagagctttaagaactgcaaagtgctctatgtgagtgaagactggtgctgcttgctcagtcatcagccttcagcaacgtttccaagttttcgcatttgtttaagggagctgagcctaaattgcaaaagaaggagagggtgaagagcagggcttgccaaacacatttaactcatcaccagcacacagagagagagagggatggctgggtgggccacagccatctcactccggcccccaccctggcccctgctctgcccaagtgagcaggaagacaagaacctgcccttctttagttgatgttcacttctccgaaatattcgattatgaggtactgccgatcacatgggcagctcctggagaacccaagcacttccgttatctgggaagccagtggcctcttaccaacaccctcctggaccaccgccctccccctgcctctcagccttaggtaatctaaggtaattgtgaatacacagatacttccttaggttctcaggctctacatttaatctctgcagaggatgtgactctatgtagttgtcaatgttacttctgtggatcagaagcttacatgctggttctaaaaaacaatctaatgtcatgttattcttacaaaattaacaattgaaaataatcccttccataacatccctgcaagcagaaatgggaacaaaacttcctcaaatcacaaaataattttgtgaacaccagcttgatagctgtgattatctgcctgcttcttcaggtaaaactatgccagcagtaaaactgctttttaaaataaaagtagccctaaagatgtggtttttcaggtgacttgaattttctaagacattatgaagttgatttaaaaacagaagcaggtgaactttgtgttgaatttttaaatgtaaactcatatcaaaaaccaaacaaaatagaaatcttaagtaaattgtcaccattagagattctattttattatagctattcattttcaatgtataaataaaatcacagaaagtcctagattatgtctaatattcaaataattttcaagctatgctagcatagagctaaaaagggggactatcttctatttttgttttataaatcaaacaaaacaggaagttctcttgtgtagagttttgcagaaacaaagtataaggctgatcaaattagtttatgatttaaaatgaaaaaagttctttctggagtaataaatactaattaccttctggacactggcaggtgaatccactgagactggaaatgcatgttgctccatttctgcatgggtctaggatgcagtaatcaatcttggactggcaaagctctccagtataacctgaataaaacaaaatgtacattttataaaataagctcttccagacccaccatgagccactctaggaattgatggattcaactggtacctgcccagtgaaggcagtggcagccttcagctaagctgctcctagatctcatttatttttacaaactatggtagtttagaaataatcatagtggtttagagtcatagttcaaaaatcgtttactctgcaaaaatctttattgcaagaagaccacatttcttcggcattaggtctgtgtttcatcttgaaatatcagtcggaactttcagaagctgagactgaggatcacgttggtagcttccttctgacacaggaatttacagtgttcagcttgatctaactgagataatggccacattccctaggccatcacaacacctacataaaaagcattaggaaaatgtctaggtatgagcagttttaatttataatattttagagctagaataacccacctgtgttaattctgtgacctctcctcccactttaaagataaagagattgaggcaaacagaatgctaagcacattaatatatttttatttatacctacttaattcacaaatccaactaaattatctgtgaagcaaggctctcatggtaattttgttggattgtaacataactacgcacatgtggtgaggaaataaggatgtaaatcgattggaacacctgtgcagtcaaaaagctttaaatacttccagaattttgtttattaattttgaaaacaaagcccctggagagaaaagtttaaaaaataaaatgctaataaatttctcattataaagtggaaaacggtaaagaaagtttggaaaatttaagacattacacagaaaaagaaaaaaatgtgcccttggttatgttatttgagtgacaggaccatcaatactgtagagataattcctatcaaaaattgtgagtcatagatattttccacacaattatgatcatagtgtaacactttatttctaggacagttttaactacataaaatcttgtctttctgaattattagttttgaaagactgccattagcacttgaatctgagatttacaaaccaaaaagatccagtgatactagaaaagagatgattcacctgagcttcaattacctgccaaatagattgtaaattacagattgggaatgtggaggcattcatttgcaatcctactcacaggcattcaagccgtgtaggagattctagctaattcacggtatgagaagaggagtaagacaagcgcatgaactaaaaatccaaacaccaggagaaaaggctatttcaaaattctagaacagattaaataaaagctgtaaattcaaaataagggagagtgaattgtttttaagaggaatgctgcaaataactttttggctaaaaataatagccaaaacttacaaaaatcacttatttttattcatacattaattaatattaataatttatccacacattaatacctaattcatccatactcacgtaaccttatgaggttagtgttattagaatcaccctatttttttttaacttcaacttttattttaagttccggggtacctgtgcaggatgcgcaggtttgttacataggtaaacgtgtgccatggtggtttgctgcacagatcaacccatcacctaggtattaagcccagcattccttagctgttcttcctgatgctctccttccccaaacccccactcccaacaggccccagtgtgtgttgttctcctccatgtttccatgtattctcatcattcagctcccacttcaaagtgagaacatgtggtgtttggttttctgttcctgtgttagtttgctgaggataatggcttccagctccatccatgtccctgcaaaggacatgatcgcattcctttttatggctgcgtagtattccatggagaaccaccccatttaacaaatgaggaaaccgaggattatgaaggttaagtaatttgcacacagtcatacagggagtcagagccctgtgtccaagccctttcacacagtccgcctaaggttacacttaaggcactatgcatcaccatcgtcaacaaacaggtatttagtatgaagggaaaataacagaaaataatgggtaagaaaacacatagaaagagacacagagcttgatataaaaaccatcaatattcagctaggtgcggtagctcatgcctgtaatcccagcactttgggaggttgaagcaggcagattacttgaggccaggagttcaagaccagcctgaccagcatggcaaaaccctgtctctactaaaaatacaaaaattagccaagtgtggtggcatacgcctgaaatcccagctacaggggaggctgaggcacgagagtcatttgaaccgaggaggtagaggttacagcgagccgagattgcgccactgcactccagcctggacaatggagtgagactttgtctcaaaaaaaaaaaaaaaaaaacaaaaaaccataaatataaatattcatccataacttacagcctatgtgtggttggttatgcttaggctggaggtgccaagaattattttttcaaatccctgactttaaagattctacaatatggctagaaaagtatagtacatttatgaaaaagataaccgattacaagtggtagcttcttagaggcagtgtggcctaaaggatgtggatggcatcatgaattctgtccccggaaagatgtcagaattgcgaccacagaatgacacaaaaccatgacccacagccagcagccaatttggtctcagaagtgagagatgtacatccccaccagacagaaaaaatagaagaatgcaggactctgtgaacttcaaagttctttcaataaaattttaacaatcacttcctttttactttttatccaaggatttaaaacatacttaaacatagagagatgaggttataaacctcatgtgtccatcacccagctccaaccattattagcattttgtccgtttaatttcatctagtctcttcgtattttcctaggttccccatgagggtattttgaatcaaatttcatttcacctgtaaatatttcagtatgcatttctagcaaaaggggagttttttaaagatcacttttaatggcctctttaattaatatttcattccatttacaaatttaattaaacactttaaaacatatttatttatatttaataatatccacaattttcttaagaaccacaactgtctgataatgcacaaatattcccatgcacttaattcttacagatctaataaattataagtgagggtgaatcttcaatgctgttaagtgccccaataccgtatgcaagttcggtaagatttcaatcagagaggctaatttacatttttaattgtcataacagcttcgggacctcactggcattttgtgggtaaagatactgaggtcttgcaggacttgagatggcctaatatattaataacagagttgtcacactgaaaatgccaatagttccctccaatgagaaacagtggtccatattcaacactttgtcattgctttatttccctgagctttaaagtctttatagtaaagattttgaaaacacaggaaacatggaactatggagaaaaagattatgtgtaatgctctagacccgtaaagtatgagcatattgacatgtctgtgggttcagtattactggagatgaagaacactaatggaggagcatggactggggtgtaggaggaagcagggaggcaggggtgagatcacgggattataggaccactgagcattctcagctgcaagtggccagtgctactggcaataaccagctatggatctgcaaagccgatgagggtagcctgatgctctacccaccccagtctccctggaaagggaggggccctttggcaggacagttgcttggtgcgagcgtttcccaaattagacgtatggaccatgatggcaggagctcaagacctgacaatcattcacaccagactcaccaagaggaccaggtattattcttggcctccagggagttactagttggcagtcccaagagtaccatcatcaactgtattactcccattacagttgcattactagccaagtgaagacagttctggaagaggagaggcagaggacaaggagccaggagcatcctgtggctggcttcagaaactctcaaataccagcgagtgactccttagaccctcagagagcagaggcttcactgaaggtgttgggcaaatcactggtattgatatacatgtaatactctgaactggatacctaagatctacacaaatctcacccttcctgtgtcttttggttttttatttgatctcataatcaaggagtcaaaactaaatgagtgactggtagaaatttaaatgaaaaataccattaaagtcttggcctgggttttctttcttccatcctgctaaaagtcaaactcttctctggggactaaagtaaccataccaactatgactaatatttccttttgccactaaagcaatgacagacacccagaggacctcgtagaagatatacaagcaagactgatggtatcgatgccacagacacaaaaggtaatacacggtggccattctgtgtgtgttatggaagaatttgctctagcatgcatacacaacaggcatttcagccctggaaacctatgccatagctcccaagtggaaggtgggcaagacatggagaaaaacccatgtaaaggcacacaagagtgcagaaaatgtgtgaatgtcattgacacttgactaaaaatgcaagacaatgataaactcccttattttgatttccaaatgacgaaagtctatacctaaccatggaggcaagtatcagcaattgtctttctttcctctagctagtggtactccctctaagcccccatgggcagaccacaagcattcgtgaaccacctgccaagttattgtcacaaccacataatacctttcacattgtctagtcccaaacctcactgcctctcaccaggactccagcaatggtcgcccagcccctgtcttcactgccacacttgctttctttcaatccattctccacatacgaatagccaaagagatccttttaagatataattcatatcctattactccttacttaaaaccctccaatggcttcccaaaaggtttggaataaaacccaaacactttacccaggggctaaaagataccgcacggtgtggcccctgcaccctcatcttggcccagtcctgccaccgaccaccgtgctgcagccacccaggcctcactctattccgaatctcgccaagcttctgctcataggcatcagtattgttttcatgctgtggcctcaggaccagaaagaatcatgagagggatgcaggattcaacagaagcagttacagtcctgccctacaaagagaagtggggcacagatttaaaattgtcctgagatggagaaattactgaagaaagttagcaataaacttttgggagtggaaaggagaggaccagtggagttatagtggaatttcatttgtaaaatcaggaaataaagacaggagggtttagaaataaattgcacaacagagtagaagacctaagagaagggtatcaaagctttaaagttatctctagaaccaggtagggagacatgaaaatgtcttaagagggctacaaagaaaagtgcaaaatccaactaaggagggaaggaaaatagctacaaccttagtgggagttaccaataaaatcagaacaattaaacaataatgtctctgggactcaggggctgtgggttttgaaatcaagcccattgatgagtatgagcttggagtttcctgttggatggcaataatagggagaggtggcctatgtgtgctcatcccactgatatgagaagaatcaccctggatgcccaggactcctgagacagccaaaaacctccctcccagaaacaaccttagtcctctgagcgccaactgcaattcatttgggtcaagaaccacagttagcttaggataatgaagctcttccattagcggtatgagtcttccaatcacaagaagagatagagccaagtatagagatgatgatatgaggacgtagatcaagcccatggttctgccacttcgtgtctggtttaagctaatctgtgcctattggtatgcaaagaatgtgtgatgattgagaaaaaatgtgatgtgtgagagaatctatcacacttatgattccaattaaaatgtttagctgagtaattggtttttgattgatgaatttaagttgaaagataagattaagtcagaacccattgggatgttgaacagagcttgagaatcattatagtgtttaagtttacttctcacaagggaacgcatacaaaagataatttcaaatagtcttctctgtgcccaaaggacattctgggatgccaaaaaactcacccctggaccctgtggtcacactgcagggctgtttcctctgactctgcagccttctgtgcccaccctctttcattagttagctctaagctcagaagtcacttgctcagacctcaggctttttgcccttgtttattctaaaacttcgctcttatttctacttgaaacacacacacatacttgttacctccccacccagaaggtgacccatgggagtagggctgcatccctggaggcccctgttgtatccccagggcacctgtgtgctcatcactgtatacttctcattacctacaatgattttctttattggtttccttccgagaacataaactccctgagaatcaggactttctctgccttgtttggagagaaacctctggaccctccaaacttaaacatttcctggcacaattatttgttgaaggagcgaatccacttgcttaaagtttttgtcccaaaatcaaccatatctttcaacttaggtttagcctctccctaagcaataatatcgagaacggcctgggtaaaatgtgctagctgcttgttttcctaatgcacattaaaataaatgcagagctactgaagtaaaaacattgttatctcaaatatctgccatcaaaaatcaccttgctgccatcatggtctgtacatctaacttgggaaacactgcaatgagcaactgtcctgctaaagggccccttcctttctaggcagactgagatcagtagagcatcatgctacccctcttctgaacttcgatcttgtttctccagctagcattcagcacctccaacaggtctctgcaatacggcaaatcaacaaggctgaagcagaactcttcattttgttgttgttgttcaggagcccatatccagacttaattccttaggtcggtggttcttgactggggtgattcttcccccaggtgtcattggtgatgtcaggagactttatgtattgttatacctctgaaggtgtgactggcatctagtaggtagagccagggctgctgctgaacactctccaatacacaagacagtctcctacaacaaagaattatccaaggcaaaatgtcctgaacaccaaggttgagaagccctggtttaggtcaatggaaccttagtccttcagactataaacctttgttttggtttcagagcctcttatcttcccttaaacagaaactgctcctttacaaagcagagaaacagcaccttcagaacattttttaaaaatcagcattctcaggaatatttataatccctagcaaattcaaagccgttgtaaaatacattgacccaaaaccctaagaacctgaggaatttataattgggatattctatgaataagtaaaataattcattcaaaaacagatgactattgaaaatactgacctctcctttcagggaattgcagagattttattgtttctttgaagaacactgcagtacaacaaagatagaagaaaagttgtgactcagggtacatggtaaggatgccctttgaggacatatggcacagccgggaaagccctcaactcaggcttcgtgcttttaaagggtctgaccgtgagcaatgatgttaggtgaaatacagtccctgacataggaagcaaagcctggcagtgagtaaattcttaaaaaggcaaaaggcagaaagtgaccagacacttgaaggaaatgcatccatttcatcagtgggtgttcacagattacatttggtctaatataggcttggagtgtttgattttatactattttgtatttaagtataaaatataatttaaaatgtattcatatctagagagagaagagtggctaagtttgcctgtgaatctcagaacagcataccatctgagtgatatcttttgatttccaacataacaaaaaatccccccaccaacccatatatcattatcgacaccaccatttcccttcaaatgaagaaaaccttccagaggtcaatggtaaattacatgaggtgtaagcgaagttagctaaatgagtcagattatgaagaagaagggcgatcaatcagttgtgggcatttttaaaaaaacattctccttccctgcacagttgtttttgtgtatgatgtttacttcatgatttctctactgaaataataaaaaaaaaaattctcctgtgttgctttggctctctaaggcagagtctaaatgtttctttggagagctgttctgaaggctcccatggtggcaattgcgacgagagctatttttaacgctcctggtcttttaatagtctggcctgtgcagtgaggtgaggctgctgaatttgggctgaatgctgatgctaccaagagaacccaccagtctcagctctcaccctggggggatctgagcagctggtatcagggcctcagccgtgtctgctaagatgcagtgcctaatattagcactctgaggcaagaagtaaaccgggggaataaatagtgcaccatcaagacgttcagtctcagaggcatcctattttaaagtcggaaggcagacattattgcacagaaaaaaactagtaagattcgctggcaggagaaacacaaacacatctggacaaacacaaacaggatttaaaaaccaaaggcaaagaaaggaagatacatgaagcccatctatgaaagacaataagtaaaatataattaaattggaatatgcaaaaaaaaaagcttgacagaaagctgacattcagcagaattagaaaaattaatctcaacattggggaaaaaagtaaccacatctaacaagtaaatagacaagaggcacagtgggaaggacagtggcttggggagtggaaggtctgggatggtgatacaacaatcagctgagagagctcattaagaggttgacttttaccttcatttccctcatggaggaattaaagattatgattataatgacttcaagcagcaggtaccatttctatggagtgtaccctttaatccacaagagcttgcaccatgcttggcatgtcctaggtggctcaatattttttgagtgaaatttatggattttaaaactgcaaagcaatatgccaatatttttggatctctcagtttttatacaggcaatttagagcagtggttctcaaaatgtgtttcccagatcagcagcatcagccctgcctgggaactcgttacaaatgcaaattgaccatcattgtcacagacttactgaaggagaaactctgggggtggggcctggcaactgaggtttaagaagtcctacaggtgatactaatacaaggtacatgctagagtttgaaaaccaccatctggaaaattagaagcaagcaatcttttaacatcaaatattaatattattcatttccgaattacacatataacgcaaattacagaggacaaaaatcagaggccaatgggtgaaagtcaaatattatatgacatcaaaaagcctttagtgattgcactgttgacatggttttcttctttttctgagtgggaggtcttgggctcaattattgcaactgtcattgcattcttcacacatctacttccctattctttaagggcaggtattgattacttttatgccagcctctagcacagagccagggacactataaatactcattatatagtaaactaataactgcataagcaccatgcatcactctctctaatataattccttttattcaatttctctagctctcaaataataaagtgcaatattgatacagtccatctatatcttttaatctgatgattccgaagaggaagataattcaatacttagaattcaatacctcaaaggggaagatatttcattaagtatgtcctgatgactactcctgagaagttgaaatcaaaagaaagaaaacattagattaattaaggtgttacaccatgagacagacaagttaggggattgacttaaactacataaaaatttatataactatatttattagttgagttttaagtttttgtagtaaatcaaactctaaagaaggtattcattcactcttcagaaagaattttttgtgagtgaaaattcacatttggggaatctaaaagaagttcaggaacagttcttaccttcagggagcttaggctccagatgaggaggtaagacacattcccatgaaacagcatactgagtaaatgagcaggagaatggtcccaaggcaggcacatgtgcatggcagtgcccaggctagcctcactgatgtgccggggaaacaaggctaggctagggcccccaatccacaaaccaaagagttggggtcactgacatggcatcttcaaaggtttctgcacagagtagaggcatggtaacgatgtgttgtatattgatctcttcctgtaaccactcaccgccatttcaggggagcacttaaggtctctcctcccttctccctgggagcaagtgttctggtctggacgaaatgagagaactccaagagggatgtcgaaactgggtgtgggatggggagtgggcaatgcccttgcagaagaaatcagaagaatgaaagctccaatctttctcatctttcatcctcttactagtgtttagaggctacaaagaagtgcccttgatggcttaccgattctgtgccagtgtgtgtggatgtggatgtggggatagatgtttgtgtatgcatgtctgcgtgcatgtgtgcactctgtgtatattacatttgtatatgtgtgtacatgttttgtgtttgtgtatgtgttatgtgcatgtgtgtatacatgtgtgtgcatgtgttgcatatgcatgtatatgagtgcacatgtgtgttgtgtgtgcatttgtgtgttcttgcgtgtgtgttttcttttacaaggtcaagatcatcattccattttatagataagagaacttgggctcagaggagctaagtaaagttggtgagtggaattcaacccaggactgcagactctaaccctacgtccctctctttcctcatatgtgttccttctttccttttgatgaagttcatttgaaaagactgtgagggccaaccaaggccagccctgaggccagacacagtgggcaggaagtggcccattcaggcctggctttcctgtgatctttgctccaacctggctcccctgagcaggagatgcagaaagagctgaagccaaatctctggccaagaaagtggtgattggactctgtgcagggcttgacaatcacaacaatatcaacagctgacatttgttgagggcttactatgcaccaggtcactttccaagcacactacctatatcatcttatttaatcttcacagtcattggattgtggcacattgaataccgtcacccatgcccaatttacagatagacagctgagacccaggaagattaagtaacttccccaagctcacacaataaatgagtagtggaagcaggcgctgcacttgggcaatctggcctcccggcccagctgggctttgcggtcagccaggccctggcttcgtaagtatcacatcggcagctgtgagtaaggcagcatggcctgcggggagggtgcaatcacccaggcggcagatgccaacagcttgaatcagggcattggtaatggaagaggaagagccagggcagatggagagtcatcataaataaaggaaacttggtggcactccaaagataactgagatgagggcggcgagcataatggccgagcttccagcccaagtgaggagggagatgatggcaccactgatagaaactagggatgcatgagaaagccagactgcaatcaagtgtgggatcaaaaggaggcagagagaggccggcaacatgactgggtgggtgtggggggcgcggacagagggaaggaaggtggtgaggaggagggggaggaagaggaaggggaggaggggaggaggagtcggcagacacattgctgcctggtgcaggcaaagtgctgaggtgaaaggctgggctagaaggggtctggaagccatccaccttgaggtgatggctcagaaggagccattgctacccaaggcagaggagagcagctgaagagggaggggaggaagaagagggtgggagaggtctcaggagagcaggcacagtgcagtgctctggaagccaggtgagaaggcttctgaaaaatgatcaacttcagcaggataaggatgaggaaggagccctcgaaatcagtgagaagggcaccactgatgaccttggagaagcactcttatgatacagagagaaaagcagcatgagggagtgggtagaaaattatgagttgaagatggaccaatatgttgcagtaacgaggaagagagagtggaagagaaagaaggggagatcaaagtggaggacaagagggaagaggaggagaggaggaagagacaaaggaggaggagaaagcggaggaagtggacatatggaaggagcagcaaggaatttccaaattactgcttgtttgcaggactggttttaagatagagaaggccagagaatccttgtgaacaagaagccaggaaagaagcagggagggacagggaatatagcagaaagagggagacaaggttagaagcacatgatcctggaggaaaattgaagagggagtacatcaggctaagtgtcttagtgtcttggcagcattattcacaatagccaaaagatggaaatactccaagtgtctgtcagcgcataaagggataaacaaaatgtggtacatccatacaatggaatattattcaggcataaaaaggaatgcagttatacctggtataacctgaatgaaccttgaaaacctgctaaattaaagacaccagccacaaaactacacatcatatacttggacttatctctaaaatgtccagaataaataaatctatggagacagaatgtagatgagtggttgcctagagctggggggtggggaggatggtagggccacagagtgatagctaaagggtagagggcctctttcaggggtgataaaatgccctaaagctgattatggtgatgactgcacaactctatgaatatactaaaaagcactgaattgtaaacttgctggtatgtggattgtatctcaataaagctgttatttaaaaaaacaaacaaactttggagtcattcacaactctccacttccactcacacctcagcacaccaggaagtgttatcagctgtaccttcaaagacatcccaaatccaaaacgtctcactacttccagcaccacagtggtcaagctgtccttatctctagcctgataaatgcacatattttaaaaatagcctcctaactggttttccaatttgtcctccctatgtttattctgccccagactccacagtgatccttttaagtggaaagtccaatggctcagcccagttcatgccctcagtggcttcctgtcactctcagaatgagctccctgtccttccttcctggccaggtccaggttccttctcagcttgctcaggtctcatcataggttctctcgggcactgtgctccggctcttcaaacacgctgggcatattcctgcatcatgacctttgcacattatcttggtccattcaggctgctagagcaaaatacctgacactaggaaatttacgaggtgcatgcagattcagtgtttggtgagggcccattcctcatagacggcaccttcgagatgccctcacatggcagaaaaagaaggcagctctctgggccctctttcatgagggtactaatcccattcatcaggtgaagctctcatgacccaatcacctcccaaaggctccaccttctaataccaacaccttggtgattaggtttcaacacaggaattttagggaaacgcaaacacagatcatagcacttgtgcatagcatataactatttcctctgcctgcaatcctattcccctgatagtcacactgtttacaagctcattttattcagtctcttcacaaacatttccccttctaggaggctttacctagtcaacctatctgcaatcctattcccatttttcttcatccctttaccctgttttattttttcttcacagcacctatcactccttgatgtctgacagccttccttcactccacatctactttctccttcccctgtagttcaaactgatactgtctttgatggtaaaatcccatctcaattcctggcttctgctgagatggctgattaaatccatgaatcacatccatgatctcttaccaaatggttgctcagccataaccttaagtattctcttcagaacaacttccccatttttcccatttttgccatgattacacacacacacacacacacacacacagacacacagacacacaaacacactacatatatgcaaacatacacacgcatacactgtatacacaaatgcatatgcatattgtctagtcatcttcctcactgaaatatgacttccacgagcacagggactttgcttcattctcaattgtattctcagcacccagaaaaatccctggcacatagtacacattcagtaaataattattgaatgaataagccttactacaactccttatgttaaagatgaggaaaccagaaggagttaagaaaggttaggaggatcacacaaggtcacacaaccagtaggtagaagtggttagcttgaagccctgacgtaccatgtctcactagctttgttttgttattctgagccccaaggggtgcaatgtctggtcctgagaagggatgaatgacacaggggcaatacattcatagaccattagaaatgcccataccttccactctattcataactaacagaaaattcacagaccattaatatgtagcagtgaaacacactctttgactcaaagatgggccccgagtgaagaggcctgcattccggtttcccccatgagctttgtgaccttgatcaagtcccacagccttatggagtcaatattgcttccatgcttcacacagaggtgagttctgaggtttctgccagtctaaaactcacaactcattttttacttatttatttatttttgagatgggggtctcagtctgtcacccaggttggagtgcagtagcacaatcatagttcactgcagcctcaaacacctgggttcaagctaacctcctgcggcagcctctgaaatacctatgactgcaggcacataccaccatgcgcagctaagctttttttatttttcatagagacaggatttcgctatgttgcccagactggtctcaaactcatggcctcaagttatcgtccagcctcaacttcccaaagcgctgggattagagacctgagccaccacacccagcctaacctactttttaaaacctgctttcatgatctgctaattcactcacttcttgaggtgaaaaaggctgggtttggggacacacagaaaattctaatcgggatttgtctccagcaggaggtgacccatttcaaaccaacaacgcaaaggcactgacacttagtcagtgtgcaaaagagtaaatgtgggaagggaacacgcgcaacaacattcccgttgcctcggaaataacgagtttttaaaaataggctgaaatcaccaattagtaggaacaatgtagtgctttgaagttgaaaaatgctttgcataatgctaataatattttggcagtggtggttctgaacttgtatcaccgctattcttttcagaaaaagaaatagctcctttgaggaagaattatattcttgaaattagaaggcttttataaaatgttaataaatcctgattaaagaagttaaatttcaacttaatcagccattgtgtgtttactatgtacaaggcacagggcttggcactgacatgatggaaaactcaagaggaatagaattgttgctgccctcgagccagctacaaattacacatgtgctgtagggagaagctgagggacagagggaagaggaagaagaaataagagaactgagcccctaccatacacctgtatggctcatatagaattgtatctcattctattcacccattcattcattcaggaagtccttattgagcacctgctttgtgtcaggctccaggctaggtactgggtgtatggattgacaactgatcaggtacttgcattccttcaatacccataaccagccatgatgagacttgttctaatctctttgcagagatgaagaagcaggcccagagagttgcataatcttcccaaggagcccagctagaaaagggtaagagtggcagcaggatttaaactgctggctcagaagctgtggccaagtggaacagataagggtctagattccagggcagacagtatcaggtttgtacctgactctggcgcttcgggttcatataacttcgggcaataagctacatgaacctctctaggaaccttgttctgaattgaatagtatgatattagggcttgataggaaataaagaatatagcccaattttaaaggggcacaattcagttcacagcattccacctctgattctccaaaattcaggttcttctcatacacacaaaatacattcattccttcccaacagccccaaatgtctcaactcattctagcataatacctaatatctaaagtcctaagtctcatccacataccatctaaatcagatatgaatgaaacccaaagtgtgatttatcctgaggcaaaattcctctccacacatggacctgtgagatcagacaagttatatgcttccaaatacaatggtgggacaggtgtaggatagatattcccattccaaaaggaagaactaggaaggaaagaagaggtggcaagtcccaagcaagtctaaaactctagcaaggcaaaatccatcagaacgtaacagctcaagagcaatcctctttggtatgatgctgtgccctccaggcccctggtgtggcagtgtcaccccacagctttgcagggcagccctgccccagagacactgggcagttattcaggcccattgaaatctgggaggctgtcatacccttagaaacaaaggaggaagccttgtccccagacctggagtagaggtgggattataccatctctgtagtgggagttacagccccgctgatctctgagtctcctttggggccctctttccctttccttgaagaacagctcatattcacagctgaatagctctatattccactcctatagattccaagaagtccgacagccttccttcattccacctctattttctctgtcccctttagttcaaactgagagtgtctttgattgtaaaatcccatctcaattcctggcttctgctgagattgctgattaaacccatgaatcatatccatgatctctttatcaaatggttcctcagccacaaccttaagtattctcttcagaacaactttctcatttttttgcaatatagatagattgagaattttccaaatcttcaagttctgatccgttttagcttaacaatttccttttcaatgcatctctctccttttgcattttacttgagtagtcaacaggatccagcctttcaacactttgcttggaaatctattcagctaaatatataatttcatcactaacaaattctacctttcacaaaatactagaatgtagctcagccaaggtttttgccactttataacagaaccaataggagatatacataaagagatgtgttataaggcattggttcatatgattatggaggctgagaagtccccatatctatggtcagcaagctggagactaaggaaagccaatgatgcaattccagtctgagtctaaagacctaagaaccaggagagatggtgtaagttcccgtctgaaagctagcaggctcgagacccaagaagggccaatatttcaactgaagttggaaggcaagaaaagaccaatgtcccagctcaaggcagtcaggcaggaggaattccctcttactcagcctttttgttctactcaggtcctcaacctaggcccacccacgttaggaagggtaatattctttacatagtctaccaattcaaatgttaaacttatctagagacatcctcatagacacacccagaataatgtttgaccaaatgtctcggcacccgctggcccagtcaagttgacacataaaataaaccatcacagagacctttctttgattctgttcctcatattaatttttccactaaacgtatttctagagcagtctgtatttgctgctcactcattctcatatcatgtctacctcctgttcagctcatcactgccaaccagtatcacctggtgggaggttgaggtgggtggtcagtctaataacttattggccacatgtaaaccatgagggtatgacagctctagacacagtattgccctacagagtgtttggcacctcctaactacccttcttgctcctgttcttacagtcttttaaagagacctcaaagcttctgatatagcctatgtcaggtcaatgtaatggaaaaccaccacaggcttgaaaaaccttgttactaagtttaataaactcctcttagattttcttgcagtaattgatgcggatgacaatccctttctttttgaaagtattgtgagaaagtttcaagaaaaatatcaattacacttcattaaaattttctgctcaaaacagaaactttactgatcaaaatctatagtccatttaatattgtgaaaacatgtatatgacttcattaatatttataagttaaaagatcacctcctgcttccaagcaattatattaagaatcaaaatgaaaactaaaagagaaactataaacaaaaagagagtagtaagtcctcacctatcaataattattttgaatgtacatggattaattttccaggcagaagacatagagtggatgcatgaatttttttaagtcctaattatatgatgcctaccagagattcacttcacttttaaggacacacatagatccaaagtaaaggaatggaaaaagacactccatgcaagtggaaaccaaaagagagcagggatagctccacttaaataaaataaaatagaatttgagtcaaaaactgtaaaaagaggcaaagatggtcattatataatgacaaaggggtcaattcaataagaggatataacaattataaatatatatgtgcccaacttcagagcccctacatacataaggcaaatattaatatatctgaaggaagagttagactgcaatacaatagcaggggacttcaataccccactttcaaaaatagagagactatacagacagaaaatcaataagaaaacaccagagctggactgtacttcaggccaaatggacctaacagttatatacagagcattccacccaacagcagcagcatatacattcttctcaagccacgtggagcattctccagaacaaatcatatgttaggccagaagacaagtctaccaaatttaagaagattgaaatcacatcaataatattttcatattacaatgatatgaaagtagaaactgataacaggaagcattttagaaaatttagaaatatatgaaaattaagcaacatgctcttgcacaaccaataagtcaaagaataaatcaaaagaaaaatgtaaaaatatcttgaaacaaacaaaaatggaaacacaacataccaaaactaataggatgcagttaaagcagttctaagaggaaaggatgtaacaataaataactacatcaaaaaagaaagatctcaaataaacaacccaatgttacatctaaagaagctagacaaagaacaaagcccaaagttaatataaggaaggaaataatgaagatcagatcaaaaataaataaactagaaactagaaaaacaataggaaaaatatcaacaaaactaatcagttgttttttttaaagataaataaagtcaacaaaactttagctagactaacaaagtaaaaaagaagacttaactaaataaaaacagaaatgaaagaggggatattacaactgataccacagagatacaaaggatttgttatactataacacaaagaattactctaatactataaccagtaatacaccaacaaattggataaccaagaacaaatgcataaatttctagaaacatacaatctatcaagactgaatcatgaagaaatagaaaatgtgaacagaccaagaatgagtaaaagagtgagccagtaataaaaaagtctcccatcaaagaaaaattcaggaactgatggcttcactgctgaattgtattaaacatttaaagagctaataccaatttttctcaaactcttccaaaatatggaagagaaggccagcgttaccctgataccaaagccagacaaggacactatgacaaaagaaaactacaggtccctgatgaacatagaagaaaaaattctcaaaaaaacactagcaaactgaatttaataccatattaacagaatcattcaccacaatcaagtgggatttatccatgggatgcaaggaaggatcaacatatgcaaatcaataaatatgatatattactttaaaagaatgaagggcaaaaaccacatcatcatctcaatagatgcagaaaaagcatttgaccaaatttagcatcctttcatgataaaaactcttaacaaactaggtatagaaggaatgtagctcaacacgataaaggccatatatgacaagcccaaagctaacatcatactcagtagtaaacagttgaaagattttcctctaagatcaggaatgagtggcccactctcaccacttctattgaacatataacttaatatactagccagagcaattaggcaagaaaaagaaataaaacgcttccaaatcagaatggaagaagttagactgtttgctgatgacatgaccttatatatagaaattatttaaaaccccacaaaaggactgctacaattaataaatgaattcagtaaatatggaggatacaaaatgaacatacaaaatgcagtagcatttctgtacactaacaatgacctacctaaaaaataaatgaagtaaacagttttctttatagtaactacaaaataaaatacttagaaatacattaaaccaagtaggggaaatatctgtaaatttaaaactataaaattctgacaaaaaaattgaagaagacaaaaataaatggaaagatttcctgtgttcatggatgggaagagttaatattgttaaaatgtccattttatctaaagcaatctacagattcaatgaaattcctacaaaaattccaatgacattttccacagaaattttaaaaaaattctaaaatttgtatggaaccacaaaagactccaaatagctaaaatcaatcttgagtaaaaagagcaaagcaggagggatcacactacctgatttcaaaatatactacaaaactatagcaatcaaaacagcatggtgctggcatgaaaacagatgcatactaatggaacacaacagagagcttaaaaacaaatctatgcttttgcagtcacttgattttcaacaatgatgccaagaacataaaatggggaacagggccaggtgcagtggctcacacctgtaatcccagcactttgggaggccgaggcgggcagatcacctgaggtcaggagtttgagaccagcctggccaatatggtgaaatcctgtctctaataaaattgaaaaattagctgggcatggtggtgggtgcctgtagtcccagctactcaggagtttgaggcaggagaatcgcttgaacccaggaagcagaggtcacagtgagccaagatcatgccactgcactccagcctgagcaacacagcaagactccaactcaaaaaaaaaaaaaaaaaggaaatttaaaaattgggaatagacagtctctaaaataaatggtggtgggaaaactggacatccacatgcagaagaatgaaattggactctgatctcacatcatatgcaaaacatcaatttaaagacttaaatatcagacctgaaactgttaaacagaaaaaaaaaaatagaagagctctgtggcaattgtctgtgcaatgattttttttgcatataaccccaaaagcccaggcaacaaaagcaaaaatagacaaacgggattacatcaaactaaaaagcttctgcatggcaaaagaagcgatcaatggagtgaaaatacaacctgcagaataagagaaaatacttgcaaaccacacgtctgataaagaattgctatttcaaatatataaggtattcaaacaactcaatagcaagaaaacaaatgagccaattttaaaaatgggcaaaaaatctgaatagactttctttctttttttttttttttctcttcaagacagagtctcactctgtcacccaggctggagtgcagtggcacaatctcggtcactgcaacctccacctcccaggttcaagcgattctcctgcctcagcctcctgagtagctgggactacaggcacttgccaccacgcccaactaattttttgtatttttagtagagaccaggtttcaccgtgttagccaggatggtctcaatctcctgacttcatgatctgccctcctcggcctctcacagtgccaggattacaggcgtgagccaccgtgcccggccctgaataagctttctaaagaaagacatacaaatggccaacaagtatatgaaagaagactcaaaatcactgatcatcagggaagtgtcaattaaaaccacgatgagatatcaagtcacacctgtcagaatagctattatcaaaaagacaaaagataatatgtgttggtgaggatgtggaggaaaagggactcttgaacactgggaatgcaaagtagtgtaactattatgaaaaacagtatttaagttcctcaaaaaactaaaatagaactactgcatgatgcagtaatctccctactggatatatatccaaaggaattgaaatcagtatttcgaggtgatatttccactatcatgttcattgtagcattatttacgaatagtcaagatatggattcagtctaagtatccatcaacaggtgagtgaataaagaaaatgtggtgtatatatacacaatagaatactatttggccttttttcaaaatttccataggtttcgggggaacagattgtgtatggttacaagagtaggttatggcgatatgtaagatttcgatgcacctaccacccaagcagtatacactgtacccaacttgcagtcttttatctctcacccccctcccgccctttccaccgagtccccaaagtccattgtatcattcttatgcctttgcattctcatagattagctcccacttatgagtgagaacatacgatgtttggttttcaaaagaagaaaattgtgtcatctacaacaacatgaatcaacctggaggacattgtgctaagggaaataagccagacacagaaggagaaatgctgtgtgataccacctatatgatgactctcaaataggcaaactcatagaagtagagagaatggtgattaccaggagggtaggaggaggggaggacaagattggagagatttaaaagagtacctaggttggtcaaaggatacaaaatctcaggaggaatgcttccagagatctattgtacaacaccgtgactatagttagtcacaatgtattatatccttaaaaaatgctaagaaagtggattttaagtgttctcaccacaaagaaatgataagtatgttaggttaaaaaaaaaaagaaaaagaaaactaaagaaaaatgtttatcacttaaccaactcaaaacccaatctgccatattcatgcattctagattacccataactaaaaaaaaaattttgtactgatacttgacatagaaattaaagcaaaaatgtcaaaaaatttaacaaatttggagctgcagattctttgctgaaaatattttcccttaccaagaaacattctcctctcaagagaaataagccttgtgtcaagacaacaatccttctgtgaagagactttgttgagagtttttgttctctggtgacaacaacacagtttgaattaattcattcatcaaacaaaataattttgcatgatcaaacttgtaataattagagcatagtgggatacattttcaaaaagaaggcacactcccctctgtttgaaggtttttgtgtatttatctggtgtttcggaggttaattaattgatattaattaattataaatagttaacccacaaagaaaatgcaattttcctatggaaaaataattggttcaaggatatccagcagctcatagttgaccaacaaggagcggcctggcttacagacagcagttgcaaagtgaatggacaatatactgtttggaaagctgctgctttggtcaaagaaggtaaaatctgatctgctcagtgggctgaattgcatgctgtttttctaagagtaacggaagaactaacagtggtggaagcccctgtgtttgggttttcactgactcactgggcagtgaccaatggcctggccatatactcaggcaagagggcagtggaaacctgtcctatcgaaaggaaacccatatggagcatggccctatgaagatttgaggggtgcattaaagtagaacccatcagtgcccatcagaagaactctcatccaggctcagaaggtgactggaatcaacaaacagatatctacgggtgctcccttgaggaggccacctgagtccatgaaatgggtggatatgggatatgggggcaccgcagcagtgcagagatgggctgaacctagatacgttcctcttgcaccctccttgggcacataatgccaaaactgtactgcttgtcaataagagagacagagactgccgatggctatggggcagattctctgtggggaaagaaggccctgaacacagctgatgagtgggactgatgctggcagcccggggagctacaaataggtcttgacgggaatagacactgactctggactgggctttgtttaccctgcggaagatgaaaatgctcggagtgccataacaaaaacaaaaaacaagaaacagaagatattacatggatttggatggttatcatttcttcagaccaatgaacacactatacagcccataatgtccaacaatgggtagagatatcctcctcagagtgatagtttgatagagaaataggacaggtaactgaaacaatggttgcctgaaataaggagacggcaggcagggctggtttacctggtttcgcagctgtgtgctcacactgcatatgaatgggattaaaggggtgtcccccttagatatttttttcctctggctgatcttggggagaggggatagcgagaatgctggtatgattaagcaattcttgccaaggtagagagtgcactggtaataacaactataattttttctttctttcccaagttacccctcaaataattcttttttctccactacctgatacaatggtccttgtactagggccacaactgcaagtactggaagcagggatgatttctaaaccgaaaactgtaactgtgtttttcaaccttatgtcagaattcctaaggacctaatgggggtaggttatgctttgacccccactggcaaaactggggctaagagtgaatacggctctattgcctgggtggtaaaaatggttcactagttcagagcctatgtaaccttaccctacacgaatgggtatagactgaggagaggcccttgctggactagcattgttaccagcagtctggaccagcagagtggccaaacctaatgtcccttccagaggtggaaaagttgagtaaaaataaatgacaaatggaaaaaggagaaatagtagctgagggtaaaggaataaataaataggatgcactatcatctcgaaagagtctcagagcaagagacgacattgtctcagctcaattataacagatgccttaaagggtacaatacatgtttgccaaagaccactcctgcttttggaacccaatgagataaaaaggaagcctgcaaacccaatggccacagcctgggagacattcatgcagtatgacggactggactgataactaatgactgaataggattctagtaatgtgggggtatcttttgagttatacatacttttttgttgcttgtttgcttgtttgttttgagacagcatctcactctgtcacctgggttgaatatagtagcactacctcagctcactgcaacctctgcctcctgggttcaagtgatcctcccacttcagcctcctgagtagctggtactacagatgcacaccaacatgcccagctaatttttgaggtttttttgtagagatggagttttgccatgttgcccaggctggtctgaaactcctgggctcaagtgatctgcccaccttggcctcccaaagtgctgggattacaggcgtgaactaccgtgcccagctgagttgtgtattcttttgatgtaactgatctgtgtttgaaaaccaggagatggcctgtggtgacgtgtgtatgtgcatgcacacatgagtgtacacacacccagtcacatatatatatcgatgccctgtgtatctcttcatctataccctttgtaatatcctttatttacttatttatttacttacttatttttgagacagagtctcactctgttgcccaggctggagtgcagtggtgtgatcttggctcactgcaacctctgcctcccgggttcaagcgattctcctgcctcagcctcccaagtaactaagattacaggcacccaccaccatgcctggctaatttttgtatttttagtagagagagggtttcgccatattggccaggctagtctcaaactcctgacctcaggtgatctgcctgcctcggcctcccaaagtgctaggattacaggcatgagccaccatgcccggccctgtaatattctttagaataaagtgatgaacaacaataaaagatgttcagaactaaactcattagtgaactcccttttaaacatcagccccctttttttacacaaaattgcctaatatttattttattataaagagatcttttgacatggaaatgctgaagggattacattgtcttaaaccatgcatttgtgacaggaaattactcagcacaccacatagttgcaaacacagaaaaacattatagtaagatgatcaataatcctgcagaaggacctgggttcaaatcccagccccaacagctactggtgcttgcacctggcatggcatggacaagacgtgttccccatgttgtttcctcttcctagtcagtgactttagggaataacaactaaattctggcaaatggcatgtggtggaagggatagcagatgctactaggcactgccctaagaacattgcataggaccctccagccgtccctttgccttcagcagtactgtgaaggccacctcttgaggatgatatgttcataacatgaagggacctggatccctgagtcaccacctgaaggctaagtgcccccatcagactatgacacaagcaaaaattaaccttggcttggaagccactgaggcttgaggattatgtgttgctgcagtgtgtgtgtgtgtgtgtgtgtgtgtgtgtgtgtgtgtgtgttggctacaataaaaaagcagcactagaagctaagctaaaagagagagagagaaacctatgggaatgggggttcctgcagggaatcggaactggcaaagaagaaaccttcttaaggaaactcaagaacaagttatcagatagatgagcaaagagggagttatgatgccaaggtaacattcctaaatctcttctacccctgatcaggatttgtgctaaagcataaaaaagagtagagccgggggggtcccctggacccatctctgtgaaaatgcaatgaagaaaagtagctgggagtcagagagaccctgacagaggcaggggtgacctttgggcaaagtggaaggtgagacagatgacaggagagctacagattcaaggagagcagaaatgaattattttaaattgctactatggttctacggctgccttaaattatattaaacaagaaagacctttcacatggagggatttttctcacacatggaaaactaactctaagcaaattatacacgtttcaagaacctcagaaaataaaacaatatgatgtaaatgtcaatgtaaaaagatattatttttgaaacttgtttagactgtgaccaatgcacaaaggcacctatatctaatttcatattatttcatgaaaatgggagctttcaatctgcaatattcagaaaatggtagaactattatcagaaagcagcttacttaaaccataatttgctattatttacaagtgtggggctataaaatagctttgttgttttaatagaagacataacagatgactgtttcgtgaatcaagatcaatttgccatctcctgggttccagcacaattctgatgaatttaccagcaaccaccaaactgttttggggttgtattagtctgttctcatgctgctatgaagaaatacccaaaactgggtaatttataaaggaaagaggtttaattgactcacagttccacagggctggggggcctcaagaaacttacaatcatggaggaagagtaagcaaacatgtccttctttacatgctggcaggaaagagaagaatgagaactgagcaaaaccattataaaaccatcaaatcttgtaatgaattactatcacaaggacaacatgggggaaactgcccccatgagttaattatctccacctcatcccacccttgacacatggggattattacaattcaaggggagatttgggtagggacacagagccaaaccataccaggagtctaagtacaattatcaaagttcatatatttgtaatgcaaaaatgctatggcctttttttttctttttttttttattatactttaagttctagggtacatgtgcacaatgtgcaggttagttacatatgtgtacatgtgccatgttggtgtgctgtacccagtaactcatcatttacattaggtatatctcctaatgctatccctcccccctccccctaccccaccacaggccccggtgtgtgatgttcccctcctgtgtccaagtgttctcactgttcacttcccacctatgagtgagaacatgcggtgtttggttttctgtccttgtgatagtttgctgagaatgatggtttccagcttcatccatgtccctatgctatggtcctgatgtcaactgaaagtcaaagtattacaatcatgcattgcgtaatgatggggatatgttttaagaaacgtgttgttaggtgatttcgtcattatgctaatgtcatggaatttacttacacaaacctagatgatatagcctactacacacctaggctatacaggatagcctattgctcctaggctacaaatctgtacagcatgttattgtactgaatactgtaggcaactgcaacacaatgataagtatatttgtgtctaaacataactaaacatagaaaagttactattaaaacacagtattgtaatcttatggcacatcattgtttacgcatgtctaaatatatctaaacatagaaaagttaccatcaaaatacagcattgtaatcttatggcacaccactgtttatgcggtccatcactgactgtcagtatgtggtccgtcatgactatacttctattattgttactgttgtacatgtacatgtacatgactatacttctattattgttactgttgttagtagaaggcccaaggagattcctatatgcctacatgtgctataatgtgctattagcattggagacattaagtcaccttagatggtaacagtaaaattctttttcccattaacaagcaaaaataattaattacgtttctggaaatttcaaatcaatggtttaaccatgacagtgcagaaatgctgagaagataataggcacaatttaaaatacacagctatttagttattccaaattctgtctgtagctttgaagaaatagggacacgttataaagtatcatatactatgtatttatagaaatggtgtatttctgaagattaaaaataaaattataacataggaaattggatctctatttcatactatatatatgtaaatcaaattcatattgattaaagactttggtataaaacaaaatttttaaatgtttagtggaaaacaaggttaatatcctttagatcttcatgcagggaaacattttcttaaattggacataaatgtattaaccagaaaagtaaagtttgagaaatataatgtctattcctcaaaagagcccttgaagtcaaaagacaagttacaaacttgaagaacatatttacaatttgtataacaaattattagtatcaaaaataaagaattctaacaaatcaacaagaagagtgtgcacacacacacagataatggcacataaacatatgaagaggagttcagcatgattagtgttcagcagactacagaggccataatgagactcctttttatacctatccagtgggcagacattaagaactctgacactaccaaatgctgaagaagatgtgagtctacaaactcacttgtatactgcacatgtgagtagatattagtgcaacacttgggaaaaacagtttgatatgacctcctataattggtcaattacatattttatgttccacaattttacttctaggtatataccttaaaaacctccagcacatacacaacagaagacatacaagaatgcatatctgtgcctgttcatagaatggaattttatatggcagtcaagaactccaacactatggatgtcttagtaataacagtattaagtgaaaaagtaagtgccagagaattgcatgcatgataccataacatgaatcatgcatgataccatttttataaattttaaaagaattaaaaataaatgtttctataaaaacatgtaaatattaaaatgattaaaaaggaaaacaggctgggcgcggtggctcatgcctgtaatcccagcactttgggaggccgagacgggcagatcacgaggtcaggagatcgagaccatcctggctaacatggtgaaaccccgtctctactaaaaatacaaaaaattagccgggcgtggtggcaagcacctgtagtcccagctactcgggaggctgaggcaggagaatggcgtgaacctgggaggcggagcttgcagtgagctgagatcgcaccactgccctccagcctgggcgacagagtgagactccatctcaaaaagaaaagaaaagaaaagaaaagaaaagaaaagaaaagaaaaagcaaacaaagaactgatcaactcaagattcagggtggttgttatctgttatctctggagagaaaggagaggtgaagggatgaacaaaggaggagcctataaggttagttgtcagaaacaacttctgtttttggtggtggtttcactggtgcttagcaaatatgtaaaaataggctatgcgtgaacaagatcggagagtgccacagaccgggtgttatcatcaattcaattctgtgcacataaaatcctttaaaaaaagatgaatcccctttgagaacaaacctagataaaaaatatcaaactgaaatcatgtcagtccaaatatatcgaaaacctccaccagccagctctgattgagactatttgtaaaaggatctttatttaacattacttccaaaagagatattgcaaccatctaaaagattcatcaatagaggaatagcttaaaacatctgtctacatttatactctttcattaattcatctcatcaacacattgactgagtgtccacaatttgtcagacactgtgggaatacaatcatgaacaaaactgatccaggtcctgccctcatgtggcttaacaatccttttaaaaagggaagacaggccaggcgcagtggcgcacacctgtaattccaggactttgggaggccgagatgggtagatctcctgaggtcaggagtttgagaccagcctggccatcatggtgaaaccctgtctctactaaaagtacaaaaattacccgggcatggtagtgggtgcctgtaatccctgctacttaggagggctgaagcaggagaatctcttgaacctggaagacagaggttgcagtgagccgagatcatgccactgcattccagcccaggcaacaagagcaagactctgtctcaaaataaaataaaatataaaataaaaaaggggagacaggtagtaatcaaagagtcacacacacaaatgtatgctgaaaacagacagtactgtgaagtaaggaatacagggttatagaagagaaaaatggagagagacttatcttgaagcctgcagccaagacttcctgagaaaagggacatttaatagaggcctgaaacaacagagatctgggagtagttacccaagcaaaaaggagacagggaggaagtattgtccaagcacaaggttgagagggtggatcctgtggcagatgagagatcaagctattacagaggcaaaaggtaaaggtggctgaaaccagggcaagggagacatgggggtgagatagggctggaaaagcaggcaaaagacatatcctggtgcagaatgaggccaaggatttcaatcgttgttcaaagagcaatgtgaagaagaagtttaagcagaaaagcaactacatcagaatctcactgcgaagggatgccctgcagccacgtggagaatggagggtccgggcatggatgaggcaaaggccgatgcccactttgacatgagaaccctggctctagtgtgcagcagggtcaagaattgttggaggaacagcaggaggccatctcagcagcacaggcaaggggcaaaggccactagcctgaaggtgttggcagtggggctacagagggtggaggatttgagaattctctaggtggtaaaatggagagcatcagaggtggaaaaaatatgaagagagagggagagggaggcacctagaatgacttgtagagatgtctggcttctagaaatggatggaacgctggaagacgagctgtgtagggctgggaacacgatgagttcagtttggagatgactgagcttaggttgtcctgggacacctaaatggagatgccatgtaggctgtcaagtaagtaggtctggaggggagcctcacctggagataaaaatctggggacaccatgtaactgttcaaatgaatgaggtcactccatataaactgacttggtatgatgtctgtgatccactgccaaatgcatactgaaaaaaggcaagttatagaacaatatgtatcatatcactttttaaaaacatgtagaaaaatacttaatcatctggcctgcaagagaaatacacacactctgacctacacacagacacacacacacaatgaaagaatatacgaaatattaacctatccctatgatttgataaagtttaggtgggaatagataagtaaatgaatttcacttttataaatttctgctttgctgactgtcttgtttcttacaatgagtacttaataacccccatgcccacttcattccatccctttttcacccccaactcctaccttatcctgaatccccacccagtggcagaagctggcaagagaatgggatggaaagagaaaagatgatgtcagttttgcacattattttataacaaaataagaacaacttggtgtttgcttttaagatgcatcaaaatagctgtgtcaaaacgttccctggtaaaatgccattcctgctcctgaagggtttgtaaccaagttggctgagcagtaagtcaattaagatgattgtcagagcatgaagtctacagcaacactgtccactgcactctccctagaggccctcaatgtgctctgaggatttccaagtctcatgtaacacccaagaacacaccacactaaccaagaaatgttaaaaacttcccattgtggagaacaaggtagcaggaatttgaactaatgaacatacatgaacaaaaggaaattaatataaacaagaagattaggtggcttttgtggtttatcctgggtttttcttcagttacttaatataatcaccctgcacagtgccagcccacactcagtacatacttgtggaattgtttttaacatgtccaagcctctattgggctgagaatattattttccctgaacaaaaatggggtaatgctgaaacagaagcattctaatgtcagaaagccaagagacatattgcgtagccccatgtgaactttcttcttccattccctgattacataaagcatagactgatagcatcaaatgagatcttgaagctgccttgttcaacagctgggcacagcattgtttaaccatgcttgactaagaagtgtatgctgaaaatgtggaaccagctcaaatgcccatcaatcaacgagtggataaagaaactgtggtatatatatacgatggaatactactcagccataagaaggaatgaattaggctgggcaaagtgtcttatgcctgtaatcccagcattttgggaggtggaggcaggtggatcacctgaggtcagaagttcaagaccagcctagccaacatgatgaaaccccatctctactaaaaacacaaaaattagctgggtgtgggggcgcatgcctgtaatcccagctacttgggaggctgaggaaggagaatcactggagcccaggaggcagaggttgcagtgagccgagatcacaccattgcactccagactgggaaagagtgagactctgtctcaaaaaaaaaaaaaaaattaattaatggcattcacagcaacctggatgggacaggatactatcactctaagtgaagtagctcaggaatgaaaaaccaaacatcatatgttctcactcataaatgggagctaaactatgagaatgcaaaggtatatgaatgacacgatgaactttggggactcagggggaagggtgacaaggggatgaggaataaagatcacaaattgggttcagtgtatactacttgggtgatgagtgcaccaaaacctcacaaatcaccaaaaagaacttactcatgtaaccaagtaccacctgttctccaaaaacctttgtaaataaaaaacaagaggtgcatgctgtacagacatacacctaataactgaaccatgagtatgtgtcgtaccaggaaggcaaacacaggtgaaattgctcccatcttgcttttcatttgcatcaatacagctcgcgttgttttggcaaggtttcctctggcaagcatcgtattcttcacagaaagtacccacgtactgctcctcacaggtacaggaaaaagttgcctaaaacacaaaaaaagcacagtgtctattacctggcacctctcaacagtgtgctttggctgtgagactcaaagtttgaaagaaccacttcctttttataatcagcaatttaatcaaatcacttatgtcataatctagttgaaatcatcgctttaagacaaacagtagtttctttacagtctaatctcaaacacgtttttctattctttgttcatatttatccccgtcattttcgatcttcctaaaatagaaatgaaatgaacttgttttaagctaaaattgaagttttgctggccagacatggaaatggcaattttgctagagcagatagtttaatgctacagccattaaactagatgtcactccaaccaactaaaaccttcaacagagatagcacttgcaacaaagatgtcatcaaatgtccaacccagaccgtcctttcagaacactgagaaaatgcactgaatcactccttcaactggcctcaatgtacagccatgcagattacctgagtgcaagggaaaataaaaggagtataattcaagtaaccattttgtatcgcttatgatattaacattatcttagtaaaagaccataactcagacacagagaatggaatttgacttgaagcttcatttctgagataggtgcaaaatacaaacaaaactgggtttctgtccccttcttaatgacagcctaggggtacgggcatgtctgaaataaaccacaaatctgtccccaaagcctacacaaagcaatatagatcattacagaagatttttatgaggaagagaggaggagaggcaaaggagaatgacattaacagatcttactacttaagaaaatctaaacaaaacagacaaaagccccttgcccagctcatctccaagcctggcacatggggcagatgttcaatctctaccattccccagccattatcccctcaccctccctccctctccctgtcctcagcctcccgctgctaatcttagaaagagactctctcctcttctccaagcactgtcaactcaggatctccacccagtaccccccataagtacaacccactgcctgccttccccttgaagagaaaagggttatccattcttctctttagtacatttttgtctctcaatcaagtttcataattcctgcacatttcttgataaatttactcctgaatatttatgtttttgtagctattgataatgaaatatcttcttcatcctattcttgttaataccaatgatacttgctagtaattattacacaggaataaaatactagggttttgtttccagttatcacactgagcttttagtacacgtcagagtttttagttgatttccaggctttctacatgacacaaaacaagatgataataataagtccataacaattgcaaatagtaataatgtcatcttttcttctccagttctcaaggttacattggcagctcttccggaataattttggcctcagagggatgcttgtagaatttaccactaagcagattgttggaatgactgtgaaattttatcaaatgccattttagctcctacaggaatcatctattgttttcatctgtgacctattatgacatgaattcaatatccagatttcctagtactgattcaaccttatgctcctggaaggaacatccacttaagtcattatacaaaatggttttaatatggctggcttctattagtagtcatacttctagtgccttccatttcactctccctccaccctctttccccaacagatttcttttctaagaaaaagctgtcccttgcacatgagatcatgttttacactgcataggaggatgcccctcacaacaactgactgaacaagaagtgtgcagatccctcacaaaccaaccaagaggccagacaacaggatatgacatttagctcgaccaaactgccaaattgtatatgggtgtctttcttctgttaacagaatacggttttttgctaagggaatacaacaggtccttgtaatctgcataatcaagtctcctttagtttaataatacattcttcaatgatatcttagaagctaaaacaattataattttttttaaaaaaatcctttcttcttaagctggagctatattttctgccttctatttctatcacctctcacttctttgtggtaaatggaaattccctcttcattctagcaataaaatgaggatctatctgttttttcatcatgttttgagttttttccttttgtatttgtagctggaagctaagagaagctgtcagaaaggtatttttttaaaacaggaaactcctttttttagaactgtcttctaaggacaatcttgtccttgctcaaatgcataacagagtacacatctgatatgtgcatgagtcctgtttggagctctctgtgcattggaagatttgtggccacctttgaaatgtaaatgctgtgcacgcccagtgcatacaatcccaaagcaggcctccaaatcatgataaattactatatgtcattggtcttggcagctgtcttctaaaatttacttggtttgtatccagacattccatattgcggataaatttgcttggttatttgacggatacatttagcatgtaattcatctagtgcattccatggaaaatatgctgcttatggaaataaattattgagagccccaaatcaaatatcttcaagttagctttatttttttatttttttttttttgagacagtctcactctgtcacccaggctggagtgcagtggcacaatctcagctcactgcaatctctacctcctgggtgcaagcgattctcatgcctcagcctcccgagtagctgggattacaggctcctgccaccatggctggctaattttttatatttttagtagagacagggtttcaccgtgttagcaagctggtctcgaactcctgacctcagggtgatcctcccgcctcggcctcccaaagtgctgggattacaggcatgagccaccgcacccagcctcttcaagttagctttgattgaatttagagataaaacagaagccatccattttgttttgctttattgcaagcaggaaccttgaaagaaacctgaagaaactgttgaaacaattgcttttgataaagtagaacacaaaattgattcttaaattttcactgagagatgaggaaggaggttaacaaatgtttaacatattcatgaccataaaattttagttaaatatttgtatattctctatcatatcatctataaagttagattactccctgtctattttctaagaacaaagagctttcctataatattaaaaagtttgttttgatagttttaagactgctgacttgtaagagatcatgaatgtttattataggaaactatgttcgcacatcttttgtgaaaaaccatgtttgaccactgaagtttaactcattgcctgtgatatcactaatcactaatctaactccaattaactccaccagcataagggacaaaataaacttacttaaaattagcagcttagctaaattacagaaagatacttccttgtaaaagtattgtataagtacacggaaatgtacttttcaagtaaaatgaacagtgaccctcagagattaatttaaaaacccaataaagaatctcaattttcctcaacagcttgaagtcaaatatgccatttgtacattaatgaaactttctcagtcagtcagctgtgggaagacgtagtgccagctattggggaagctgagggaagacgactgcatgaccccaggaattcgaggttgcagtgagctatgatcatgccactgcactctagcctgggtaacagaatgggacgctgtctctaaaaaaaaaaaaaaaaaaagaaaagaaaagaaaagaaaaaggccgggcacggtggctcacccctgtaatcccagcattttgggaggccgaggtgggcggatcacaaggtcaagagatcgagaccatcctggccaacatggtgaaaccccgtctctactaaaaatacaaaaaaaaaattagctgggcgtggtggcacgtgcctgtagtcccagctactcaggaggctgaggcaggagaatcgcttgaacccaagaggcagaggatgcagtgagccgagatcgcgccactgcactccagcctggtgacagagtgagactccgtctcaaaaaaaaaaaaaaaaaagaaaaaaaattaataaaaggaaacttctaggttagaaaaaaaatcacacatgcattcacttatttgtcctttcaaccaatgtgtattaagcatatactatgtgccaggcactgttctaggagctgagggtcacagaagtgaacaagaccctctcctggggtttatattctagtagcgttgactgacaatgaataaaatgaatgagaaagtggtatagtaaattaagttataaatggcatggggaaaaacggagacagggaatagaagtggaagggctgttatgaagaacacaatttaaaaccggatgtactgagaaagtgaaaacagggccaggacttgctggaggtgcagagtggccatggaggcatccgaggaaaggtattccaggtgaggggaacagccagtacaaagacttcaaggtggaccatgcctcacatgttcaggaaagatccagaaaccagtgtcgctagagtatagcaaataacagagagaacactgtaacgtgagaggtcactgggcgtgccgtcaaatcccgtgggatggtggttttcatgtagggaccatattacctcccagaagacatttggcaatgtctggacatactttttggttgtcacagccgagggcttgctactagcctctggcggatagagttcaaggatgctgctaaacaccttacaacgaacacggcaggtcccacagcaagaaactatccagtcccaaatgtcagtggtgctgagcttgagaaaccctgatataggctttataggctactgtaagaaccctggcttggtgtgaaattttggaaaagatagttcttgcgccagaaaagacctgaaaatgcattgcacatagtaatgtcgctctacgttaaattaccttgtttcattacaatagtttgttttattcagataacacccagaccctgaacgtaagtaatcccacagccatctcaaagcagaagctggatggttatttattcagggaaattatgtttgagtcttccattttcacatgatgatgtcagtcctaccatcttaggtgatcttccaagtatgagaggtatctttactcagcattataaaataactggctattactggataatttaacttaaactggatattgtccaacatgtattcaataattccattcattcaacacacgttttttgaacactgccatgtgtctagcaatattgtgaatactagagatgtggtgaaggtcgaaaggacacagtccccattctagtggaagaaaaggacatgttctatgtcagataacatcctagagggacaacaaatatatagtttcctgtcacattgtgtaagtgctataaagaagtgtaaattgatacgaggagacagagagtgacagtggggtgtaaataggcttttatctcaatcaaagtctagttgggaagaccaatgtctttgaagaattgcacataggtggaattcaacccttcctccacacagtcaagctttttacacctaaatcgagtccaaccatcagaaaactgaatcagaaaactgaatcttggaccgtattctcttgttcctttggcagaactgctttcactgagctgttatttcaccttacactctcaattaaatattgaagagccatataagaaatatccctgttaaacctaatatgacatccactatgaggatattgttgagaacattatataccatatatcacttcgtgcaccatttacgaactcttacccaagaaaattcactcatttaagtgccacagttttgctagtctttagaactcatgtttcattctcaagaacgatgcaaatcatgcgattactcttttttttttttttatttttgatttgggctgctgtaagctcagggtctagttgaagtttagctttaacaactacatagggctctatgactacctgactatttctcctttctaacttggacaatgccttctaatttatatattccctgattctgacttttttgatatttttctatttcaatactttatgtaatatagagccaaatatcatgaataaatctaaccccctaacacagcactcagagcacttgacagtctggccccaacccaccttttcaatcttattctctgtcattttacctctctcagtaacgcctgtgtgttggtgaacaaatcattccagtgagacaagtcttctcagcagctatatttcttgctttatggatcagaacttataattctattttactttctcccttaaagaacatatacagaaaatatacttgtctttttttgatatcccagtgacatcagtatcaacataaaatgcccaactgactagacattgaatttcattgtttataaagcttgcttcagtgaaattattgcattaaccttcaccatgtctgtcaggtgatccatcttaagaattgagaacagactcaaaaaagaggtcaggaaaattatgtcaggtgtcccagctggcaagcagaaggtcaaggcttgaactcacattgtctaattccaaatcctttgtcattcacagcggcatacagtcccctcattactgtgatggcctcgggttcagaagatgcgtgtggggaggcccttcacccttaagggcatctgctaggtcaaaactctggctaatgagttgacaactctcaaataaccccggcaatggtggcattttagttctcactccagatttctgtggtttttctacttcctcccttgctgtcaggctgccttcatcagctctgcattagtgactatccctttggttcgctgattctaagttcctgtaatctgagactactactgaatttattcaaataaggtgtcaggatagagtaaaaactatcctatctggtggctgaaagtacctcttataagaggtatacataaagcgcctaattgctcctgaacagacttaggaacttcaggcaattcttcgccagaattggaagtccttgatgtctgagactctagttactcagacataatagatgcttaggtgttcactgaaataaactgacatcataataggctgcttagcagtagtcttgcgggagagttctgcacaggcacaggatcttctcctccttcttccgtgtctatctctgatatcctgggtttggctgtaagagcatcagagtcattctttgagcacatgtttatacaaactgggataactggaaccaggattaggaggacagtcccaagccaagaggcgactaacaggcccctaactctgaaaacgaaatggagatgattcaagccactccttgctaaaggaccccccaggccaattttgatttccatcgtgagccagcctaattccaaactacatccgggttattcatagttaaatgtccaaacatctgctaggtcaaaactctggctaatgagttgataatggttgaaactaggtgacacaggcatggtggtctgccagttactctatgtttatatatgtttgagattttccataataaaacaaacatttttttttaattttaagaatctggctaagtaccaagaaaggaaagctaaaactcggaaacactggaattccatttgagcatcccacatctggctcttccccatggaatctgccattgcatctgctgcaggactgctgtggagaacactgtgagcatgtgactgagtccccacatatgaagtcccactccagagatttatttcatatccaagtgccaggaaaatctctgctcgccttaaggaactaacatgttttctccttgtggacaacataaatcacataatagagcatatttccctccaaacaaccctgtcagcttgaagaaaaggctcagccattcctatgccaagggagggtctggctgcctctcagcttccccagtgtactggggtcatgactagggcacgcccagccccagccttggcggaagcagaggaattcctgcttacagagcctatgaataaaaagtccgaagacctctctaaaccagttccccacatactggcagcatcaagttgagttggtttcctaacatcggaaagctctggaatcattttgctcctagttaatggaggagctccaggagcctgtccgtaaagattccaggagtaagggctttctgcagccacttttaccgacagcttatgttgccctaagcagccatcagtgggaggaagacagtgtgtcctggccgactcatgtaacgacacagcattggtcagggtctagcgagaactgaccatcaccccaaatgcactgagcctgaatctgtgcagacagaggtcacagaaaccttgtcctgctaaccctcagccaaggatctattaacccagctcctaggctgtgggaaccagacaggacagtcatttaggtctgaaattacataggtgacagacactaaaacctagatacaaaacagtaaccattgacacattttgatttgattaagcataggcgagctatgactaaagggtcagacaaccagttcagcatccccttttagccatgtagagtttaacctcctactaaacccagatttagtatttcaagaagcaaaaaggactatgtggatgtaaaatttaagagactacctgagaattccatgtataatgtaaaaatgactataaatgccttttcctgaaccagaccacacaagaacacatggaacctagccacagagacaaactgttgctctttgggggaacacagtgctcaaagaaaaactatgaattacatgttttaaattcttgtcttttggctgggtcttattgttctattattcattacacatgtaacttaacatgttcatatcacttatagctcataattttatttcctcatcattcttagatatactatcattcttttattcgggttcagtaattgcaaatgttgtagcttattataaaaaaaaaagacaagcgtagaaacatgcagatcatctcagcattaaattcaggacttgacattcatgaattcatggaattcattccttcagcttaaatgataaattttaaataatagtagcaataatgagagtcctgctctttccttccaaggacattgaagtttactttactacccaggggagaagaaagtaaatgtcttttaggaaatgctgtagaagtctttcttcctaaaactagatatgtgggttggcagaatggagatgttcaaaagcagcttccagccatatactggcaactcatgtgttctcagcactcttggagtggttataattaggcatacaatttacatgtaatcagtcttgatcttcaattcactcacatctgtgtatttatttgccgcaacgttctaatccattaacaaaagtaaagtttgactttaaggaaaatgaatgtcactgaaaattcatctttgattgaatttccctgaaaaaagagcctgttcccacaagtagacaacataccattctactttcttattttaaaattccatttagccctctagttatttcctgtgttatgccacaagaaaatggaaaaaaaatactttaagaaatgaaaattgttatgtataaattactaatgagaagggctggttaaagaatagaaaacctgcccagcatcttcaagttacctcggatgggagcaaaaatgataaatcagtgaagcagtggtgactcttcctaaagatggaaagccgatggggacggaacagaggacaaagctatcatctcctgaaggaagccctgccatgtgccaggtatcatgggaggcttctttcatttaatcctcccaacagccttccaaaataagtgtgatttttccatgttaccaatgaggaaacaaatcagacaatttaagtggcttgctcaaggtcacacagctagtcagaggcagaggggctcagattgagtctcattgtaaagaccttcttacaatttaagacattcagagatgcaaggtaggagggacaggactcagacaacatcctgagaaaggtgatgaggggagcatgatgcactgagtgggaatgggaagggggtgaccccctaaggcctcatccactcttaggtctggtagccctgggttccagccccatgtagggcacaaatcctctctgctgctgtcctggtcccagagatctcatgtcactccagaatgctaacaaccccatcgtgggtttctttcctactctttctgtattcgtttgctagggctgccgtaacgaagtatcacagagtaggtggcttaaacaacacaagtttctttctcatcgctctggaggttacacagcctgagacgacagtgtcggcagagctggtttctcctgaggcctctctccttggtttgcccgtggccatctcctccccgtgtcttcacacagtctttactctgtgtttgtctatgtcccaatgtcctttcttattggatgaggacccacccatatttcactttacctctttaaagtgacctcatttcactttacctctttaaagagcctacctaaatacagtcacactcttagtaccgcaggttatgacttcaacatacaaatttggggggcaggaggacagaattcaaaccatactatttccctttcccctttctgcttcttcctccaactattttcagaacagccttcctcaaatgctgcttttagtccttcacagatatctgatgcttactgtattcagcctcttatcctagacggtgcacaatattccttgaacaattgctgtctgaagaggttagcattgcatgtgcagatgcatgaaacatagctcatgagctccaagaactgacaatctagttagagaaaatgtctgtgtcattctcatcatcatgatcatcttcactgtgaatatttatcaggccttcaataaatgccaggcattgtactaaaggctttgcaaaatgcagttatcctcatagctacctctgaggtggctgttattgttattctcattttatatttgaggtaactgaggcacagagagggtgagtaaattgaccaaggtccgccagctcgtaaattgaaaagctgacatctgaatccagctagtctgatggcaggacctgctctttacattagaagaacatgaagcagagatgacaaagtagcatagccagggaaaacacgaccttgcttgctgagatcttgttcctgggtcttctctctttttgaccatgggcaagtaatttatattatttattgcattgtttcctgttaggcctcacttccgtaataggagaaaataaaaggagatgtgcgtaacccaaagatgctattatttatgttatgtttttaaaatttaactgttgaaagctctaaaatgacacaactgatattcaaaaacacttatccagtaacaaaggagtcagtgcagacatgaatacaattactgtattcatgacccaggatggttgactggtcctccttcccagttcctgcatgagtgaggcaatgaaatcaaatcaaatcacaggctagattcatgaaccaggctgtatgcagagattagaaattgggctggggtaagatccccaaaccccatcccccagtctctttttttccattaagattacccagcccttcaccaatcttggagatagggaagaatcaaatgctgaaacagctgtggacaccagggaggagctgcacctgcacctggtccaggtaaaagggtgaagcccttgatcccttatagagagtctccagtgccctgactgtttcaaacactctgatcgctctgggccaggccgaggtcaatcctgagtggcagcttttgtccttctggggctgaaccatttagttctcaagacgtttgtcaccatctgaaactcaagatcctgagacagggagatggatgtgacgaactcccttcgggacgtcccctttaatgacaaggctgccgtctccatgcatcactctgatgtgtggctcttctctcatctcccttcctccatccttgtttccctctctctcctcattcccatggggctctttcacatgtgtggttcataatatcacaggctgcagctaaaaaatatgcgtgtgtctcaacgcccatctttagccgggatgtgggccttcttctgtgcatgtataactttaacccagcttcactttcctagtcaacctaaaattctttgcctcagtcttcacatcaactttcctcttagtaggttattttatggtttatgtatttttgtggatagcctcaagtctaatgcaaagagagagactgtaaataaatttttaaaagtagaacactgcataaagctgacataaggaatcactgtagtcttcctaatgggaagtgaatgccagctttacagcccattgttttcctatagaaataataatatacacttaaatctaaatattgatatagtctaaattccaagagttttatgtaatccttgatatcatggaagttaactaaaaaaaaagttcttcagtatttaaggaaaaacactttgcattttatttctatagtctctgatctaatcaatgcatttctttttttatttattattatttctgagacaaagttttgctcttgttgcctgggcgggagtgcaatggcgtgaactcggctcactgcaacctccacctgccaggttcaagcaattctcctgcctcagcctcctgaataactgggactacaggcatgtgccaccacgcctggctaattttttgtatttttagtagagatgggggtttcaccatgttggccaggctggtctcaaactcctgacctcagataatccatctgcctcagcctcccaaagtgctgggattatttcttactttatttgaatctagacccacacaaattgatataacatcagcaaaggtgggaaggtcctatcattcatcttaattaaatcttattaaatgcttgttgatttcattattttaatattgaacaaaaggcaggttagatctaataaatgtgtttctccagattaattagaaaaagaatcattttaataggggtctctggaagaaacttaacatatctaactcaagagtggcaaaagaattagaaaaattcaccaacaaaataaacctttcttgcttttgaatttttattaatctataatattcacatgaagcgatttcttttgtgtgataatttaatcctccaattctgagcaagaaaggaaatctgcatacgactttgaatttaagaacattaacactgctcgcgtgttcctctcaaaagtgcctgggttaacgtatcatattttaactattatgatgcttgtagtttctttcctaactcatttacgatccccagactaggaaattgaattcaggccctttatacagaggaaatgaaacccacggttaataccctagagcagcagtccccaacctttttggcaccagggaccagtttcgcggaagacaatttttccctggacagggtaggggggtggttttgggatgaaactgttccacctcagctcatcgggcattagctagatcctcataaggagtgcacagtctggattcttcgcatgcgcagttcacaacagggtttgcgctcctatgagaatctaatgcctccgctgatcggacaggaggcagagctcaggcagtagtgctcgctcgccactgactttctgctatgcggcctgattcctaacgccatgggcaggtaccagtctgtggcccagaatgggggacctctgctctagagcttctgtgtccccatctgatgatggggatggtgaaaatgtctgtcacagcgctgtagggtgtggaagtctttgagccaacacagatccatctaggtgctggaagaaacattaagtgacgtcctcattcacgtgcacacactgcagcaaaagccaatcgccttgcaatatggctgccatctactacggtcctcggtgtggaaggcaagctcaaattcttttttctaagtattagttacagaggctaattttaaaaaagaaaaagatcctatgagttggcctaagcgcctgtcctctccgaaagctgcataactgggcttttgctgtggaatgaggctgtcgttcacgtcatcgcgtgagggattcttccagagcctgtaaagctcctctaaacttagcctggtttatttggcataacctctgcctcagaagaataattcaaataccaccagcttcccctgtttctgaaatgaaacccagacatgagattcagatatgtgcacatatctgacgattcttacctccccaaacccagatccctgttctcacaacccatacctacaagttgcacctgccttctagaatgatctactattctcactttcactgaaaccaacccccaactaagctgagttgttccagttttagtaatagataacaccttaatgtgttactattttagggacattcgcatttaaatagaaagccatgcctttattatacaggaattaagttcaaagaacagaaatccaggcagcctgccaggctggtgtctcaaggaaatttggggttgagaaaccaccctagatagctttgaatcttacctcagtgccttctgtccaacagcatggacaaatggattgtatcaatgtttgagttacttctattttttaaaaagaatgttttgttcaaaagcaaaaacttcataataacttttttttaagttattttctcctactattactcctggctggtaaatatggtttatctattttttagaagacctatgtatcagctttctttctgggatggggaatgattatgtattcacgagtatttctggctaaaattgacatatgtcaacaattttgtattttaaccgcaaagctgaaatacatttagctgagtagagcttcaaagcaatggctaaaaagtgaggcaaagggcacatttctgtggccagctgcaccaacacttgtcacaacacaggtctttaaaaaaattacatgccagtgaatggagcatgtgctaatgactcgaactcagaaatttaagtatcaactttcttccaacaattatcctgcaagattagaactccaagagggaaattagacatgagtctagccccagtgatttccactaaagctaattacaatcccttctgttggccagaagggtccctgctcactcaaaagacgatgagtggtggcagaaacttcctaggataacagggtcaggatgccaagtgcaacaaggaccatgagaaggtgactgttgacggaggcaactgatggcttcttttgtggtttgcgcatcacatgtgccaccttttactgggaaaatgctctacaaagtgcttccacctttgtgatcttatttcaacttccattagaaatttttccagcatttacacagatttgtgcagcctaagtccttctacccaccacagccctgtgacatagatatttctatcatccccaggatctgatagggataccaaggctcttgggaaataagaagggcaatttcagtaaatgctggagtcagacattgaactctgatctctacccgcaagtctgctggcttccacagggccatgaagcctcctactctatcagatgattttgtacaaatatggaagcccatgctgacatcacctggaccgaggacaggaacacataaatatttgctgtccccatgaattctctctctaactaggaaacacaaataaggccttcccgtgcttcttactgctctaaacaaaactgaaaaatgtgagtgtctttgcagtgctaaaaattatctaaattccaacccttactgagattgtgtcgcttaattccctagagcctctgttcccattggataattccagtaaagaaaatgtccatgtcccggggctgtggcaggtgggagatgcttcctaccagggcatagcagtgggactgacgtctcattagcagtctgtggatttcaatcaagctaatgtcacggagtatatgtgattaaattgcaaaatggattgttcttctggtagaaaatggatgaataatattatgctaatctaaatatggaagcccatacttctcacagtttcatttattttagcaacgtgagaaagcccttcaggcaaaaggcaagtctacctgctgcttttgattctagataccacaacataatatctttttttttttaatccccaaatctaccatatgtgaagaaatcctaacaatagaggagcgagcttcggctgaaaaatcaatgaaaataattcaagcttgatgataagtgagcggatactgcaagtttccactgtctgtggttaagccccacccttgatctcctccaactccaagtgaaccacgacccttgccattcagccacccatcttaccaaaggctctttttccatccaagacccctaccacacttcctcggaagattgtttcatcatcacttcagctggtgctttcatgacatatataactcatccctttaatattttactttcaacccaacattaatacttctggaattagcatttaatttggctaacgtgtatgattttgttcaactgtccattactcacacctgtagtactttgcttaccagcacttacatctataggaaaccaaactaagaccagagaattacaagaaaaaaaaggtaaaggtaaaatgctaaccagaaagcatgtaaagacatgaagaagaggccaggtgcaatggctcatgcctgtaatcccaacactctgagaagccaaggcagaagaattcctcgagcccagaagttcgagaccagcctgggcaacatagggataccctgtctctacgaaaaataaaaaattagctgggcataagttggtatacccgtgtggtcccagctgctcaggagactgaggcgggaggattggttgagtctgagaggtcagggctgcagtaatcacatcactacatgccagcatgggtgacagagtgaggcctcaagtctttaaaaaaaaaatgaagaaggttaatagaaaagaaaaatgaaaaacacactaaaggagtttaaaaagcacctattaaactataatggggagatagaatgaagagagaaaaagcaaaaaaaaattttaagtttttctatagatatagacctaaacacacatgcataattatttatgaaatatataaatggtattctataagcagctacaggtacttattctgttcatatacttcaatgttcccccagattcctgccaaaatattgccactgtgcaaaaacaaaatgcataaatgacagcactgatgtcctacataattaatgacctttgaactctgggcaactctgggacattccacatttgccagggcctcttcagattcccaggaagactgttatgctagagtctcctgtgcccttctctctccatttgagccctaaacgatatcccattgcacatatcacataaccacttctgtctgaggactgagccacagctcaaattttctgcccagaaattgcatggaaacgaactacagtcacacagaagagagatgactgtattcacggcaatggcccgagagggcctgtagcaaccttgctgggtttgtccattactaagcagctgccgaattccagggggagctttctcattcccttctggagtcagtttctctatcccttattgacttggaaatatcctatttaaccacagaaatatcattaaactagaaactctcctctgccgtgaacttggaaagaactaatgcctgtggcacaattaaatgctgatcttagccttcaaatgctcattatgtgaaagaaaattgagtatggaatgattcccctgttaccgatcagtaacagatatgtgggtgtaggccaagtttcttgggattattcttgcagtacaaggaaaaagcaatctaaaggaagaaacccatacgagcattcatgacagcctgacagatgctgggggtgaggtgtgacctgcccttttcccacagtggtggtggcttccttttgggtcaaggcaatattagggtaccatcttctctgaatttgccttattttacattccctagaaacaatccaaacttctaaaagactctcagacaaagcataacctgagaatgagcagatatgtcagctctgccctagcctaggccagtactcaaggcagcacaggcaaactcaatcagccacctccatccaaagcaaagcaacccagtatttccaggagtgctgctctcaatcaactcaacgaagtgacgtgcaccattgtttcttgccctgtaacccagatctgcttcatgcacaaacagcatatggttggaattcagttttgttggggaaactcatttttttccaaagacataaagcacctataatatttttttcataaaactctgattaacatagcatcattgatcattagaaaaatgcaaccaaaagcacaagataccaattcacactcagagggatggcaagaataaaaaaaaatggaaaataacaagtgtttgtatgtggagacattagaacactcgcacattgctggtgggaatgcaaaatgcttcagccactgtgaaaaacactttggtaactcctcaaaaagtaaaacatagaattagcacgtgaaccagcaattctactccttaggtattcacccaaaagaactgaaaacaaggacttaaacaaatacttgtacagacatgttcatagcagcattaaccacaatagccaaaggtagaaacaacccaaatgtctatcggtgataaatggaccttgtggtatatccatacaatggaacattactcagccatataaagtagggaagtactcatacatgctacaatatggatgagccagaaaacattatgctgagtgaaagaagcagacacaaaaggtccattcaatatgattccatttatatgaaatgtccagagcagtaaatccacagagacagaatgcagattggtggttgacaggggttgggggaagggacaaatggggagtaactgcttaatgaatatgaggctttattttgggggtgatgagaatgttttggaactagacagaggtggtggctgcatgaagctgaatgtacttaatgccattgaatagttcaccttaaaatggttaattttatgtcatttgaatttcacctccatttttaaaatgtagagtacctctgtcaagtcttttgcctgacatcactcgctcagaaaaggaaggtttcctccccttctctgcagctttccttacctctgtcaattccatcccctccaagaccttcatctgttaattacaccccacctaaccattctgatagctcccacctccccaggtgccagtttccttccctcggcctatttcaatgtgatgtatcctctgctctagaagcaaaagcctttcttttgaccgaatttcccactcaggtaccatctcactctgtccttcttttcaatgccaaacttatcaaaaaggcaagccacacagattgccaaagctcctccttggttcctataatctggcttcctccccaccatcatcactgtcttctcaacataaagatccaggggcaaattatcaggccttcccacaaggagaaggtcccaggccctgggtggaacccaagaaatgaagcccagggaagccgaccaatttcctggaaagcaactgctcaatttccttgtttctttttactgtcttgaaagctttcaacaatgtttatcaaaaaagttggttttaaccactttagaagatttctataattttaattggctggctttcattttatttttcaacagaacttgggggaatgttcagttcacttctaacctggccccctgtgggctgctggcagagaaggaaaaggagagaaagtgccttgggaataataagggagacagttgctgatcctgggctgggcatgggggtgtgggtggaaatggaagagaaggggttgaggggatcgaggagcagacaaagatggggagtttgtcaaatctgcttttagtagattgacccagagctgttacaaggaagccattcaaagaatcaccacagatgagagactacaatgtgggttttcaagatcaaagcgagaaaaggctgaattattcaaaactaaattaagggttctcagaataataagttaaaggtaaacaaagtaaaaacagaaatctagaagaaaagggttagaggcatggcctgaaccagaacagaggatctcaaaatgtgatttccagacctccggggactccctgagatcctttcaggaggtccatgaggtcaaaatgattttataataatattaagacatgatgtgccttttccactctgttgacatggacaccaaagatgtaaaaacaatagtaagagaaactgctgatacctccgtaagaggcaaagccgcggctttgaagcggtagactggggatcatcaccatcatcagacatttgcagaggggaaaaaaatgtcaatttcacctcgaatgtccttgatgcggcagtaaaaattaaaatttgatgaatgaaccctcaaccctggagtgcacatctttccaacattgtctgacaatggaatgtgcgtaccaggcccttctgctccacacgggaagcactacggctccctcaaggaagtgcacttgggccatcgttcaccgtgacctgaggtcgtccatttttcatggaacaccctttctcctcaaaaaaaatgaccaaaagacaaactgtggttattcagacatggctatttggcagatattttctctcaaatgaacaaagtgagcctgtcacttcaagcaaaataagcaagagtttttgttatcggagataaaatctgagctttcaagagcaaattagaattttggaaaacttttatacaagcttgacagattcccaatacttaaagacttttctgatgaccagaagtgacttttttgatattgtaaaatgaaatgcatcaacatttggaagctctgtataactcagtgatccaatgttttccaaaggactgatgtgtgatgttaccaaacccattcatgggcaaaagatccaaaacacaagacagacattatagatcgtaatagatggtaatggaacagaccaatagattgtaatgaaacaggccaagagattgtaatgaaacagaccaatagattgtaatgaaacagaccaatagattgtaacgtaacagaccaatagattgtaatgtaacagaccaatagattgtgatgatatagagaccaatagattgtaatgaaacaggccaatagattgtaataaaatagaccaatagattgtaatggtaacagaccaatagattgtaatgtaacagaccaatagattgtaatggtaacagaccaatagattgtaatgtaacagaccaatagattgtaatgaaacagaccaatagattgtaatgaaacagactgaaagcgtttgacatggcttcagagtccacattgaattaacctttaagaatctttcacatgtcaaattttggagtattttctagaatatacacaaatatctgaaaggctattaaaacatgtatcccatttccaactaagtatctattgaggctgtattttcttcttagacttcaaccaaaacaacatactgcaacagattgaatacaaaagcaaatgtaaaaatccagctgtcttcttttaaaacagacattaaagaaatttgtaaaactgaaaacaatgccagtcttctatattgttttgttttagaactataattattgttcatttaaaaggtattattatgttaacaggtgatgagtttattgggtttactaataagatgaatttatattttttaattctttttttttattttgagatggagtcttactctgttgcccaggctggagtaccctggcacgatctcaactcactgcaacctctgccacctgtgttcaagcaattctcctgactcagcctcccaagtagctgggattataggcacccaccaccatgcccagctaatttctgtatttttagtagagacggggtttcaccatgttggccaggccagtcttgaactcctgacctcaggtgatcggcctgcgtcggcctcccaaagtgctgagattacaggcatgagccaccacgcctggctgtattttttaattcctcagttttaatttaatgcattaaatatcaatagatataacccaatcgacaaaagctctttggggtcctcaatcatttctaagaatgtaagggatcttgagaccaaaatgtctgaaaaccacaaggctaggtgaagccaaacagttttgtaaataaaacgactaacagtacccagtagacaaatcttcgagtctataactcaataggcagaaaatgggtcaagttctgaaaacaaaagcactatggaagtccagtgagggcggtaatgtttgtccagagggccagtagatctcaactaataccttggagaaagcctccaaatccaaccctgcctgccattaagactcattagttgccaatgcccagagtccactggtgcttcgaaaaagtgctactatactatcctctaatagcagcaaccttggacacatgtaactggtcactcagaagccacttgacaccccacagcttggaaggagatgttgtaaagccagactgatttttttttttctgagacagagtctcactctgttgccaaggctggagtacagtggcatgatctcggctcactgtaaacttcgcctcccgggttccagcgactctcctgcctcagcctccctagtagctgggattacaggtgtgcaccaccatatccagctaattgttgtatttttagttgagacggggtttcaccatgttggccaggctgttctcaaactcctgacctcaggtgatccatccgcctcagcctcccaaagtgctgggattacaggcgtgagccaccacgcctggcccagactgatttttaaaatctaagatgagttcaaagaaggaatggagcaattaccatgagacaaactaaaggtctaatctcatcagacttcagggaaacagatgagtctccttataatttaaagtcatatttggagtgggtgcagaggaccgaacaccatggtggggaaatgctaaaagtttttccctcaaaatctgaaagaagtaccaacttgcatctgatggtcattggctagttacatagttagaggctgaggaaggctgaggaggttggaaatggtttacaggagatttaggcctcagataagcagggaggtcagtggcttccaatgacagttttctgacatgaaacatcagggcagcagggacgcatccgtgtcctcaccctggtttggttggggcttagtttgtgcctcacagagaagagatgctcacgaaacactggatgagagaatgaaaatgaatgaatcctccaaggtgataagtggaagagatccctctttgggagcaagcagatggttttcaggtccctaaagaggggcaatgaagcagcagccccatatgggtgcccaccccaggcacagccatttatttccagtggctctcacatacacactgacttatgaactgaaaaataggacaaaggtataagcattccagggggaggaagaacaaggaaagctgacccaccaagctccaaagcgatcattttctgctcttgggcataaaaatccagccagaggcctatttctatatgttaaacattatggattaaaatctaagaacaatagttatgtctcccatacagttatgacatgagtatctctcctctttgtaaagacttaaaatctgtagcaaatgaagtgtgaaatcgggccacacacagttcctggaggcgtatgaaggctgcaggccacacccatgggaattctctttccccaaattactgatttcacctgtaccctcattttctcaaactttgctctggagacagagaaacccagggagttttgtgccccaatacaacacatgccaaataagaccatggaagagaggggctgaatcttctaagtctctctgaaaggtcatgagacccctgcctttagtgcgttggtgtaaggtccgtggtccccaggctggcagcgtaggcattgcttgcgtagcatctcggggccatcccagaccctctggccacattctgcatttaacaagatcctcatatgattcacgtgcacattaaggtttgagaatgctgcaccaaaatgccataaggtcaacccccgaccccgccaaaaaaaacccaaaaatgtatttctacctgctgcctgttttttctcgtagtgaacattaaaactttgcataaggacactgaatgggctacaaaggctgctataatcctgaatatcctcctagaggacactgctgggggtggaaggcattagaggcagtgttgctcagcagtaggaaccccagagaaaagtccagaaatctcacttcattcttgtcctacctttactatatattagctcttgggccttggataaacggcttaaatatctcttagaccttgatttcctggtgtttaaaataaaataggtggagagacctctaaaatccccttctactctaaattctctgaccctgaaaatgtcacccatgatacaatccttgccctaatatatttaacatgccaccaacattccccaatgcttctataactgtccgcatgggacatacatttcaaccttctgaaatagaaacatgacaagatgtctatcctttgggaggtcattttatttttctttttttcttttttattattattattattatactttaagttttagggtacatgtgcacaatgtgcaggttagttacatatgtatacatgtgacaggctggtgggctgcacccactaactcgtcatctagcagaattattttttaatttataataaatgattcaaatatgtgattgcattttctgtgcaggcgatgatacaatcatccttctgttctgtaacgtaaaatgcagcaatgtctttttaattacattagtaccaagaattataattcaaacacaagccaatgaaaatctagacaggcttattctttactcgttaaaaaaaagcaacagctgggctgcacttacttttatgatctctatggttaatgtgtttctaataattattattgtacttttattactcataaaagcactttctctctcagaggtccacaaagcagtttctgcaagtaaaatctgtggaagagatcaccctgctattagcaaataaacatatctcagacatcttcacgttagcattaagtctggagcatcactctctgactcaaaaatgtttaacgaacactgtcataaagctatttagtcaaaagaaagggtttccctcatctcttagaaaaatgtatatatattttttgacacagagttttgttcttgttgcccaggctggagtgcaatggtgcaatctcggctcaccaaaccctccgcctcctaggttcaagcaattatcctgcctcagcctcctgagtagctgggattataggcatgcatcaccctgcccggctaattttgttttttgtttttttttaagttcaagagatttaatgtaccacctggtgactgtagttaatgatgatgtatacttgaaaattgctaagaacaaattttaagtatatactgtggaatgaataaatcagactaacataagcattatgtcacataggtatcattttttgtggtaattttgtatttttagtagagatggggtttctccatgttggtcaggctggtctcaaactccccacctcaggtgatccacccgcctcagcctccaaaagtgctgggattacaggcgtgagcccccgtgcccggcccaagaaaaataatttcttataataaattagcctcttttatctgtaataacacttgccactggtttatcaagtatttcccatccactatcccactctgcaccccctctcactgctttcttccctagtgaaaggagaaattcctccagagtgctggcagagctctgggcacctaagctcaccacacactgaacagaacgattacaaagtaactgtatgttctgatgtcctccttgaaagctgcagttttggtgctgaaaaggatgcaggaaaggtctttcctttgattctttgtgggctccctcgactcctctcccatcctattcctttcttataagccaaccaggtcacagtgccttttcaatgtctcatgaggacctttgtgttgcattaatgatgtagaggaatgagttctcagggaagtgatgggtgagtgaagatgacatcttctcttgcacttctgtacattcccacttccgaatctgaaggggagttcactgatgctttcaaaccaacagaggagagcatcaaagatccatgggttcaaattttcctgacctacttctttttgaaatgataaggaagaactggcaatgctgcttaaaatattcccaaagggttactacaactttctgggtcacacaatctgtgagatggccttagatcagagaatattttctcactattttgtaaaactaaattcaccgtttactttccatgctcccatatttagcaagtatcgaacttaaagtacagatctaactcaaaactcagacaactggattcctatcttatttccgttcttttatttgtttttctcgtcccgttgatagacagttcctgagcatcccatttggaaagcaccatgctagttgttacgacagttactgaatgaaccaggcacagtcactaatgtcgaagagctcaccttccgagattccaaaggaggttctccatgatctcacatctgagtcagacatttctctgggctctcagaaatgtacttgcaaacctctcccacagcacacaacacactgctctctaatctatgagttactcatccagcaccctgtccctgcggccttgtaactgcttctcagaggctatgtcttgctagaccagtatgtatcctccagagcctagagggtaccagacacacagcaggtgctcaataacgttgcaatgaagggaatgcaaaaaataatgaatataaagacatataagcataaatcaaaagtcatgtgttcccacaacagaaggaaaattctacagtacttcagaggagggacctacttcccattggagattagggacagcttctagaagcaggaagattttgagctgagcctgaaaaatagttggggaggtggaagggtaagtggtagagactcagggggagcagggccagtgaggcaataagcattccagatggggaacagcatgagcaaaaccacagagatttgagggtggaactgggggtgcaggggttgtgagaggggctggggtcagacactgaagtagctgctcatacatcagctatggtgtgtgtgtcactcagtgagtgaacctggaaatagacaagcccaagaaatgataatttacagggagccctaaaaaggaggcacatggtttcggaacaggagaaaatagatatgaggcagacatggacctgaaaggacagtgtctcccaacttggccacatgggctatagaacaaggacagtgggtattatcaagcaatggacaaagtaactggttcgagtcattgatcatttccaataaaccaaacccaactgaaagaactcagttgtaggtaggaagagtaggacttcccagagcttgagccttcaaattccaaaggtaggaagagatgtcacagaagtcaggactcgtcaggggccagaaatgcaagagcttctctcagagataggcccacccctgggctctagaaggtttgaaaatgatgccagctcaattgtctctcaaaacaacgtctcagtagtcagctctggtatccgatcctaatagattaaggatggtgggttcctaaggcaagagacagtgaggtttctagggagtcttctcagagtggaggcctgatcccatttacctatcaacataggccagagccaatcaacaggaaaactatgggattgttattgaaccattatatcactgcctagcatttatctttattactaactccatgtggacttgaaatgattaacaacataatccttggatgaaaagatgttgtgcctatcctttagggagtcagcaggaagggggagatgagaagcatttttctgaggcctctgttttcagaattgttgtccacaatctgctctggcatcagaatcaccctgctgcccaataaaaggcatccacagctgagcaaaggacctggaatatgactttttgccaggggaaaacctaacgttgggggaaagggattcaactgggtagaaagggggcaatagggaattagaagaagaagagaatcttgtggtggttaattttatgtatcaacttggctgtgccacagtgcccagatatttggtcaaacatcattctggatgtttctgtgaaggtgtttttggatgaggtttacactgaaatcagtaagtttaatatatctagtgttccattattggaacgctaagcctgtgggagttatttatatcctactgctcaaggtcattgccaaggtctgattattcactcatacaaaaattcaaaaaaattgtatcctccagcataaatgggctaagaaaagcagataagcagattgcccttcataatgtgagtggcctcatccaatcagttaaagacccaaagagaacaaaagcctgacctccactatgcaagatgggattctgcatgcagacagcttttggactcaaactgcaactctttcctgagtctccagtctataggcctcccccattagatattgcacttgccaagactccacaattgcatgagccagttccttaaaacaaatcatatatatatatgtgattatatataatttatatttatatttatttatatgtatatataaattatatttatatttatatttataaattatatttatatttatatatactttatatttatatttatatattaattatatacaatctatattatataattaatatataatatatataatcgccatccaatgttcctgttcctccaaatacaaatttcttgacctagagagacatagtccatggaatctaatttggatctaaagaagaattaaggcctaaaccaaccaagagccccgtgctgatgccctgacactcacctgtgaggtaattaaggagtcaatcaccaataggccgcagctggtagcctaacaaccttgatgaacaagttcagagagagatctaaagctttttttaagcagaaggaaagatcagaatcaacccttggtaacacgaaagcagttttcaagaacagagagctccttgcgatgttgaagtaaacatttataaagaccttcccccaaatactgcaatatcaagaacagcaagcttgagctttatcacaaaccacccatcagctcgggattgtgaaatacgccctcgcccaagtgcctctgacagaaaagaaatgagttccattaccaaatgaaagcggggtggaaataacagaattgcttttattttgatggatgatctaataaaaagacataaaaatgatgagaaacaataaaattaaatcacaaaatacagttctatttgttttgtgctatggagtggattcttacattgggtggaaggttggactatataacttctaattttaggaaacagtaaaaagaaaaaaacgtgatgacaacagtctttcattgctagaaagctacttctaagacactgaaacagccattgcaacaatcataaaaagtcacaggaacccaagtaggcaaaaaaaaaaaaaaaaaaaagattttccattccctctgttcctgccttagggagttcaagtccccccagacatttctctccaacttaacagtgtgcgccaaggtggtgcgtcttagaatgaaatggacgtggtcattccagcctaatcatttgcttagagtcactgaggggtaataataatggctcagataagattattgccacagtttccttaaattcactgaagggcaatacagaatcaatgacagccgaggctctactagaaacacctgaggtggaactgggaggcaacacggaaggaggaggtgttagctcagaggcaccagaagctcttcaaaaacctgcacgttgtgcacatgtaccctaaaacttaaagtattaaaaaaaaaagaagaagaagaacaagaagaagctgctacccctgatggagatgcgctgcctctgaaaggatctgctaaaactgatttggattcttcaccacggcttttgattcgctttttttcacatttgacaaggctggccaagttacctgcccggtgctaaacacctacctctattgccttttcaatgagtccatttgaagcttccaggcagagccttctagctagagcttacctgcagagaagcccacaacacacatacattaaagtaacatgacgaccgccttacggaatcaacgtttctccagaagggccacccgtaataaaagaaagctcacaatgaatctcaccactttatcaatcaaaaattctggttcctcttacaggacatttctctcgtgccaatattaactttttcagagctaatcagacctcaaaattattcactgggaagcctgagaaggcctgggggaagatctgtgtgtctcctcctcctccccgaaggctcactcagaaggcaggaaggcctgcccctcctccaccccctgccagtggcttttcttagtctctcacccttcctctcttctggcacctccttatcaaatacgttctcccatagacaagtcctgcatatgaaaaagaaattatattgaaatgtgagctgactgaagagttaactatgacaaaactgagtattgatgcctgctctttcttccgttacctaactatgcatctttccaattcttgccccttttgcttctctataaaattcctcctattagtctcatctccatagcagcatcgaccatcatctctaatcagaaaattcacaactatacacacacgccaccccacttgcccttaccctcaaacctcacattttcctatacttaattctaaaaattgaattaaaattaaaaaagaaaaaaaatatgttctccttagcctcctcttcttttctccagttattttacccctccctagccatgactctcatagaagaacactgagtgtccttcacatttttttcccataaagtatgttgatacatgaggtttctcctcgggaagaagagcagactggtccaaagtggcatagacaggagggcacaggatgtaaagggcaggcttggcctcctggaaggagcctcctggctctgcacctcctggcctcactctagtggctcacctcactcccagaagcagggagagtttgggcttcagtttccatttgtgttctttttcaaagatttagcagaaatgattactttcactatgctttcgggttcctgaccacattctgcctcctccaaggaatatcctacagaaaaatgttatatatctatttattaatttttattaaatatatttatatattttatttatttattttttgagatagagttcagctcttgttgcccaggctggaggccaatggcacaatcttggctcactgcaacctccgccttctggattcaagcatttctcctgcctcagcctcccgagtagctgggattacaggtgcccaccaccacgcctggctaattttttgtatttttagtagagacagggtttcaccatgttggccaggctggtctcgaactactgacctcaggtgatccgccagcttcagcctcccaaagtgctgggattacaggcgtgagccactgcacctggccggaaaatgctatatttaagcagctgcaatattacagctaacaggaaagtcacaggttttctaagatgacaagaacagtacttgaaagcttctgccaatattccttctgttagtccccctcctcacacttatcaaagtccactagtacccaatgtgctgacgttctcacaagaaggcatcaccaaagaaaacctacctgtgctaccctcaaaatctcaaacaaaccatgctcttttggggtttgggaatccactgtcactgaacattaactccaatagaaatatgtgtataactagagacaaaaataaagaaaaggtgctggagatggatgtagtgagtggtgaggggaatagatgtcccctaatggaacaggccccccttgtaaggtatgaagtcttccttgttagagatcttcaggtggaccctggatccacctgcaaaatattttaaggaagctctaggccaggtgcagtggctcacacctgtaatcccaacactttgggaggctgaggcagggagatcacttgaggtcaggagtttgagaccagcctggccaacatggtgaaaccccgtctctactaaaaatacaaaaattagctggacacagcggcacatgcctgtaatcccagctacttgggaggctgaggcaggagaaacgcttgaacccagaaggtgaggttgcagtgagccgagatcgcgccactgcactccagcctgggtgacacagcaagactccatctcaaaaaatatatatattttaagagagttctatactgatgaactttgacctcagtgactgctgtggtcctttgttcatctgactcccaaactgctgcctggaaacagaaaacaggaggcagaggaggaagctgtactcgggccttgcccccatgccctggccacatctgctgaagaaaaagtggaacagggctcagggttcccatagtgtttctgatgccggctccacaaagagcaaagttaatgtgtcatctcatccatgcctcttctcggtttcttctcttacttttctctgacgtctgtaactctattatcatagccagggaaatgcgaagactaaggaggaaattaccacattggcacacaacagtccccaaaacgggtaagtgaatgactgtgtttaccttttgtttcttccatttctcttgattgtactactggatataatgaccactacttctcacaaaatctctactttataccaaagcaagaggatctatcactacacaaatgcattacaattactttgaaaatcatatggagatttaaatatctatatgttgcatactggcatataattgaagctgtacattctgaggacctctttagcaaatgcacctgttttcttcccttccactcttgctaatgtatacagtgcactttccccatcccagtggttttaattccattcatattcagatgagtcccaaactgaaatcttcagtcctgatgtctctaaatactcatgtcctatgtccaaccaccattcagttttaaaactactccgttaagtttatgagcaaggaatttaattgggctgaaacggggcaacaaggaattagaaaatagagagaatcttctaatagttaaattttatctatcaggctgggcacagtggctcatgcctgtaatctcagcactgtgggaggccaaggcggggggatggctggaggccaggagttccagaccagcctggccaacatggcaaaaccccatctctactaaaaatacaaaaattagcagggcatggtggtgtgtgcctgtggtcccagctactcaggaggctgaaacaggagaatcacttgaacccaggagccagaggttgcggtaagccgagatcacaccactgcactccagcctgggcaacagagcgagaccccatctcaaaaacaaaaagaatgtatatatcaacttggcttgagacagacagatagacagatagatagatagatagacagacagacagacagacagacagacagatagatagatagagcaaggatgaaaggggtaagaacacacacatacttatgtatttattcaggtaaatattcatgtaaatatgtgtatttacaagctaccaggcatccccttacctctgacggcttcgtggtgcattttccttttcctgaacactccaagtcatttgcgtgactctcccccggcacacaggtgctgaccttcaccaccagagttaagcgcaaagccacaatagacttagtcacagaatcattcacaaaacctaaaagaaaatgaggcaaaaggaaattgtcaagtgtctcctctttaaaggcagtgtgttgaaagctttaccaacagcctttctacaagactatgaatttagtgtaggcagcactcaagtctgacaaaacaaaatgcagtgaggcaagggaataaagcacatggccaccatccactgagacctcaggactttagggcaggctggtcctcccaagcctcataagaaacacctaaggccaagcaaaatcagcaccaggcacttgagcaaccacctcagatcctttcgctttgctcccgcccttgccctctgggggctgctttgtctctcaatcccatccctgtgctggcgtcttagaattcagtttctgctttggaaccccagtcttctaccagggagcagcttacctgcattacccaagtcctcctcctcctggctactttggagtcacaaatgctggaaatcctcaaaggccccacccagttatcacctgccctagtctcggtccccttggagtaggcatgcagcatgggtacaaattctctgttgggtttattgatcattgataagatatgcatcttacttgatcaccaatctgactccacagtatcaagttaagccatacagttttagccatctaataaaatgggactaatcatagttgaatatggattgcagtatcattgacacaccgtatttgtcattgaatgatctttatgtcctagagcagctattcatacatagtaggtagcaataaatatggaataaattgatgaataaatatagcctctaactggaaaggagaaataaatattataagtatttttgcatcaaggattaaattattttcactaagtgagcatttttttctaatatgaacattcatttgtatctaatttttaattttaaaacaaaatatcgaaattaatgaatatgattttaaaaagtttcctcagctctgtcaagagtaaaagttaaaaagcctcatcattacaaagccacattcatagatagttttacaacaaaagatttgtaagaccaaggggactactaggagtcagtggggaaaagagagagaaaagaattgattctagggcaactgaaatgagttccattatcaggaaaaagagtaggtttggatccctcacacctcacactatacaaaagtaaatctagatggcttaaagagctaaatacgaattaaaacctttaaagtggcactattcacaatagcaaagacttggaaccaaaccaaatgtccatcaatgatagactggattaagaaaatgtgacacatatacaccgtggaataccatgcagccataaaaaaggatgagttcatgtcctttgcagggacatggatgaagctggaaaccatcattctcagcaaactatcacaagatcagaaaaccaaacaccacatgttctcacttataggtgagagttgaacaatgaggacacatggacacagggaggggaacatcacacactggggcctgtcaggggcgggggtgagtaggggagggacagcattaggagaaatacctaatgtaggtggtgggttgatgggtgcagcaaaccaccagggcatgtgtatacctatgtaaccaaactgcacgttctgcacatgtaacccacaacttaaagtataataaaaaatatataaaaaacaaacaaacaaaaaaacctttaaaacttcaagtggaaaatatagggggctatttcattgatctaaagataggggatttattaaacaagggcaaaataataaccataaagaacaatcaatttaactttacccgattttaaattatatgtacatagctaccataaaaaaagacagtagacaagacacaggcttgaaaatgaaatttataatgcataaaaccagcaaatgcttagctgccagaatatatggagaatttttttggcaaactgcttttttctcaacgttatttatacttatataaatattgaaatctatgaagcattaagaaacgctgttacgcatatgtatacatacagtaaaagtataccaagatgcatggaaagaaacacaccaaattcaggaaaaggatccggggaaataggggtagccagggagatggagcttctgaccacctatataatattttatttatgtattaataatacatagagcaaataccacaaaacacttattcgatcttgtgtacaaaaaaattatattcatttccatacttttattttatttttagacggagtctcactctgttgcccaggctggagtgcagtggttcaatctcagctcactgcaacctccgactccagggttcacatgatcctcttgcctcagcctgccaagtagctgagattacaggcacctgccatcacacctggataatttctgtattgaggcggggtgtcaccatgttggccagactggtcttaaactcctgacctcaagtgatctccccgtcttggcctcccaaagtgctgggactacaagcatgagccaccacatccagcctataatattttatttctttcttaataacataggccgggcatggtggctcatgcctgtaaccccaggattttgggaggcagaagcgcgtggatcatgaggtcaggagttcaagaccagcctggccaatatggtgaaacccccatctctactaaaaatacaaaaattagccaggcatgttggcatgcgcctgtaatcccaggtactcgagaggctgaggcagaagaatcgcttgaacccgggaggcagaggttgcagtgagccaagatcgtgccactgcactccagcctgggtgacagagtgagactctgtctcaaaataataataataatagagcaaattttgcaaaacattaaatcttgtgtacaatgaaatcttatactcatttccatagttctatgcttttttttcttttgagacaaagtctcactctgtggcccagactggactgcagcggcataatcttggttcactgcaacctctgcctcccaggttcaagcaatccttgtgccccagcctcccaagtacctgggattacatatacgcgccaccacacccagctaatttttgtggttttagtagagacgggatttcaccatgttggccaggctgttctcgaactcctggcctcaagtgatcctcccgcctcggcctcccaaagtgctgggattacaggcaggagccaccatgcccagccaattttatgcatattttaaatattgtgtaaccaagttttttatttcgattatcatagttcaggcatcacaacttcaaacaggctttaacaggttaggaaaatattagtatccagaaatctagaatacacagtcccaaaatgactttgtggtcaccttctctagacgtttcctcacaatttgttcttataagtacgttaagttggccgggcgcagtggctcatgcctgtaatctcagcacttttggaggccaaggcaggtggatcatgaggtcgggagatcgagaccatcctggtcaacatggagaaaccctgtctctaatgaaatacaaaaaaattagccaggcatggtggtgtgtgactgtagtcccagctactcgggaggctgaggcaggggaatcgcttgaaccgggaggcggaggttgcagtgagccgagattgcaccactgcgctccagtctggcgacagagcgagactctgtctcaaaaaataaataaataaataaataaataagtatattgcattaaaaagtaataattaactggatagaaacagagcccacgttggttcaccttgcctgcatggtacctagcatcacctcattaactgatggtcacttgagaacatgctgcttctattgacaacaaattagcaaaacttcccaaatattttcaatgttctcaatgttgaagtccttgcacactaaggtgttgcacactcctaaagcctgttttcacaggtttactcaaagtattgcttgacacaggttcacttttcatacttttaaagagaaggatattttgagaaatttggcttaaaaagtcaggacagacttcctacattgtttcatttttcatacttcttttaaaagttttcataaatgtaagacttctctcatggcctctcagctatttctgtttgtcttttctgtttgtttattatctttggggaaagatataaaaatgatatcacaaatatctacgatgactaataacccttctgaaaacagattgagcctctaaaaatttaataggaagtgcccacattaagtaagtatatataggccaggcacagtggctcacgcctgtaatctcagcactttgggaggcagaggcaggtggatcacctgaggtcaggatttcaagaccagcctggccaacacagtgaaaccccatccctactaaaaatttaaaaattagccaggcgtgatggtgagcacctgtaatcccagctacgtgggaggctgatgcaggagaatcacttgaacgcaggaggcagaggttgcagtgagccaaaatcgtgccactgcactccagcctgggcaacaagagtgaaaccccgtttaaaaaaaaacataaataaggaagggcgcagtggctcatgcctgtaatcccagcactttgggaggcagaggtgggcagatcacgaggtcaggagttcaagactagcctggccaacatagtgaaaccccatctctactaaaagtacaaaaaattaccgggcatggtggtgggtgcctgtaatcccagctactcgggaggctgaggcaggagaataacttgaacccgggaggcggaggttgcagtgaacggagattgcaccactgcactccagctgggtgacagagtgagactccatctcaaaaaataaataaataaataaataaataaaataataagtatgtatatacaaatatatgtagtgtgtgtgcattttatgaacatgtaatatagacgtgtgtggaatacatatacgtaatttaaagtacagtcatacaatgaagattactgagcagaatggatcttaaaaaattttgaaccaaacaaccacctttgagaaggctgtgaagagcctctaccttctagggtaaaagcaggactgtctatgggacaggcagtgcatgcttgagggaccactctggaagcccagtgaacctcgcagccatgattcagggaaatgcagacggtccttgaggcagtcctgaagtcctgaaggatggaattaacctacaggcaggtgtttcaggctgagatggtaaatgtttggcccaataatattaaatctgtagaaccatttgcttcctctgaaagaaatctggagggtgctgctatggtttggctgtgtccccacccaaatttcattgtgaattgttgttcccataagccccacgtgtggtgggagggatgcagtgggaggtagtttaatcgtggaaatggtcaccctcatgctgttctcctgatagtgagcgagttctcatgagatctgatggttttataaggggcttttccccctttttctcagcacttctacttgctgccaccatgcgaagaaggacatgtttgcttcccttccactatgtttgtaagtttcctgagggctcccaatccctgcggaactgtgagtcagttaaatctctttcctttacaaattacccagtcttgggtatgtctttgtagcggtgtgaaaactgactaatacaggtggggttctcttaaattgggatccataccatcatctgcctatactgttttgtgtggctttggagcttcaaaaagctaggcctggactatgggaggagaggagccagaccccatcttctcctttgtctggccagaggactataaaaagctattatcccgggcttgcgacaaggccacctggatgaaatcaattgctgtggccatgtgctttggaaatgcaccaatgcatgaagaaccaccagggttacatggcttctcagctcatccaggccatcgcatcctagaggtgagggagagtagatacccaccatctaccatgctaaatgggggccatcctagggcaaaaaataaagcaagctttgaattgaagagcaaaaggaatctgtacactctgaatgggattctgatgtgcaatgattcctggagatccctttagtgccaggggattggcacaaatctgatgaggtcctctagctctcagaactgcttccagtagctgtggtcaattgatctctgggttgtacttgtgtgtttcctgggcattcagtcaagtcttgttaaagctaagccagttccccacattctatgcagaattagtcagaattcctgactctttttcaaagtcaggaaatcagaggcactcatacatagagagaaggaagccctgcgaagatgtcatctcatgagtgttagacagaggaacacaggggagcagtggggacaagacaaaggacagggataagacccaaaatggaacaaaccaattggtgaagggaacccatcaaggaagaacccgagtaactgtgccgagtgagaaactgacatgtccggcctgcccatgttggctgccatgccagcgcaggtgggttcctaagtggcctaggtcccccaggcaaacaccttgtgaaaagccgcaggttcctccgtacttcaatctctattgtgtatgccagtttctcctgtgggccctgtactggttgagaaaatagaaaactgccaacgataacaactctattcataattgtctagggtttgtctcagacctgtgggatccctcaaatcccatcactgaggctatgggaaacatttaccctgattctccttgggacagaggaagacacggctatgactttagccagcccagaatgtaaatgaacaacgtacaatcaacacctcaattatctagaagaaacattcctgcattactcataaaaggtgctaagacaatgtgctggacattgttaagtaggaataataacccaagtaggctgaccatggaatttatcttcaaaactaagatgcctttcaaaatacaactttttataattatgcctggacacaggcataaagtgagactctcccaggcaatgggacaatatagtcaccctgcacttaatgtcccagggagcatctggagacagaatatctgcaaagtcctacatcaatgctaagaatgtttttaacaggcagaagatggattcaaaaaagtagtatgacgttcaattcagccaggcatggtggctcacacctgtagtcccagcactttgggatgctgagactgggggatcactcgagcttaggagttcaagaccagcctggacaacatagtgaaacctcgtccctacaaaaaattttacaatggccaggcatgatggctcacgcctataatcctagcactttgggagtccaaggtgggcagatcacttgagggcaggagtccgagaccagcctggccaacatgctgaaactccatctgtactaaaaatacaaaaatcagcagggcatcatggcatgtgcctgtaattccagctacttgggaggcagaggcaaaagaattgcttgaacccgggaggtgattgcagtgagctgagatcgtgccacttcattccagcctgggtgacggagtaaggctctgtctcaaaaaaataaataaataaataataaaaattagttgggcgtgatggcacacacacctgtagccccagctactcaggaggatcacttgagcacaggaaggggagactgcagtgagctttgattatgccactgcactccagcctgggtgacagagtaagaccctgaaaggaaaagagaagagaagagaagagaagagaagagaagagaagagaagagaagagaagagaagagaagagaagagaagagaagagagaaaagggaagggaagggaagggaagggaagggaagggaagggaagggaagggagaaaggaaggaaaaagagaaagggaaggaaggaaattcatgggcaacaaggtcatgataggagattaataaaagtcagagtgagtggagacattcctcaacttcaagtagggcattaggagacaaatatctcttggtgtctcagtaaagacaggcaccacaggtctgatgcagagtggtattttatgtccaaagagaactaattgctatcttcctaagatttcttactgaaaagtttatttaaattggctttgggaagtaaggaaattaacaatttaggcaaaagtgcctcttctgtggtgctttctattcttcctttatggccctgaaccatgtagacaccttacacctctcccagcagcctttacacatcttgctcaccccaactctgtaaacatttccacaatgccccctttgtctggaatactcctccttcttccagtcttacagccattgagatccagctcagagaccaccttattcataagcctctcctccatattctagcccactctgagctctaccatgtccatctgtgctcaggcgtaaaacatcatgtacctcttcctgatcattttgtatcttgggtggcttcttataccacctttactgaagcttccttgatggcaagggacaagtcttagagaagtggtgagtagggagtcaagatacaggtacattaatagccaaagcagcaaagacaattcccaaataggagttcttaaaatgtcttatcatccaatatgtccactttgaagaacagcaatcatttggatgtacaaattccagtttactaaaaaaaaaaaaattgcttaccaactggtgattacctttggtagagaaatggagcctgctagaatgttgggatgctaccagttcttattccaagtaacacttttacgcataaaataataaagataaaatcagacatcagttattataaaagtatttttcatacctttgcttcattctctagtttcacattaaactatttattaagatctatatcatctctgtctacttactaagcatttagaccacacaatgatctaaaatgttatagacaaggctttcttccaatgattagttttaaagtcctatttaactattatacttacccagcaataatgcaaatgaatgtgtagttaaaaatatacaaggcatagttttctagataatttgcttccatttccttgatgaacacttactgaactcgcgtccaccagtgagacaccactgtaaattctaaggttacaaagataagtcacgcttggtttctgccactccaaactttcaggcaaaagtagcagttcttaactagtgttgaaaccagtagcttcaaaagtttgcaggagctttttcaaagcctgtatatccaggctccaaaataagtgattcagaatctatagtcttggatgggtccctggcaggcatgtttttgtgaaaaatgctctaagtaattctgatgtgtgcttccagttaagaaccactggtctggtacaaaaactaatctaagtcacatgagtgatgcgttttattattaaagtaaaaatcaccttgaattaaaggcaaccttatgcacatctaaaattggaatattttactcatctatttttgaaatctaggtgatgagatgatatttagacaaaattgatattcccaagttcatcataagtctctgaagttcttagagacaactctgaaaatggtttctgtattagctttatttgcttattaagactgtattttggtcctaaaatctgttaatagatgattactgaaatcagtctttgcaacagtgtgtcacacattaccacgtaactcctaattattttaaccaatcccctaaagtggatcaataggacaagcatgttatttgcagcaatgtgctgttcactcaataagaacagtggctggaggctccttccaggtaaaagtgcaatttcagttagttgtttatatctccctttgatcacatctagggggaaatgcctgtatttcctcataatgaaaagcaatactgtccggtttaactttcatcaaactgcagctgggtcagaagcaaagtagccctcaggaaattccacatgccaagagcaggaactgtgccccttacaaaggggcagcaggaagaatctgaaatgaaatagaattcattcaaaagaaggaagttctttggggctttataaaagagtgatcatttgagagctgttgaaaagccagtgtgagttctttgacacagcactcaaactgatagacacttccaacatactttataagaaatgcagagcacatgctcactttttctcttccttaatggtaggaagtcaatgtacatagcatagttgctgctgcatagaggtctgtatagaaagacttgtcttcatactcagaattctaagatccacaggccaactgatcagagacgaaaaccagtaaagtagcagtgagaatgacagtctggatgcatttacgaagctgtttgagaatagggaatgggcttttgtcaacacctgcattcccatggtctttttaggctgaagaactggtgccacataggaggcaatgaaggtgccccaataaagcctgctgtgaattacaagcaagaaagagaaatagaaaggagagatttataaaagaaagaagaaaagacagaaaaagagagagtaaaagaggaagaaagactaagaagggtgatgggaaaagaaaaccaaaccataagatagatactgagggagacaaaagaaaaaaaaaaaggaaattaatacagagaaacaaagtcgaaatggaggaaagaaaatgaaggcttattttggaagacagtgtggcaattcctcgaagacctaaagacagaaataccatttgattcagcaatccattgctgggtatatagccaaagaaatatagattattctattataaagacacctacatgtgtacattcattgcagcactattcacaagagcaaagacatgaaatcagcctaaatgctcatcaatgataaactggataaagaaaatgtggtacatatgcaccatggaatactatgcagccataaaaaagaatgagatcatgtcctttgcagggacatggatggagctgggggccattatccttagcaaactaacacaagaacagaaagccaaacactgcatgttctcacttataagtgggagtgaaatgatgggaacacatggacatatagaggggaacaacacacactggcgccttttggagggtggagggtaggaggagagagaggatcaggaagaataactaatgagtacaaggcttcatacctgggtgataaaataatctgtacaatagacccccataacccaagtttatctatgcaacaaacatgcacttgtaccccagaacttcaaatataagttttaaaaaagagaaaataaaggctttctgtcaaaaatgtcaagggttcttatatcttttgttataaaaaggcattctatcatcatctgatttttataaccttatattcctcactgcaacccacaaaaaatgtaaaattcgagttatttcaaagttttcacaaataaacatttgcttaaatcataactgtatatattctaagtctgtgattccatttatgaggctgaaatacagaagcaccctaactgaacagatcatgagtccatgtaaggactgggctgcaggatggggtgggagggagagcagtgtaggatggagggagagctgagtccattcattcaacattcagcagatgtttgccgaggtcaaggtaggaggtagcatttaggttgagccctgaaggtgaaaatgagccagcaagaaaagctggggaggtcagtgtgtcagacagagctccagtcaccagtgtcttagctgaggcagagaagcaggaggggccagatcacaaccggtctcatgaaccttagtaaagatgtggattccttgccaagcaccatgggaatccattggagagttttaagcaggggaataacacacgactggtgcattctcaaagaccacaactcaaagaacaaacaagattttcatatagattggatgtgaggtatgagggaagggaagaaattacacatagatagtttaggcaactttgtggggggtgtggtggtaggcaagtgaatcaagatttccatcgttagtgtactaaatttgggatgctgatgagacccccaaagggagcaatcaagttggtggttggacgtagaatatgggtagttagaaacatcatggctgaagatttcagtttcggactcatctgaatacggatggtattaaaaccactgggacagggaaagtgtacttagggagagaatagagggtgacaaggcccagaaccaagctctacagcctgacagtcatgatataaacagtttgacatagatatcagaccatcatcatactagaaaaatcaactaaaacataaatatcttcattattttcccaaagcagagttataaggaaagataagatctctgtgacctgaagaacataaacagcttcgggaggtcagacctttggcaacgttagcatggaagagggagactttggtctaccagaaaaaaggaagtctcaaggactctacacagctcaactcaacatttagatgctggagaaaaaaaagacagaagaaagggaaggaaggagggaggaggaaaaatgacagtgctggacttgagaggctcacttctatttgctacacaactgggagatttccctaatgagtttaaaactgtaatgaaggggaactttctccaaagattatccagggatctgttaacacccttgagtaactggttatgatgacaaataaaagttgggtttccttctctctccttccatttccactctcctccttccccactctcctatcacacaaacaaatgcacttactctgctcttgcccacaactccaagctgtgctcattaggatggcaatgaaatgttctgccatcattatggcccttttaaaaccaagactttgccaagctcacctcccttggtgcaaatgcaaagctgaggacaaccaaaaggggctccagtcattatctctggaatggagtggtcaagcatcagtggaagcacaaaatgctgggcttcaggccattaactgtttgttttactgcttgtctcccttaatattaatactaaagagtcttaaatggactttgtagttaacacctcattgggattaatagcaaatgggatttgcttttctcacttcagccatttggctaaagaccattttctttcctgttaaagggaaagcataagtggaaaatagaaattctgaccataaatatttgagcagtacgtgttggaaacagactgtgccaagttttcctattaagacacaacaagtcatttggcacaaaccaataacctaaaaaaatggttcacagtccacaaagtcccatggctggcaccagataggcatgaaaggtttgcaatatcacagattccatccccagatgaagacccagggattttgcattaactcggaggtgggggaagacaaacacctgcaatcccgcatctcacccctcagaggcaggggtgaaacagcacacctgtgccaactctttcagaaggtgggataaggttagtgcaaagctaataagccggtcaggatccccctggatttgtgactcaatacttgtgggctgggaaacaaaactggagaaataaatcaactcttgacaatgtcgggccaggtgcaaaaattgctcgatgctgagagcaaacttgagccaggacccagtccagggtggcaatgattacacgaggcttactaacatacctcagctgtgtggactcagatgtccttccattacacgtaagcagaacgcagtccaaaccaggaggtaaaggggccgggggcattaaataagcatttaaaaagtgtcaccacacccatggactatcacaattatgcctccatcactgaagaatgtcacttgcctggtcacaccaactatcccaggatttcatgtagagtattctcaccttttgtaaaaaggcttttaaaaatttccaactaaaggttacttgtggtttgcttgcttgcttgtaaggcacgtttagatgcttaaaagagcaaattgctttttggaaaattcacccacacagaatctctcattttctctgggttcctaagtaaagtatggccaaaaaatgctttccaaattagaagacacaacagtacatcccagaaatggtccaaatatttttacctttgtcacttatgtaaaccatcaggtagattatacctagccaaatgactatgaaaattacatattaagtaatatcatttgctctagggaaaaaaattgtaaagatactgtgatgatatcctagcaaacatacaatcaacttgctatcacctgaagatagattggcttattctcaacaaaccttactgtcaaatatagcaatccttaacaactaccttcctactttataaacatctcaggtacactctctgtctattcatcctgcagagaaaactctaaaatttatttaatatcaaaatacaggcttaaagagtgaacaaaaaaaaattatattgagagtccttcctagactgacattctacacttttccaaaagaaatttctattcccatagtaaagtgttattagccaccgtgctacatttctgtttaatattttttcaagattcaccctaccacactcctctctccattaatattagactaagttatgtgtcctaagtcaaatcatttgtcctagttgagtatttgaactgcgggaataactgctaattgcccactgatatctattctcctctcatgcctataataatgggatgtggagtttttgctgtgaactgggccacgcagctaaagtatgtttctcctctgtgaccagtgagacaaagtacagaaataccgtattgtacatttacaaggaccgagcacgcgcccttcctattggctaaaataccaatgtgattgtgacagcttggacagccagtttgcatccagagatggaacctgtgtgttgagagcacacaagtgtactctatcggtcctagaccaactacctcttgatggtaacagtggggagaaattaacttgtaccttgttgaagccactgtatttgaggtctctctattgcaacagcttatcctgttccctaaacaatacaggcctgtaaataaatcacacaaaacccctcctgggccacatcccaccacctctgccacctggcccagaaagaatcaccattcagctactacttagagtcataaacacaaaatactaactccatcacatccccttctcggtcctcttcctttgtagtgacaaagctgagtagtcatcaaggtggctcgctttatattgaatagggaggagtgggaacatcaacttagcaaaagtgtctaatgtcattcctctgattaaatagggatatatgaaatatgcatataaacatgtatattctataattcgatttttaacactttatgtattctgtatagagtatgtttcacattacagaagtggtaattgcccataatatccattcattaattccaaatggatgcttcctgattagtggctttactatgaatatttaaatgagataccaggctcctgtgctgacacaagggtaatggaaagattacaccaggctctgccaccagatggcctgagttctcaccagctctgtgactttgagagagttagttatacccttcatgtcctggattccttctttctaaaataaaaataatagcactatctatttcctggggtggttgttatgattaaaggtcttaatatcagaatagtttttaggaaagtgcaagcattatgtaaggacactataaatcatcatcaacttcatcatcatccttatcccattaccatcatcatcaacttcatcatcatccttatcccatcaccatcatcatcaacatcatcatcccaccaccatcatcatcatcatcctcaccccatcaacatcatcatcaacatcatcaccccaccaccatcatcatcatcctcctcaccccatcaccaacatcatcaacatcatcctcctcaccccatcaccatcatcatcaacatcatcacaccatcaccatcatcatcctcctcctcatcccatcaccatcatcatcctcctcaccccatcaccatcatcatcaacatcatcacaccatcaccatcatcatcctcctcctcatcccatcaccatcatcatcctcctcaccccatcaccatcatcatcaacatcatcacaccatcaccatcatcatcctcctcctcatcccatcaccatcatcatcaacatcatcacaccatgaccatcatcatcatcctccttaccccatcaccatcatcatcatcctcaccccatcaccatcatcatcatcaccccatcgccatcatcatcatcatcctcaccccatcaccatcatcatcttcatcatcaccccatcgccattatcatcatcatcctcaccccatcatcatcatcaacatcatcatcccatcaccatcatcgtcatcaccccatcaccatcatcgtcatcatcctcaccccattgccatcatcattaacatcatcaccccatcaccatcatcatcatcaccccatcaccaacatcatcaacatcatcatcaccccatcaccatcatcatcaacattatcaccccatcaccgtcatcatcatcctcctcaccccatcaccatcatcatcatcaccccatcaccatcatcatcatcctcctcaccccatctccatcatcatcaacatcatcaccccatcaccatcaacatcatcaccccatcaccatcatcatcatcaccccaccaccgtcatcatcatcctcctcaccccttcaccatcatcgtcatcaccccatcaccatcatcatcatcctccttaccccatcaccattatcatcatcctcaccccatcaccatcatcatcctcatcccatcaccatcatcatcatcatcatcctcaccccatcaccatcatcatcatcctcaccccatcaccatcatcatcaacaccatcaccccatcaccatcatcatcatcctcaccccatcaccatcatcatcaacatcatcaccccatcaccatcatcatcatcctcaccccatcaccatcatcatcaacatcatcaccccatcaacatcatcatcagcatcatcaccccaccactatcatcatcatcctcctcacctcatctccatcatcaacatcatgacagcatcaccatcatcatcatcctcctcaccccatcaccatcatcatcctcctcaccccatcaccatcatcatcttcctcaccccatcaccatcatcatcatcatcctcaccccatcaccatcatcatcatcatcaccccatcaccatcatcatcaacatcatcacaccatcaccatcatcatcatcatcctcatcccatcaccatcatcatcctcctcaccccatcgccatcatcatcatcacaccatcaccatcatcatcatcctccttaccccatcaccatcatcatcatcatcctcaccccattaccatcatcatcaacatcatcaccccatcaccatcatcatcatcatcctcaccacatcaccatcatcatcctcatcctcaccccatcaccaccatcatcatcaccccgtcaccatcatcatcatcatcctcaccccatcaccatcatcatcaacatcatcaccccatcaccatcatcatcatcatcatcaccagcaacataagcaaccaacatgtatttaaaatggagtcctggcttattgagtttggtggctgtaatgaatgaccatagactgatggctttaaaacaaaggaaatttattgctcacagatctagaggctgggaagtacaagtagattgagttccactgagggcccgttcctggctcacagatggtcatcttctcactgtatcctcacatagcaggagaagtgaggaagctctctggggtctctttcataaggacactaatcctattaatgagggctctgcccctgtgacctcatcacctctcaaaagccccagctgcaaacactcctcatattcggtgttaggatttcaacatatgaatttggggaggaaataaacactcaatgtacggcaggtcctaagtggaacttagaattgttagaagtctgaggaagaggctctggaaaagtttgctccctgagaaaacagcaatgccaggatgaaagcatggaggtcattcagagagtcctctaagcccttctcaattcaaatctatgaaatggaatttgtttaaatgattgctactctttaaaaattattgctagaatttttaaataatgtccaaataaaagcataccatacattcaaatgcaagtaaatgatttttactatctgcctttttgaataattcatgccccgtctctccattaaaaagccttggctctaggcattacttaaagttgtaaaaaatatgtgaataaacaagatatggctaccattcataggatttgaaagactttttttaaaaagtataaccagaaactaatacaagacagattggttggcataatggtataaaaatattcaaattataaaatctttttttgaagcaaaatttacaagtagagctgtcaaatctcccaatgtgcctatttctcacattaagtaatctccaattagcaaaaatattttcttattgcctgtaagaaccacatcataataggacacctttttaaaatgccagtttctgaatacccattggtagaacatgaaaattaatttgcactttcctttgaaatttttttggcttgcacagaatatacaattaaaattctttatttaatctctttttcaatgtctatttgatcaccttttcataatcagttcaaattgtatcactttatctcccactagtacagtttcaacttatcaaatactagtaaatcagttttaaattactgtagcactcatatccaatcacccaccacatctggtcattaatactcaatgaatgcctcctgattaatggcattactatgaatgtcgaaataataataacttctctgtgttgatgtgaggggcaatgggagattctaaacatagctaattgggctgcagatgacttcataaacgttagggagtccgggaatcaggtcttcagatgagctaacgtgaaaagctgttgattgacatgtttacctgcctggctattgcaagcattgtgaacatgatctttcaattgtctttgttctaatacagctctttgctccacactgatttaaaatcccaagttgaagtggtcaaggtcatatgaaagaaattacctgaattttcaagtgttcaatgagatttctcatttgggttgcatttgcttcttaaattatgcataacactttatttttcagtgcatgtatttattgcactaaaaatagaactaaccaatgtattgcaatgaagccccagtggtgcaccatgatttgagagaagaaaaactgtagatgtatgggaaggttgactctgactcagcctgggttatttctagttcatattagcatttgcatcacgggtgctgtcataccctcagcctcaggcctcaagaagctctcaggcagtcttccttatttttccacttgctagagatccagaaaggtcttcggcacccagcctctctcccatcaggctcacaaatacctagaatctgcagtgattcataattgcctaaagagtttatttaatcaattgtaacttaggctccaagacacctgtgggtttacctgctcccccagatgtctgttggccaggtatggaagctattgacttagggatgacttgtttttctgcaaaattaagatgcatatattttcactgggatcctacaccaggataaatgtgtttttcaaccttcccttcaatgcctcctcattgtcactaggatcccatcatggcctccacagcccaacatgtctgacccaagctacctcttcaccacatctccaccaccttcctccttactctccaagctccagcctcatgctttgttgcagttcctctaatattatgcactccctccaacaacagggcttttgcacaagcagttccaaccttctgcctacaaggggttttccccattgcctagttaatatctcagcctaatagtccttctccaaggtagtaaaccctcctccacaaggttgttatatttttattatcaactacagtcatagcacagtgtgctgatcacagttgtaattttctatttattctgcaccctactaaaacctatgattcatgagagcagagacttttgtctgatttgttcattgctctatcaccagctccaagcaggtgcctagtgcacagtaggcactcagaaaacattttgaaagggaaggaggaatatgtgaacacacaaatacaagagggtaagtgagctgactatggtgatggcaaatatgggcatacaagagagacaaagtggcagagagaaacaaggaacccagaaaagaaagctggtagtgatgagaaccaactggctaacggcttcagtgcaggcagtcaccaaaaacagccctgaccatggagcaaagtaacttcaaccttaaccaggattacatatcttgagcacagagccccaagccaatttaggtagaaggcctcattctaaaccacgccttgctgcagaccatgaacaatgccaccgatcctgctttgagggtttaccaagaaataatgaattactgattgtccctgttcccaatcagctctctcctgaaattaaattctgtaattcaatgtgactatcatctcagtaggctgaaaagagtctcccttatctgtccagaacagattttatttatgcttcagtctctacaaaagtcttgtaccgctatctgatcatcaattctttctgtaatagtcaatgcagcaaattaaaaattcaatccctctccctcacagtctttactgtccaaaatcccaatctgagtgtgaacagactgccttcactattagaatatctaacacggatcacagcataaaagacggatgtctgaaaacaaaactaaacaaaaatgaacttttgttcctattccaaagaaagaaaaaatcatcaagcatatcaagtagatctcatgcttttctagtttccatttcttttttggtttttaagccgtgttccaagaggccccctgctttcattttatttattttttattgttttaatttttttagagatgatgtctcactatgttgcctaagctggacttgaactcctgggcttaagcaatcttcccacatcaacctcctcagtagctggcactactggtgcgtgccattgtgcccagcttctagtttccatttctaatgtcatttttaggcccctgccttggtaagggctgcctgcagcataggagagagacctgactccgcagtaggaaatgcaggctttggattcaggcttatttgtaggagtcaatcacactttaatattctaaaggaaatgatttataaaatacaagtatcgcactaatagaaaataatttttattttgcaattgctttgtagtcatggatattaactatttatgccatacactcattattataattatagcattatttctaattctaaatgtttctttgcaaaccattgtttcttttacgcatccctactgacctacacactcacttttgaatgctccaagctatacgtttccttttttttaaaattttattatctgtagagatgaggtctctctatgttgcccaggctggccttaaactcctacgctcaggcaatcctcccacttcaacctcccaaagtgcttggattacaggcatgagccaccacacctggccctaagccaacagatcattcttttataatgatctattatacctaccaaatcttgtaaatgacctatgtgcatatacatgtctgtgcatctctgtatatgtgtgcttatggatggatgtgtatctatgtgtgtgcatatacacgaatgtgcatctctgtatgcatgtgcctatggatggatgcgtatctatgtctgtgtatatacatgtctgtgcatctctgtatgtgtgtgcctatggatggatgcgtatctatgtgtgtgcatatacatgaatgtgcatctgtggttgtgtatacagtcatccctcagtattcacaggatactcgttccaggaacccccacagataccaaaatctgaagatgttctagtcccttacataggctgagcgcagttgctcaagcctgtaatcccaccactttgggaggcaaggtgggcggatcacttgaggtcaggagtttgagactatcccggccaacatggtgaaacctagactctactaaaaatacaaaagttaacagggcatgatggctcacgcctgtagtcccagctactcaggaagctgaggcaggagaatcacttgaacctgggaggcagaggttgcagtgagccaagatcgagccactgcaatccagcctagatgacagaataagactccatctcaaaaaaattaaaaaaaaaaattttttaagttctctatataagatggagtagtatttggatataacctatgcacatctgcacatcttctgatatactttaaatcatctctagattatttataatacctaatagaaggtcaatgctatgtaaattattattacactgtattagttttttatttgtattatttttgttacattattattgtttattttttatttttttcaaatatttttgatccatggttggttgaattggcagatgtggaatccacagattcagagggctcactgcacttacagaagtgctcccatggatgtgtgcctgtatgtataatggatggatgggtgtgagcacgtgcatcaatgcatctccacaatgtattctacgaaatatgatcagatgcacaaaatctaaaacaagtcgaaaccaaacgtttcagagggccataattttcttccaggagatctgtgtgattccagctggctgtaacacttactgaaaccagatccacccctggactttcaactgcatgagattctcgcttatcacctttgctagctggttttttggttgtttcctgtaagcaagttggagttgggtttccacacttacagaataattcctcctgactatttaccaggaatgtaatatttaccgaatttattcagtaaacatttattgcatacctactatgaaccaggtactgaaataagtcattttgatgcaacagtaagcaaaacacacaaagttccctgcattcattgtgcctacattccagcagaagagacaggtaataaataggtgttatagtctatattagaaagtgggccaggtgtggtggcttacgcctgtaatctcagcactttgggaggtcaaggctggcaaatcacctgaggtcaggagaccagcctgaccaacatggtgaaaccccgtctctactaaaaatatgaaaattagtcaggcatggtgttgggcgcctataatcccagctacgtgggaggctgaggcaggagaatcctttgaacctgggaggcagaggttgcagtgagctgagtttgcgccattacactccagcttgggcaagagcaaaactccatctcaaaaaaaaaaaaaatcaagagtgatacattctatgggggaaaagagagcagggcacaggcatgtggagtatgaggggcacgagaggagaagcggggttgcagttgtataagagtggaggttagactgagaaggtgatgagtaaacaaagaggcaaagcaggtgggggagggagtccagatgagggcgtggccagtgcaaaagccaaggcacagggatgcctgggaagttctggaagtggtaggagcacgggggagaagaggggaagccaggatcagagaattaaggggcagacatggaagattttgtctgtgtttaagtcttggcttctgctctgagggaaatgagagccattgcaggattgtgagcagagatgagacataaaatggtcctccccaaatatggtcccagttgtaggggcctggggtgaagcggggaggccagtgaggcagcttctgcaataacctaggtaagagaggctgggggttgggccatgctagtagccgtgaaggtggagaaatgaggtcagatgtgagatctgttgaagtttgagcccgagtgtccttctgataaatagatgtgggaaagagtaaagttaaggatgatgcccaggcctgggcccgatgtgcaggaaggaggaagctgcctcatcagaagagggaagccacactcagagtttaccgccattgaaatctacttgctgctaaaatctcaaaccttgaaattccctctaggatttgcttttcccctcccactccctctcaccatctgtctccagctccacctctcccttactcctctttggctggctcactttctcctcccatgtgctacacatagctcaacactcgcgtttacccagattccttctctctgctccccacgccttctctctctgtgtgttccttcctccccagcagcttccattctaacctccctacggaagactcccacctctgcactcaacttctacccctggcctccccgtgaattggggttctgcacttttaactgcccactgaatgccaaaaacacatccaaatgcaatgcagcagttcttttcagaaaagaacctttctttctaacttggtatattcccattgatgagacctccccccctgaaaccgtggtgtctgtcactcttgattctgccaccttgtttctcagtacttccctcacacacaagcacgtctagagttgactttgacagtggtcctgacacccataggcctgcttttgctcccacttccacccactggattctggctcttcattttaccaaaagctactccataacactccccatgttatatctccaccacagccaccaccagcaccccctcctctacttaaaaccctgcatcaccactgcctacaagctaaatacagatctcaacacagcacacacacccctttgcagtctggctcttacatcctatccctttgttaattttccataactttccactaccctagccaaattgtcctattatttctaaacagagcattctccctcccgtgttgttactcacaccgttcccctttaccccaaatgcctttccctctcatacctgctcttcagttcaaggccaagctcaagatacacctcgagttctaaagccttcacttgccccttggtgactactctcaacttgcgatgtgaattcatgtagaccctaaatggactgtacagttcatctaatattgaatagacactccttgatcttccgattaatctcttgatgtgccacatcatctcaaaatcattaacgtctaactagagtaacaattacatgttacatgaatgttagcaattgccccttacttcagcttgaaagggagaaaggccagcttgctgggtcatctcccagtcaaattctttgcagtggagaatccaagtaaggaaggaaatagaagaactaaaaacaaacagagaggctacagtgacatataaagcactgtgctaaaggaacaggacaagaagagaaaggaaaggaaagcctcaaaggctgagacattgggaagcagaccttgatagtgggagagagaatttaagaaagcaggtgccaaacacatggagactattaagagaagagaaaggacaagataagatggatgcagttttttgctgcacgacaggaatgcattttttccactcttattcataatccctcaaaaagatgagtaaacatatacagtgttttaatttttggttacttgaatgtgactttatgaacaagactaggacatgagacaacaagatttatctgagttacataatgagtataacttgtttgtttggaggctaaaatctcttaaagtcagggattgggacctggtatttctttgtattcccagtcctgggaacagtgtcctacatgtagtcattaatccataaatgttagttgatgataaacaaggatgcagataaatgagcagatgacgtgatccctgttttttatcatggaatgttccagaggctgtcatctgttattagcgatgcagccaaacagcatttgtcatgtatttatttaaggagattatccatttgtctaccaagcaaatataacttttgtaggtcaaactcacaattacggcattaaaacaggacaaccatgtgaggattgcttgtgaagaatgcacgtgaataccaaaaatatcatggcattcaaaacccaaatgtcagagagagcatttgagatgagaaagcaagacagcattttcaaaatgcaatcccaattatttatattcttcaaaaactagacaattttcttctgctgacatgttcgactctggtccattttcttgatgctctgagttttatacccaagacctttgtgagaaacaattaaaactaccatgatttcatgtcaaaagtaaatgatcatctctaacacctctctgatgggttttcaaaacatttgcattttctgaaaaatccttccttccattctcatgcactcattctgacctcgtaaaaagtctatgataaaaggtacttaaatatctaccttcaggagattgtagtggaaaagcaaaaggatcacagagaaggaaatggaaatgaaatcaggaattgtgatcttctggaatatgactgttctctgcataacattaaatgagaggaatgtcactagaacttggcaatgtgatagcgtccatgaaagaccatgaaagcagcaaccccctgtttatttcctaaccttcctggccattccacattgactgtgatgtgcaaatgtagtaatacaatgaaaccactacatttaccattactccaatgtataaatgcaatattgtgatgaaaccacttaaatatcttctgcttaaggagatttgcactgtcctttttctgaaaactgttaatgatcactgttttttccttgaggagatccctaaaagtctcagattcttaaggacgttgctaaaaagtacacgtaaatttcaagttgaatgccacctgaaggttgatggaagtggagcaacacagaattctgaagataaactggctgtcctgagcgaaaactggaagaaagttaaagacaactggataatgtgtatcaaatgtgccattaaaatatacaaaccctttgatccagtaaattccatatctgggaatttaacccaaataaatcatccgagaagacacaaagatgtggttataccaacatttgaaattctgcccaaagaagcagaaaaaaggaagaaagaaaggaaggaacgaattgtgtaacgatagcctattgataataaattatagtacattgattcaatggaaccctataccaccacaaagaaaactgttagagatttatatttattaacataaaagattgtcagtgaaacattaaatgaaaaaagcaaataaccagacagtaaatgaatgtattcttctttccaaaaacagtgtatgtctatatacatgcactgtcatgcaaagaaaaggaaatatcacaaaatgtaaacactggttgtcagtagaggggcgggttataggagaagaaaccagtttttcttatctttcttgtatatattaatttcataataaatagacaatagagtctttttcattcttcaaaagaaaataaattaccttgttgagagaaacgcatacttctggaagtttgcatattttgtcctgagaaattctctctctttcctgctctccttctctttcttcctctctccaaagaaagagaagagatgctacaaaggagcagaaatttggctataaaaaaaggcaatttaaaaaattactttcttagttgaaatttgcactgacagaagctaagaaaagcttttgaccgtaagctggcaaagccccgagaaagtttgtctctaagttaaaagaaaaagggaaagttttaaagaaatatttaatcgaattccacagacaagatttcggttaaaattcattattattaagggataaagtatttctttctagaattaagaagaaatgctttaaaatataaaaataacttattatgtaattttcataaattaacctgtaaataaaatgcactagctttattttttttaaatagagtgttgatggggagagagagaaaatgaggcagaatgaggaaggagagaaaaggagaatttatggctttgaagtcatatcttcagtttgcttctcaaaaccaggcaatcccccacgtaatggatcaggcccaaattgtagaatatctgcaactgctctgttctattaaattttgaaactgatgctcaaaaactgcagaagcatcttagtaactcatgacagtgcccttccacatggactcagactggctttaccctactgagggttgtcctttacttcttgataaattcctagaatttgcataacttttagtgctcaaagaaattggctgagagcattgtgaaagagtctcctgaggagctaccaggtccattggggggaccagggatcttcctttctaaccaacctgatttcagggacagtcttggtaggaagagaaacatctcatccatctttgatcacctgctccaacaccaccgcagcctgggaagcccatcccagcagggccaatggaccttagactgccagctccagggacagacgtatccagaatggaatgctcggggtatcaccacaatcaacaggtaccaataagtaaatcatgctgaccatgacaatatttaggattagggcatatagaaatagggcatggagttcaggccaactaatttttttaaatcctaaaatccattaagtaatagaagatcaaaaagaataatcttgattgctgacaatattaatatgaggtctcaatttaagtaaaactcaaatttcatagaaatctttgaactaagcaaatgtgagctataagaatttgatgtaaattatgccattcagggaagctttatatttcctctgcttttgttcttttcaaactattgcattggaacattccaatggttctccccgctacactccctacccccaccattgcagtgagttcagcagaacttactcaattgtggttttaaaatgaccatgaaaaggtgaaatatttgcattttttttaaatcttaagttttcagtgaaagatgttaatgattctatagatgatatcttttccaaactttcttcaactgttttacccctggcccccagagcagggtatcttagaggacaaaatgtaacattcccaaaagaatgatgaaagtttctctctctttttttttttttttttttggcatttgatactctaaaatacttttaatataataaaaagggggaatgaggatttaaatgtcacagaggtagattgtgaaaacctacaaataattcttaaggttgacattttgcagctgggaattttcttcacatggcattaggaaatggcagaataacttttacataggaacaaaatttaaccagtcaagtgacgaacatgtggtcatcatggttgcaaggagctatggcatggtccaatctctctagaagtttacagtttaattaaacatataaaatcatcatgccagaaaaggtttgtgggggggaacggagaacattctgatgctactttgtgtgatactggctgtcaatgtgattagcagaaagtaatgtgagacacatgactggtaaagcaaagattttataaaagaaggggaagggaatcagagtggagagaaatgacgccagctacacggagaagaaccagtgggaaacctgcagagctgagttaggtgaacagctaggaaggctgcccagcaagccaaaccacagggttcagaggcaggaaagacacagccccaatctgagctggccttggtatctaagaagagggcatggtccaaggcagaactaatgggactatcatgaaatcagggtccagaccacggagaaggggacctaccacagatgaagcagctggtcagggtaagggtcgtgaagctgggactgtgggcagtgggactttatgcctaaggaaatcaggttttgctccaggaagctggaggaagcttagtgtctatgcatttagaggagaatattccagttcaatgtacaaccaaggggccagggaccccaggaaaattgatttgaatggtaagatgtacatgggaactccctccaccaataaaagctaataaagtactgcaggcttgtttgagaatggatcagagactagaggcttcatgtaactgggtaggtctggagaatgcagggcctgacattatgagaatgaaaggggcagttatagaaaatgggcagttctagaagtgtggataggctgggcgcagtggctcatgcctgtaattccagcactttgggaggctgaggcaggaggaatatttgaggtcaggacgccatctctactaaagatacaaaattagctgggcgtggtggtgggagcctgtaaccccagctactcaggaggctgaggcaggagaatcacttgagcccgggaggcagaggctgcagtgagcagagatcgtgccattgcactccagcatgggcaacaaagagagactctgtctcaaaaaaaaaacaaagaagtgtggataaagcagatatgccctgcctgagttttctgatccaaaggagaatattccaggaagaataacttctttgaatattccagggtgccagtgtgctagtaagaatttacattcagtaaagatggattacaaaagatgagttaacacattttaaagaatcaacccagcttcactgcatcagagctgggaaacaaagatccttaaaaatatataatcaataaagatattaccaagttaaagaatattccaaaaatttaagtgtcctgccaactatcttatttctttatatcttaacttactctataagatctgagaggctcatagaaatacataagattaaagagtgaaattcaacttaagtgaatattagaggcagggaaaatatcacctaaagtcagagtgtacagaaaagagacacgcagaccctcagctcttcacagtaccaagaggtgaatttccagtttggttctgcatctccccgtgggcttttctgacaagagaaaaacgtatgctaagcatctttcacttcctatgggagtcctttcttctggcatgtcctggtcggtcgctcgccctgtctcctcccatctcgtccctatcaccctgagtcttccacagggagccaggtcccagctgctccacatggccaggaagcagtcacaggagctggtagtcagacagtaacaaaatggaacaggagggcagctagggagtggcaggatctggcctttttatctctggattccttttaattcctgagcaggaaacaaaaggattcgtcaagaaatggctgagacaaaggaatacacatctagagacttgatgcctgaatagctaaaatagacacacacagaaaattaacactggccactatgcctggcttcaggaagccctccagccaagctgagatgttagcaacatcccccacccctacttttctactggaacttttccccctttcaatactgccagcagccctcaccccagctaatacagccccagtggtgccccctgccttcaggaagactttctccaaaatcactctctctgtcaaatttacagaatgaggtaccccagctccagttgcttttgaaactttcattttaaaggacaaggcttataggaatagtttacccagaagggagggaagcagagttcaagaataagaaaatagagctttactaaggaattccaaaggactacccagaaattcacatcgaagactagaagatccctctttttcgtttgaaagataaacagagaactcaagaaatatcatccacatcttgagcacctacctttatataaatgtgttcatatccaagatgagaggcagctgggtggaggcaggtgacatattcaaaggttctgttacatgcttgttgaaatatctctatttccagttgtgatggtcactagtccatttctagcactattatgaaatgatcttaaatagcacagactactgtgccatcaaaatgccacacacacactgccctttgtatgtccaaggagaatactggcctgccttccctccctctggcagagttagctgcttcttcatctgaatcccatggccacttatatacaaccctgtcttgggcacttgtctaagcttttgttgccccattcactcagagaccacacctaaatcatctttgcacatccagactaccacagtgcttggaaaatgagaggcatgcaatgcatcttttctaaactaatacggaactgagtatttcccacagccctgctacctacaaatataaataaataatttaatttcctcaatatggagacttaggaagcaggtacatctgtcaaaggaaatatcactgggtgagcggagaatgctgaaaaacatacatcctcccacaggtagctttaagcggtgctctacaatttttagggactcagatatctttgagaatccaatgaggttttgactctctcctgagaaggatgcatggatacacaaaagtgcattttcaggagattcatgagatccatgaagtggatctttgacccctatgactacctcaaaaccaagggcccactgagcctaaattaggaacttttgcctaagagtaatggtattagttggctgggtattgagaattcctttttttttttttctaaacatagtataaactgttaggctacaaaacactgttatctccagggaagcatcactatgccagtcaagatagaagcttggtaagaagactttatggtaagtccataaagaataaaatcctggggactgtgaagggccagagcaccaggacagtcttactactttagtaaaagaaaagtcttattcctccttgtacctcctaaagtacctagttattcatgtcttatttctcaagagaaaaaacaaacaaagtgaatacactaccgtaggaaccattttcaaaacaagaatcttttcaggctagaaatgtagaatcaaggcaactgaaagcactctctctagagctcccaggaggctcagaggagtcatgggctgactgggaaaccttctaatccagttaagacgtcaattagaaagacctgcaaattgttgatttccagggttccatggttaatttgatggctataatcctgaagaaatgacctcagctccaacaaggacattcttatcagccatgggttgtaccattcacccctttgaagttacagtggacctaaagttatgagagaagcattttaggaggtcatacatgaaataccaatggtctggattaaacagtaacatgcacttatgttataagttagacattttaataaatgtactgaaactgtaagaaaggatggtacaaatgtgtacctaataaaagggattgaaaaaatagtaggctatgggcaggagaacagaatgaaggaagagaaaaaggcaagtataagaagctagaaagaccactataaaggaacaaatggagagaggaatagactggatcaaaatgaaaataacttcaaagaagagagaagggataaaatttcagatggaggtaacaaaacgaaccataagaaagaaaagtgtgcaggaaaaaatcggggtttctctgaggcaggcagggagtgtggataaagcagtcagtccctgcctgagttctctgatccaaaggagaatattccagggagaataactgttagaatattccagggtacctggaatttagcagttaaaggagatctgagaatgcatgctgaatagaattttaactggccattttctacataaaccactccagaagagggggatttcagtgaggccttagaaatgagctaagtttgggggtctgaggctcagacagaatgggggtgggagagggttgcacccccagtggggatggggccggcagtgagctgcagggtagaagtccactgtgcagaacagaggagaactatgcctgaggacaggaggcaacatggggaaaatccttaaaagcagcacaaaggggctttcaccaaaggaaatggtgaccttcagcagcttcctaacacagaagccacaccccagagatctggtttggctctcaccctgagatcggccatcacatctaagcaacagcaagtttaaagatacatatatatcccatacttaagacaggcaagccataactgtttcatggaaatgtgactggagcaatgaatttgactctttgaaaatacgaaacatccagcaaatgaatcattcaggacactaatgagcacctccgatgctccccgagaagcgggcaatgttaaacaaaaggctaatttagatatttaccccaatgcgtggcatcaggcaaataacatatttggaagtaacatatttagggtaaacaggacagataagtaaagagaggccagaagagtcgaaatttggtggcaacacagcaggaaagaagttgaggcacagagggaagaacaacacacttggtaaaaagttctatcaactctttctttctgcaaaatactataaatattaacaaggcagtggtcatgaaggaaaaccataaagaaatgaactgtagtaacatggaaataagccaaatgtaagtatattctcttaatccggaatgtagaacattaggctctcggcaataaacttttaaagagtatttgtgtaaatctggttacagcaaccaagtttgtctcccaaagacacagaaggaactcctctgctctgttgcatagaaacaggaaaatacctttggtcatcagttatgtttatttttatttatttatttattatccagctgaatttaagatttgtggtccttagttatgtatgtgcaaactattgagagtgaatgggaagcaggagacagtcaattcctgaaagtgcctcagcttctctctaaaaaacaagcaggagggacagaaacacagcgacataattctgaaactttactcttcctttaccgtggaagttttcttccgcccaccctaacattggtttgtttgttaaatgaacgccactgtactcttaaaaatagtctgagctaaaacgtatttgtgtctggagagtccagattgtaaaagtaaattgctttaataagctcctttttaaaaacaaaacaaaaagagcgttaagcacatgttaacgtagtgagcatcaggcttccgcaaagattgcaaaaggtacatcttgtttctgaaggatgaaaagattttgtaagagaagcagctggcggtgtggaggtggagttgatttatcatggttaggaacctggccatccctccccaggaagagctcgggacaggactgctggctacctttgaagagaataacaccaaaagatcgtgatctccttacaaagccacataaaagacccagaaagccctaactagaaaatttagaaagatatcaaattttcaaaatgaaaaaaaaatggtttatcaaaataaaggatgttactcaaaatcattgctttctcctcataatcaaaagtataatttggggaaaagaattccttaacatagttattaatatatcaaagttcttttttgagttggagtctcactctgctgcccaggctagagtgcagtggcgtgatcttggctcactgcaagctccgcctcccgggttcacaccattctcctgcctcagcctccctagtagctgggactacaagtgcccatcaccacgcccggctaatttcttgtatttttagtagagacggggtttcaccatgttggtcaggctggtctcaatctcctgaccgcgtgatccacccgcctcagcctcccaaagtgctcggattacgggcacgagccaccgcgcctgacctaatatatcaaagttttaaagattattcccataaggaataatacgtttcatccaaagataattttttccacaaaatttttgattagcaaaatgagctcaaaatatgtacgagttcacaagatttcttctatcccaaaagaataaatttacattaatactggaaaatccatctcaattaatccccatcctcaatctcaatgtcagtctaaggtcatagttatgttaccatcaaaagtagtataaaatatgaacttatacagatgctcctcaacttgcagtgaggtcatatcccaataaacctagtgtaaactgaaaatactgtaagtcaaaaatgcatgtaatgcacctgacctagcaaacctcatagcttagcctcgcctaatttaaacgtgctcaaaacacttacattgaccagcagatgggcaaaattatctaacacaaagcctgttttataataaagtgttgaatatcttatacaacttattgaatactgtattgaaagtaaaaaacagaatagctgtacgggtgcttgaaatacagcttatactgaatgttaatagctttcaaactgttgtaaagtcaaaagtcattaagtggaaccagcgtaggtcagagactgtctgaatgctaaataagtatcttctggtaacgttaaggacattttaaagagtagtgatactttatatgttttcttgaaatattagctccatgtgataccaaacagaaaaacttaaattcaatataaaataaaactatcaaaatacagaaactacatccttttagataaatctttacagcagatatggaagtaaataacagttacttcaaatgtattggggagtgaaattcagatttgattcttgacaagtctttatcacacaatttctgattatctgtcattcatcctgatagtcaaacaccagtctgaagtgaaatgcactcgtctctttgtcaagctatgttcattcccgaaataaatttctctttaccttcttttcacccagtaaaattcctgctcccccagctggacttccaaagattaaaaaaagaacttctcatcagaagagggtcagtcaaacataaagtgcaatataaattatagagacctgagcattttcttacatccctttatcttcattatgatatttgcatcatattttggagggtgagtctaaatgcatattttccatttagcaaaatatttagtgtacaccagaaaaaaatagagaaaatgccctaggataatccttaacatttgtcaattatccttgtacattcgttatctaatttaagctgacaaacaaccctgagagacaggtgctgctaggaggatgcctaccccatcctccaggtgaggatggttgcaatatatagtcagacaggagaaggaattaacagcaggatgcaagaagttgcctgggtgcattggactgggatgggtagattctaaacttgagctcaggcctttgaattgagctgcaaggtggaacattatgtcagcacacgaaggcaccagagttccaagttccaaccccaaaggtactatatgctggatgagaaacaaagacaactgaaaggacacagaatgctaaactaggggaaaggtgatcctctgggaactgtccaagtgtccaagcaagaggcagtgggtcggggagggaatactgagggtctctctttctggcggccatttctacgccaaagcggaggaattagaaaacaactaattagcctgtaatcccagcattttgggaggccgaggcgggtggatcacgaggtcaggagatcaagaccatcctggccaacatggtgaaaccccgtctctactaaaatacaaaacaaaaaattagctgagcgtgatggcacatgcctgtagtcccagctacttgggaggctgaggcaggggaattgcttgaacctgggaggccaaggttgcagtgagctgagatcgtcccaaaaaaaaaaaaaaaaaagaagaagaaaaagaaaagaaaacagttaattggacacgtggtagtttgagaaggttaaactacagaagcaagttcaagagagagtaaaaagttagaagtgactgatgcaggaggggtggttatggaggagaggggccccaaagagagctataatcccaccagttacttctgagttggggaccctgcagtggcaaatcactgtgaggtgctgtgtttgaacgccctaagtcaggccaaaatcaactgggaacaaaggttatcctgagagaccaacatccaacacctcaagttttccacaatttctggaaaaagaagcagatgaaagattccaaaggaaaactgatggccagagcattcagtaccaaagatcacacacctgtgatgccttcgccagggctggaacacagtcgctggattccagagcccatgcctttccactttgagccacactagaaatattatgttagggccaggctcagtggctcatgcctataatcccaacacttcgggaggctgaggcaggcagatcacctgaggtcaggatttcaagaccaacctggccagggtggtgaaaccccatctttactaaaaatgcaaaatgagccgagcatgatggtgggtgcctgtagccccagttgctcaggaggctaaggcaggagaatcgcttgaactcaggaggcagaggttgcagtgagccaagatcgcgccagtgcactccagcctgggtgactgagcgagactccatcatcaaaaaaaaaaaaaagaaaaaaagaaatattatgttagaatccagtttttattctaaaaccttaccaaagtgaaagaaatagcattgatggatagaattcagattatctgagcaaaattccctacctactgtctcaacaccaaaccaaagttgggttgaatcagatgcagtgttgagtagaagattttggtaactcaccaataaagtgattattccccaaggcgagcatctcctccaggaggaccagtccccctgaagcctgaaggggggtcacacttcgtccatctatgagggagcactgttggaatcctgtggccgtgaccttccagagcaaaatcagtgaggcagtggcatcttgccgaatcctggaaacaggaatgatgtaaacagaaagctcctttcagaaaaattcatcttagaaccagttcttcaaattaaaaataaatacaaagatggtatgtgcatctaccaaggtaccaggagatcgatggcataaacagatacgcgggcgtccactgtaaaggcgtacactcccacttgttcacagtgtaccacaaaatgagtcactggtaactcacctttgagtaaccactttgatgaacagtaaaagagtacactgagttctctttcagacaaatccttccatagccacacaatataaaaagagttttgcttaaatttgtcataaacgtggactgcaacccaacacagccacctgagttatgctgccaaaataagcaaaagtgtgtcacctttccccaacaccccccacccacccacccacacacacacacaatcacatacaatccacctcccaatgcttcaggcctcccctggctcatttttggtaaaaaaaaaaaaaaaaaaaaaaaaaaaaaaaaaaaaaaaaaacacacaaaaccaccccacagagaataggatgtcacagaaagcccatcaaccccaaccccaaccccagctgccctcctgcgcttttctcctcacagcccaatgcttcagctactacgagctaccccaacccagttctttctcacctcccaagctttgtctccttctccaccttggaaatgtgttcctagcccacatattacctcttcccagagactcctgaccacttcccaacatcccaacagctgcccattctccccagtgctcctggagaagatcacagtagactccgcacagatccgctcccccagcacagggctcctggcgtgcagcaggggctcagtaaagctttgatcagtgactaaattcatgaggaaatgaaagcgtaaggagctagtaacccccacaagtgaattcagtgccctcaggtcattcggcactcccatctcacttcgtctgagtcagactctgctaattcggtcccgttctgcagcttaagggagtctcagagaatggcaggtttgttgagaggaaaaaaacaaaagcatttaacgagatagaagaccagaaaatttggaaaggtttatcaaggtaagataatatgatctagacaagaaagggccgagagatgttttaagagtaaaggaaactagagatcctgctcctaaaactagcccaggacggcaggggtttcagctgtagtctgagcagtgaaagaaacgcttaggaccggggtccccctgctggtagagctcgaagctgcctcaggcttcacctctcccgcctctccggatgggagcgttcctcctgagcccaggaattcccaagcagcccttccaggctcttcccctgccagagtgagttcaaggctgtggtgacccagggtgcaagagcaatgtaacaaagtccctcttccaaacatgttcagggactccactgtttagaaagccaggtagacaaaaatggcgatggatacatggaagagacctacagtgcccgcaggccccttaaaagggagccagtgcaacagattggttaaccaggccacgtgttcccagtcttctaaaaatccccaaagactggacagcaaatgccccttaggttgcatggaaagtgtggggagggtggtagtcaatggcaactgaaaaggatgggcagtggggggttgtcagccggcctggggcaccctaatactggcccataccccacccccagctttgtgctcctgggcacctgctgacttgagcctcatataaagcaccacacatatcaggtctcaaccagcactgcttccctatgcctctccctcttccccaccggtgacaatggaccctgtcatttaaaatagcttgaattttaaacaaaacactctctttgtacgcttgcttttaaagagaaaactgtaaaaataaataaataaataaaaattataaaaaataaagagaaaattgtaatatgtagaatttaaatttggggcaaagtatgcatctgaatgtaactgatggtccaataaaatcttaagaggccaataatttgggaagcaaagcatttgggagacaaggaatctggctgagatcttatctaaggcctcacggtttgtcacctcacaccagactcatccagtccaatttctcaattccacttgtccagcctgaaaaccctcactgtaattgcctctgaaatcgcttcctctagttttcaaatggcaggggccacatctacccgtggaatctgttcacgattctcacttgacaggccacttacacaccaggtccgcggatggacacaaccccacttataggtcatagcatcactcttaacagtttgtaactcagaattttcttacttgactgaggtgttctgtggcacttcaaaggataccaggcggccacccgcagagctgttagaactggcattcccacaggcaatatctgggatcacctgggaagggaaaaaaaaaacgacatatgattggggttgtttatagtataacataatgtgataaagcaaaattccatgctgaatttccttcatcccttttgatgatgcgggggtagggctagagaggagatgaagaagtgaagccttacaaactcaaaagaaaatgaaatctttgtcatttgatgttctgaaatgcaacagcttccctgagagcaatctacaaattcctgggattgttaaaactgatcaataggatattgcaggacaggaagcagatgtcactccctgctcattttccattcatttaacaagcagtcattgacccctgcactatgcttaacctgatgctaaccaggaggccaactttaaggactaacttacaaacagcaggtaaaagcctaatgactaggcaagccagccttcgacttgcaaagtgcatgcagtatcaggtctgatgactcttctgtgtgctgatgggtccaggagcacatgctaaggctggggagcttgaacgctgcctttctttttccttgtaggctataccttcgcttttaaattatttcccaaaagtattatatggatgtatatttttttaaaaaggagatcaattggtggggggaggactgtgctcatcaaaaagcatactgcaaaaccttgagctatgtccagtgagcataaacctggccaatttatgcacttagtcctcatgccacaattactgtcctcccccatgtcaatgaaaatgaagcagtattaaaagtattcatcatcacagaattaattgagaacaatacagaaactctcagcaatttcactccacagcccacacttagatcttattttccagaatgccctacaatcagattctatggattaagcccaccactgatattcaaagatgtgagtataacttgttaaatttgtatgacagatggctgctacccaagcctctaagtctccaaataactttatgtttccaaagcatcattacttcacagaaaggggataataatatgcctcctggtttccatcaggttaggcatacatattaacatgtcttcctctggcactttaaatctgcttcatgagcagcctaagaaataatccatgatataggaagatgaggcatttcctttttttcttttttacacttaccaactgtaaaataacatgactttaaataaatagattgaaatggctggttagggagaaattttcttttaaaggacacttctttgataaacttgaatcaaatctagttcacattcaagaactgagtcatccagcaaagaagcattaacatcataacttcaaagcatttattaaaagcctgaaatcagagcaagttcacagttttttaggtaagctaaaaacattgccctgcagtctgaatgtggccttcataagctgtgtggtaatacaaaaaaaaaaaaaaagtgggtcaactggtgagaattactcaagaaaataaaaggagaaatgctactatctcttttataataaaggaaatttctagatgcagtccttgactctaatacatgctatgcaaaaatctatttttttttttttcatttaaacgatgaaacccgtaataataacataccgacacaggtttatatggatgtcatacatataaagtataagatatagaatggaattacactccccagtgtcacttcaaactcatgatttggatttgttccccaactcttctacccagcaaatttattttatgtcaacttctaggagtctactgaaaagacttttgaagagcttgaagataaaacagccaaactcaaacttgataggagaagttccaacaaatagaatttgctgctgccaaaataaataaaacttggaagtttctttgtcaaatgcattctaaaaatatgtcaaaatcattgatagcttcttctttctaaaccccattgaaatacttcaaggtaccaaaaatagaacctaaatgacaacagtaaaaaaatagttgagtgttgcggtctgctgtggtctgaatgtctgcgcccctctaaattcatgggtgaaatcctaaccaccatgatgatggtattaagaggtggggcctttgagaggtggttagatcagcagggcacagggctggtgaatgagattagtgcccttgtaaaagacctgaaagagctccatagcgccttctaccatgtgaggttacagtgagaagacgcgggctgtgaagaaacaggccctcaccagactctgaatctgccttgatcgtggacttccttgtctccaaggctgtgagaaataaatgtctgtgatatgatttggatctgtgtcttcaaatctcatgttgaaatgtgatctccaatgtgggatgtgaggtctggtaggagatgtttgggccatgggggcagatctctcatgaaagacttagcaccgtccccttggtgataagtgagttcaggtgagattggattgttttctgggacctctcccttccctctcttgccctcactcttgccatgtgacacactggctcccctttgccttccgccatgattgtaagcttccagaggctcagcagaagcagatgctggtgccatgctttatgtacagcctgaagaacaatgagccaataaacttcttttctctataaattgcccagcctcatgtatttcttcataaccactcaagaatggaccaatactgtgtgttggttataagcaacccagtttgtggcatttttgttatagcagccttaacagactaagacacactcccagaaaggaaaataaggtcaatgatggagggtcctatgacatgttcctttacatgactacactgagctgtcttccccaaaatctaagattatctcacagaaatacatgtggataccattccaaaaaataatttgattcatttttttgtttactctttttatacttataaaaccatcgtacacacaaatgcagacaggaataagtttagggagatattttgcttcgtgatttaacttaaaatgctttcatttttaattgctgatactagaaccgctggagtcactttaagatttctggtttctaatgtaaaaatgcacatgatataacgttctcacctccacttgatcccatttcatttctacaactttctgccctgttttcggctgccaggtaggcagtgtcaccgttgcctgagagcgaggcaggattttgtcaggctcctgagtagcaggaacaggctgaagctgtcggggtgccatggattcggtccagccagtggctgggagactgggaagtgcctgttcacagttgggaccttcatagccttcattgcaaatgcagaggtagccatcgctgctgctgctgctgctgctgctgcagttgccatggtgacaagggttgctggcacaaggatctgcaacaagctgaaacgagaccataaatgggtcaattattccctcataagaaaagtggtgccatcgctgggaaattagctctgtgtctcagagcgactgctgtaatggaaatgctgttcctgtggaatacactccttaactacttgtgctgttgtggggtggggtgtacaccaaggtcatccgaacattaaccttaccacagataagaggcacccagcaagaaaatacaaagtggagagcagcctcctcaaaacccaaaacacccaataatgtcgatttcagtaaccagttatttagagtaattttctagggcaaaaatagttaaaactcattaggaagatgccaactttgacatttttagctgtcaaatgatattaggaatctaaattggaatctccttttccacattctggacctgtgcaaggtctcctcatgagaaaagactgccccatttatctgccctgcagatgtgcttacctgtatctctcaatttcctaaccggtcaacaatactttttaaggtgatactgtactatttaattaaagacttccaaaatgatcagtttgcatggcagttgctagctagaagagactgtggtggggacttaagcagaattttatgaaattttttatttctttattttggagggtgattagagagaaatgtgaccccttccctcgccagatatggaagatgagaactcagtcatatgtgtttcaattatgctcatggtctggggaaagtgtttatctcagagtccttctctgttgacctctgaatggccatgtgttggtagttgcagacacgctacaaaacaatgtgaaaaaatcacctgctcctcttcagatagcgcaagggttcagtcatgttctcagcacctgttcaattaggatttgtttctgtgataaggagaaaattagatctctagctgatatacccctggcttctcagggctgactacaaaacagaattcagtagagaataaatgacagagaagtgggaccctcactctcttgttaaaatgagttcacacacttaaacatacatggagagaattctgaatggtaaaacggctactcgttctgctaattattcctatcaagcaacttccaacagactcctgaaggaatatattaagggatttggggttgaatcaaatgaagcttcaaaaataccacattaattctatgctatcacttggcaattccctcacagaatctcagatcagagtcaatggatttgtatctgaagagaatatttaaattgtcaataattaatttacaatattcacaatctatcaactcaaagtaaaatccaaactccttcttcggcagacaaagctctttttggtcaggccccttcctctcctcccacaaaccttcctcctcccttgtagcctactgtcctcaccctgtctctctccatggactataccaagttgattcccacctcaggccctttgcacctgctggacccctgcccagaacactttttctccagacgttgcacggctttcttcctcatctcattccatcctctactcaaatgctaccttctaggagaagccttccctcactgtgaaatctaaactaatctcttctttacccctctcctacaaaaatgtgagctgcacgaattcaggtattttatctactgtgttcactgctctattcccagcctgtccaggaacacagactgtatgatgggactttaaaaaaaattgttggaaaaaggagatatgatagattgatcaacatttggaaagcaacacgtgatgagggagggatgtgaacttgttgagtcacaaagttgttatcttgtttctgatttatttttaggaaggccttgtggaacgggtgtcaccccaagaattatgcaacaagaagaagaattttattcacgtgaacaaaggagacattcaaagccatgcttctgaaatcaacttttaaaacatctgaggttgatctagtcacaaataagaatttcaatacatgcattaaaaaggcagaaatacatttaaaccacaagggatcaatacaaaaattaattctgaaagtccaaacctccattgcgcagcttagagaatgacattactaaggcaaggaccacccatctggtggcctgagaggcctcacagcttcagctccattgccacagcccacatctgacaaccatcagtcctcagagaggcagaggcctcctcaaaaggggcactgagcacagcagaagtccacattccttcagagaaaccagttaagcacgtgtacacacccttcccacggtaacaggcacaacacctaccctccccaagatagccgttttgagttttcaaaggacactccatagagtaacttctcttcatgccaacactgaaatggagaaggatcttctgaatccatatcacttctgagaaaaagaagagcagagggccgggcgcggtggctcacgcctgtaaccccaacactttgagaggccaaggcaagcagatcacaaggtgaggagtttgagaccagcctggccaacatggcaaagcctcatctctactaaaaatacaaaaattagtcgggcatggtggtgggcacctgtaatcccagctactagagaggctaaggcgggagaatcatttgaacccaggaggcagaggttgcagtgagccaagattgcaccactacactccagcctgggcaacagaacaagactccatctcaaaaaaaaaaaacaaaacaaacaaacaaaaaaaaaaacaggcagaggagttgaatgacctctcacagctactatactaggagaccatgtcttctgattttcagccaagagttctttccataacacagcaccacaactttaatatcatgttattatcatgccaaaaaaaattcctgtagagaaggcagaaggtaagggttatatttttgtaagcaatagaaaacaagtagctattaaatgtaggccaattaagactgcctgaatgcttttttgagaaaaatgtatgataatggtaatactcaaggaacactgattgaggacttactatgacaagaactgtaccaggtctcggtataaaatgctgtttaaaaaaaaaaaaaaaaaaaaaaaaaaaaaaaaaaaactctaaatctgtcctagagagtctacatctagtaacctagtacaagcactaaaagtttacatctagtaacctagtacaagcacaaaaagcacctagtcctacctgctattcacaatacttatttgtgcgcctgccattctgttgggtgttttacatttcttattttagttcatccttacagcaacccttttggtaagtacatttgtacatttattattctattttacagttgaggcttaacagtgttacacaaatgactgacttttacccagaataaaggccaaagtattcactaattttttttttttttgagatggagtttcactcttgttgcccaggctggagtgcaatggtgccatcttggctcactgcaacctctgcctcccaggttcaagcgattctcctgcctcagcctcccaagtagctgggattacaggcacctgccaccacacctagctaatttttgtatttttgttagagacgaggtttcaccatgttggccaggctggtctcaaactcctgacctcaggtgatccacctgcctcggcctcccaaagtgctgggattatagacatgagccactgtgcccagcctgtattcaccaagttttacaggccctctgtctgtaatgtgcctgccctagtctccctgacctcacctcctgcccctgacctccctcactgactgcacaaacactggcttgctcactgctcctccaatgctccagtcactctcctgccccagggcctttgcaccggcagtaccctctgccgggaatgccttgcttctcaaggctgctcctgagccacctttgagtctttgctccaatgccatcttctgatgaggagcctgcttaacagagcaaggtctccagcctctgtcaatgtcaactcctctttctttttttcaatttttgttttagattcagggagtatgtgtgcaggtttgttacctgggtatattgcatgatgctgacgtttgacccttctttccttgcttttttttttctaaaatatccatcatcttctcacacaaattttaaattatttaatacattcatttttttctttccccactagaatgtaggctttttgaggtccaatttctgttttccgtttaatttacttgtgtatccacagccctagaacagtgcccagcacatgggagctgctggataaacatttactaaatgaatgaatgagtgagtgaatgaatgtgaatgatgttatatacacgcagctgccagagcctatgaagtgtactgccttgttaaatggaatcaggattctccaaggcccagtctcaggtcttgagaacataagtcaaggcggagccttaaatgtcccactgtggtgttttaaagtgattaaataactttaaatctgctttaaaaggagtaaaagctctgtcgacctgagaggtaagacagaaccagcacaacctgcagcctcagccttgatgagggcaggaagagtacagacccacttcacaggtggctttcaacacagtgagccaagccacctttctctggtcctcggagaccatctctgggagccactttgtgaagccattcaccccagtgggaagtgtcagaggtgctggttgatggagctgagtggcaaagggcaggtcccatggcaatgttcaatttgccacatccaggagtcagtcccaccaggtaaggggataaagagccagaaagaaaatatgatgagaatcaataataccctaagtgctcttgtctgagcttcatagatgagaggaatgcacaaatagcatgtgggatgaaacaatgaatgactgacacggaaggccaggagaaacactcttagtgaagaagagaggacaaaagctaaaaattaaacagtcagttgcataaatttctaaggggattcaaagtagtggataatgtgatggagtgtgtatgcacacacatgcacacgcacatgcacatgcatgcacatgcacgcatatacatgcacacacctgcgcacacacatgcacacgcacacatatacatgcacacacacatgcacacgcacacatatacatgtacacacatgcacgcacacacaaatgaacacaaacatgtgtgcacacatgcacacacacatgcacacacacatgcacacacacacaggagtacgaggcagagaattaaatgcattgcagggtcattgggccctttttaaaaataattttatcccaatgctacttccttggcgtgtatattagttgtttcattaacaatggcagctttctgccattattttctctaactcttcagactagttttattttttgggaaagctatctgtttcaattcataacagcatatataagataaggtgcaatcattaacttttaagcaaatcataaatatttatcttaagtcctacgtttctgtatacagtcaagatttttttaaagttcgtatttgtattttatctcattaaggaaaaggtcctgttgcagaggtcgcatctgctcttgcgtcccattaaatctgaactataagcaggtaataaccaaactgccaaaatgcataatgaggcaaaatatcagaattagtagacctaactttgggaatgcataaaatgtaatacatgatattttccgagctataatttctagattctaatgatggggaaaaatgattaagcctttgtaataccagctataataaagaggaaagagaaagcccatgggttaatggtcttctgcttacagtgaaccaacaggcccatttattaaatgccgtgtgcttgctgcatcagatcaatttatctgcttaagccacattttttcacatcatagaactaacctgaaactattttccacattttattttagacttttcacccgtgtcaaataatgtctactctaaccaagagcagttctgggggaatggactgagtaaaatgggaggccagacctgagcgagggtgccagcctctcctgggacttgtgattcaaaggcagtagcagtgtgaccctttagccatggcctgtttttcttccttaaattctctgctacccatgtttctggcaattcccatatcctctgcggcgtacaaacagaaggacgaaatgccaactttaaaaggcatgaaaaaggcccattgatagggtcattagatatagtaagtcaaagctaatagggttgctcgaagtgtggacacctgcatcagcattacctggatgatggtggggcctggggagacacagaggtgactaacttcccttccatactagtttagaaaatgtatgggcttcagccctgcctcttctgtacttttacagacaactcaatatggccactcagcaattcatgtgacatttatcaagcacctatgatgtgcaaggcaggatgcctataataggggtcaggaagatgaataaagccttacctggcccttgaaaagctcacagtccaatagatgagtcagagacgttaacttggacttgccctgagcagtcggctcatcaattgcttgccctgctggtatgcatgtcagctattgggatcctttgtttgattgaggttacccaccccaacacctttatgttaaactaccttacatttttttaatgctgagggagagaatggatctgatcatagcaaataggaaacgaaattatgagcaggtgttgggaccagtctcttttagaatgatagcggcagctttcggcaaaacaaagacagcaattctggatgcctccaccaagaagaggtggtctgggagttttccaatgagaaatggagccagctgagcaagcagtgccctggcgttggccctgttcttcacaggtgggtgggacaagttgctcacctgctctggacacacacccctcacgcattaagggaggagctgggtttgcatctcgaaaggcctcctccagcttgaagacttaagattctattgatagccactaagcttgatggcagttttcagaaggttcagggaagaaccgagccgaccagaggtcagctcctccaatattatacccaagctaagtgggcaaaggcatccagggggaatgggacggtgcttgaggaaaccaaatgtgacaaagccccagaggagaacttacaaattctgggcagtgggtggggaaccactgtcattatatgacccagcacgacgctggccacagaggggacacaggggactcgtgatacttacagagaagtggagaagaagatagaggcaaggatgggaaagaacagggggaatttgtgtatggtattaagaaggaagtaaagtggaccattacgttagtaatttgtctgagtggcagaatcaattttaaaacttttaatacagactttaatagagatattagtattaaaggaagagggagtgtcttattaaacaaagaacaaaaacaatagccttaaagcaggttttctcaacattggtacttttgacaccttgaattggataattttttttatcactgggggctcccctgtatgttgtaagatgtttagcagcatgctgtgtccttactcactaaatgccagtagaatccctccttccaagttatgccaaccaaaaacattgctaacatcccctggggaaagatcatctctgattgagaccactgccttaagggaacagtgcatttcactccatcaaaattatttttaatcattgcaactccatgagtaaatttaaaatgcaacactatcatgaaggaagaaatgtacaacatactataaaggactaaatcccttattatagaaagaatttttaggataaatacaagataaatgcctcagcgaaaagggcaaagaaataaacaagcaatctacaaaataaacagtctacagaatcatgccattttatacaatcttaaacacaaataaaatgttatgtatttatttgtatgtatatttactggaggatggaaaggagggagggaggaaaacagaaaaggaaagaatgaagaagggaagcaggtaactagaatggaccattgttttagtgatttgtctaagcagcagcatcagtcagggaacttttaaaacacagattccccagctccaggccattcatcagaaactctaaaggtgaagcctagaaacctggatctttcaacatttcccagatgattctgatgcacctggccccaaaaccaaaatttagaaattgttagtacaaattagaggttggcaaatcacaaccacaggccaaatctggtttgttttttgtaaataaagctttattggaatacaaccacagccacctgtttatgtgctgactgcttttgcaatacaccagcagttgagtactgacaactgaaagcgcctggcccacaaagcctatatgatatttgttatctggccctttagtttcccagtccctgatctagacagtacagactttggggttcacaaaagagggaaaacaggtaggtgggggtcacctggaaagacttcaaaaaagaaaactatcttgaactgggccctacaagtttgatagcaataacatctattttctccccccatgcaactccctaattggactggtgtgcagcaagtgattaaataacagaagaacctttggcaaaacaacttaaaggaccagatattcttttagtcataattatgtgcaggaaggttgcagaataaatcttggtactatgaaaagaatgctcatctagatagtccaccttgaagcaagaacacaatgaagggtcatacccctacctttccttcactagaagaaatatggaaattctccctctacctttccatccatcagctgaactaaatggagatgaatgatgagcaacccatgccaaggctaaatatagaactaggtggacccatggaagacgatggatggggaaaggtcacacagactaaggggatattgaaatagcaggagagtgactctgtctgccagttggagagggggactacagcaaagatgactccagaatttatagcttagggttactggagaaattagaatgaacaattgccacctggaggtactgtgatatgggagagaaagactggggttccagtctcatttgcaggtgatgttggacaaggcaagaaagcttcctggggctcagcacactcaactgtaaaaggaagggatgggactagaacattctaaaggcgtttaagttcttaatattgtgtttctatgtccaaaacaggaattgcagtggttgtaaatgtcatcttccttctgaaacgcaaatgaacaatgttggggtccaactgtcacagtatttttgtctcaaaaagaaatttttcccaccttcttcaataaggatttcaactatattccaacaccaactgcttactcaccaggaataaagatataaaaaaaaatcactatagtgcttatgccagtagtagactcagccaagaaatgcatcccaagatttttttcccaaatccaaataataaaaatgctcattcgctttactgaatcaagaactatatgtcttagtgaaatacacattccatgttttgataggtctttacttctgtattagaaactctacatcaattcaaaaaattattccaagactaatttggtcagtccattattccctcaattctgagtcagctttcttgaaaccagcttgtcctgatttttgtatgtgagttgagtcacatttgtaagtaggctaaaaggaaattataagcagaattgaaacgtggctataaaatgaatccattaaaaataaactcttacatattgtttccctactttttcatgctgtctctttaaaacatactgcatttggaaattaccttgaaatctcaaggtaattgctttagtctgattaacacatagtgataagtcatagtgatgaatctataagccctgctcagctgcagatatatcaagaattaaaggaattgttcttcaaaaacctgatcttccctttgtcccttggtttccatatttaactaagtcctaagagatagcactcaattgcacttactgacataggcacaccagcctcaaatgaaatgcttttttttttttcacttttaatcattcaaagaccaatttcttgaataaaaaagttgcagaacaattccagtgcacacatttttgtttcgcctctcatcagagacactcatacatcctatcaaacttttttacaaaaccacaatgccatcaatacaggaaatatgtcgacttctgcctctttcgtactcaggaaaagaaggctgcaggcaaactgggaattaaatttcctgtgaagattgtatgatcatctcaaccaatgcagaaaaaactcttattaaatttaacatctaggtagagtgaagacttttagcaaactaggaatagaaggaaatttcttttatctgataaagagtatctacaaaaaaccttcagcaaatataatacttattggtgaaaggtagaacagtttctctctgaaactgggaagaaagcaaggatgtttgctaataccacttccattgagcactgcactaaaggtcctacacagtgcaatgaggcaaaaataaaaagaaagtataaggatccactaagaaaataagctgtcaattacagactgtatgattattcatgcagataaattattaaaatatggaacttcagcaagtttgctgcatgcaagatcaaaatttaccaaaaaataaaaatattttgcatctccatgtatcagcagcaaactaaagatccttttctcaaaggtacagtttataatagatgaaaaaaattaaattcctagtaataaatcaaatgttaaaaatgcatgatctcaatgaagataattgtaaagggggaatattccagtcatgaattagaaaacttgatattagaaagactcaaatttttcttaacctacaagattcaatgctgctacaacagaaatcacaacatttgtgtgcttctgtaaaatggcccacgatagcacagacacgcttgaataagaacaatgtgggagggcttgctctattagaaagcaggaattttaaagctatggtaattaggatagcatgacactggcagaaagatgaacaaatagaccaatggaacagagacaagaaacagaaaggatcacacagggacacttgacttctagaatagagtcttttcaataaactgatatccaatgagaaaaaaatgaagacttttccctctctcaagccatatgcaaaaataaacaccaattggattgtagatccaattgaaaggtaaaaaattaaacttcaaaaagataatagaagagaatatctgtataaccttatagtaaacaaatatttaataaacagaacacaaagagtactaactataagaatattaatattaaatgacgagttaatgggtgcagcacaccaacatggcacatgtatgcatatgtaacaaacctgcatgttgtgcacatgtaccctaaaacttaaagtataataaaaacaaaaaagaatattaatgagctggatgacaacagttatagtatactgataaaatatactatacagccatgaaaaagaaagaactatagccttatacaacaagtagaacaaattccccaaacacaatgttttttccacttgtgtaaagaatataaacagcaaaagtgacccatgcttgaagtcagaagagtgattagctttgcagagctgagagaggtggggacgaggaagctgctggagggcaacattgtcaaccttgatctgagtggtggttacacaggtgttcattttatgataatacattgagctgtacatattttgggggggtgcttttctgtgctttgcaagtttgtgctttgcaatttttgtgcatattttgtgctttgcaattttggaaaattgtttttaaaacacctaccatatacacatatctgacatactctttgttccttggttgtcatatttaagaaagatgatgaaactaacttgcctctacccaaaagtaaccataaggttccttcctgattttcctcccaggtaagaatggcacacagattccagagtgactctccctccagcaccgcggccacatgaagccacagggaccaggagggccagcagaagccaaaatccagcagcctctgtgtcctcctaatgactttgaccttccttctagaagacacagaaagccaatgaaacatgccaaacaggggtggaaactcaagtcagagtagcactttgaaaagaactttccacttttgttggggactccaaagacagggactccaaacattttaaatgttctcatttctttatttttaaataggacaaatgacatgctctttatttttaaagaataaataaagaacaaatgacaccaatgtggggtagcagggagttggaaaaccaggcacatagtaggctctcaaaaaatatttcttgtctgaaacaaagaagagaccccattgctttctaaatcattctttattcagagtattccctaccaggaagagtgttcttctgtatctgttaggctcggtggcctgggatccttaagagaagttggagagagaaatctatgagtgcctgtgaaaccaggtgcaagagcagaaaaatcagggtcaccttgtttagtaaaagtcgggggaggctttgggttgatccgccaagtgccaagtgttcttgtgtacctgcctggcttcttgactgctttgatgtgtgtttttctctctgcaggcacacaaaattccctctgctctcttttcagcttttctaaccttacttggaaacagctgctctaattttaatacccatctgctcccgggaataggacaaaaatcagtggctctgcagataactctaaagtctttgggtatccaacttcatttatctggagataagccttctatatacagcaggcttcatatagacagctacactaggaacaaaactaaaaaggaaaatgaggaaaaattcaagcaaaagagcaggtggccctagatatccagtaccaattgttttaaaatcaacaagagccaaagacccacaaattgcacgtgtgttcagattgtctcattgcaagattaaaaagaggatctttgattggctagcaaatctgctcaaaggccagggttgttttatttttttttctccatgaggaagctgagaggaccttcgtagttatgaaagacaaaagaaacaaaagaaaaaaataataacagaacaaaaaacagggctgaaagtggaagaggtcacccgtaaaagccctaccaactagaaacagtcatggattgtgaagcagagaaacaaggatggtcacaacagagacgggagtttctgcagcctaggagttcagacaggaagcaaagggatgagggcagaaacccaccaccaccttaattctgcagctctgtggacactatatataagctatacagggaagcagaagaaacctgtataattgtatctaatgaagcagtatggcaaaggtactgtagctttgaagacactctacagtactgatcattcaaattatctcttttaaatgcaaatatttagcatttccaattaaggcataacattagaaggctagaagaacccactgggaaaactgtcagaaaagtatatccataatggcttttcaagctaacaatttttgaacacagagcatcctctgaactgttttagaatgttgatgaaatcaatcccatttaacaatgcttgccatgttgaactatgtgaattgttagtgtataaagattatagacaccataacagcctgggcaacatggcgaaaccccatctctacaaaaaaaaaatgcaaaaactagctgggcatggtggcacacacctgcagtcccagctacttgaggggctgaggagggaggattgcttgaacctaggaggcggaggttgcagtgagccaagatagcaccactgcactccagcctgggtgatggagcaagaccctgtctcaaaaacaaagatcatagacacgtgacttaccttgcatatgcaaatgccataggcatccatacaacagaaacttcgatggaaaatttcaccattcaagattttaattgaactgatggccaggcccttctccggtggaaaaaaaattagataaaattaaaaatgctttcatttggaggtaagctttaaaaaggggtggaagaaaagggggatcctcaagtttcaggaatgattagaaaattcacaaccagagaacttagcacatgatgacactgcattgaccacacagcctacagagctggaaataagacctacagttctgggaattggggttctaaaaatcacatgggagtgttccagctcttttagaatctgtctagcaggctttctggtttttacaggaaggcccctctcacacacacacacacatactcaaatggggccttgagcacaggaaaggagaggcaactataactgagcccacaaatgaagcctcttagagcctcctgtctgtttagagagagcagaagggacactagagaaatccaccagcagtcccgaggtaacagcagaaaaactgacatctctacagtctttggattaaaaaaaaataaaattcccatgaataattaaaatctcccatatgaatgtcccctgtgattaacaacatctccttcatgtggacatcctaaaccaaaaattaacataaaaaatgtgtttagggccaggcgcagtggctcacatctgtaatcccagcactttgggaggccaaggcaggaggatcactggaggtcaagagttcaaaaccagactgaccaacatggtgaaaccctgtctcgattaaaaatgcaaaaattagctgggcgtggtggtgcgctcctgtaatcccagctactcgggaggctgaggcaggagaatcgcttgaacccaggaggcggaggttgcggtgagctgagatggtgctatttgcactccatcctaggcaacgagagcaaaactccatctcaaacaccaccaccaccaacaacaacaacaacaaaaacgtgtttaggatcagtacagaagtggagtgacacttttcacaatacaggacacatgggactcacgcacatgcctgtgtacacacagactcttatcaaatcagcacacagcaaaaaattacaaaccatacaaggaaataagccaccatcagcacttggaactgtggataaacggtcaacaaaaccttttccactcctgcatgaatatatatttatgcattttaagatgaaataagatgcttaaagtagatctaaaacttttttttaattcctcacaacttctttaattaactgacctgattaaactgtcctgatatctttgataagaagacttctactaaagatattaatagctaagatttctgagtgcttatgctatatctggcatggttctcgtcgtgctccctatgttaatccatttaatcttcactatcaccctgtgaggcagttactgttatctgcatattatctctgaggctcagaaactaacttgttcacggtccttcagctagtaacataatgagaatactaatccaggtagaacagtacaattccaatcaaaatcccatgcttcttttttgttttctgacttatcaaattgatctaaacacaaatgagagatgaaaggaccaaatattttcaagataatttgaagaagaataaagatacatgctttattccctcccagaaataaaaatttattataaatctataactacattgaacaatgtttcagatgagagagcacagagatttgccatgtagagaaacttagaatataacagggaaggcattaacaattagtgtaggaaggatgggcgcgatagctcacacctgtaatcccagcactttggggggccgaggtggtcgaatcacttgggcccaggagttcaagaccagcctggccaacatgatgaaaccccacctctactaaaaatacaaaattaaccgggcatggtggtacatgtatgtaatcccagctacttgggaggctgaggcacaagaatcgcttgaacccaggaggcagagtttgcagtgagccgagatcataccactccactccagcctgggtgacagagcgaaactctgtctcaaaaaaaaaaaaaaaaaaaaagtagtgtaggaaagatcaactttttagtaagtgatacttgaataattgctaattgctgacccctgggactgacataaatatctaacttataccatacatctacacacacaatgaattccagatggattttgtaggacaatgttaaaaatacgacctcaaaacttttaaatcaggagttgacaaattacagctcacagaccaaatgtggcccatcacccaattttaataaatcaagtattcttggagcacagtcacacctgtcagtgtgtccattgtccaaagctgctttcccacagttgagtagttgcaacagacatgtgacccacaacgcctaaactatttactctctggctgtttgctgaaagtttgctcattcctgctttagatgaaaatataggacaatatctttctgacatcaagatagaaaagaatctcttaaataagactcataaaaggtgaataaattaaaccgcatgaaaatttaaatgaactagagctatatctgaaagccacagacaaatcgcagaaacaccatagtgagtgggaaaaaagcaagttgtgaaaggatcctgcagtgtcatacgtctgtgcacattttatgcctatattgtaaaaatattttaagagatgaaagcttacaacccaacttggaagaatcattgtttctgggtagagagggagggaagtgggttggggaggagtagggtagtggcagtgagggtggcgggctttaactgtatttgcctgttttatttatttatttttaataattggaaaccaatatggcagaatgatgtttgttgaatctcagtggcagatgctaattatactattctccattctttcttgtaggtttaaaatagttcataataaagattttaattaaaaatgtgatcttggtcgggcacagtggctcacgcctgtaattgcagcactttgggaggccaaggcaggtggatcacttgaggtcaggagttcaagaccagcctggccaacatggtgaaaccccatctctactaagaatacaaaaattagccgggcatggtggtgagcacctgtaatctcagctacttgggaggctgaggcaggagaatcacgtgaacccaggaggcagaggttgcagtgagctaagatcacgccactgcactccagcttgggcaacaagagtgaaactctgtctcaaaaataaataaataaaaatgtgatcttcatcattcaagcaccttctctgttccaggcatttctgtagcccaggggctggcaaattctgacccacaggccaaatctgacctgcaacctgtgtctgtacagcctatgaggcaagaatgatttttatgctttttaaaggttggaaaaatcaaaagaaggttaatattccaaataatcatgtaaatgttcgataagattcaagtttcagtgcccatcaataaagctttattgaaacacaaccacactcattcgttttacatattatctggctgccttcacatggcaacggcacaggtgaacggttgccacagagaccttgtagctcacaacgctgaaaatattaactatccgccctttacagaaaaagtttgctaacccctgcactaggccctgaatacatgcaaagcctctgttcctaacgtgctggtggagggacacaatgacaaacaccatagacacagcagcagtgtcacacattgctgcttatgtgtatgacccaatgcaggaaaaggcaaggacgattttcttctgtggattgtacattctactttttatagcttcaataaaaatggctaaataattgtggagctctcccaatgaggcaggagtaatgtctggattgtaatatttttactatgttcttcttcccagaattatatcactgattcagcccattggctagaaatattcagaatgtgaaattttatcacataaaagtttttgccatgagaaaaatcaatccatcctgcaaaaattataataggaatttaaataacagcataactttgcagatgattattttaatgtcatttgtgttttaagttctgtttgacgtaaaatattaacattgtgccctggtaccatttgttttgacgatggaagattttcagactttggaataagccatgcccaataaacctaagcacaagttctgaaaataaacaggaaggatgagtgtcctttatcaatgaagagagcaaatgacacagaaaagggagcatttgtggcccactgtgtcgtgctgcagaaatctcaggaaacactctcaacggcctcacagcgcatggacacggtagaagagaacggtttcctggaaagtagtaagttcacttagaagaatgttattcagaaagcaactgttccacattcttaactgagacccgcattcagatggccagttctatccagcggggagcctgcagctgacgttcatgaggatggctcagggtcatgggaacaccatcattgggtttgcatttgctccgtttggcaatgcgcagaaatgtgtcatttcctcaaccgccgacagtgtactggaagatcagtcaccaggactgggttccagtctgcggtcctttcgtgatacttaggcatcttagagaacggtaagagcagcttcatttggcaatgctcagaaatgtgtcatttcctcaaccaccgacagtgtactggaagatcagtcaccaggactgggttccaggctgcagtcctttcatgatacttatgcatcttaaagaaccataagagcagcttccaagtctgtcaaatgccaatatggcaatgtgtacgctgcttacatccacagttcccaaactgtgtgccaaagtgctatggggtgccaagctgaaggcacaaggcaccacagattatattttttaaattttcaagagaaacacaggatctacaacttctgtcagatatttcacaaactactagctagaagtagttcattgtttcaacattagatcctgttacattttgatgataccatatcttaccaaagctgggtttttcagcaattactgggataagaaaagcaaacactccctgaaagtcgatgtgaacaggaaatgaggtgatcaactgagcagctgtatagtgccccacaggcacatagtcccagcagtatgtaactgcaattacttaagaataaagtaaatgtatttttttctttcaatttatgtgttatttttttcaaacagctacgaagtcatttgcacataagttgttgggatccaactacttaataaaaagaaccattagcaatgccttttggcctgaagcactataaaaaatttactgagatgctaaggccaccaggaaccaagaaagtttgggaatccctggcttacatgaaaacagttgttgtgacacaacacattaaaagttcttcataaaatgggtcactttataaattacataagaagtaaatttacaaagttctgccacttaacaattttagaaatctcaataatcagtccttatcttctaaaagaaccaaatagctggaattccaggagaccagtaggcagaccacagacagaacaggcttatcggcaaattgattgaaatcaactaggttggcaaagcatgcaactgacacagctctgaaagatcccccaaccactccaaccttgtgaggtttcaccttcgctttacagagaaggaaaccaaagtcctatggggttagatgcaggtttagggtccctaagtgacagagcagaactccaacccagttctttgaacctggctccaccagcccttcctctaagacgtactgacaggaaatcataaataaccaccttgaaaccttcgtcacacagtgtcggtgggatgttacaccgtctccataaccactcagtcctgagtctctttgaagcccttttcttcgatatgcaggtaaggagtgtgaagcttttgcattggtagcctgtcactttttgttatcctattgttcctatgttttagcagctgatcaatcacagcgtggattaaggcattagttgcaaactgaagtcaaccatactctggagtcaagcgctgctagagtcaaatcccagcacagccacataatacctcttagtccttaaggagttaaagtaacttctcaactcctcactttttgaatatttgaaatggggatagtactttctttgagggactgctgaggattaacagagagaatctaggacttgggtacaaaactctgatcggtggaattgggatctctggtcacccacataaatatcaactgaccaggccagaaaggcttcaactgagtccactgttggggatcagacattatgggcattctggatacactgggggaccctggtggaagcctgactgttaaaaggacaaaacatcccagagagagatttactgtaaagggggaaggcatctggtagagccagccacagccagtaaagatgcctcaggtgagggagaacagctctgggtccaaaacttccattggtatcagacttagactggcccagctgtgcgtgagagctgtccacaaagagagctgtccctcggaagcttgcagctctatgattccagaagcctcgctgcggacacaaagctgggtggaacatgctgggctcactgttttttgcactttgccagaatggcctggagttaccaggctatttggcccaggtttcgctttgaccaatagtaggcacaatgagctccaaactggttatctttggtcttctgacctaacatctagagtctgtgataattttatgaaggactcagttatttactttccctatcacatctacacacacggggagagagaactggatgaactaataaaaaatcttaaagtgacaagttctattactatgtggtagaaagcaagaacgtattccaatatacaaaactattttggaccaaaatatgtatttgcatatttcaggcaaatgtacaagtgacttgctaaaataaaacaatagcttatctctagttaaaattcaatcgcacttgcatcctcattaaaacattcgcattgtaaaatgtccaacatgagatactgttatcagtatctctattgtgcccagctcttcagggaagattttcagcaaacagccattaaaaatctaatttcgctgaatagaatatagattaacggccagttcattctataaatattgcttctaaaaacagaagttttgctggtaacagaaaaaaataaaatccaaacagcagtaccaattactacagcagcatttttagtagtttggcaatcagtatgaaccattgtaaaaagcaaaatcaagcattcaagcatgtggctgccaaagagccagatcacctgaattacagtcacagcaaatttaatttatgaacaataacatactcaatgcattgcgtagaaaataaaattcatgacaaattttcatataactgagcagtgctatgagcgttgaaaataggatttccaaaactaaaagtaaccctgtaaggcaaatattaccaactccatttcagaggtgagacatctaagacttagaaaagttcacaaaccacaaacataatatatggcgcagggaagagtcaatgccagattgtttttactatactctacatttccaaaaaaaaagaaaattaagagctaagtttcctgggtattttttttttctttactttaaaggaaagacgttacttttactttaaagacatttcatttactttaaagacatttcatttactttaaaggaaagacagtttgagctgggtgaatcttagcatacattcagaaacaagtaactacatagagtatcaagcccccaaatcattagtctttgtttcagccacccttcataactgttgagttttaaattccttttttttttaaaccatcattctcagcaaactatcacaaggacaaaaaaccaaacaccgcatgttctcactcatagatgggaattgaacaatgagaacacatggacacaggaaggggaatatcacactccggggcctgttgtggggtgggggggagcggggagggatagcattaggagatatacctaatgctaaatgacgagttaatgggtgcagcacaccaacatggcacatgtatacatatgcaacaaacctgcacattgtgcacatgtaccctaaaacttaaagtgtaataataattaaaaaatttaaaaaaataataataataaaataaaaaataaaaataaataaattcctaatcatgcgtgctaattgaaggacatcatggcacagacaagcaagttaggagtaaggcaaaagtaattttgtttggcactgagcagagtttgagatttacatctgaagataagcatctaaaaattcaagatccatcagaaaaaaacatgaaacacaaaaagatggaatgttcgtttctcaagtcacccagcctttctgaagtcctctaccattgggaacaagtgagagtagctccaagcccagtctcctggccttaactccatcctccttcccaccctgtttctggactctcctacaggacgtttttattaacagggtcataatttcctgggacaaggaggtagctctgtatgccccaaagactttcttgcagttcttctggagctagacagggttgtcttgaggctacagaatgaggcaaagaacagagctatgaacccgggcataagagactgggctccagccctgcctcctctgcagactggacagtgactctgaattgcatcttcctcatataaaatctaaaagaccagtgcccactttcctcatggctggttagagaaatcaaaagtacagtgcaatatgatattaggtgattattttaaagttgtattaatatttacctcccattaaccaagatacagtcacttgaagtctaacattctgtatgtatagttgcttttatttgctaggattaggaactaatctacgaagactttatctactaggattagcagtaacatttatcaccaaagtttcattcttagaagggtaaatgggaatttacaataacgacatagtcaaggcagggaagctggtgacacctccccacccccactcaatgatgcatttttcaagtcgtccaaagggtttagaattgttctgtagaggccgggcgtggtggctcatacctgtaatcccagcactttgggaggccgaggcaggcggatcgcctgaggtcaggagtttgagaccagcctgaccaacatggagaaaccccatgtctactaaaaatacaaaattagccaggcgtggtggcacatgcctgtaatcccagctactcgggaagctgaggcagaagaatcgtttgaaccttggaggctgaggttgtggtgagccaagactgcacctttgcatcccagcctgagccacaagagcaaaactccgtcttaaaaaaaaaaaaaaaaggccgggcgcggtggttcacgcctgtaatcccagcaccttgggaggccgaggcgggtggatcacgaggtcaggagatcgagaccatcctggctaacatggtgaaaccctatctctactaaaaatacaaaaaaaaattagccggaagtggtggtgggcacctgtagccccagctactcgggaggctgaggcaggagaatggtgtgaacccaggaggcagagcttgcagtgagcagagaccgtgccactgcactctagcctgggcaacaaagcaagactctgtctcaaacaaaaaaaaagaactgttttgtagaggacaaagtgtcacatttctgtagtggtcatcccttcactaggagactagcggcaaaaaaaaaaaatctgtctaaagctattgcaaagcaagcagccacaagaagtgagggtagctaggatccagctaagagtctgggtttctgagggtctaattccccaggtagacatggacctgcatgtaggaatctgaatgataaggccagcgtggcatggaatgctttatcaaagtttaaaagtgaaggaaccccttttactggaaaacaagtttcacaaacacccaatgttaacctccattaaagttgttacccaaatagatacaagtatatttttattaaaaactgcaaaactgataaacttaaattaatataatgtggtagaaaatattattttgctgcagctagttggttgctcataggtgaccatgctcatgaagtttctctggagtgtgcccactgatgctactaccacggaccaccacgggctatggggccaccatgggccgtgtgatgtggaatcctcccacatcctctcctcattcaacccaccttgaaacttttgtcctatggttccatgtgactttgggccttcacttggagcaaatacatcatttacttattactgattttttttttctcattggccaactctatgatcaacccaaacaggccttgtatctcagagtggtactcaatcataaagtggtcacttctgatctagggtgatgataacaagagagcacacgaacattacacgttttctcagccaactcacagacctccctgagaatacacccacagacagtgtgtatgtccctccttcctctttctgtccccagaaacattgctgtagaagaacactaactggggaatcaagagaacaatggcactctctatccacttgtggtcatcatctccactctctgggtgtcacgggtgaagtgagggagctgtctcagatctagatcatgtctagggcccttggcagatccaccttctataatgccattaatctctaataccctggggtgatgccaggaccatctctgggcaaaaggctcacataggctaagtgagcattcctaatgtatcttaaatcatggtgtttatctggacacgtggcttgtcctggtctctggactgaggcctttggcatgcttatgcagatgggagggtctgctacaggttgctctggccatgctgtgacaacgtgccctggaaaggtcctgaatatggctaattttggcagacaccagagcgcatccactgaagaagaaccgaaagatgaaaagccgggatttcaaccttgcattgatttcaaaacatgcaaaatgaattcaataaataggaaatcatttatgacacttgattttatttatcaaaacttaacattagctctacaatgagtaaaaatcaggatggagagtatggtaactaaaataagaaaaaaagagctccctttcttgattccataacagtaaatgtacattccagaacagagattatgacatggttatatttccagtatttagatccaatttattcaaataattgcaacctaattgtgtggagctattttaaatactgatttgctttgcttcccatttaaattaaaacctcatcacctgtgactattataccaaatatgttccttataatttagacaatgaaatattaattataattttgaaaattagctttgcttagatacaactgttctcaataacttttagtcttctgaaaaaggctcttaaagactgatccactaaacacattggttgtatccttttctatttcaattttctaacacacaaaaaaaaagtttatattttttgctgatattgtaagtcatttatttccatacttcataaagaagacaaaggaaaaatagtttttttgttataagcatgaaaagagtcccaggtcagaaattcaggctgggcatggtagctctcgcctataatccctgcactttgggaggccaacacaggaggatcacttgagcccaggagttcaaggccagcctgagcaacatggcaaaccccatctctaccaaaatacaaaaattagctcggtgtggtggcacacacctgtggtcccagctacttaggaggctgtggtgggaggatcgcttgagcccaggaggtcaaaactgcagtgagccaacatcatgtcactgattatatgattgcactccaatctgggcgactgagtgaacactgtctcaaaaaacaaaaaagaaaagaaatgtagtcccctgatctttgaaaagtcacatgacccctgggcttttgttgctacatccatccaatggagataaccccccttttcctgcaagaggcaggagctgtgcccaatggccttcagagcctgccagccctatattctcatagatacataatgtaggcaatagagcataatggctgtttttttaatcacaggtactactggccaggaaatagtgaatccaaaattcccgtaagagtctggaggtaggtggaaatacatagtgttattacacaaaaagcttcatgctgtgaaggccccacaggagaagacactgtcagtctagaaaggggatgacaacaggccaacaccattcgtttgaataagagttcttcccaattcctccctgtgaaaaatatagtcaggaaaaatggaaccgcactacatgtttttttattatgctttatactatgtggctccagaaggtgggctccataattctcaactcaaactcatgtcttcatgaaggcctatttccaagggcctctcacgcagcatgtgatgtagctcgccacgcatcagcctcgcaaagctggtgccccggacgcacagcccaccccagtgaattctgccttaacaaggcttagttcttccaccagggcaccaagtctcagctgccgtccaaattgttatgttgcacatttcatactctatttgtgagtagactaaagtcaataaaattagtaaattggctgaatttaataatttttaggtatgccaattcagtaactgttatataagctaaataaaatgatattcctctttttaaatttcctcgcttttattttaatgtctcttaaagtggcctcatgactcaatcaaaattttacatagctgaacacacagtggcttatgtctgtaatccctttgggaggctaagggaggagaatcactagaagccaggagttctagaccaggctgagcaatatagcgagactccctctacacccactcctgctgcccatctctacaaaaaattttaaaattagctgggcacaatgactatacatgtaattctagctactcaagaggctgaagatcgcttgagccaaggagttcgaggtcacattgtgtcactgcattccagcctgggggacaaagtgaaaccctgtctctaaaaaaatttatacacacacacacacacacacacatacacacacacataaaataatttacttacctagcatatgccactgaacaaagctaaaatatcctaaagtaggtaaaatttattgaataattatgcactgtatgcctggagaaggcctatggttaggatattttattttcattttgaacacgttatctaacaaaattatctagttgcatagcccaaataaattagaagctacacattagaaagaaaagtttttactaaaaaccagctcagtgatgtaagtgcagagagacatctggcttggaaagaagcaggaaaaatatatgaaagggagcaacatggagtcaagaagttggccactggaggccactggatggagttgggggtgagacggcaatgtcctagggcttctgttcagttactgcctgattctaaattaatgcccaagataatgcccttcagttacaacagagagggtaaattatattctgtgtgctctgctggtacgtatagtgtactgagggaccatttcttaaaaatgactgcaaagaataatatcagaatttaaagaataaacttcaggtatctgggaaactcatttaaagtaatttatcaaatgctaggtaaaggagctggtactatattttaaataattaaataatagtgaatataaacttactacattaaataatagtgaatataaacttactacagtgatttctagttggataatgtttacatctattatttcgtctctcaccccacgggtcattctccacctgcactactattccatcctcacctttgtttttgaacaaggaaaagccttgtgaaatcaagcaattaagtattcttttattattatgaagctgagaggaagtgaaaaatcaccagggtgaagtttcttcgcacttgagaaagcagattgatgaagctaacatgggatgcacgggaagtttgttcagaaccaaagcgactcggatgggcaccctctcagcctgtgggtgtcgcggaagaacgggatcaccctcccctcctgggccggaatgtgatatgaagagagcatcgctcccgagagacacaatggatagaaataataatggaaaggaaataaattcagaaagcaattaaggaactgtcaacagaaagggctgagcaaaaccagatatcaaaattaccatttaatcttttttcatgtatctttttggctcaaattactttcatatcagagttataattatggatatcaccacaagccattagcctcacagttggcactctccttacccccaacaaattaaatgtcagccatcgggcttcagccatcatcactccttcaagaagggctcctgtcaatcacctcactgcgtgtgatgagatgagccgcagcctcgaggcagaagcagccctctgcggtttggggtgctcggtagctcctgcagacacaaacgttctcttttgctttcctgatagagttccctgcaaatcctcagagaaacaccaaccccacactgggatggggcgtcagtcccttgagaagtgttatgggctgaattgcatccccccaaaatccatatattgaagtcccatccctcggtatgtcagaatgtcactgtatttgaagacaaagtctttaaggggtgatgagatgaaaaagaggccattagggtggggtcctggtccaacaggactactgcccttaaaaggaggagtcacaccagggatgcccatgccaggaggagaggccgtatgaggacacagtgaaaaggcagttgtttgcaagccaaggagaaaggcctcaggagaaaccaaacctgctgacacctaatctcagactcccaggctccagcactgtgagaaaataaatatctgctgtttaagccacccggtctgcggtgctttgttatgacgccttagctaactcatacaagaagtttctgcgtgtttccaagagtaaacaagtccttaaggacatcattactaagtgctcttactaagggttttaacactgcagatattaaaacaaaacaaaagtgataaataataactacatgagtacgcctaccatcagaaattactgcaatgacttcctgtttccccacagtttctcattgccctattttgatcattcctacataccgttgtcaaagtagaatcttcctaaagcacagcgttgaaaattgtattcacctgctgagaaaagtccactggattctcattgacgaccaaatgaaagtgtcatatgaggccctggagaggctggccccgatgctacttcccagccatgcccactgcaatacttcccacacttcccacctgctcccagccctgcccaccacaatactccccacacttcccacctgctcccaacaggaggatctgaggccacctggatgcacctggcctcaccctcactccttgccctttggttttttttttaacctggaaccatgggcctcttgagctcagaaagccttcccagccatgcctactacaatatttcccacacttcccacatgctcccaacaggatgatctggggccacctggatgcacctggcctgaccctcactccttgccctttgtttggtttttcttacttgggccttttgagctcagaaggctcccaaggggtctcagaatctattgaaattgcatataaaagggccgggcgcagtggctcacgcctgtaatcccagcactttgggaggccgaggcgggcggatcatgaggtcaggaaatcgagaccaacctagctaacactgtgaaaccccgtctctactaaaaataaaaaaaaattagctgggcatggtggcaggtgcctgtagtcccagctactcgggaggctgaggcaggagaatggtgtgaacccaggaggcggagcttgcagtgagccgagatcgcgccgctgccctccagcctgggcgacagagcgagactccgtctcaaaaaaacaaacaaacaaacaaaaaaaagaaattgcatataaataattactcctctctatacctgacctctttccagaaagagggctataattctcatcagattttcaaagagcttgacagcattgagttttacctgagccctgtacacctggaaaatagtgatggttgtgaaattgccatccctttgtattccaggaaacaacttactgcaaagaaccacccttccccatatgacttagataagactcaccaatgacccctttgacccccaaaggccagacacaaaaccctcaaattctcataaatgaatagctgaagctttgtccccattgacccatctgagcaagatacctgctaatgtgacttaaccaagcttgagtcttttctgccctgcgggtctttgaacttgatcccccctcagcctgagtcagcacgggaatgcagagtaacctccttaggagccacggactgtgttacaagctgaatcgtgtacccccaaaagaagatttgttgatgttgtaatccccagtacctcagaatgtggatttttttggaaacagggtctttgtggacatagttagatatgatgaggtcatactaattagtgtgggtcatggatgcctgcatgactggcttccttataagaagagaagaagagacagagacacagaagctggagacagacaagggagtgatccatccatgagccaaagaatgccaagaattgcaggcaacaccagaagccaggagagaggcttggaacagattcctccaaaaggaaacaatcttgccaacatgttgatttcagactcctggcctccaaaactgtgagagaataaattactgttgtttaagccactgagtttgtggcactttgcacagaggccccaggaatctactacaaccaaggaaagacatctggtcaaccgttggtttgtgccacctgctcatccttactcctccaccctaggtctttccagcatgtttaatcctccctacaaaagaaagttcctttctgcctgacctttgagactctcgcagacctcatggtgggagcattctccctattgcgcaatagtcccctcctctaattgtaaaagctccccctcgccctacgacaatcaccgctttcgatgaagtctctccttacctaagcccgggctgtttttttctttgacaagctctatggtccataagtggttaagaaccagtgctcctcatgagctaatctccacccaccttctttgcaacttaccttagcttccgccatgctgcctggccatttcccctcaaatccttgcctgctccccctcccatcagcaggaaggagcctttccaagtctaccattggtaaagggatagtgtgtgttccccacccccatacctacttgttttccaagatccctgcccccagcccaggcagccgggcatgagctacttgtccttaggggaggcctgctactgggagcccgagaaggcaggcacagaatcctggcatttgagtttcaaaaccacaataaggaagaagacagaaattgttggacaagtccttgatcgctactgcagactacagaaagactccatgggctgaggctgggaggtgggcacagagctgctgtcattggagtgagcactgttgtcaccagcatcaggtgagtggggacctatggatatctggtcccactgcagtgggtgctgccttagggcattgcttcccatcccagagccaaggaacccccagctccttccacctctgcttctctccctgctgcacacattcctctctaagaatcacatgcttcaatgcttaaaggaaagtcctaaacagatgtcccatattatccatgaactgggacaatcaggcctcacgtgaataaccaacagccatggtggggcttcacggaatcacagaggtcctgggttggaatggactttaaaagtcttaaaatccagctccccagccaccccagctgcttcacaaaaatttttcagacagtgtttataaaagtctcttgagcaagtgaaagaatttgttgcagacacaacagaaagctggggtcagctagttgttcctcctgagcacctgctaaagagatgcatcaggaaaatgaaacagcagggaaggcaggtaagaatataacaaaaggaaaacacaactctaagttaaaagtgaagttaagaaagagaaaaaagcaggaagatggagtaagccacgagaaaacttaaaggttcctaaatcctatgctagcagctcaaatctctcattaacagacaggaaatattctgcagcaagacacctactagaaaaatactaaaggaacctaaaagtccgttcttcaacattttacccattttctcttccttgcactaaaaagtaaaaaggtgagtctctggaacaatataataaactaaaaaaaaaatagttaaataatggctttaagagactttccaaacttttctccaaaaccagaaatacactaatgttttcctacctccagcaaattaacagggcataaaatagttcctgtcttaaatagtacttaaatagtagcgtgtcctgatttcaacaagatcaggtacgtttgcctgcatgcaatcagcagttttcaccaatgctaaaataacccgaaatcgtttttctctctgcattttttagactatgacattccaccctcactcccaggcagtcttgacagagccagagttgagctacataacacctttgtatttgtgtacatttctggaggctacacaaattatcatttcaaatcatccctcttaattttcctgctgaggttagctcaatggactctgggactccaatttctattacttcttttttagtcaatttcctcagatttcaaatatgtaagcaaaatctcctaaagtatttctacatgagggtgagaaattcgctattatttcattttactctttatattatttcattttattattttgttttattatatattgaagataaatatgagaagattttataggatgatggtatttctttaaaataaacccctaagcccaaggctaaatagaaattgcgatcaaatcaaggaaaatcacataaagcaaattcagaaaaatctgcttcctcagtgtagctctcttgtattttacaatgtagctctcttgtattttattttcatggaaaatcaccgggggctgggaggggtggcaggaggaagctctccctcttcccagttgttcttctttccatctaatcccacactttcccttctgacacctgcttcccgattccactcccttactgccaccttctcacatccttaccaacatctactgacacctcccccatcaacccagcctcctccactgctcaggtgaacaaagctgtcatggccagaatggagcatgaaggcccggtcaccgagtcatatcaaaggccagaaaacaagggagacggaggggagcgggctcaagggccagaggaaagctccacttctgcctaggtaggatttaagctctagaaccaacaaagagcctcttatcaaaagcttacagattatataagttgggcacattatcaataggaaacataattatggaagaaatgaatgtgagtttgaatgaagaggagagcataggggtagggcaggaaagttgtcctaagtattggaaaccacttaccgtgagccttggtagcaggaatgcaataggtggcattgaaggacagcaaaaaggtccagtttggctagactggagggagagttgaaagagttcacaggtatggaaaggccagaaggactgtctactatgcaactttgtttttgttgtttttgttgttgttgttgttgtttgttttttgttttttttttgagatggagtctcgctcttttgcccaggccggactgcagtggcgctatctcggctcactgcaagctccgcctcccgggttcacgccattctcctgcctcagcctcctgagtagctgggattacaggcacccacaacagtgcctggctaattttttgtatttttagtagagacggggtttcaccgtgttagccaagatggtcgcgatctcccgacctcgtgatccgcctgcctcggcctcccaaagtgctgggattacaggcgtgagccaccgtgcccggcctactatgcaacttcaatgacataggttggagtagaagtttcttttgcatccaaaggctaagggggaaatattgagtgaaggaggaacgcaatccgctgttcaaaccattacatgcaactccgaacaactcatcagaaactaggatgtatctcatgatctaagaaaaatttgtacagactaatttttctttaattttagaaataggaaagatagacaaagcacaaatttagcagtttctcccatgtgcttatacaaccattattcaaacatattaccagaagtagttacagagaatcgggcaattacagagaatcaatgttcctttcattgtaagggcctaatgaaagggctggaacatgctgaaactataaaagaagcaacattttcctataccccatctgcctgtttgggaaataataccagcttttcccatataaagtaaattaataaatcaatacaaccaacaaaaaggcagcattggtaggagatattttaattgagtcatcctaaagtctggacttgtttaaagccttctcactttaaataaatatcaagtcatttaagttttgaaactgactttgaattcagtacatacaacatattgtccacacagtaaagaagagagcatgcagaaatgcctgtttgaaaataaaagaaatatccaactcaagtcacctttaaaaaaccaccagggcattttagagctgatgagaatgacagagatcatggggtcgaaccctgttatcaatcacgttggaaaactgaggtcaagggatgttaataactcaacccaagtctcagagcaggcaacacatttttcttttcactgaagtgcatggtcccaatgaatttatcagaatgtctctttgtatgcagtgtaaatctttatggtacctcaacttgtacttctagtccccttccaattagccaccagaaacaatatctagtgccagcctcagacaaagaccctgtgagatatccacacaaatgcttcactctctcaattctttcctcacaataagcacctacagatgcagactgcgaatatctgtaatttaataaacacacatcaccctgtattttataaatataactagttacaagatagaaaaggaaaatagctcaacaggtcacctaaaatcagatagttctgtttatttcacaactttagacataacagatttcaattaataaagacttttcctaatttttataaaagcttaaccacttggtacccaacctttctagacttctggtttagtgccagctccagaagaaaacaatttttaaatatttgaagcaactaaacaggtatttaccacctattaacaatgaacaaaaccaaggaaggaaataaagacacaaagattgcatcaatgaaaccatgatcaggatgccatgtggaagaaagagaggtctgattaacaagcgaagccttatagatggcaatttgtttgctgaaaaaacaagactcccagtaaaaacaagctgtgaccagcaagtttactgtaagcagcaagttgtaagtgtgactagggaaggagagagtccctcacaagcaggaaatgagagaagagctaggaaccccaggcaagttggaggtaataaagggattaggcagtgaaattgcatctatagccccaggggcactgcagtggtgagaggcagcaggcggtattttccaacatggcgcaacaatggttcccaccacacatcctcttctgctgagtgacattgccactttccaatcaggaggtagagtccttttctcccctctcttacacatgggcaggcctgtggctgctctgaccaatagagcagggtagaccatcatgccaggtccaggaaggccctcgcctggtccagtagctactacttcctgcctcttggaagacagctactgtgttggaactgaggctatccaaaaaccaccatgctgggagaagcctacaccacatggagatgccctgaagcatgagacaccgaggtgagcggcagaggaggggaaatagatcaaacagtaccagggcaccagctgtaggaaggaggaagtcatcaaagtcatatatccacagtttcaggcactcctgctggtgtctcatgcaccagagacaaattcctcaacagagccctttccgaatgtccaacccataaaattgtgagcaaaataaaatggcagtttcagacaactaagttttggggtaatttgttacacagaaatagacaccaaaaacacgggaacacggtagtaacaactaagtgttgcagagaggccattttcaactgattttgaacgactgggccttttgtccaaaagatatcttataagaaccccaaaatattcaacagaaataaccagagctgctctgacgcggtggacaagggtgtccagaatgtcaaggagctctgtggtggaatgaaggatgatcctagggccagtgcactgaccatggtaacgctacagagaggacctgcaatcctcacccaagaagtcatcactgcaacccagcttcctgaggcagtgtctaaatgtaagtcaacagctcgtaatcttaccctctgcagccagagggaacctagttctaacatcaagagttggaaccccggacatcaaaaaggtactacccctggtctagcctcttctttgtctcaggatctgaccactgacgtttccatcttgcagtgtgactgcttcccctaacatattttcaccctaatcttaacatgtgtttaaaaataccaacaccccctcaccctgctccttcctcttttcttcttctctccactcactgttttttgctctcagggaaaggagcaagaaaaagaaatgggacagtgttttgcctggtggttggctgattagactctgaatctcagctctgtagattgccataccaaatttgccaatttagtaactgtgcctctgttttccaagctgcaaattggctgcaatcatcatacaaaccctgctcattgaattgtaagactgaaatgaattcatatgtgatagtcagcactcaataaatgttaggtcatcattatttttctaactaaaccttaatgctttccaatattctagtaaggaggaatttatagataatgcctgagatgcaccataaagaacaaaactcttacatatgattagacttatataggtctctttacattttactaaggaggacttacttaggtggctcaacagcactgtagtcactatgtggagacctcattgggcagaaatggtaacgagagctttctgaattgttgcccccatttgaatcagccaagttagcaactccagggtgccagtttgagtgagtcagcccttaaaagacccttgagcaatacatggagtcaagtgtctcagacaggcagtcagctgtggggcttccagtcatcccaaaatgaaaatgttcttattacgaagacttggaaaatggcaaacaaaagaaatcacaattttgattcatttaccctgtatcaaagcattcacgtttgaaaagtcttcgctgggcattctgggacagcacccagaaatgcagtgaggtggcattctgaatatttgtccctctgtgaccgcatctgtaggtgactttatctttgatagatggatctttaaaacaacatttattgtggttgcttcttgatcatatgcagtaacttgggcattttcagaaagggtgaccaagaagcatccaacacaatattagaaggttattatgactggcagaaaatatgtctcaaattaggagcacacagaatgtgtgcctcttttagcaatctcatctataggcacaatctattatccctaatcattttccaatgtttttgttggcagtttatctatcttctattttaatggataattacataaaaagcatgttaagcttcagcagaatttattcattcattcaacaccaactataaaaagagaccctagaagtgttatagactcacaaaaaataaaaccttctgggccaggaatggtggctcttgcctgtaatcccagcactttgggagactgagatgagaggatcaccggaggtcaggagtttgagaccagcctggccaacatggcaaaaccctgtctctactaaaaatacagaaattagccgggtatgctggcacatttctgtgatcccagctactcaggaggctgaggcaggagaattgcttgaacccggaaggcagaggttgcagtgagccgagatggtgtcactgcaccccagcctgggcgacagagtgagagactccatctcaaaataataataataataataataataataataataataataataaaatcttctggcagatgtttaaaatatgtctcatttacccatggcacagggatcgcaagctaatatatatatttggacagaggctttttattgacagcatctcattttcttttttaaaagaaaaatcaactttttagattcagagggtacatgtgcaggtttgttacaaggacatatgcgatgctgaggtttggggtatgattgatcccatcacccaggtagtgagcatagtatccactaggtcatttttcaacccttgccccccttcctgcctccccactcttgtagtccccaatgtctatttttacatctttatgtccactgtacccagtatttagctcccacttataagtgagaacatgtggcatttggttttttgttcctgtgtcaattcacttaagataatggcctccagctgcatccatgttgctggaaaggacatgatttcattcttttttatggctgtgtagtattccatggtgtatgtgtaccatattttctttatccaatccaccactgatgggcacctgggttgattgcatgtctttgctatcacgaatagcactgtgacaaacatgagtatatgtgtctttttggtagaataatttattttcctttgggtatacacccagtaatgggcttgctgagtcaaatggtagttccacttttagggaaagcaccttattttattttcatacctgcagggaaaaaaaaaacatttaaagacattggctggcctggaaaagaccagctaacttacgcatggggcttgccccaggtgcaatgtttgtggctacaagtgtttcctgatcattttcctgtaccccagtgatttcttggagcagaggtttctttgaaagccatcatagagtccctagaagaactctcttctactctgagctcccctccagcttcttcttaaaatatagaaagaagatgtctggaggaagacacttcacattgctgatggagctttcttggggagtagaattagatcagaagaaagaaaatggaagacttcttactttatgtactcctgcatactgagcattattattttcataatttaaaaaatatatattttaaggattactgaaactttcagggctctgattttctcacctgaaaagtgacaaccccagaccatgaactaaatgatatgaagataacacttccagttcttaaattctgcaccagaaatgcctgctgcacagccagtcaccagtgcttccatctccacatcttcacgaaagagcaaaagaaaagacatggaagtaacttaattgctcagtgcctcagtttcctcatctgcaaaatggaaatcataacagcatctgcctcatagggttgtcttaagaattaaacgagctaacaaaagtaactggcacacggagctcaaatgtcagcgagaattatttccattatggtcactcttattactaattctatatcaaccaataaaatattcctgccagtatttttcctaacccaataaactctgcactacagaacttttagagctaatataaagtactcttgtcaaaatatagcgctgtgaatgtctctttaattaaaacttcagcagcaaaggcagtgccattgaacagaagataccacttttagctgataaggatgagaagtcaaacattgtatcacttcaataccagccaaaatattattaaagaaagcattccaatatcctaaggattctggaaacactgcttctaagaagcctgcaaattcaaagttactcatgtttttaattaacatattacaaaacattgagtaggagactctgacacattcaatctaaagctaaataaacactaactataatatagcgcttgcatactaagaaactcagcagctcacaaagcacatctttgtgactaaatggagcatcttaagaactcaatttcacaaacatttactaaggcttgtctccttaataaagcactaactggtacacaaatatctatgcttccaaaatcaagatgcagatttcattcatttacaatcaaagttcaggcaggaatttttgtgcaggatgggaggctggagcaactcaccaaataattataaatgtcatgtaccaaggagaggataagaacataaagaaagttctgaaagaattacaaagcagtactatttagactgcagtgttaacataggtagtccagatcacaaaaatataaatatcagcccagagatgatattaattagtaaacaaactagtatttgccacaaagtgttaacatttttctcaactaaaacaataagaaaatattaggcccaaatcttcaaaggatctaaaaagataattcacaaaataaaagctctagagtgagcaaacatggggaaaagctcaagtttaccagtaactaaaaatgcaaactgaaaaaagatagccgctttccctactaaattagcaagaataaattaatgaataattattattgtatcaaatgtcagcaactgttctgtaaaactgatctcaacattacctatgatgttgtaaattggtacccttctttaggaaacctatgagacaataagtaaataagtgacataagtaatctttaatttcataagagaaaatctataagttcaaagctgaatgtcaaaaaatgtcttaatggtaaatttcaggacaactgaatgtatgacactagataatggttgagccagttctggtacaatgaccacgtggagtatggcaactgttaaaaaacagaagccccctctaaaacaatacagaaaatgtaaataatggtgtgttaaggaaagaagcaggatataaaatcattcacctatcacacttacaactttgttaaatattttgaatatctctagggaataaacaaaaattattggagttatatttgggtcatggatatttttctctttcttgctaaacataatggtgttatgccaccttatttttaaaaataaaaaatacattgtgggaactaaacaactaagatagtagaatttctttagaaaatctaaaatgaatccaaagtaatataaacaatgatttaagattttagcagacaaaaaattaaatcccaagtatgaaaggtgaaacaaagccacaatgtgaaatctagtcaggcaggctggaacagaaagcatagctccttgcaagcctgggtgagcatgcctgtccagcagcagcccgttcagggcctgttcccaagagctgggacatagtggacagcaggcgcccaaaccaccctgtttcccggcaccactgggtaagagcatccacatccaagagaggtgcgctccagccagaagtacatagagcagcgtctctgggcaaggcgtcctccctctagactccttctctgaaggttcttaacgcaggtcacagaagcactattttattcatgcaccttacagacagcctgaagccaagcacataggcaactggcttagaaaataggataccagaatatttatccaagtaaaaacactgtgaagactgagtttaagtagtaaattatgtaggctggcacccagcaggctgtgactttgtcctctcctaagggacaatgacacccatgcacagcctatggaaatgagaaagaaggcagcttaaggaggcagaagatgaaattaaatgtagaccatggttgtaactttcgttaaaaatattgaacaaatatgcatatagaataagcaaaaaaattataatagctatgtctgagttatggactttttccttctttccttccttccttccttccttccttctttccttcattcctttctccaagctttctctgaaatattatctcattctgtgaggaggaaattgagaggcagtgggtgaaatatcccaataaattccactgtactctcgccacactactgcagcatttctcacttaacaaatttgaggaaatgatttttctcatgcagttacattgtattgggaataattctgaaaatggtataattttacttctgaattctagaaacatatactcaaaaaagagaaaaacaaaagcattacattttgtaaggatgtaattacatccggaatttgcttttggagctattttgaacttataatgtaaggctcaaggagaaaccactttttcttaaaaaaaatagattggcatttagtgccatttcacagtctgggcagaattgggaactggggaattgcccgtcttttctgctctggtggctttacaaggctgccggcccaaaggagtctgtcatcaccatggcaacctggctcagcatcctctgcgagcgggaaggaggggctgcctcccttgtcaggttcacagcacccggccacttgtccccttctggcacctgaaatgccctttccccccaccaatggaaacccttcagggcccaacccaaatccttcttccgcgaggtcttttccttaacttttgagaacagcagtgaccctcttctttgaaccacatctaatgacagcttgactgtcagtttttcatctcaagctccagtgaggctggtagcagtgtctgtgttgacacaattccatgcaaggttgatattcagtccatttgttcaaggcaaccattccaattgttaacacagtgaaatacttccattcttccatgctgccctgagcacccctcccttcccctctccccatgcctgttccctggatgctctggctttttcctgggaactccttctgtctcctcggcagcaaccaaggggttcatgcctagtacagcaggagacctccagccctctggccagggtcagctctgactggtcaaacaataccacatgttaaatgttctgaccacggccctttctatggatgcactaaggtcccacaggaaaaaaaaaaaaaaaaaaaaaaaactcccatattgattagcaatgtctaccaagggtacaaagaggaagaggggccggcacactgtatgatactgatctgattagatgtctgcagcatttaggctggcacttcagtattgacacaagtctcaatgtctttattcctcacatgcaggaaaggcaactgaaggagggaagaggagcataaagggaagaggaagttagcccatagcataattggaatggttttgtattttttgtgagcagcctgcactgcacaatcaattgaatcaactgtcagttcagaaggagcctgatagtgatcattttacttcctattcacaatgtccataggagcaccatttcctaaatatgctgggaaataatcattatattaataacaacagcaaaaatagtattttgtacaacatttaccatgtactggtaacaaaagcaaaacaaatattttgtgtagtgtttgccatgtactgggcactgttctgtgcatgttataggtattaacttacttaatcctcaaaaaaactctgagggttattttatagaaaatatttttatattatatatattttttatattgttattttagttgacgttttacagagtaagaaactgaggtacaaaaaagttaagtaatttggccatggttacaaactcagaaaagacagaaccaggatttgaacccaggccatcttcttcagaggccacattctcccgtggcacaccgtaactcctccaaggcattgtttgctggtgcaaaccgtttgtaccagcatatcgtactcagcgttttcctgactgaagcaaaatgagaacagcttcccaacaaactcctgagctgcccaatgcacagttctcctcacatccaacagctgggctcagtccctcagaatccctgagtcagaagcacccctgtgctccctgccctggttgcaagccaagccagtggcacagaggtgccaagtcatagggaagatagtgttcaactggcacaaaaagtcctatctggaccaaggggtgaacagaaggcaccctcgagaagacaggatagatggggaaacaggaaatgctgaggagggaaagacagagtgcatgagagagtcccaaatctaggaaggacctggtgcaagtcctgcgtcttactgactaggtccagagagaggatggggcttgtccaaaagcgtagctcactaacaataagacttaactaaatttcaagttccttgaaatcatgagacttgaatcacaagacttgaaatgtccctaagtcatgttgcatcagtacagctaacaaggtatgaacttgttcccccaaaccagttttccccctctacttaggcacagctatagactacatttaccagactcctttgcagttgggtgtggtcacatgaatgagctaatcaatggaatgtaagaggaaggcacaggtaccagatccaggcctggccatacaaacctccctgactggctccttcttggtcattctccttcccactgaccagaatgaaacccctgtgtgatcttgaataaagttgcagagctttctttaatttgatccctgaaatgactgagtggaactgacactctccaaaaaataaaaataaaacaaaaatcagccatgatcacctggaactgccctggactaccactattcaagtgagaaacttctgtgaggaaccattacaggtttgggtccatctgttttctcacccatcccactctaactaaggaaaagttccagctgatcttccccaacccactcccatcccctcaacacacacacacatacttacatctgtcatcaatcatttaattcataaaatggtaatacaatatctacccaaccccatcagtttagaattgttgaatggggtatttaaagttacaaaacataacaagcttccattcattccattttgtttgacaattaactattagtttagtttgatattaaatatgctttagtctttactcttggtccatagtggtgtgctgaagttggttcattgccaattgcgaggcaattttcaggaattttgtgagctgttgttaagagcaaacattataaatgttaaagtaagcacttacattaaattatactaaaagcaaaggtaatgcatactcaaaacccatctcttcctaaatattttactgcagtttatcatccacactcttgaaattattggcatctattgtagccataggatggaaattctatgtaatggtgctctagcgtgtatctcttcccaactctgcattcagagacatcaccttggtagcttgaaatcagctgtatggggcatatttgcaatgtagaaattggcaaagactacaaatcaagtgcgttttttttctttttgctggagagtcagctgttaaatatttaccactgctctaaggaaaaagcagccttgaacatcatcctcttaattattttctacagacatggaggcatttggccatttgttaatatggaaataccatcatgttttatttgtaccttttacttaacttggtttatttcaaaaattaccaagttgctttaagaaaattatttaatattcctattaccatggaaataattggaatagatgccacataaaacatattagtggaaacttgaattcattatctgtgttctattcagagctaatgaggatttttcttccttaaattatgaacaatcctttaaaaccaaagctaatacgagagagggaaaaaattacagtggtttatatatcaattcttccccaactgatttatagatttcacgcaatcctagtcacaatcctagcaggcttttttatagagattgaaaaaatattttatagacagtctaaaatttatgtggaacctcataaagaacttaaaagaaccaaccattttttaaaagaatgagttaagaggacttaaactatctaatttcataattgcagtctagtacagattacctatagtaatcaaagcagtatagtattcacctaaaggcagacaaaatagatcagtagggaagagtccagaaatagacacaaatgcatgattttcagcaaaggtgccaaagcaatttatggggaaagaatactcttttcaacaaatggtgcgggacaactgaatacccgtatgaaaaacattcgcttggtgcacaaatctccttttcaacctgcacattttgacatgcagtgtgcctgagtggaagggcagaaagagagacctaaaaagggtatcttccctcactatatgaatttaattccaactagaagacacagggatattttctgttctaattatttaaataaattgatcaagtgcaggactcatttatctactgggacctgcaaaacctatagccaaaagtccaaaataaaaatattacttagaattatatcctttcactactaagacatatagtcatttatttgggacaaactacaaagcaatctacaaaactatatcggtaaaacccacctcacagattaagaaaataaattccaaagaaattaggttcctaatccaaaaacaccaaaagcctcaaggccaggtctccaggcttctgctctgctgcttgaatccaatgggtttctcaatgtctatgaccacctggactcacctgacgcagagcccctggggaattcctataaatgtgactccccagttttctgaatggcagtgtctgggagtgaggttaggtttataccctgaacactcccttcaggtgataccaacacacatctctatgaccataccatgtggactcaaagaaaagcatttagaaaccagacaaagctatgggaaaccagcttttagaaatgagaaaatagggttttttctcataagcaccaattattttagactgttttccctccaaccattttatttgtttgtttgtttttgagatggagtctcactctgtcacccaggttggagtgcagtggtgagatctcggctcactgcaaactccacctcccgggttcaagcgattctcctgcctcagcctcctgagtagctgggattacaggtgtccatcaccacgcctggctaacttttgtatttttagtaggacagggttttggcatgttggccaggctggtcttgaactcctgacttcaagtgatctgcccacctcggcctcccaaagtgctgggattacaggcatgagccaccactcccggcttcctccaaccattttaaatattttgaaatctcttcttgaaacactcaaggacattccacaaagaataaaaataatgattcctaaatgcattataaaactaagcttttgagggtttatatttgcatctggaaaaatagctaagagcaatgctcagataagactggggcttcagacccaatcctcacagacatcaagcagctggccaccaaaggactgggccaggaagtcaagataggagcaaaaatcggccaggatgcagcgaagaacccaagggcaggcccttgaatgatgatccagtgtcggactcaggagctcataggacttgcacattttcactgataaaataacccagaatgcaagctctggctttgtcctccaagggacaaccctccatttgaacttggatcttaattacaagcatatatttatgaaggagcccttgaagaaaaactgtactgagaaagggaaacatcagcagaagtccttctcccatagccccaaatactgatttcttttcacagcttacaggagtacttgtccttgctactgcaccactgaaattatagcaccttgaggaggctaatttaaagggttacaagacaaaacaaaaacaactataaaaggctaatatcagcccaagtgtgctttcgtgaagtaaagtcaacacaatttcagctctatcgtggcaggccttcgcctcctctgttctcagctctgatttgcatgtttcaggattacattacaatgcaatacttcccactcacgaagtcatagctttgttgaaaggattagtatagaaatgtgccaaattatttaaagatatctgaatagtgagcaaaacattatcatcagatgatacaggaggagaaaagtagctcagtacaacctgtaaaaaagctgtcacagaaatacctttctctctactcatgtggtatgaggagtttgcctatgtgagactattcaaaatatctgtgataattcctggaatcaaaaaatatttcaaatcagtttagctttactcaacttcttctcaatcatggtacaccaggaaagaaagagaaggatatcaaaacatgttctacgcgtctgaggttgacagtttctcagaacaatgtgtgcacaataaaattgaggcaacatcaggaagtaaatggcagagggttcactggagccatgaatggattgctggacagtgtgctgaggacctagcggaagttggagaccatgaatatacagcagcatcagtgtcatggatgggcagttttctctggcagaactccagggttttggatagaaaaggtcaacacctgaacaacactgagttgcggttcggctgagtaggtgcagcagaatgtccaaaggggtgagggagctgagagtatgggcaagagattggctcaatggagcacatggcttccactagcaagcaggaagagaaggtggaaaagagttgtcttgggtctggaaggggctaggtgggagaaaataaagccttaaaggccctagaggtcttgttgaagttgaaggacagatgcaggaggaataaatgagccaggagctggaggatgcatggtaatggtatggacaggacactgcaaacagaaatatcggaagtcaacagttctagggatcactttgtccaacacgcagtcgtgagcaaggctgactgaactggagtgggggtgaggttagaggcagctgaggggacacagccacagtgaggctggagagttggatggatctttaatagtatgttgcattgaaaccagtgtcaccaggacttagaggtggagaagaaaacaaaatcagacatgacagattttgaggaatgtggggatatgacagagtagagtttacggcaggaaaagctcccaaagagtacaattttttacacagatgcaaatgcaaaagaacaatagtttcaagttatattgggaatctagaagaattttccctccccccgccccacacacacacacttgctcacctagttaatttcataccccagatctgtgaccccagagactttttaaaacaaatgacctttctagacagggaagtagagaactacaatgttggtcctctgatccattagcaatattgcaaccttcatactgggaaaaatgaagcaggtagatatatgctaatgaatagacttccaagaaaagaaataaaaatcaaaaaggaaaaacatgaagacaaccctctgggacatttaaatttttcttttaaaggaagttgagaaataatataaaatcctgcatttcagtgaagaaagcaggttggtctcctctttacttctcagctccctctggtggaatactgatttttatggtatgccccgtgaaatcaaaagaccctagaggtctggccaaccttccacattccgagatataacattagggtgtcaggattggaaagagagagaaagtaatcagagaagggagaaacaaggaacacacctgtggaagaagcagcgagaaatagtgaagaaatatgattataaaagtctcacttgtatcacttttaatatttttattgcattaaacatagtctattaccttatattgaaatactgctaaattattaacttgtctttaaattgattttcctagtattgggaataaggtttcattcaaagggggaaagtacctaagacattttactgtagcttttagagaaatcactaatatttctctaaattctgctttttcaatcccaacaattattttcatttttacccgagaaacaattcacctgaggaaatgcactccttctctaataatgagaaagccactttgacagagtttgtacaaagttttgcaaagaggcatcaattccccctgcagtgacagacgcccgctgaaaatactatgggaaaaaaagcaaagtgaaatggtttagattggcctgttgggcataaacatcaaggtctgacaaggtcagtgactccagaagctacaacacatggcagaaaaacatgaccagggcagtctggctgacctctggctcctgaccagagaggaacaagagaagcccttccctgaagccaggtgagtcacggaagtggcagggccttgagtgagccactgcccttcctgtaaggagattgtgtaaaaagtgcccatatggctcctctgcagacagaacttttggacttcctcaacagatatttgcaataaaatccagcttctctctacatcacaccaaatcttctctagggtataaacatcccctataaatgcagagaaccaacaattgaacaaaatattccagtagtggcctgagtaggatccaatgtagtgagagcattactttcatattacttgaggccatggagggccagggaagcacatagaatatggaagcttaaaaaataatactaaggggtcaggcacagtggctcatgactgcaggcccagcactttgggaggcgggtggatcacttgttcgagaccaggctgggtggtctcgagagatggtgaaaccccatctctacaaaagcatacagaaattacccaggcatcatagcattcacctttactcccacctactcaggaggctgaggtgggaggatcccttgagcccgggaaatggaggttgcagtgaaccaagatcatgccactgcactccagcctgggtgagagagtgagcccctgtctcaaaaataataataataataaggaatttgaatagtgtagtggtctcaggaggtactacctatgtggtcttaggcaagttatatcctttatgggcctcagtttcccagtgaatactgtgatgacacctatcttaagctgtctgcctgaatcaaaggagatgtttgtgaaagaagtcttgtagtttggaaagcattacacacttagaattagcgcatggatttcattgattagcaggataatccctgcccagtcttgaactgggagaggaagctgcatagcagataggagcacaggccctgaaacaggtctgcctggtcttccatcccagctctgcaactttctagctgtcaaaccttgggtaggttacttaggctacctgtacctcagtttcctcactggtatcatggagatgatgatcatgatagtaacaatgcctacctggtagagttgccaggattaagtttaaatccgtggaaagtgcctaacagcccggaaaagaattgggcatcagtaaatgttgacttatgttatcacaatgcatggagcatcatttttgccatacttagccattttcttacattttatctctgtatcattttctttccttgtttatgctccaaagcagtcccttcattttgtgattttctttttaatttctcagagtcaattatcttcttaccttcccagatgatggttgcctaacgttgtctcaaagaaccttgaagggtaagaaccacgcaaatgcccctcatcaccacttcagtgctttgcaccaagcagacactcagcaaatgcctcattggcttgcacagctgtgactgttcatgatgcagactagtgaacacccagacaatgccagcccagggatcagccctgcacctgcccccaaatttcccaaatgtcatggatcactacacttttattaatttttaatttttaatttttgtgggtacctagtagttgtatatatttatgaggtacatgagatgttttgatacaggcatgcaatgtgtgataatcatatcgtggaaaatggggtatccatcccctcaagcatggtcactatactttgcttaaataccctccatccatcaagtatgatgactgtcttgctttctctttttttttttttttttttttttttttgagctggagtctcactgtgtctcccaggctggagtgcagtggtgtgatctcagctcactgcaacctccacctcccgggttcaagcaattctcctacctcagcctcctgtaatcccagctacgcggaaggcacctaccaccacgccaagctaattttcatatttttagtagagatggggttttgccatgttggccaagctggtctctacctcctgacctcaggtgatctgcccgcctcagcctcccaaagtgctgggatttttgaagagagtttatttttcagtattgtgttaagtatagatgctcccaaactcaagggtcacctgagagttacagctgcaggtttctaaggctctttcatcctgacaattaagagaagatgaatgcaccattccttagatcatcaggagtgactacagagatgtttatgctgaatttatggctctaatttttaaactgtaatgggtatttcaatcacaacactgcacaacccatcagctgtaaatattgctttatgaagtaaagatgagtaatcggtaactgttgacatctgcagggtgtttgttgacacaaatagagctaaatccagacccttaggatggcactagtccattgaatccaagttgaagaagccatggcattagtgcctttagtagaaaaaaaaaaatttaagagacaggatctcactccttcacccaggctggagtacagtggcatgatcaatctcctgggcccaagcaatcatcctgcctaagcttcctgagtagctaggactataggcacacaccaccacacccggttaaattttttttatttgtatttttttctaagaaattgggtcttgctatgttgctcaggctagtctcaaactcctagcctcaaaggatcctcctgcttcagccttccaaagtgctgggattgtagacatgcatctggcccaggaaaatttttaaagcattttgtattggatattgaacaagcaagaagtccagaatatttgctactaacgtagcaagtcatagttaataggtgaacaggatcaaacttatgctaaacaacattgtagatccctctcaatctgttcttctgggacaactgaagttcttatgagccctagaaataggccatgcattttgcccaaactgagttgcacgttcttttagctactgcaaatatgttcaccaatctgtcaatagtacctgaaatgtaggacgactgtaatttatccttcaaatcaggtcacctttagagcaaaaggggtgctattaataattacaaggagatgaaccaggaacatggtcaccctgtataaaagctggtggagaattaacgtcatctggcctgatggaacagttttactttgagcttctttcattcatccactcagtaaaatatttcctgaccttgtgccaagtcctgtgcaaggcactgaggagaaccgtgatgaaggagctgtcagtcctcactctgcagaggaagccatcaggagcattcctgagcccaggtgtcaagtgtaagcagagcagacacaaacaactatatgcacacagtcctgagagccacagttgggaaaagaggtctagttctccccaaggaaatcaaccagaaataagttgtctgggggaatctattccttcagccactttgccgggagaccaaggggtggatgaattccctgacaatgtggattctaatcttttttctgttgctgcctgaatctaacttttggcagctccctctctgtatttctctcctttccatgccttctatgaaagctgcaccaagtaaataaaaccagaggttatgcatccggtaatcctgtcccgagtgtgattattttccacttctaattttaaggcgtcattataagaagtggcaatgactaaacaagtcccaacaagcacagactagcatattgcttggattgccaagaaaaaaatgtgtaataaataataaaatcgccaaaaaacgatttggaaaagcattgtaaacacagatggcttgcaatgcaaaaatatataatgttgtatctgtttaatgcagaatcccaaacatcaaaactgataagtcaaacaaccataaatttgcatttgtattttgctgatgctgaccaagtacattatgcttgtgtatgcagttgtgcagttgacagaacttatggaggaaaaggcttgagccagccatctctgagttactaataggatgaactaaacttctgacagatgctcgttacacaacattacactcaggctctccacaggaataaaaatcaacaatataaaagcaaaagcaaccaaactctacaagtatttttgaccttgtgttattggcacaaccttctgacatccacttactgaatgcacactctgtgccaggcctaggccaggtcctcagggtccacggtgaaccagacaaggtccctgcctcatggaacttacatgcaggaggccagagacaatagaaaagcaaataataaatatttaatatcaagcaatgctagtagtaaaaagaaaaataaaacagagtggccaggcatggtggctcacacctgtaatcccagcactttgggaggccaaggtgggtggatcacaaggtcaagagatcgcgaccatcctggccaacatggtgaaaacccgtctctactaaaaatgcaaaacttagctgggcatggtggcacacgcccgtagtcccagctacttgggaggctgaggcaggagaatcgcttgaacccaggaggaggaggttgcagtgagccaagattgcaccactgcactccagcctgggcgacagagcaagactctgtctcaaaataaataaatacatacatacatacatacagggtaagaagaggtcagagggttccgggatggcctaaggaggtgacgtgggaggagagagccaaatgtaaccagggagcagcaatctaggaaaagaacaagtcaggcccgaggggacagcaagggcaaattatttcacctgggtgaaaactaatcagttgacatgattttcagaactcaacttccccacttgaattcattacactaatattagaacacacgttttgagaatattcacatcattgcaggtgggaacataaacccggaaatgcttatagactgcaatctggaaatagatatcaaaaactattacaaatatcataattgttcaattcagtaattattttcctgaaaatatatggtaaagatgtattcagaaatgtgcacaaaggtttttatataaagacagttgtggatatccacatccaagatatctataacttatattagcaataaattggaaacaatttcgaagtgacaacacaataaatgttcaatgaattacaatatatctggatgacgaactgtcagtcaatgattgaaaagcaatttttgtatgatatgtgatgacatgcagagatcctcataagaattttaagggaaaaggcagagtataaaattgtatatgtaaatatacttgaaatctatgacatatttgcatatacatgtgaataatattatgagggaaatggttaaagataatcatctgtgattcgggaggttacaagtgacttactttctttttatttctctaaaggttctaaccgttccacaaaggtcatgatgcacatttataaggagaaaacaactaaagaaataggaatatacacttttatatcattagcctatcattagcctttttatactgaaaaaaaataaaggagccagccacagttagaaatgtattaagtgctccataaaatttagtgttgtcattttagtgtactggggaggcactgagttcttcattcttatgtttgtctttttctctttctgtttattgatgctgttgctttcccattaacctagatacgggactgtaccaggatcatgtttgcaacccaggagtctagcgcagtatgtggtacctagtagatgctcaataaaagcaactacattatgtaagttacaagttcaaagtaattagctccatgattttgaatcatctatccattgtgcaaattaattgtcttgtatttaactcaaagcatatactatccctggagtaacacttaagctgttctgcattctgactatttagagctttctctttgcagagcttttgggtgcttgaaataactgttcgctttttgtaccacttggaagtgccgaattgaagctgtctaaagtcgctgtagctactgcatttctccttttcctttgtattacttcaccccagagatgtcaaatgacttcgatattttagaatatctagttttccaaagaattctttttaaaaataatctttagttttgcactggaacttctcagcatatgcataagtcattatgataacaaaagcaagttattacagatattatacggtaaacttcctctacatatgtgctctgattatctatgacctgacacattgtttctctctgattcaaatgcaaaaagctaatagacatttctctgaatagtacactttgccccagaataactcatcacctctatattcactgttccaaaccttttttgttaatttgcaaactcttcctctattgaaaatgtgcttgcaattacagtaggttttttcctaccgagtgataacgtgcctcagctaacctgtgtagtgaggccaaaatccatgaatgaagcatatgctgtcctgaagtcactacatttaacaggtcactgacccttgtagttctttccagtaacagagacgaggagagaggaggaggcaagaaaaggctggacaacagcagcagcttcaaaaggccttggcgagtactctcggctcttctaattcaccatcattcaggatttatttctattgcaatcagaaaactgcactttcctttctattccttttctttttctttcccctttctttaaggtaaataagctaataccaaagattgactgcaaagatgctttggaaattttaactatacatttatacgctcatcagtactgcatattaaaatatgttgtcctccatagaaaggaaagcattagctatgtaaccctgttactttgaaatgaattacatccagtgatatgcagataaatgtttaacaaccaactctagggggaaaaaaatcctgatttatagggtttccaatttctatattataaatagtcccaccagttctcagctaccaatacgatgtcactgaacgccaagatgcgcacaactcttgcaagccagtatgagttggctccatcacacctgatgctagctaagaacattgaaattatatgaggactatagcaattgagatacaaggagggttttgtatttataacctacaacatgatgaaaatttccaacacctggggtcattagactttatatacagtggatgagaattattcttaactcctctcctgctatctcttctcacatcttctcttaagaaatggcatccccgggtgcggtggctcacgcctgtaatcccagcactttgggaggctgaggcgggcggatcacgaggtcaggagatcgagaccatcctggctaatatggtgaaaccccatctctactgaaaatacaaaaaaattagccgggcgtggtggcagccacctgtagtcccagctactcaggaggctgaggcaggagaatggcgtgaacccaggaggcagagcttgcagtgagccgagatcatgccactgcactccagcctgggtgacagagcaagactccgtcaaaaaaaaaaaaaaaaaaaagaaatggtatcagaatcattagctgaactcccaggtgtaacttacatcccatgaaataaacgcaagaaacctactgtcccgtacattctgactaaggaaatttcatcagctggagattcaacccttcacttgggctgtactcccagtggaaaaaaatgtgcatattccctcactaaactattctcctttactcacaccacagtgtgaaggaagtatcagagcccaggttttgaaggcatattagaggagggagaacaaaaaacgtatcctgtactgtactctacactttaaggagacacccatcaccaaggacagggaaaaggttttgcaaatgaaaacacatttccgtaatttggcaaacttgcctagggctactcctgaaaagcaggtttcatcccacaaattcagtagagtcagaccctcttgagagaacaccggacttccaataccaaattttcacttgcatgatgggcatttggatgctaaatctcagcccctcacacctgctgccacccctccatgaacgaccaccaccccaagggcccctacacacggttttctttcagggttccttttcgtagtattttcattatctggtaccactcacctgccagaacgggctctacttacctgcccaaagtcacccagtcactgtgcattgtcatttccaagctggtgcttgcctcacctgatggtgtctggtctctgaatctcttcctctccaggggccactttatggctggttctgaagggccctgggacgcatcgggtgggcagctgtgaagtgctttctatagagtggatggggcctgggatcaacccattgtgtagaggacacatgtcagttttgcttgcctctccatcatttgccctttatctgggatgagcaccaacatttctctttgggaggcttagtggaactatcaatcaaggcatgcctaaaggtggcccctgacacagccaggccattcagcctcgctctaattcgagttgagtcaagtgatgagaggacaaaggctgaagtgtcccaagggcatcccaggaaaggaccattcactggttactgcttcccagagcctccctgatcccctctttgagcagctggttgctcagtttcatcttcatttcagcaagctgccctgccgcttccaattaattcctttcttgcttcaattaatgagagtccatttctgttgctaataactgatgaactctaattgacataaacacacttatagatgactggtggacagatatggtagacaggaggaaagtcttctgagtcgtcgatgttttcctatggttctcagaggacacttgcgtgtcctctcccaagctctggccatgggcaagccctggaatcactctcttttttgccctctgcaggttctcaagacatcacctgggtctcagagaaagcagaattgcaggacagatgctctttgggagctgagggtgccgaaggacccagccaggtctctatccattctcaagctgagtccctccctgggctgctccctagggtctgttttagataactcagcctggagcaagtgaggataaaagacagcacattggaacagaatacagatggaggattctttttttcccaaacaatgaatttagccaaggggacctttggtaggtgacatctcagaataagtccctggatttcaaaaaggaacatgaggaagcaactagcaatcaaacagagtctagacaaaggagcaacatgcaagttagcatgatccgtcagaacaaccctagggccaacaaccacaactcttttaagattcagtagcatagccttaaagcaaccatgggggcaattaaacaaggcactccggtggtagagagaaagtcagtggggaacatagtggatttgtctcaattagaaaaggaaaaatggcaggcatttgacatcctagctattactggtcattactgtagcatttcaaaaaaaggaaaactgtactcaaagcagatttacttaatgatagaatcaaagagctagaggaaacatcaaaagaaaaaaggagccctgccccctgcagtcaagaacagtttgaaatgaaatcactaagaaaggtagcaggaagagtgaggtcttgaatgagaagctgagttcagattcatgttctgctggggctagctaggttggccacgcagactcctcaactctccgagacctcattctcgttctcattcttcctttgtaaagtgaatgagatccccacctgacagatttattctgcaaaataaatgagataatgtgtaagaccaactaacacttaagttgtcagtaagatagggtaagcacactaggtgcatctatcagagcatcatagaaaggacatgaaccatggaccacgtgcacatcaaaatacataagcaaatggtcccaatcccatcaatatgatgttaaagagagaggtggaagaaaagaagagcagtaactgttataaaatgccatcaggtgagctgaaagagataccacaaagggaggcaacctgactgctctcccccagtgtccaccctagagacagaagaaagtgtcaggcaggaagcagcaatgtggaagacagtagatattgatgagctcagaagcaggcaaaaaatcaatttttttcagcctcgtatcttgggtgttttaggtgtggaaatacaggaatcaacattaagctttcagcatgcctaaaaatagttcttcacctgctgctgtttttcccattggttacaaaggctattgtttatttcagcagatggaaaagaagctgtgaaaagctgttcacatcctgcaaaagggagcatggagaggcggcggcatgggtagtatgttaatgagtggggtcggggatgattagctcaattgctcacacaaaatctttcttctccccggaatttgctgttagtactctgagctatggactctgatgccagcatgctaatttggacctgcatctcagtgggcacagcagtgagtatttccatgaggctcagtttccacttgcttctgtactcttccccattgcactctgaaaatccaagctttcttttcatgtgtcacacagtatcttagaagctcctgggttacagattcggggagaaaatcaccagccatttctggctttgggaggcagccgcctctgctgctgacagctgctgcccagtcctgctggagatggagagtcgaggctgacacctctgctgggcagagcagtaggaaaggcattgtctctcccagctcccagagttggccatgaaagcaaattccggtttttgtttttgtagtgttgagaaccatcagtcccaagcccagcagaagatcattgcctttcacccccaagccacttgtcataaaaattaaaagcatataaattcttcactctacagtttttcttctcagtggatggccagcatcttcagctctgtgagttctttttataaacacatatgcaccaagcctcagctagcaccccctgcccaacaccaatttttttttctcctttcctgcctgagcagttcaaattgatgagaaaatattaactggggctcattttacattaactagtaaatgctccatcaccaagctaaaggcaatggagtaaaaccagctcccattaagtttccgtgaatccatctcctacagctgtgacttctttccctgctgtggcctcacattcatgtaacacatgtgctttgtaagccttaggccatctgattaccctaaaaggaaatacccaacataggggaaaatatggggcttagtacaggctaatggttgaaattccttggtgtaagattaaccatgctgcaaaatgccaaagaaaaatacaaaagtcatgaggacgttcagcaaggttgtctttttcattattattattattattatactttaagttctgtggtacatatgcacaacgtgcaggtttgttacatatgtgtacatgtgccatgttggtgtgctgcacccattaacttatcatttacattaggtatatctccctaatgctatcccccactccccccaccccaccacatgccccggtgtgtgatgttccccaccctgtgtccaagtgttctcattgttcagttcccacctatgagtgagaacatatggtgtttgattttctgtccttgcgatagtttgctcagaataggatctagaactagaaataccatttgacccagccatcccattactgggtatatactgaaaggattataaatcatgctgctataaagacacatgcacaggtatgtttattgcggcactattcacaatagcaaagacttggaaccaacccaaatgtccagcaaagttgtcttaaatccatattttagggagagattcagggaaagtatgtggtaaagattttgtcttatttcaatatgaatttattacaaagataataataatacctaaagggaaaaatagtaatgtttgaaatcccatcccagaggttatgttttgtctgccttgttatctatgcttgtggcagccaagccctttccagagaaggtcccgaattccaactctctggccttcgggcactgcctatgcttatgtgtcacacaagtctcaatttggggtcagagccctgaaacaacaagatgaagaggttcttagctacagacgctataatcagattcacacatttcaaattttcctggccaaatcagaatgtcctcacaagccacctgaaattcagcccatacacttttattgagcacattaatgatatgctcattaatgagcacactgacatgttacttttcatcagtcaaaaggtcaatggtgacccaactagaagtgttggttttatagtcttaaactctacaagaaaaaaactacataaagaaataccagaagcatcattaaaatagcttctgacaattgttaaaacatctttcagatgttttaaaaaaaattcatcggtactgagatgaatctaatagaatgaacaatttactaacctagtttttaaaacattcccaaatcccagtacatttccacataaggccgtggtactcagtgaaatgtatggtgggcccatcatcaccaccaccaacacccctcaaagctgcatgatatctttacatattaggccaggtgcaatcaagaacgaccaccaaaagaaatgaaataaaatatacaaatatataacaaaaataatttttaagttaaaaaataaagaaagcagaaggaatgaattcaaaagagggactggtaaaaaaagaaaacaaaatgtaagaaatgataactaagaccagaaaagcatcttttaaaaacctcctggagtgttaggggtgagagaggatgcgatttaaataccatcagactcaggaaaagagaggagatttcaccaggttttcacaagcctaagatccaggagtgcagaggcaaatacgacagttcagaaggtctaaattcactaaatcgatcatttagtgaatggcttttggtccttcatttaaaaagaacttggttgaatttggaatacataaaagaaactaagagatgtattaagagtagactgaacggtgaccacccccacaaaatgtcatgtccatgtcctaacccccaaaacccatgcattgtgaccctgttgggaaaagggggtctttgcagatgtgactaaattaaggatttgcagaggaaatcatcctggattgggtgggtcctaaatgcaatggcaagtcctaagaagggaagaagagaaaggaagggaaaggaagagaagagaaggggtgggtgggaaacagacacagcaacacaggaaagaaggccgtgtaaagacccacatgaagatgaaggcaggcattcacgttaagctgccacaacccaaggaataccagaaaccactagaaactggaaacagcaaagaagaatcctcctctagaccctagagtgtctggaggaagcctggccccacccacaccttgatgcctgactatggcctcaagaactgtaagagaatacacttccattgtcttaagccacccagcgtgtgataatgtattactgcagccctaggaaattaatacaggcacctgagccattaatgaagtaattgtgaaaagccatcctttgcctgtggttaccacatgtgacctgcagtctcatgggaaacaggtatcatccacatggccagaagcagaagctttcagattgaagagacctaggctgaatccagattctgacaattactcacagtgtggccttggacatgtttcttgacctctctgtacctcaaggtcatctctaaaaaggtgagcagcaaaaaacagtccctacctcatactgttgttgggaatgaatgggatcacctctggaaaagtgcaaggtgaggggcagacacatggtgagattcattccctaccactaagcgtgggctgagctccagctcagccaaccacaatgtgagcctggggattggaggacgaggaagggaaaagctcactgcaagggaaccagcatctagcccctcgaacctgttattctcggtacatttcttgtcaataattaaaataactccactgccttgatagccacacttctatttataacacttaaaattatcagcttcattccactctcacacctagacacttactcattcattctcacaggaggagtttaatttcagcaaatgtgtttttgagagattttgatgtcctggagctatgaaactataatgtaattcatttactttctgaaaaacatgaaggcaatgatttttctctttttttctggccttgttgaggcatacttaagaaattaaaattgtatatatttgaagtatacgacataatgacttaatacacatatatattgtaaagtgattaccaagtcaaggtaattaacaagaccatcacatcacagttaccacgtgtgtgtgtgtgtgtgtgtgtgtgtggtgagaacatgccaagatctaccctcttagcacatttcaagtaaacaatacagtattactaatggtggtccccatgttgtaccttcaatcccagaacttattcatcttaaaactgaaaatttgatccacgtctccacctttccccacccctcagaaccactgttctgctttctgcttctgtgagtttgatttttttagactctacctataagtgagaatgcaatatttgtctttctgtttctggcttatttcatttagcataatgtcctccaggttcatccatgtggtcacaaaggggaggatttcctcatttttttgtggttgaaaaatattccaatgtatatagataccacattttctttatccattcacctgtcaatgagcatttaggttggttctataccttgtctactgtaaataatgccgcagtgaacacagggatacagataagcaacatggaagttcctcaaaaaacaattttaggaccgtgatttttcaatttcaacactacatgacataagtaacaaaaggagagttgttagggtcctaaagatacctacctccagatgttttatcttcattagctaagtaatagtcaacatgcattcaaatgtttgcttagtgccatacgatgtgacaagaagatgatacgtaaggcctaagcaactcgttatttttggaaacatgacctctttcaacctagttcttgtatccagactctcacaacagcttctccatctctgagagctaaaatacctgccgggtggataagcagtcatacccaggccagccagcagctctcctaaatttggagggagaaatccattcaggagtgcgatgatagagtcaggcttgcaacttcctaaatttcagggatacctgcatttcaagggaatttcatgatcattaatttaaaaaaaaaactggttcttccttataggccttaaaaacatgtaaaatgtccctaagtcaatgatttgagaacaagaagattaaaaatgaaacagtgaattgaattggaattgaacagaatgctgctgaagtcaaacacaagcagctcgtcagtctaagataaaaatgctagaaagacctctatctttatgatcagggagtcggggtcatattaccttaattgcctggtaaacctagcctgcacaagcatgcacactgaagatatggtgatatctgactttattcattctctcagctgactctctgaccttaacatatgcaaattttattcaagcatcttctgaagcactttttattttgcctgaagatgtcagagaaatcagtacttccaactggcattgctggtcctatttaccgtggttgacgatgcaagttgcccaagtgttaatgaacatgtccttcctgctcaaaagccttcaggtacactgttgcaaaagcagcatccttaaatagctaagtgggacccaagtgagacttctctctggcaatattttgtttgaatcttggaatgatgcttccaaagattcacacaaattaaaaatgaagacttgccaattccttcaacatgaattcattcattcagtaagactttattaagcactcacaatgtgcctgttatttaagggtacttggggagggagttgtttttattttccaactgcccatctgaaagactttgaataaaagatgtattttactcctttatctgaatgacaaccaattcaaagagtcagtgcccagacaccaaaaatctaatctaatcttgccttgatgccctattcttctagatttcgacatgattttaaaaattctggccaatttctaaggctgtcgatgctgaaaaaagtagacttaacttttgcagttgaaattgtacaacactcatcatataaaaataaattataatagaaggtttgaaaagtagaccttaaaaatagaggttacaaaattagccaggtttctactgaaagaaatgtgatactattttttttaacgtatcacgtctctacatctgcattttgtcctgaaggatgtggtgacctaaataaaactgacactctctggtcagaattctgcagcacccagaactggcagtcattgatgaagaaaactacagctgcaagggtacccggcagtttcatatctaaacaagagtgtttctttgtcctaagacacggatggggcatcctttcaaagtctctgaagatattggaaaacattagacttcagtaaacattggaaatggggctacacagaggaactcagttttttagctattaaacctttctttaaacagatttcaatacttaaccatagacacatctacaaattactaaaagaagtgcaaaaagaatgactccccactccattcactagcaagcaagtccccaactctgcatattcataaacatttaatatttatataggacaaaaccatttgacctaatttaaccttactatgatataaatatttttggtctcaagatctgaactgtaggacctggacccgggcagacaaaaacagtatgaccttgaataaatcgggtaccgctcttagcctccattttgctacctctgagatctggtctccatgagcctttcttaaactcaccatcttgagagtctgatggaagttatgaaggctctccacctaaactctgacgtttatgtccaatttgatgatgttcaaaagcagtcacagattccaggtgaaaaacaactgacctaaagaatctctgtgatccctccaagagccaaaattttactattgtttaataggataacctgtactctataccttacattatatattatgtatgcataatgttacttgtttagctttgaaactgcagagcacgctggcggctgcagttttcttcatcaatgactgccatgtatgtatataggcacagatattttagatactattattatattatgttaatagaatataactgctatattttgtctacatcttactgtatttattatacctgtgcttgtaagttaggtatacacatacctcatatgtgtatagacagaactcaaagtagttggactgtgctctggcccatcttttagtagaggtgacattcttcattgacttcttttaaggaaatgtaaatgtgctccttaagtgactgagaatttttttaagttcaggaggacacgtgcaggtttgttacataggtaaacttgggtcacggtgtttttttgtacagattatttcatcatgcaggtattaagactagcacccattagttatttttcctgatcctctccctcctcccaccctctaccctccaaaaggccccaatgtgtgtctttcccctttacgtgtccatgtgttctcatcatttgctccacacataagtgagaacacgtggtatttgattttctgttcctgtgttagtttgctaaggatagtgacctccagctccatccatgtccctgcaaggacatgatctcattcttttttgtggctgcagagtattccatagtgtatatgtgccacattctctttacccagtgactgagaattttctctctctcatttatataagctagtctaagtttctgttccccagcctggtggagaaatggtcccattatagatgtggttgggcagaaagggaagttaacaaaaacaataccatcaagtcaccctaatttgcaatgcaactgttacatgtgatactaacaaattcatgaatatatctgaagctataccctggtatcattagcataaagttaaaatgcagtgatcagtctatctcttagttttggggtgagcaggaatgtaactctagtgaccttaaccttgacttaggaaaattatacctacattcagaaatttgtagaacacaactccaaagaaaaagatatgtcttaaaactgtggagtttgttgaatgattgcagcccatcagaagaaagataattacattaaatgaaaataatataaattaaaggaaaattaagaatgagctagagtaagaatgctgctggcaaacctaattacattgtttattgtttttcttcatgccccaacctctttgccatcccaatccctacctgctgctcaaatgtaagcttcctcaggaaagggttttatcctttgtttttactgatgactcataagcataaagagcattgcctcatgcaataaatatttgaaaaaatggcactaagtgtctttgccaaagacatcatggtgattatgagtagtaatccataattgtgtgtgtgtgtgttacttaaatgctataatcaagcacaaactgaaaaactgcttccccaaatctcctgtacaccagtcccccacacctccccaaaaaaaacttgttactcagtacatgattcattgcagctgagaggtatgttccggggctttccatggaacaccagaccaattggatattgaaccctaaagttccaagatcataaactaccaagaccaggaaatagagatctgattttaactcaccattaggaattaacctccttatggactgctcaaagaaagatgacctagatcattgtccttagtcagacatcaaatgtcaacaagactaaaaagaaaacttagtaagaaggataaccaagttcaaactcatgttgttcaaagttaacaaaaaagaaaaagataatcaaggagagaagccaaatgttaataaaacaaacttgtgattcataatgcagcataaagtcaaccctacctaaagtaaaccttaaaatcagagcaactaatatgaactcgcgggagtggaaactttttcaattaaacgttgacatgaagcattcagacaccatcatttcatagtgacccctttgaaaaaactggaagaaatgctttgccacttcatggtttactggcattaggattcatgattcatgattaagacaaaaatgaagctccatggctgcattctcttgatgccaatatcaagagctaggaatagaaaaactccagcaggcagccacaagaaggattttcttgtccataacatcaaacaatttgattttttaagtcaattaatatttggttgagcatcctatagtcatagccaaaggcttataataatctggagcactcaatttagtcatatttgtgtcaattttgcaagggtatgctaccttcaaaagtgctaggctgacaaagaaaatcaataatcccattggttagaaaagaacacaatgtcgtcaggcgaactgggacagaactttcagagtcagcacagcaaaggcatccaaggccacttcacccattgcagatgcaggctatacttagttcattgattctgtgtcttggagcagcctcatccaaaagggtacactgttgacagacaaaagtagacctaaggaaaaagataactcatcccaagggagtactcattatttgttaggtactattctaagggttttacatgtaacaaattactaataatgttgctcccattttacagatgaggagacagaagtacaaaaaggcaaaataacttgttcaaggtcacccagagagtaagtggcagagccaaggtgcagaaccaggggttctgggtccaagggccacgctttcaaccactgcaagcatggactctgaggaaggaaacaaccaccctctcctccctcatggccttcaggctaaggtttccatataatctagagcctacccagcctcctgaaaccagagataaaagcaaaactctctggcctctgctgaccagaacagacacaccaggctcatcaggtcaacaaagccaccagtatttgagcaaccaagctccccaaatctgcaaagtgggatgcaaaagtgaattcacctatgaaatcaggtagacctgtcagaagtgggaaagccataaggaagaccagttctcacattggactaaacaaaaataagaaactgtgctgacaacctctgtgacctaaatccagtctgttctgcccattcacaacttggtttatgtagcatgagacagctggacagttgctaagatctcctcctattctaagattgggtgctcctcgtgctcctctaagaaaaaccacactgggcctttccagtgctttgccccaagtagatgcttgatcagttgaactgaatttagagcacccttcaattactcttttccctatccagagtgtttagctttgatctaggaaaaatgcaaaaagaaaaattcacatcaattttaattattagctcttctttgatccaccaaaaacatgaagttcagtagagaatgtaacagaatagaaaatgcaggcttcctcccaataaaaccactatgttatgctgcaagtcaatcagaaaagagtttttccatgatgctgaaacaaaatgtactgacatcactccaaagccaatttttttccatgacttgactcaatcccagaacctgccctggcactcacttccttagcacgtgaacaaaccaaagacatcatttatccaacgaagtgatttccgtgtcgcatttctgggagaattataatttgacatacttgtatgctgcacagacactctaaaagagtacaaaatcaggcatccctttctcaaagagagatttcaattttcagtctcattttcatgtaaaatttttaaagtaacaccaataggaagaagtctcaattgtatcgtgcaaagcagaagttccatctggttccatccttacattgttatccagcatcttcactaatgcatccagcagattaactggaaatatggcatgaatccttcattgtgaagaggtaaaatttaaagagggtactgtcacaccagtggatactagtttttaattttttcctgagagttacaggaagtagaggataggggtgcaatttttttgttgttgttccaagctggagtctcactctgtcccccaggctggagtgcaatggcacaatctccactctctgcagcctccacctcctcggctcaagcgattctcccacctcaaccttctgtatgtgtgcaatttttgatctctgtattcaggatgaatctgacattccaaaaaggccttgaaattaactaacctggtccaatatgataatttcttcattatccttgctcacatttcagttcttgacttgaattggttttgaggggattttgtgaatcctgtaattcacaaaatatttgtatatttgtatatttgccttttttcagttacaaagatttctgttcaatgctgatttataccaaactaaataggaattttctcccagtctacactgtaagtaagcaatttgcccaacctcattggtcaaagaagaatcactaaaataaagacagtttgtactttgggccattttgcatccaccagtggtaagatgcaagcaccatccagggcatcaagaatggtaaggccagctgggcacggtggctcacacctgtaatcccagcactgcgggaggccaagattggaggattgcttgagctgaggagtttgagatcagcctgggcaacatagcaagtccccatctctgtatttaaaaataataataataataacgaaaacaaaaatttaaaaagaatagtaaggccaagaactgatgttggcagataagacttctggataaggccccacactagaagcaatgcagataactgaccaaagagatcaggtagttatgctcatccccattccctggataagtaaactgaagcacaaagaagcttcataattagaccttaagctggtaatcagggagctaagacttgactccaaaattcatgacatgtctatttcacattgctttccttcaaaaaagaatagcacccaaagtgaaaacaaggcattctccaaagattactgcattcttttacctggacagaggaataggcacattcagaacactggcctgaggccactgtgctatgaaaaggaaaaaatttggaccctgttggaaaaaaaaaaagttacatataatacttattccagagatcaaacttcagcattctttatcatgagaagtagaatagtctcccttttgtcgaattactcaagcaagcttcaggtcaggtcctttaatttgcggaatagttactaagaaccagtttatcaggtcacacattactgagcaatataaacttcattagggctaattttcttttgcaggaaatataacagctgaggagaatgcccacctagatcagattttaaaggcctaaggacaccaaaaagccatcacaagaagactgaagtccagatcctcaggaaagtcattaaggtaagaaaatgaattcaagacaacaaatcttgccagattgaagaaactaattaaaggacccagcagaaagaaagccatagtgccaagggattccaagaaagccagtgtttgttccaagggttggtcaccaggtccaccaatgtccaagccagatgacagcctgagctggccaacactctagctccacagagagccgaggaaatgggcaagcaaccaaaaacagggatttaaaacagtctaataactctaacaattaacattttaagtaattatctaaagcatctattagaaaatgtaacattatgaggagatagagtcaacagtgtcataaaaaaactaaaaatatgaataatgttgacctcaaatagttttaaggcaatattagagcaataataaaaaatgccaaattgtcagtatttaatgtttttaccctactcaatgttagatatagtctaccaaagcaatgcatagctggattcaaagtcaaactaaaatggggcctaatatagattccaacaccatgaacacttgggaccatctttgcatagggaagaaggtgagtcggaagtgatctgggtctcctttccatcatagctcagagtcatctttccctctccatctctgtgagtctaggcctttatctggcatgcctgcatctctgcaacctcctctgcactgatttttcaattctaatctcaactcaattccaatcactgtgcatgccagataaatattctacatcatacttgcatcttatcccacctctatccaaaaatctcaattttcagagctaaatgggcttggtatccaaatccagactccaagactctgtcctgtcttctcttagcagagatttcctatcgtatttcccattgtatcctgcaatggcctaactgtttgcctcactatccgctacacaagtcctgcctccccacattcattcattatgctctttaattatgtcatatcctctttccttccatgcttaacacccctcctgctttactttcccttcccttgcaacctacgggtggtcaccatcacacgagaaatggaggacactctagaacaaatcattggcatctctcccacacccatttccaaaaacaatctgatatggctcattataaaaagcacaggtgcagtaaaacaagcacccaaaaatattttatcagtaaccgaaaggcaaaataataaaggtgaggaagaatgggaatcatattttaagaagctaaacttagaactgagttctgagtacaaaaattagctctgagcttcacagcaacctaggcaagagataaaacatgatatattaagtagtttttatctgacttttatcacatgaattcatccgtagagattcaatttcctcagctctgaactcaaaggaaatttccacatgtattattatattaaggacatgtaacaacatgatggaggatatccttaacagctgttttacagaaagtgctaacccatatcatgatttctgaccatgaccctcaataaaaactgagggcataatattagcctcattcaattaataccattctgttgggagccagaaagacagagttcagctgtatagcattatggttctgtgactgggctcagggataactccctctaacaccagttcttctgcctggacttctggctggagtgatgcatcagatggttccaaatgggagccaccagaaagcacctgatggaaactaaccaaatcctgtccctctgcagatgaagccaacaaaggtcacatttgggcaggaaaataaaagagtcaccccggcagagggccacctggcatcgctggggagaagtgactgtccctgaaatcactctgtattgtgtcaagtgctcaaacaaggacttttcttttgcatcacagacctggaaaagactcagtgggcaggattatccaaacatccgcctctgtcccatatggcctggataatggctcctgtctgatatttcttttcagcaggtctgtggcagcgagaggggcccaccaggcttcaatggcaacaacatgcccatggggtaactaatgggttgaaaggattgcacagcactatctagacaacaaaatgcatctgcccaaaatagcattttgatttaccactctgcaaagtggcacacagaaaagtgaaaaaaggaagcgatgtatgaggctgcaaagagtttctgacaaacaaatgcctttgggaaggccaagcagagtatttcaatcaagaagttattgggagcaaatagacatccttaatgactattacataaattgcccagggtcacgtgtaccagggtgatggtgttcaccactagtctttttgttcttgatgtttctttggttttttgtttccagagtttgggacctgtttatcccatagcatttgccccaaataaatgacagccatttgggagttgtgggtcccctatgtttgtcactacccccaatgcattttctgacaagggtagtgtcctaaaatgaaagctgagatactttcatatagcttaatggtttcaacaataaaaccatgttaagtttatgattaaaaagataaaattttaataaggaagaaaacaaggaaggatagtggtaggtttggacaacagcaaggagtgataatttgctttcagatagtcatggtatcaacaggctccacccttcaccagggaatgtgaacaaatccattcgttaatttggccatggagggactcattggagatttcggggcagtgaccatgtcagagaatttatgctatgttgtagctaacaaaatagatgtgttgtagcattcagagcttttgaagcccaaatcttgccaaatagtgtctcttacttcagtgatacttaaagcattatagagattgagaaaatgttgagatcacactgtcatgactgcatacaccaccattcagacaggaagcgctgaccaccagtaggattcacctaggggagatgttaccatttcaactgtctcaaccttctaattggaggtcttcatgaaaggttcactgtggggtgatgtaggctcatgactctgtcacatgaccctaacttaatttgccttttatacctgctcaaaggaacgattattgtcagagaaactgtgtgtatcacttcgcgtcccagaaattcaagcagcagctcctaatattttgatccagaaagaatacacataaaatattcttttatatatatatatatatatatatacacttatatatatatataaaagaagacatatatataggtaagtatatatatacttacctatatataggtaagtatgtgtgtgtgtgtgtgtgtgtatatatatatatatatatatatatatatatatatatatatataaaagaagacatttatgtggccaacaaacatatgaaaaaaagctcatcatcactgatcattagagaaatgcaaatcaaaaccacaatgagataccatctcatgccagttagaatggagatcattaaaaagtcaggaaacaacagatgctggagaggatgtggaaaaataggaatgcttttacactgttggtaggagtgtaaattagttcaaccattgtggaagacagtgtggcgattcctcaaagatctagaaccagaaataccatttgacccagcaattccattactgggtatatatccaaagaattataaattattctactataaagacatatgcacacctatgtttattacagcagtattcacaatagcaaagacttggaaccagaccaaatgctcatcaatgatagactggataaagaaaatgttgcacatatacaccatggaatactatgcagtcataaaaaaggatgagttcatgtcctttgcagggacatgaagctggaaaccatcattctcagcaaactaacacaagaacagaaaaccaaataccacatgttctcactcacaagtgggagttgaacaatgagaatacatggacacagggaggggaacatcacataccggggcctgttgtggggttgggggcaagggcagggagagcattaggacaaatacctaatgtagatgacaggttgatgggtgtagcaaaccaccatgtcatgtgtatacctatgtagcaaacctgcacgttccgcacatgtatcccagaacttttatgtatacatacatatatatatatatatataaaagaatgtctatgtatatataaaattgaaatgtaaagtagtttttttccaattctgtgaaaaaagttaatggtagcttgatggggacagcattgaatctgtaagttactttgggcatacggccatttgcaggatattgattcttcctaaccatgagcatggaatgttttcccatttgtttgtttcctctcttatttccttgagcagtggtctgtagttctccttgaaggggtccttcacatcccttaaaagttgtattcctaggtattttattctttttgtagcaattgtgaatgggagttcactcatgatttggctctctgtctattactggtgtataggaatgcttgtgatttttgcacattgattttgagaatacacattcttactacaacacaagaatataccttagaagtagctgagacatagaaagaagaaatgggaaaaagatcataacattttttctaaaataaatgtcgtccataacacacaggttgagggttcttgctcaatgagtatgagaacacaggaattgtccattccagagtggttataatcagctcaagcacaccaatccctgtgcaagctgcagagagtcgcatcagcatcctgccttcagatcaaagctgctgagccagactctggtggaggaagggccccagaacaccctgcatcactcagaaaccattcaagttctggaactgctgttgcagcaatcctcaccagacatcaggaaatcatggttatttgtggacagaaaaaactgaggtcattcaaaggatccaggccagattcccgagcatgatgtggggtttgaatggccctgcaaagagccacacattcatagtgggagctgattccagttgggttctatcagggagaccccctcactgtgtctcctcccaggccgaggcaaacgagtccctgccttctcacaattgcacctgtgtgctcacaaggctgcgtgtgatgctgctgtgaaagcactcccagctaagtctattcatcattgcacacggtgggtaatgaagacctcggaggaaactggtttccacccctggggaaatacatcaggagcattcaaaacaacagactagctggactgtaggaatgatacagattttccttggggttctccatgaaactggaaacttataaagggaagatgatgttattgcattagccactcacatctaaataaacaggaggcaacactagttctggggtaagtcaaaactttgtctataaatgcatgaagagaaaagtgcttacacttaaaaatgcaggaatgggattgtatccaacactgtgctgtccaacagtaccttctgtgatgatggaaatgttgtatcccactccgtccatagagtagccaccagccaatgcagctacagagctccgtaaatgtggctactttgagtaaggaactgaattttttattttacttatttgcaactaatttaatattagtctaaatagccacaatgggctagcagctaccaaattgacagtataggtctagtgtataatttcagtgatgaaaaaagacacaataagacctggaaaaatgtgtgaaatgtcagtagtggtgactgcagggagggggaatttttttctgctttttaaatactttttctctatttccaaagtttttttattaataagcacatataaattttataatcagaaaaagataaaaataaatgtatgctgaaaatattaaaagaaggacaagataggacaacttcagcggttcctgtatctggcaccaacctgcttgctcaagctgatcaataaccaataaatgatgaaaacattgctgttgcccaaacagccatcactcatcaggaggctccaattcaaacctgtccaaagtctactaggcgccagccatactcggctttcccttggacacctgaatatgccaagcttgtcctcactcagggctacctaagctgttcctcctgctgttcctccaaatctcctctagctgcttaaaattcccttaaatgctgcctcctatccaatgtaaccagccagtcatcttctatgtcatcacttcctttaattgtccgcacagcacttctcactacctgctattttcttgtttatttatttgtgtattatctgtctccctccacccccaaactagaatataggctccaagaaagcaggagtcttgtctgttttgttcactgtcctatgcccaccacaaagcacagtgtccacaacatattggtgctccataaatatgggctgaattaattgctagagtccccagtatttcccaaggctgctcagagactctgctttttaagatttcacttgcaggaaagggacgggctctgggaccaagctgtcgggtttgatctgggcagataacaactaccctcttctctacatatgcttcatggtctattattcgtgggggcagtaaacggatgcttcatggagctgtgagaattcaaatgagataacagagggaaggcactgagtgtagtgcctggtgcgtagaaatgttcaaacaatattagctgttatactttgcagatctctggtttgtgtgaggagggtaggacaagtttgccaaaatgtatcattgagataaaagaaagggagaattaaacttcaactaccagcttcttaggctggtctttctgttattttgctgtgtaacaaactgcgtcaaaactcaagaggtttaagacaaggacaacaatgatttgcccgtgaatctgtaatctggggtcaggggctcggcaggaatagctcatctctcctccacctggcagcacggcggccaaggctggggctggaatcagacgcaggctcacctggtgtcctgtctggggtagctgaggtagggagattccaacagctatggccaagacagccgggcactcagcatctctgtaactctctgtgtggtctccagcctggcagcctcagagcagccggacttttgagatggaagctcagggctccaaaggtgcatggagagagaggaggtgaaggagggaggggggagagagagaaagagaggaaaggagggtggtgaggataactgagaaagaaagggagggatggagaggggaaaggagggatggaggcaggaaaggggagagagggaaagacagaaagagaggaagaagcaggaggaggactaggaggaggaggaagaggagagaagaaaggagagagagaggaaaaaggatgagggagggagagaagaagagaaagagagaaagatagagaaaggacttgagagagaggaattaagggagagatatgagatagagagagaggtgaaagctacatcacctcttccaacctagcctctgaagtcatgtcacagcactgtcaccacattctcctattctcttcacagtagtcacaagtctgcctgcccatgtttaagggaagaggaaatagattcagtctcttgatggaagagtggtaagtttctagaagggtctacaggatcaaaaatattgtttcagccacttttggaaaggagcatctcacaggactaccaactaatagttctaggcatgtcttcacccaatgaccactgtcgttttgagagccgccctgtgcactgctctcaggaagcacatgttccaggaagacccacgcacactgttccacataacacaggaagacataagaaaccaggaaagcctgcatctgccagggatccacttttcctgtcctttgtgctttgtgctaccttaagtctggctttctgctggatggtaacgtgatgtgaaagtggcagctcagataagattcctgtccataaattctttgaactgaatcaaaataaatgcaagcccaggatcagaactgacagtgcctggcaattggtaggtattgagattggaagagcgtggaaactgctgagaagaaggcacgagatgcagttaggtccactacagctcatcctgacatcatccgcagcagttcagaagttctccctttaatgagtcctgtgaaaccaacgtggccccttccacaggcttttggacttgccctcctggggaggaaggtgtcttcggaggtttctgtcatatggcatataccttgttcttcagagtattttcaaacttagaatcattagctcccttctccccaaccagtatagacatgaacatgtgtcaacagtccccagatacactgcctgtgctttgaacagtgtaacagtgtaaggtttcttatgtgttccagtgcacactgttccaggaagacccatggccgatcattccttagctcagaatgccaggacagtgcttagctatgtagcaccaaagaaaaccgaggcaccaatgccagctgttcaaatgcatcatcgacaaaagaaaggtgtacacaaactcacagacagactgaactggtttcatttgctcctccagagtcagtctcctcccttccccatggctctttgctctgaggctgacgcatacggacaaacacaaagactcatacccagctcctttgactctggctgctagatgggtttggccaacagagtgcactggccaggggccagggagggaggagagagaggacaggtatttgtcatccccgctgctccttgcaggtcactgcacactggctgcatctccccagtgaaggtctccattcttgtccttgaacacaacccctattggtctccaggttccaagaatagctggtctcctccccttgctccttcaggactatggcagtaaaggagctgttggtagccctggggtacttcagggtccctggttggtttctctataccctgcacactcctgtgtaaatagttcctttgtttagctcttctcgaattatgctaatttgaaagtgtcacccatttctggatgtgacccagacagacccaggacccttcttcttttttggtgggggatggagtcttgctctatcacccaggctggagtgcagtgatgcgatctcggcttactgcaacctccgcctcctgggtttaagcgattctcctgcatcagcctcccaagtagctaggattacaggcatgtgccaccacacctggctgatttttgtatttttactagagatggggtttcaccatgttgaccaggctggcctcgaactcctgacctcaagtgatcctcccctcttggcctcccaaagtgctagggttacaggtgtgagccactgcgcctggccccttgttcttattaatggcacaaatctctctcccagccaccttcacactctgcttttcctgagcactgttccctagggtcatctcttatcatgtcaccattcattcacttatccacaaataactttgagctctaacagagaagacactggctggattcaggggtgaggataacccctgctttcacagaacttactctccaccctctctgttgaactccatttggccaaatatttctcaggaaacctgaaggagagcctgtttccaatgccctgagacgtaaggtcatacagattgcaaatggtgacttctgtcttcactcatcaccttgtgcttaccagggagctggaagatgtccctcatgaggagaagctacctaagcaaggacattcgcaagccatcagcattagtcatcttttatataaaaatcacattgttctggaaggtggccatcctgttacactgttcaaagcacaggcagtgtatctggggactgtcgacacatgtgcatgtctatactggtcagggagaaggaagctaatgattctaagtttgaaaatactctgaagaacaaggtatatgccatatgacagaagcctccaaagacaccttcctccccaggagggcaagtccaaaagcctgtggaaggggccgcgttggtttcacaggactcattagagggagaacttctgaactgctgccgatgatgtcaggatgaactgtggtggacctaactccatctcatgcctccttctcagcaatttccactctctgccaacctcaacacctaccaactgccaggcactgtcagttctgatcctgggcttgcatttattttgattcagttcaaagaatttatggacaggaatcttatctgagctgtcactttcacatcatgttaccatccagcaggaagctggacttaaggtagcacaaagcacaaaggacaggaaaagtggatccctggcagacacaggctttcctggtttctcactgatcagtgtgtccctggaggctaatcatccagaagaaatcttgttatcctaccagaaggatggtactccaggcctgccccagccacttggctcacatttcaaagaggaaatgacccacaggctcccgttctggccagtgctctgtctgcatctactcattactcttttatagcatcgatcagtctttgctggggggtggaaaccagacccagctcttcaggctggcaagttcccaaggctcgtgctcagcaggcaaatgggccagtgagaaccatgcactggtgaataatgaagtccacctcccaggagtggccaatactgcacacctccaggaagtaccactgccagggctgctccactggtgcatcggggacatctcaggagggtttccaggagaaggaagctgcagttctctctggctgtgctgctgctcatgtgaaatccccatttcccactctcacaagttctggaaggtggccatcctgttacactgttccaagcacaggcagtgtacctagggactgtcgacaagtgtgcatgtctatattggtggggtagaagggagctaatgattctaagtttgaaaatactctaaagaacaaggcatatgccttacaagaggagcatcacagctgcagaaaccactgctcttgactttgcagaaggaatacactggttgagcggcagatggtgaagagctctgagcctgaacccgatagggccaggcttcgaccttgtcactaaaattacctactgtgagatcccaggcaagttactcaccagagagcatactcacctgctccaaaagtcagttgtgaagattcaacgtttctgaaaatacatctggcaagtgctaaatcatagttgaataaggttaaatgagcattaagaaataatcgcctggttatagatgctgaatggcccgatcctaagacttttcttagatttaggttcacctgctgctgtggttttggggtgctatttgctctagtaaaggactgttcttgcaggtcttcccatccatccctgttttctgccacttcaacaaggtcctcctctctgagcagcacaattagatgggagatctttttgcacagtacctacagacatgtctcccaaggagaactctggaaatggctaggggcaggaaacagggctgggtttttattttgtattttattttattttgcagaagtcacggtaagggtggacttgaaattctcatgtagacctgcttccctctccatttcatgaactcatagagctgtcacccagtgtagggtttggataccatgctcacagtaatatacagcctgcagatacatctgttctttgattctggtgggtggataggaacgagtctcacttccctgttctggaacatgatttcctacaaaacctcgatgccggctcacttagtatgtgatgttacctacagaattcttgctcttcccactctgcttcttccatgcctcgtgacactggggtttcttctttttcatcttcctcttaaagactattactatcttctcctcacagcttcactatcctatccatctgaccttgtctttgacacatcagcctcatttttgctgatcttctgccctcagggatgatgtctttggttggcactgctttcctcctggggtctctgtcacatttgagccatttccttctagctctccaggtcaaggagagcgtctgttgtggtagacagtgccatctccacccaacatcagacacttcacttctgtcttcccaccatatcatgagctcgatcactctggacaaggaaacctgagatggggatgccaattcaagctctcccatcatcatagatttcaagggtgtttttaaggttccaaatccctgttttgactctcattttatgcacgacactaaaaactcagaagtgaaagagggaaggagtagaagccaggtgtaaattcccacctctcacaactctgggcagctataactttgaagacccactctcttcttttcataaatataccacctttcaccaccaccccagggtggaagggtgattacaatgaattttttttaatctacattggttgtaatattcaaagaaaaggttctatgaagcatgatgtaagtttcaaagtgttactgtctctaatacgcaggtgaaagacaaaaatttactttttagggtttagaagcaataccattatcacattcatcttatcaatatgtttaagttttttgaaagattaaatggatagctaggtgcccatgagctcatgattgttctcttacagatggaagataaacctgaactctgactttcatattatataggctggaggacttactctcatgttctgtctaaagctttatttaactgatggtcattgtactcctttgcagctctcagtacatggggaaagaagtttgttgatcctaacaaagcataaattgcactcatatttgctcttgttctaaggccaatttgggacttctaaacatttttaatgagctttgtacacaaaatcacatatgtcaaaactcatgcatgccagaatttctcatccgaaaccatgcatggcagcaagcaagttgaagcacgtgtcttccagggcagtacacagtggcagccacttgctaccccctaatttactaaaaaaccctgggttagtgtccccttcgtatttcccaacagctttcccagtcgcttctcgattccttccatcacttagtgaagacactacaaatacctccttcatgagattctgatgggattctacatgccagggttgccagagaacccatgcatcatgaattcttcaggaaggcaaattgcatctagagtccctcaagttgttgtatattctgattcttccccataaaaaatattttaatgcagaaattagctacatatgaagttattaaaaaggtgtcctgtgactgagggaaacttggagaagtcaggtaagtatagtcaaaaaggtttggcagatgaggttgaggaagccaacatgcagtaataaccaatttgtgtgttgcaaaagctagaccagtatttttccaccattagcatcaaattctcagaacccgccctatatgatctcatgcataattcacaccttagcaccactaaatcctgtttcctctggattttagagccttagaagaaaagtacatcaactcatttcagcacctatgggcagtataccgtcacatgactttcctgtatttacagggtataaggaagtcataataaaagggggaagtgattgacagaaagatacctacagacagttaggacataaaatgtatcagataataaatacatctacgatcttccaagacagatccacaaagcaggagatctcactacatgctgttgaacagatgtgaggggcttccccaatgctccccacagaaacactgatgattttggtctgacacacgtgtatggcatgagaaagatcccgctatatgtgagaacaacccctttttaatactcacttacccacactcctcccagaggccctgtagacagagttataccattgttcacacaccagggactaggaccagcaccacagcattcccctaaatgctgcctcagacctgcctgaagtttattcttaaacaagaatattagaagagaaaagagataaaataattactatagtatttaaagatccaaatcacctttaatgataatttctattatagttaaataattaattttcaccttttgcctaagcaaaaaggtatgtaaggaaagaaggagctcagcaagtagttataatattactcttaacattttttaaacatttatttaataggaaaatgttattgcaaatgaactgtaatgtgaactttcaacttcacttgtacaaacattatctttggaacatatttttctactaccctgtcctattccttttttttagattgaaacagaatgattatagtcatttgccataatacctaacgtcgtctgacagtttaaaacagtggtctcaaaaggtatgtcataactggcacgtcctcaacagtaccttatcgttctgtagctcatctcagtagaaatatcaagacctatcaagccactaatgccttattctgcctgtctgatggcccatttggtatttgacaatgccaattcctctgtcctcacatttactgttgacttttctgcatttgctcactgggattgtcattcactctaacctgggcttcctcacatagcacacaaaatgttaaccacatgtcctaacatctttcacaccaaaactgaggccaattccaccactcttcaggagcacagtcagcccaagctttctcacatgagaaagtggagtgactcacttctaatcaagagggacatggtgtgtaagtgcatataattacatgcagtaaaagcaacctgactcatttgaaaaaggctataaaagttgggtctctcccaactgcaaagtaccagaaggtatctaattcaagcccacacaatcatgaagtagtaattctgaattcatttaccaaatcctaaaatactggaataaggcacaccctctacaactcaaagtataagacaaataaaaggaaggcaatcatccacagaggaataatggtacaaaactcattcatctcaacatatggtcccgggtatggaataaaaggtgacgcagaaggagtatggacacatcaatatgccactgagtcacggatggcttctcagaaagacctaacctgtaaagctgcatcagggaaaaaggtttccctccaaggtgtattctttggggctcccattggccaactcttaattggaccatggatctcattcttattggtgattcttatgttcctaccagtagactggaagtacctggtaattaataataaccagagaagaaccactgccccccagatgcctgtggagtcactaattttatcattccttgaagtgcaggtatcacacaagtgcagaatctgatgggccagcaatttggtctcaacactggaatgtccaatggcaggctagagcctggaatttccctcacaaaagcaggcaagcaagctcttcatgcccttttaagcagtgctatgtgttggtcatgcaaaatcaaagaatcagaacatccacttactttgtaagctgtttgacaaaactaatgattgccttttcatacaggttacctttctcagcaatgtaatttctcctaaaagtaatgatcacataattctctttcaacaagtatctaaatttgaaaaccatatagagaacagttccaaaagacaggtatatattcaatcaactgatacttttttaagtcctactatgttctaggcactgctatagtaattatggatactgatgaagtctgctttcatgaagaggctagctttggcaggagatgggagtggagaggaagttaatcaaggaattgcaaacaacgtaaaaccacaacagatggggtctccaaaggagaggcatatatggggtatgctgataaaagtttaacaaccagctctctgaggaagctctgatttgtagactctgccaattttcattgtgtaaacactcccagtatggccaataccaacatgatatcatatggcctgcaaaattcctggaaatttcacaaccagcaggtacaagactagtataatctggctccagaacaccacttatataagaagaagctgagctagaaaaggacatggaatgcttgagaaacaatagaccaccccaaggttctaacacttaagtcctggatctcaaacattccatccctggcaccaaaatagcataatggtggactggatgcacctggaaattaataataaccagaaaagaaccattggctcccaggtaaccatctacttgtcagacatggtgttactcctttaagccaattatgctcaaaataaggagtttgtccctcctagaaaacacatccaaactcacaaaatagtttcatttaataataaattccccccttgtcacccacaccaccaaaaaacaccaacattttttcagtcattcttcaagtaaattccatatcctttgctatagtcacccacctcagtccctgagtcgtgggcagccacacaacaccgctcaagggggcactcgaggagaatgaaaacaacttaacaatagtatttctctaggaaatactattctttcaaagtttgtgaatcctcaccccaaaatctcattcaaattcagtggagttcatttaataggttaaggaattgtatacctctgcctaaaacacacacacacacacacacacacacacacacacacacaaatgtatcgtataacatgtttataaatttataaaaacataattatgtattttttaatttagtaaatgtcatctcaagaactagaagcaggcacaacagattgccagatcctctgcacgtatttcagagaaaaccatattaaaggtttgaatcaaatgaatagaaatcatttgaaatgtaagcaagagggcatatggggagatggcacccaagaaggcaggagagaattccaacaattttgagcctgaaggccaccgctgaaggctgcactccatttagaagcataatgacatttgaacaggtgaggacacatgtgaaaactagttcacaaatttagcccacaatctctcccaaactccagtataaaattcagcagacgataggctgaaacttcctaagaaaccttgtacatagaatgttttaattaaaatttgatgaatatgtattcagctcctaagaacttcagaagactcaatattttctgattagtataactaagggtaactttcatttgcctagtaagtttgcttctcaaactgtagctaaatatttcactgaggttttcaaaatactcacaaagagcccactgatcctgcttcttatttcttcttactgatataatcagctaagcaaatggcatcttaaaagttaaactggttacttcatctcataatcacataccaggatagaaaagataaagggccaggtgcagtggctcatgtctgtaatcccagcactttgggaggtcgaggccggcagatcacctgaggtcaggagtttgaaaccagcctggccaacatggtgaaaccccttttctactaaaaatacaaaaattagccgggcgtggtggtgggggcctgttatttgagctactcaggaggctgaggcaggagaatcacttgaacccaggaggcagaggttgcagtgagccaagatcgtgccattgcactccagcctgggggacagagcaagagtctgtctcaaagagaaaaaaaagaaaagataaaggaatgagagagtgacagtgagaaccacagcaagaagtcaagactggttatcagcaagggttattgctttcaacaagattgaactatacaactgtaaagatggacaaaaatttccaggaaaactaggaaaacaaatttattttgtaagatagttaattatttaacatattaattataatttaatagcataaagtttgacttttgccacaggtaaacaaattaataaaaatccacactgatgacaataactccatcaactgaataccttctatgcagtaggcagtccagttggtggtttttacacataacttatgtaagtctcatgcccctacccccctcttagatatatattgttaccccattttatggatgaggaaaccaaggctcagcagatttcgtaatttgtcgaagatcatgacactgcaagtcgttctgaagtctgaattccaaagaggatattcttaaccttgacacgttgctgcctccccaccaactagagctcttatcaatagttattcagcattcaccaagaaatcatgaagtccataaattgtgaatgtcaaagaaaatgcacagtaaagaagtccacatttttcccagtttacaaataggctggttttaaaatttgtttagaaatcaaagcacattttcctgaagaaaaaaaggaaagaacaagaaaggaaagaaaacaaaataattgggttatcaggtcagttcagaaaagcctaattcctgatgatgatgacaatgatgatggtgacgatgatgatgatggtggtgatgatgatgatggtgacaataatgatcatgatggcgatgataccagcacatgtggccaggcactcatactaagtactttacacatatttaataacatacctcaatggccatagggtgccagaaatgcatctcttgactttgtgcagagattttccccaggagccaaagtagggatgggggctgggggctgggggctagggcatcatgggggctgtacagcagggacaagggcaacatttacaagtgggaggaggttgccttcatgggcaaacatttgccttcctcctctcctgtgcagagcactgtgttaggggctggggagagatgaataagacacctaaggctggtcttgtgggagagctgatactgaaaccctttcaacagtctgaaaagtgcaatggtaaccattttccagatgctgctgagaacaggagatagtacctaccagagtgtgtgtgtgtgtgtgtgtgtttgtgtgtgtgtctgtgtatgtgagagagagagagagagagagagagtgtgtgtgtgtgtgtgtgtgtgtgtgtgtgtgtgtgtgtgttggggctaaggaaaggcacagtgtcaggcagggcttccaataggaggtgatggctgagctgaactttaaaggatgagcatgaaattgatgataggaggagctaggggaacagatttaaatgtctgaattctctcccgagcacccaccattccaccccatccccctcttcatcggctcttcctcctctacccggatttcaaatatttgtttttccttctcttctcactatacatgctcaccctggacaattgcacccactcccatcctttctctttccatttccctctggagatgtctctgctgagctccagaggaacacctccaactaagtgccaaacatctcatcgaaatgtctgctgggcccctcagactttacgtacctcaaactgagctcctgtcttcccctctagagctggaaatttaccttgaatttaccgctcatccagtgagtgacagaagtattatgagtgagtggaatttaccactcatccagtgagggggcagttttcttggaggtggacagacctggctgtactttctaccataatctgcggtataaattcctatcaaatctggtcttcatgattagcacctatttatgccccacagtttacagcaaaaattagaaagcagtatgggctgttttccaaatgaaactaatttaaaataatttacttttttgaagaattataatgagaatcagtagttacagataatttcgatgaaagctaatctcatgacctagtaaaaataaagagactgagcatatggtttggaataaatgcgattctctaaaatgcaatctggataatcactgaattattataatcattctcaggcatgtttttatctttgttgatttttttccatccaccaggactgtggtcgtataataataacacaacaagtttagaggactctgatctttggttgcttagcaacttgcagctttgacgagaataaaggataaagggtccatagcaaaataatgctgtttgcaattcaacagttatttaaaagttttagaattattaaaactgttctgttttaaataaaactatgcaaatgaataaatacttcacaggatcagtcatcgtttttatttctatcatactctgaatttgtggttggagtcaatcactgaatggatgacccagatttactaatttgaataaaaatatgatgagaacactgtttaacatggcagagtcattgttccttccatagcagagctcataatgttgctgggaaaactaaatggaaaatgcatttaaattacgaaaggtaaaaggtggtgcccatcctatagtccctgctcagtaaacgctagctgtcatcatcactatcactattatcgtcattaaagagaaatggataaacgggcctgtgtagagaattcagcaaatggcatgcatcctacaatgagcattcttccatttcagtggttgcaaatgtcagttagcatgttcctcattccttcatttattttttattcattcaacaatggtcattgagcaactatagatgccaggtgccataccaggcacagagcaaacaactgggaacatactagacaaagtgcctgtcacggtgtggacagatagcaaacgagtaaacacatcaatgtaagtcactacaagaactgagaagggctcaagcaaggggctaaggtcagtgtgaggcatcggaggagggctccttcaggaggggaggcttagtgggcacctgaaggatgagggtgacccatgcatgggtagagctgaaagaagagggagtttttcgtgacaggatgtgcaaagggcctgaggcagaaaagagcccatatgtttgtgctgggtgcccctctgagaatgggatggacaaagtgggctggggtaaaggagagattggagagggagctggatttgtgttcttatgaaaatattattttcatactttgccagggcctctcaaagtcacatttagtcaggcaaatacacccacatttgcactccccacagaatggaggccatgtctatgggatggtgccactgactgttcatctggcacagctacagccttgcccccactcccagcccgcactaccaccgtcaccaccgctgtcaccactgccacccagtcaacctgcacccaggttctgagtcagctttcaccatcattaccatggctgtcctgggatgctgcagcatggtggactctggaatggtccaggaaagacacagctctggccaacctgacttagcctgggggctagagcaggcagaaattctagaaattcaaacaagccaacagaggcaaaccccagagactttatgggctcacacctcatcctgactccagccctccctcagggtggctcagagaccaccgcaccccatctctgacctatctagcaagaagccctacccaggcctgtcttctgctgctcctccatgagctgactccagcctgactccagcactcactcagctcacaaacaaatcctgctgatagaggagtgactgttggctgaatgccatattgccatcccaacagtccagacacgaacctcctgactgtccttaaaaccgtaagccaaacaggtggctttaattgtagaaattcccatcaaaccaacatgctagggaagaggagtcttttgtggacttacaatcaattcccttcacatcataacacaatgtgtacagaaaaactgcaaatgaagccaaaatcccaaaatctttacataacttaaaggtacaagacttgacttttcaatgtcactctgtcaaagattagggtatctttctttccaattttattttatgcaccttaacataattttgattatagcactgatcaattttgtgtcttcttttttcttttcatataatttcatagatgcaagattgtctttaaaaacatcttttgcagtggctaagctctgtcatagagctatgccattatttaaacattctcctattaacttgaaaacatttaggtgttttcccattttggactattacaaataatgttttgatgaatatctctgtttatacaaatttccaacttcttttttttttttttttttgagacagagtctcgctctgtcacccaggctgcagtgtagtggcacgatctcggttcactgcaacctccacctccagggttcaagcaattcttctgcctcagcctcctgagtagctgggactacaggcgtctaccaccacacccagctaatttttgtatttttagtagacatagggtttcatcatgttggccaggctggtctcgaactcctgacctcaaatgatccacctacctcggcctcccaaagtgctgggggattacagacgtgagcaaccacacctggcccaaatttccaacttctttctaaggacaagctccaaaaagggatattatgaaatcaaaagatttaaggttcttaattcatgttgtctaattgctttccagaaaaatgaacaaatttccatacccccaattgatagaggtgcccatttcacttcaagaagtatatttttaatgaaatttgacactacttatctgtcacaacattttaatatctgtagctgccaaatttagacataaggctaatagagtaatttcacacaatatttacataactggcactgctttgggtcatactgatgtccagatggattcccagtcaactctaccttaactgtcaccatttcattcctttcttcctgtccccttgatctggctggtaattaaagttggccagcaagtgtttggcaagtttccgttgtggcatagaatctatgccaatccactgccattgcaaacccacatcagcaaacaggttggctggaaacctttcatctctcatcaaacgggattaagtaatagttttccctaacctacttcaccagagaagtacaatcggggtgttaagagctcctcccatgacaggatacaccaaacggaccttcctggaaaggactggtccgcccacagggacacagtcagtgctaagtcaccttgaaactcaaacttcccacaagtaacacatggatgtctactctggcactcaatcctgcctatcccagacttctctgtagcaatcaacagacggacgcatggatttgtgcagctttgaatttttgcagcctcagcaacattgagcaagccacactcctccaatttaattacggaaatttatggagaggaagaggggtttcccagcatcaacttgaagactgaaatgcagaaaagtctgggtttgcattggccagatacatcctcttggaaccatctttgggttcctgggatcccacatccgtagtttgtggaagatgccgctagataatgggcttgattttttcaagatcttggccctctaggcagcagggtgaacccttcatgaaataccacgtttctaacactaggacctttaaaagcacatatgaagatttaatgtataagactgcttcctgggagacacaggaaagtgtatgtcacttgagcacatatttaaaataaacctattcatggtagcaaagacatggaatcagcccaaatgcccatcaacgatagactggataatgtggcacatacacaccatggaatactatgcagccataaaaaggaatgagatcatgtcatttacagggacatggagctggaagccgtcatcctgagcaaactaacacaggaacagaaaatcaaacacggcatgttctcgcttattagtgggagctgagaaataagaacatatggaaccagggaggggaacaacacacaatggggcctgtcatggagtggagttgggggagggagagcctcaggaaaaatagctaacgcatactgggcttaatacctaggggattggctgataggtgcagcaaaccaccatggcacatgtttacctatgtaacaaacctgcacactgcacatgtaccccagaacttaaaattaaaattaaatgaactccataatccaagtttatgcctatacgtttagcctatggtacctatagtcctgtttttccaccctgatggccactcccctccttggtcctgggttaaaggtgtcttcttgaacacagggagttagctgatttctcccaaagctgctgagcaggtggctttggtagagccatgacttcctaatgatgcaaaagtttagacatatttctcttgttaaaattcatttaaacatgcaaagtttaaaaccattttaaaatgtgtttctgcacacaatttattttagccaagagaaaagaagtgagatgagagcattcacatcagcatactagaaagcactggagatgtaacctggcaggacatcaagtcagaaaaaaaaatatgtttaactcagattggatgaaagggaaataccaccacctaccagtgtgaaaatcccttggcacttcctgcattctgaaagtgtatccacacacaggcacattccctttaatcacggggtgctggggagtggggaggggcagataccaccaatggctctccctggctgcaaggaaaaaacataagcactcccaccattatgataatcatagtcttcaaagcaacctcagagaatgtgaaagccagccttccatcatagagctgacataattaagtttcgaaaaaggtggtttgcccagggttttgctgtgagctattatagagtctgacttctggatgccccatctagaactctctctagcataacaacctagcacccaaggctggtaccactccaaagttcattcttctgttcaaacacaggattcctacatgcatcaacctttggcaagtgtaatttgagtaattatattggaaagctgcaattatttcctttctgtgggtcactgtagtctcagaatattcatgagtaaatcttccaaatgatcaacccctagtagtccgcaggcgtagctgccctttagaaccacttgggggtttccttttgttaatattctgctgagacaccaatcccaaagattctgatgtaatatatgtgagtagggcccagggatttgcattttaaagctcacctagaggtctaatatgtggcctgggttgagaaccactcatggagagaggcagactgttttttcttcttttgcctataaagcaaaatatgtcttgcagggatcaactttagagtctcaaagaatgacaagatctttgctcttctacaatctggatagctttggaaaagtcacttaaccttcttgagcatgttttcccgtctagttagtaacaacagtgcacagagaaaacatctaattcaccttgctatgcccaatgccaggatctgaatggaactagcatttgataaaacgttattgttgaattgagtgaagttgctacaccgaatgcacccaatctcccttccagctccatcactctgggactactcattcattcactcaacaaacactaatattaagttatcaactacattcaggcactagttcaagggcttatatctgtgggaaaaaaaaatctctgcccttgtggagattaagttccagcaagagacagacagactgtaaatgatggacccaatgaaaaagtaagttacaaaggaggtagaaagtgacaaacattatggaaaaacagagcagagtaatggggtttgtgtttgtgtgtatacatgtttgtagatcttggaactaatattttattgctgactgcaatttttgcttattacattgcaatattaaacattatgcaatggccaagttcatccttatcactgcccacttattaagaataaatacattattcatttttaatgctgtgtcagtaaagctacaagacttttttatcatcagtttgagtcttttgtttcctctaaagttggacctggtcattcagaccaaccatcctgctgagaataactaaaaagctggataagtgttgtttaaagtactttgaagggtgtccagcatttgggaaagctttttctcaaggagtatctgaattttccagaagaagttgctaaaatcctgagaaattgagaagagacaacagtggcttcactgaactctaagctctaaccctctatagttagattttgtattttatgcagtttgatgatctttgtattttaaggagaagatttagttcatttatatttacttgccaatataacagagtttatttctaccacatcgcagctctggttcactcttaatggaaaactactatcctttgagtttctagtcctaaatgaggggagattaatcaggctcctgtgttctgagacgtgagatttatcagagcttcccgttcaaagattggagcctaataaatctctccatatttagggttggaaactcaaaggataatagttttccattaagagtgaaccagggctgtgatgtgatagaaacaaacttaattatattggcaagcaaatataaaggaaccaaatcttctcattaaaagacaaatattatgaaactgcataaaatacaaaatctataggctatttgctaaagagacactttaaatataagtatacaaaaagtcagaaagcaaaacaattggttaaaaaaaaaaagatgcattatgcaaacactaactttaaaaacttccagtggtggacacatgactgaggcctgaccaatcagcagaatctaacccctcagccacaatgactggttcagagatgcacacgtgacccaagtcagtccaaccagaactaatctcaggactttcctgatcaactgaaaataggtgctctctgtttccctagggttgctggcaatatgaatagtgtgaacctggagctgtcagaagtcactattcagaatctgagaatgaagcctataaaacggaaagtggacccaagaaatgaagagactcatggcccaggtgatataagttgagctcccagacactgctgtgcctacacttttcagccacatgaacctacagactgcctttgatgcttaagttatttgaattgagtcttctgttgcttgcaacccagagggtcctgactaatacatacaatgtagaagaaccctgatctgacctggtcttcaaacctctctggcttccatttttttcaactctaagatgacaaaattagatatcacttgattgctaaagttcttgcaggagtgcttagtgcatgcatatttaagatactgtatatctacttaataaaaacccaaacacatcattgcatttctggtttattcatactcactcaaacacagatattacactcatcttaaaatcagtacttctattggctttcagctatggttaaccaaatgactgaatcttatatcacaagtgattatgcaagttgattaccattttcagaaactcattttatctttagagattttctgtaagttaaactataaaactgtacttttaatgagcagttacttctgaatatattgggcaaaagcattaagccatgcataaaaattgcttctgatgtaaataaaaatggttttggggttcatcttaaaacaatggcctgcacatctaagatgtcttacttgccaaaaaataaaatgatgcaatgattacagttaatattccactgtttcaattcattccacatagttttaaactgaatggaatgtatttgagaactttgatcagcatcttttataaagtatttttcttatataaggatgagcagatagctgttataagaaataactatatgtaatataatacatataatttatattttataatataaaaaatctaagaaagccctgcatttgtagacaaaggattccaatctcaatgcactgctatatgtcttgggcaagccaccaagaacctctgtgcattccagtctgatatggtttggttgtgtccccacccaaatcttatcttgaactgtagttcccataatccccacatgtcatgggagggacccagtgggaggtaactgaatcatgggggcagttatccccatgctgctgttctcatgatagtgagtgacttctcacaagatctgatggttttatacgggacttttcccccttctgcttgacatttctccttgatgccaccatgtgaagaaggacgcatttgcttccccttccatcatgattgtaagtttcctgagccctccccagccctgcaaaactgagttaattaaacctctttcctttataaattactcagtctcaggtatgtctttattagcagtgtgagaacagactaatagagtaaactggtaccacagagagtgggacgctgctgtaaagatacccaaaaatgtgaaagcaactttggatccggaaccatttggagggctcagaagaagaaagaaaaatgtgggtaagtttggaactccctagggacttgttaagtggctttgactaaaatgataatagtgatatggacaatgaagtccaggctgaggtggtctcagaaggagatggggaacttgttggaaaccagagtaaaggtcactcttgctatgcaaagagactggcagcattttgcccctggaccagagatctgtggaactttgaacctgagagagatgatttagggtatctggagaaagaaatttctaagcagcaaagggttcaagatgaagcagagcataagagtttacaaaatttgcagcctgatgatgcaatagaaaagaaaaacccattttctagggagacattcaagcctgctgcagaaatttgcataagtaacaaagagccaaatgttaatcatgaaaacaatgggaaaaatgtctccagggcatgtcagagaccttcacagcagcccctcctatcacaggcctggaggcctaggagggaaaatggttttgtgggccagatccagggccaccccactctttgcagccttgggacatggtgccttgtgtcccacctgcttcagctccagccatggctaaaaggggcaaatgtacagcccaggccattgctttagagggtgcaagccccaagccttggtggcttacatgtggtgttgagcctgtgggtgcacagaagtcaagaactgaggtttgggaacctccacctacatttcagagggtgcatggaaacgcctggatgtccaggcagaggtttgctgcaggggcagagcccccatggagaacctctgctagggcagtgcagaagggaaatgtggggtcagagaccctgcacagagtccccactggggagctgcctagtggagctgtgagaagagagccactgtcctccagaccccagaatggtagacccactaacagcttgtaccacgtgcctggaaaaaccacagagactcaatgacttccgcctgtgaaagcagacagaagagggggctataccctgcaaagtcacagggtcagagtggcccaaggccatggaagcccacctcttgcatcagcatgacctggatgtgagacctggagtcaaaggagatcattttggaactttaaggtttaatgattgccctattggattttagacttggatgggacttgtagcccctttgttttggccaatttctctcatttggaacaggtgtatttacccaatgcctgtacccccattgtatctaagaagtaactaacttgcttttgattttacaggctcataggcagaaggaacttgccttgtctcagatgagactttggacttggacttttgggttaaagctggaattagttaagattttgggggactgttgggaaggcatgattgtgttttgaatgtgaggacatgagatttgggaagggctaggggtagaatgatatggtttggctgggcccccacccaaatctcatcttgcattgtagttcccataatccccatatgttacgggagggccccccctgctgctcttttcatgacagtgaatgggttcccatgagatctgatggttttataaggggcttttcccccttttgctcagtacttctccttgatgccaccatgtgaatgaggacatgtttgcttcccctttcaccatgattgtaaatttcctgaggcctccccagccatgctgaactgtgtgtcaattaaacatctttcctttataaatcagccagtctcaggtatgtctttattagcagcatgagaatggactaatacacagtctcatcatctatcaagtaggggaaatgcctcctccaaagaaatgtgaggattaaaacacataatatagggaaaggaacctagcatgtaacccttcatgtaagtaactgaacacttaacttgaatctgaatgtccataagaatatatttattataaatccccacccatgcctcccccacaggatggtcttcagtgtttgcaatgtctgggcattaatgctctggtggagacagccctgggtggagagtcagcaaagtctaatcctgacttggacattcatctctttcaccttcattttcttctgcagaattagtgaactgaccaatacaatttctagaatcccttcccactctaaacatctataaaatgcattgctgttgtaatcagtactcagaaatgaccagtggtagagtgagttccccaaattgcattgaaaaacaaagaactctacctctttcccagtattccataaagccgaactcgttagtgtcagactgggagtagggcaggcctggaagaccccaagttctgggaacggaggatgaatagtaagctgagggtcatgctgagcccttgacctgaggatgaaattgtttatgagcttctctgggcctcaaactgtccagagttgccagaactgctccctgatggagatttgtttctttgtttgtttgtttgctgggggtgggagagatctgtgcattaggagacaaactgagccaaaaaaacacccagtttgcactcctttctaaacctcattactaaacctcactgcccaaatcctaatccctgggaaattaacaaggcttgggttatgaaaaccaagtctcctggcagtggttgctaagcaacaagtgatctacagtcttttagccctgctttggctcatcaagcacagggggtcccacccccagcccactcagatttctcatttatactgagctcattaaaaaaccagcaatataagtgctctaggtcaacccacatgagctagtttcttaacaaacaagttgactgggatagtattacaacccacgatgattgacggggaggctgtatttctctgcatgatgtattaaatgtgcctgaggggtgccaggtcctaggaggaggaaactgaccaaataccaaagacctttctcaaaccctgtgctgttgcttataatctggacggccttgcataattattttttcaactttctggcctcagtttcctcttcagtggagtgaggcaattggaccaatgacatctagggccacttattcccagtggctcaagtgccccagcaagctctctgcttctcccaaaggagctcagcagaccacaggagttagcataaggcataacttactggagtggaggggcagcattcatggcctaggctgagccagagaacaaagcttcccaattcacaggctttcttgggagggaggtacaggaggctgggccttacatgaagagacaagggatttgagccagcagagtgtcctggggagctgagacctcagatcacggctggaatggagcttctgggatgctatcacccaggtaacgacagtagcaagacattagtctggaatgcaaggagaggctgcaagtaaccatccaggggggatcctggggctcaggttgtgtaagaagataacacagatggaaagccatctggtagttcctcaaaaatttaaatatggaattaccatataacccagtcattccactctgaagtatataaccaaaagaattaaaaactgagactcaaacacacacttgtacgagcacattcatagcagcactattcacaatagctaaagggtgggaacaattcaaatgtccatcaacagatgactggataaacaaaatgtgatatatatgaacaatggaatagtattcagccataaaaaagcaatgaagtatggataaatactgcaacgtggatgaatctcaaaaacattatactaagtgaaagatgccagacacaaacagtcacataatggattactccatttctatgaaatatcgagaataagtaaatccatggagacagaatgcagattggtggttgccagtgactgggaggagggaggaaaggggagcaactgcttcatggatacagtgtttccttttgggatggcaaacatgttttggaactagattatgaacatacaaaatgccactaaaaggttccctttaaaatggttactttcatattatgtgacttttacttcaataaaatgttttaagacaacacagattccacagatatacctgggatggtttatgatacagagaattggagatatgggatgatgagacaccacaggacgtttcaagactctttattaactgtctacttcaatatgaacaaacttcattgatgttcctttctagtctaatggactgtggtcagaggcctaagaatagaatacaagaactctccaaggaagcatgcttcttcccaggtttctcattaggagtttacaccaggagacaagcagcccttcatcaggagaacccatgaaggaagcaggtgtacaggtgagccctaacaggaaataaagactcccttttctaggaaagaagacctgcctccaactgaggaaggagttttcaaggcatgcatgtagaagtagaagagcagggctgggcacattggttcacgcctgtaatcctaacactttgggaggccaaggcagggggactgcttgggaccaggagttcaagaccagcaacatagaggcctgggcaacctagaaggacccccgtatctacaaaaataaaaaataaattagccaagtatggtggcatgtgcctgtagtcccagttactcgggagactgaggtgggaggaacacttgagcccaggagttcaaggctgcggtgggctgtgattgcactcccaccacttgcactccagcctgggtgacagagcgagactctgtgtctctaaaagaaaacaataaaagaaaaaaaatgtggaagggcaaagtgaggcaaggagatcaactgaatggcctctgtcaacagccttgtaccctgctggtctccatttcctgcacaacatttgcaagtcaatcatttttccaaatatacaggagaaagaagaaaacaatcaagcatactcacatactaccgggaaagatctatgttaggagaaaaagctcttgacttcgcctaaattcccacaggctctacttgcatttatgtgctcttctaagcatataaaacatctgtagggtccggggaaagcaagggaagcaagaaaaaccttgcataaaatcgacttgtgatttttaaaaaggtgtcagcatcggtttttggcatcacgctgttaagtttgaacgtaatgataacaatttattttccttaggagacaaaaagaaaggtgacttcccctttagtcagtgtgcagctccaaaatttccaccctcccacatcctactctcccttggtaaaataaaaaaataataataatatggaatttacttctctccagctaaaggtttatttggggcctcatagaaatgctaatattagttctcatttctctgtttttcctattatctctctcattatgaggcttttctacagaaataaaagaattcccttttgcacaaccaaaaaaaccaatggccaattttaaagagtaaaaatgaagatagagggtcacaaaaacccctcgtcaggagaaataaggctgttctcaaggggaaaggagctaaaaatacaatatggagagtaaagcataagggaaatttgcattttgctgaatattagtgcaagcctttctgcccaagcctggttgaagaacattgtttgaaatcagaccattacaccatcaaaaacttttaagaaatactctattatccaataatgccattaaaattaacttggtgattgtaacaaaatactaaggaacacacgacaattattaaaagtgtgctgagtagttcttaaaaaaaagaatcttgataaaatggttgcagtgttccagcctcaataaaaagtcaagacaaattaaaaatatttaaatatgacttagaaaatctatgccaacccttcttaaaataggcataaattgaagttaaatttaattgtactttttttgttgtttttttgagacaagctcttgctctgccgcctaggctgcagtgcaatggctggatttcagctcactgcaaactcctcctcctgggttcaagcgattctcccacctcagcctcccaagtagctgggactatacgcatgcactgccataccggctaatttttgtatttttagtagagatagggttttgccttgttgcccaggctggtctcgaactcctaggctcaagcgatccacccaccccaccttcccaaagtgcttgggattacaagcatgagtcaccacgtccagctttaattgtacattctaaagaaataatagaatcaaccttatcaatacaaatcttggacaaaatagaatttttcaaaagcaaattcttggcttgaatctgctcattctcaacatattatacagtatggtaacagtataaagcatagacttctaattaaaattgatcagcttccccattaatgaatctggctaaataagaaccaagaattataagcttctaaagagcaaaacaatgagcataagcgaagtcaaatgaaaaatgatacatagggaaaaagagatttacaacacaaaggacaaagggcgaatttaatttccctcattaacaacaagccattacgaatcaatgtggggaaaatgtacaacccaaaagaaaattagacaaaaataggaacaggcaatttcattaaaaaaaaaaaatcttccctcattcataattttttaaatgcaattaaaccaattaaatatcatgttttacctatcagttaacacaaaaaaaatgggggctagtaggcattctcatatgctgtcagtaaatttgcaaaattctccaacctttttggatggcaacttagcagtatttattagaatgcttaatgtatatacatttatgtcaatatatgtgtgtgtgtgtgtgtgtgtgtgtgtgtgtgtgtataggggtcagtgcaacattttttttttttttttgagacagcatctcactctgtcatccaggctggagtgcagtggtgtgatctcggctcactgcaacctctgcctcccaggttcaagcaattctcccgcctcagcttcccaagtagctgggtttataggtgtgtgctaccacactcagctaattttttgtgacattatttaaaaactggaaataatgtgctttagtaaggactgaatatgtaaacagtcacacaatggcatactagtcaaccatcgaaaataatgggtttgctttctgttttaagatatggtggccaggcacggtggctcatgcctgtaatcccagcactttgggaggccgaggtgggcagatcatgaggtcaggagatcgagactatcctggctaacacggtgaaaccccatctctactaaaaatacaaaaaaaaaaaaattagccgggtatggtggcacacacctgtagtcccagctactcgggaggctgagacaggagaatcgcctgaacccaggagccactgcactccagcctgggcgacagagcgagactccgtctcaaaaaaaaaaaaaaaagatatggtaagatgctcaaaatagattaaggaaaacattgcagaacattacgtataggttgagttagcttttatataaaatagtttgcatgcatataaaagtatttacataggcttcacatatgcttatacataccaagaagaaaatgtaaaactacacagcaaaatggaaacagtgattagtgcagagggatgatattggcaggagaggccgaagaaagggaagggaaggttaccaacaggtcttttacacatttccatgcgtttataatgccttagcagttggatggctacccttaaaaggacccatgaagatgcaaaactatgagctgatttcatattttaaatgcaagttagcaaaatttaccttctacaattatttgacaagaatttaaagtgcaattgacaaacctttcagaaaaaagctgggaattgggcctttggggtaaggttgccatatttagctaattaaacatacaagtttcccagttaaatttgaatttcagataaatgatgtacaatatttgggacacacttatacaaaaaatgctcattgtttatctgaaattccaatttaactgtgcatctgtattttgcctgggcatcctactttggggtacttcgaggtccctggctagctcctggtctatgtcttagtccatgctcagaagtcccatgtattcaaccagctgcttcttcctccattccagtggttcttttacaggtaggtgaggtcttaaagaatcttttgaaacttttgagccattccccaggagaatatctacatacaaaatttggcatctccagggtatgtgggtcccacgtgagccccaccccacaatggtcggacccaaggactcctcccacagtccatggcactgtgcagatggccagctacgaggaagtgagcatgttggactttgaggagttcaaccagactatgaaacagcaaaatcacaagaccttttttgccttctttgccagttccaaggacattggaggtaacagatatagccccaatggcatgcgggccaaaccagttgtagagacgggctgaagcatgttcgggaagaatgtgcattcatctactgccaagtaggagaaaagccttattggaaagatccaaataatgtcttcaggaaaaatttgaaaggagctgcagtgcttaaccatggaacccaggaaaaactgatagaatctgagtgtcttcaggccagcataatggaaatgttctctgaagattaagatttgatgatggcagtcatgccttgatttcctgctctgttctggtaaactgcatacttggtttgaattcttgttagcaataaataaataaatgatgatgggctgggcacagtggctcccgcctgtaatcccagcactttgggaggtcaaggcgggaggatcacttgagcccaggaggtcgagaacagcctgggcaatgtggtgaaaccttgcctctacaaaaatatttaaaaattagccaagcgtggtggtgcatgcctatagtcccagctactcgagaggctgaggcaggaggatcacttgagccatagaggttaaggctgcagtaagccatgatcacattactgcacttcagcctgggcaacagagtaagaccctgtcaccgaaaataataatgatgatgatgattttaaaaaaagagtatgtgagtgtccacgcactcttgaaaccatccacagatcccaggttaagaatcctggttctggccgggcacggtggctcacgcctgtaatcccagcactttgggaggccgaggcaggcggatcacgaggtcaggagatcgagaccaccctggctaacacggtgaaaccccatctctattaaaaacacaaaaaattagccgggcgtggtggcgggcgcctgtagtcccagctactcgggaggctgaggcaggagaacggtgtgaacacgggaggtagagcttgcagtgagctgagaccgtgccactgcactccagcctgggggacacagcgagactccgcctcaaaaaaaaaaaaaaaaaaaagaatcctggttctacctcagtgtaaaattctaccctgttttggaggattcttgtcatctcaatatgtgcctgggagaactgcatttctctagctcctcacctgtggtattctaaaaagcaagttctaaaggctctagagtaaccaaaataattttgcaggtggtggggagaaggggggagaacatatttacaggactcaacctgattttaggacttactataactacagtagtctcaagatagtgtagaattggcaaaaagagacataaatgtaataaaataaagagtccagaaatagacccacacatgcttggtcaaatgattttaaacaaaggtaccaaaataattcagtggagatagacagtcttttcaacaaatgtttctgaaactattagacatttgtaagcaaaaaaaaagaacgaaaactacccatacattgcaccacatagaaagagacgatcttaaaatgggtcaaagaccttcatgtcaaaccttaaatgatacatgagaaaacaagaggggatttttgtggccttgggttaggcaaagatctctcagataggacacaaaaagtacaaaccataaaagaaaaaatggaccaatcagacttcattggtctctaaaacctgtcctttgaaagaccttgttaagaaaaggaagggctgggcacggtggctgatgcatgtagtcctagcactttgagaggccaaggtgggcagatttcttgagcccaggaatttgagaccagcctgggcaacatggtgaaaccccacctctattaaaaataagaattacttcagtgtggtggcacatgcctgtagtcccagctactcaggaggctgaggtgggaggattgcttgagcctgggaggcggaggttgcaaggagccgagatcacaagtttgcaccactgcattccagcctaggtgacagagtgagaccctgtctcaaaaaaaatgaagaaagaaaagagaaagagagaaaaagaaaaaaaaaaaaagaaagggaaaggagaagccacagattgggagaaaatatttgcaaatcgcatatcaagtaagggatttgaatttgaatcagaaatatggaaaaacaacctcagaactcatttgaatagacatttcatcaaagaagaggcatggatagcaaatagcatatgaaaagatgttcaacaccattaatcattataaaaatgcaaattaaaaccaaaatgtgataccactgcacgcttattagaatagctaaaacctaaatcaccaatgatataccaagaactgacaaggatgcaagcaactggaagcctcatttattgctgatgggaatgcaatggtacacctcttctggaaaacactttggcagcatcttctaaagtttaacacgcacttaccacatgacccagcaatcccaggaaatcctagttatttactcaagagaaatgaaaacatgtccacttaaagacctgtatgtgaacacttacagaagctttattcataatcaccagacactggaaacaaaccaaatgtcatcagttagtgaaaggacaaattgtcatctagccatacaatggatactattcagcaataataagaaacaaacaattgatacatgaaacgacatggatgtatctcaaaagcattatgttcagtggaaaatgcacatgtatgacgttctagaaaaaatgcaaaactatagtgatggaaatcagaccagtggctgccagggactggggccggggagaggtttactacaacggggcatgaggaaatgtatagggatgattgcggtggtgttacacacctatgtgtcaaaatgcatagaaatgaatgccaagaagagtgaattttactgtatgtaaattatatcttaattttaaaaatagttatgaaatgaaaagggtctgggaatcctttgtagaagaagcaatacagctagtcaattggaagctaaagattttcgtgttcttttcattgttcccgtattgcattttccctttctaaagtaatatacctcggacatatttgactttttgtcctattctaatacattctattgtgcttgaaaattaaccacaaggttttgctccaaatgacatagtgcagaaatctgacttcaacgcggtgggatactaggagtaatggtaattcagccatcctccactcagcccccatcagcccattgctacagactcttcgcttcagtcgtctcatggaaaagaaggactagatacttttcttctcttgtgatttcttccaccacagaatgtcttccataaaggagttttaatctgcctccgaaacccaaaatgtaattacaaatgctcctttatattaactacaaggaccagataagtaccagtgttgaaattctaaaggacctgcttgctttcaggaactgtgagcaaaagatagcagacacgtttctatttccaagcgcctttctttcaagtacagtgatttcatttctcaaatcctgtttttcaaaagccccgtgccttttcttttctctttaagaaagaaataccttaacattacacaaacccaaagcctccatacagaaactaaaacttccagaatggaaccgcaaccctctggttcccttttccctctggtgctcactttgaaagtcacaaaccatggagcagtctgaggcacagcagtacagtaagagtaatgaccccatactcaaagccaccatgcctgggctcagatccccaactctgtcaccaagctataggaccccaggtaggtttccttagccataagatggggactcatattcacttttatcaaaatagcagtttgtgtttatagagggccagttctgtgccagagaccttattattcactttcatctttccaaccatcctgtcaatgattgaggaaacggggtttaggaaagctgataagcctgtagtaactcagttaagatgctcacccacaccccaaacccctccagttagcatttcttttccctgcctcacatacttccctggaaataaactctaactatggtgtccagacatgttggccaagggctgatataaaagaaaaagttcagatctatccaggaagactctagagatttaagcaatttgaagacaatgactgtactctttctgtcagtcccagggccctacctggagcctaggtagaggtagccatcaagagggatggaagagaacaagaggaaaagggaaaagggagaggagccttgggccaagtccaataaataaaaatgaaaaaataaactctttccaccaatgtttacggaaatatttaggagagggtcagccaacttcttcctttatcaagggccatataataagtatttttgggccggacacagtggctcatgcctgtaattccaacacactgggaggctgagatgggtggatcacttgagcacaggagttcaagactagcctgaccaacatagcaaaacctcatctctagtaaaaatacaaaaaaaaaaaaaaaaattagccgaatgtggtggcacacacctataacttcagctactcaggtggctgaggcacaagaatcgcttgaatatgagaggtggaggcagcagtgagccgagatcacaccactgcactacagcctgggtgacagagcaagactccatctcaacaaataaagaaatattttcagctttgtgagccatgctgtctcttgcaactcctcccctctgccactggaacatgtaagcagccacagacaacacttacgcaaacgtatgtggctgtgctcaaaacaaccttatccttggacactgaaatctggatttcatataactttcatgcaatgtgagttttttttaatgtagaggcaaggtttcagtatgttgcccaggctattcttgaattcctgggctcaagcgatcctcccaccttggcctcccaaagggctgggattacaggtgtaagccgccacacccggcccagatattagtttggttttgatttttttttgaccacttaaaaatgttaaaaccattcttagttggtagaaagaatggggatgagaactgtgctttggccacccttgatttagttcatcagaaaaggtgattttttttgttttgtgttttttttcccccgagacagagtctcgcttcagcccaggctggagtgcagtgatgcgatctcggctcactgcaacctctgccttcaggattcaagtgattctcctgcctcagcctcctgagtagctgagactacaggcatgtgccaccacggctggctaattttttttttttttttttttttttttgtattttcagtagggatgcggtttcaccatgttggccaggctggcctcgaactcttgacctcaggtgatccatctgcctcagtctcctaaagtgctgggattataggcgtgaaccacagcacctggccacagaaaagtattgttaaaagaaagctttattagaaatattaaaagctagagctactgcaaagcatttattgaaaaatattctgcacttcccagaacagacctggcacaagggaaatgattaaacagattaaatgtcttcatgtgctttccttctcctaaacacaatccctcctcatatgccctggatctactccacaaggcccagtgccctcctggtgcccacagctgcaccccactaaacctgtcatttattcaacagtattacgtagagcctactgtatgtagccccagtgctgggttcccatgcaactgggggagaagagagcagagattctgagagctcttcctctcaaagacaactgctctaagatgcacatggtgattattgactgaaggtaggttagtgtgttcaaataaaacatgaggagtgattccctaatagtctagactgccagctcatgctctcttcactgttttcttattgttctttgcactcactgggtgagaaggacagaggaggaattaacagaagtgagcaccttttatctggtgtctctctgatgggccaggcactgggctagacacttctaagccatagcaactttcaaggttggcatcaggatcccattttcacagatgataaaaccaagcctcagagaaaggagtcacttacccaaggacacccagagccagattctaacccaggcctgactcccacatttggactctttccattctaagttcactttgagatgcaaaatctataccatttgaggagggtgtggaccaggagtttccaggctgtgagcctggctgcccttcaggcaggagtgaccaaagcaggtgcaactgtcgtttttctctgccacatgctatacactgaacaggctatgaaggaagatgataagagtctagcaggagcttctcaaccctagtcatacagtagaatcacctggggagcacttaaaaagtaccagtgccaggccccaccctaggccaattaaatcagaatctgggggacaggggaaccgtaggacccactcatttttgttcaagctgccaggtcagtctaatacactgccagggctgagcactaatgtggggaagcagaggaaggggtaaatataaagaaattctgtctgcaaacctttgccacattgtcgggttttctgtttggtgggggcaggattctgcagtcactgcctctgggttaagcagctctgaccacagctgcctactgaattgataaggatatctaaaaatacaaccctggcattcagctttctgactcaaatacccttcaaattcagactaggttttctttcttgtttgatgcttatcaaatgagagcataaacaaaaccatttttgatggtaccatgtcacatgagaagcttaagcaaagaagctaaagacaggaacacgtttttgtgaggtggccaagctgagaagagtgatgcctcctaagaatgcagcaagaatgcagtgcacgaaacaggcaaatcattctgctttaataacaccaagaaaacatcaagtttcctgcttttcttaacattcttacaaaaatttcgacaagtttttgttctttcatttcaaaagaaaacttcaagtcactgagaattttctaagaaatcatttatttcagaataaaaagtacacatttataaaaagtttaatacaattaaattttcattttcaaaacatgtcataacataattcatcctagtagagagaaaaagctgtgtctgttcattgaaggaagacaatcaaacacactgaataaactaatataatcattttatatggggaaaactacaatccttttcttagtatatcttttatttttgcaacgtgttaccttttttcaaaatgttttaaacttcattcttgcatacttctttacacttttaaaaagaactttactatgttcttatttgtgagttacatcatttctataaagaaaacaagataagcattgttagtccatgttagagatatgaacattgaggttcaaggatgttcaataattatcccaaagtcacaagaagttcatagaaaagccagagaaagaagcaatgtctctttacatctcagctactattcaacattttgtacatactacaatgtgagtttgtgtgtgtctgtgtgtgtgtgtgtgtttgtgtgtaaagtccagtaacaaagactgatgtagtacaaagaactagaattctttgttagcaaacctcagtcaaaaataggttcctctgaagcagaccactgtttcaagttagcatggttaatcagaagaaaggattataaaatcagtttaataagtaaatttaacttgcatgaaaagcagccacacatgtcccctttttactccaagtgcagaaattaacacattgttattataatcctgaaggataggatccttagggaacatgtaacgaaaaaacaaacaggtatctgactgcttaaatattaggcaaataattattttatgaaaataaaataagctttacaaacaaagtaatacaaatgtaaatagccccttctttgacggacagcccaatagaaggagtttctgtatcactcaccacaaaagaaaaattggcccagccactgccacctctgatacctgcctgcttccccaaatgaaccagaacaagcaagagcggcctcaatttctaatcagttgaagttttttcaaacctatcagaaacattttttttatgtagtgtccatttgcttgccatcatggtaaaaataacttcagctaggacccagaattctaactctaaggtgaaggttcctggttagcatgtggcataaggagaatctgtgtctttgtcacctctgtgcctttttattccagctgagcacactcatacaagctcatttagagcaagactggactcagaaatttctttatcccctttttaatgataaaactcaaggaggttatagctcttgctccctattgtaactatgacaggtccagggctggattttcatctaggcactctttagattctatagccctgtatcaagccagcctggctggctcaaattccagttccagttctcacacttactagcagtgtgacattgggacagtcacttcacttttctgtacttcatctataaaatgggagtagggacagcacccagctcataggacattgcaaggatcagcaagttatgtctgcaaagtccttggaacagtgcaggcacgtggcaagtgcttaaaaggagggtaagctaccatcatcatcatcattacatatctacaaattagattttcatatacagttttaaaatcagctgaatttctcatgatttaagatgtttgcatgtgttagaggactttcagggcagtatcaaaatgtgaccttggattagtcactcaatcaaaatgagcttcattttctgcatttgactaaaagagatgatgattagctcgatctagttaaggtaatgagcatttgaaatatgtgcagaaagtttacaaagaaagaaatgtcacaggtgctcagtgatttacagcacttaattaatttaatccttcccagaaccttagtgtgaacatcccacagagacaggatggacacccactcaaaatttggtttggaccctgagactgaaaatggcatgcatacacgcgcacacacacacacacacacacacacacacacacacacaggatacaaaaaggtttactgctgacataatggggctctctggggagagcaggcagctcccaaatgggtttaaatggcttctgagaacagggaaaggagactggcttgtgggttttgctgcattttggggttggggctggagtagcacagggcaggagtttgcatggtttgaacctcccaccagcaccaaaggagggaacccctgggctttcttatcagcttgttttgatgtggaggaaaagaggaaggggagaggtgaggctttaaagctgtcagcagcaatcagacatcaaggaatggaatcactatcttcatgaggtaggtcccatagatcccatcgttgaagatgaggaaataagacccagtagttttaacttcagcttgacttcaaacccacacgacctacaattcccaaatcctaggagtttccatgactcaggtgacaaaagaagcatgtcctagaccccattgacttacgcaaactcaatcagccaaccacagaaaagctaaagacatccttttttaaaaaagcctaaagacagccattttaatcctaattcgtagtttatgattttctcaaaatttccccacacacagaaagaaacttcaaggttaggttctaatgttaccattgctaacactattgtctttggagaaggaggagtgacgctctgttaaaagatcctctttacatccaggtaaaattccatttccaatttatccagtgagcacaaggttctatttcagcaaccacatagtctgcagtggctaagatccaatttccttatctgtaattgagtatgtgtagtttctctctccctctctcccctcccctccccaccaccccaggtttaacttctcttctgaaattgtcttttgtgttctttgctgttcccatgaaaaatgagtctcaagtcttactgcgagatcatgaacgattaaattaaaatcatcaggaatccatttttatggattgtaaggccctgaatcatctcagtaagtttttctgggtaaccaagtccaatcaagttccaagttcactaagctttcctatgaggattacagtaacttcaccgctctctccaactcacacaccagggcatgcagtattgcttctgctcaggtggatggtgttcacacagctaagcctacctccaatgggagctacaaaagaaatctgaatctgttttgatccagttggtcctgcaatgttatgtattagttcctgactcttcggaatgaattatattatacatcaagtcactacttaggacaaatcaaaatatttatgtttcgctgttagtcatctttaggtggcactaaagagctctttttcttgaagatgtcttatatctgtttttagagtcaccaaaaaccatctcagagttgtgttaaattcccagtgagtctttcttctcatgtaaatcgatgggcactctaacctaccttctcccatccattcccactaaaccctaggtccaaatcaactatttctttgaaggataaaattcagacgtgtgaatataacagcagtttgatggacacactcagacaattcatttcttcaggaaaagtcatataaatcatcaatccacagggaaaattagcgtgagtgcattccttggtttttgatttgcagttattttgacttttgcaaaagcaagattttgttctaatggttagaatggctccaacaggcatttcccccaagaagctatcatgtcccaaatctactcctgaggctcacatcacacaaattcttcctcctcctcatcacctcccttcaagtaactaaagcttattgtaaccagtaaacaaagaggaagagcacagtgttgaaaagatagattcagtttgctaatttgctattaaatgaaataaaaagattctagataaatgcaaaaaaatctggctgtcaaggtcaagtttctcaatcccatttacctctaaaaaatgtaaaacctgtcataatgaaagggcagcctttttccccattgaaagaacctatttgagcattctcaaagtaactctccaatcattgttatcaaatttatatgaaacaaactcctccaccctaaatgtaaggaagatagtatctgatcccaaatatcgtccatattcatgtggtttaatgtaatcatttcagataacttcattatttgccctaccctgcaatacaggtttggggattttctacccgtacacacagtcctaccaaattgcctactggaaatgttgatgttaataggtttcacagagctttaacggacttgtaaaagccccagatattattttctgccaaattctcctgaaaaccccaaattcacgggcggctgctggctacatcccatcgtcccatccctcgcaccgcccccacgctttctggcggcttcccggtgccctgctcacgccccggctgccagccccaagcgtgcgccccgtggagcgtccggcaggaagggcggccctgccagcgccacgtacaatgccccctcgaatgcctccgactgttccaacactgctcctaagcttagagagggctggtcgcaggccgaggggaggcagctgccctcctcgtcctctggctgctttgtcacagccctcaagggcgtaggaagagaaggagaaagtgccccaccacctggcacggggcccaccatcacctgcctcccacaccgcacaccctttacacacacagggtccagccggacgtggagcgtggaccacctggacattgaacacctcgccggggacgctcggagccggctcctccgcgctgccaaggcgggcaccgctcaagtggttcttggctcggcccggcctggaggggcgcgccactcagtggccaaccggagcgtctagagccccgcgcgagaagtgccgagccccggagcggcacaccccgagagcccggctggccccgcccgggaaccagggcgggtaagggaatcagggtcggcccgggggtccgcgtccacgcgggccaagagactggatccatcttcttcccaaagtgggaaagcctgtgtcaggcgtgcccattgtcgggcagcagcagcagggccggcgggaagaggctgctggtcccggaccagcgccccgcaccgcgcccgccgcttccactcacctggcagttggcgccggagatcccggcggggcaggtgcagctgtagccaggctcgccggcgggggccgggtgctgcgggtccggctcagggcgcgaggtgcacacacccccattccggcagggctgcgcggcgcacggcccgggcgcagacaggggcgcggcgggcaccgggttggccagggagctgcctcggggccccgctccgagcagcagcagcagcagggccagcgcgggcagcagctgcgcaccgggcgcctgggcgcggcggggctgcatggccggccgggagggcgcgggagccggagccaggacgcagtgacggcggcggcggtggcagtggcgacgagagctgcgagagcgacggtggcggctagggctgctccgccgggccgggcgcctcctgcagctgcgggatccgcggtt

SEQ ID NO: 215 - DNA, 65317 bp, Homo sapiens
atgtagttctcacagtttaatagaaagaatgcatttttttggtatgcagttccttttagaaataacaaaatagaaaatgagttcaaccattgctttatagaaaacagggaaatgtccttcaattgagcatttcttttcctcacattaataaagtctgcacacacctcctatgttaacaggaaataggaatttcagataacaaatgtgaaaagttgaaataatcctgacaaatttttcaaatcaattgttgaaaatatttatttagaaaaaaatatttagttggaaaacagaagaaaccaaagaaaaacacacttcatgtaaacaacagaacactatgctaagtttagttctacaataaaagccacacaaatctgtgtgtggctaacgatgaggatacagagaaaagaaaaagaaaattgagagagaggtagaatataactctttgcttactgcaggtcttgtctggaggagaacctctggaaaataataagttaggatggccctagtctaccagcatgccagaggcagaaccaatataatctcctaaaatatgagatttgtgtcaattcttagggttactcactaaggtggtttggttccaccaatgaataaattttctaattctatactaagctcatcctttggaacatcaatctcatctccagattcttctccaagcttcttccaccagggtgcttgtatgtgcttcagggttgtgagatgggcctgcttggccttggctgccacaggcctggatctacttaggaagagctcaggttctttcccttctgcctccttcagacttggtgcctctgtagtggacagaaaataaacagatgagcagaagagtcctatgccaagcaggtaggaacttggaagctacagagctgtaactctgcaggcagaaacagcattccaactctgaatgtactacttttgagaaagggtcttgctctattgcctaagctggagtgcagtagcaagatcacggctcactgcagcctcaacctcctgggctcaagtgattctcccacctcagcttcctaagtacctgggactatgccaccacacccagctaatgttttttctttttttgtagagatctcactatgctgcccaggctggtctcaaactcctggactcaagcaatccttctgcctcagcttccctaagtgttgggattacagccatgtgtcaacatattcagcccatttctgtttttttttgagacagagttttgctcttgttgcccaggctggaatgccatggcacgatctcggctcactgcaacctccgcctcctgggttcaagcaattctcctacctcagcctcctgagtagctgggattacaggcgtgcgccaccatgcccagctaattttgtatttttagtagagacgggcgtttcaccatgttggtcaggctggtctcgaactcctgacctcagatgatccacctacctcggcctcccaaaatgttgggattacaggcgtgagccaccgtgcccggccatttctgtgtttaaaggaatttaaaaagatgtagatttttgtaagatggcttatttatttatattattattttttgagacaaagtctcactctgtcacctaggctggagtgcagtagcgcgatctctgcttactacaacctccgcctcccgggttcaagcaattctcctgcctcagcctcctgagtagctgggattacaggcacccgccaccatgcccagctaatttttgtattttcagtagagatggggtttcaccatgttggtcatgctggtctcgaactcctgacctcgtgatccgcccacttcggcctcccaaagtgctgggattagaggcatgagccacctcacccagccaagatggtttatttaaagaatagaaactttaatagaacctcatcctatagatgagaggctcagtttcagccatttatccaatttaagaatataaaattaccaagtagtggccattaaatagaaaacactggtcctttctgtttacatatactaaagaaatccaagatgctgactgaaacacaggggcttcatggatgggatctctcattaaatggatcagtggttatgatgaattcatttttgtaaagtgcttcattaaaaattataggctaggcacggtggctcacgcctataatcccagcactttgggaggccgaggtaggcaggtcacaaggtcaagagatcgagaccatcctggccaacatggtgaaactccgtctctactaaaactacaaaaattagctgggcgtggtggtgcgcacctgtagtcccagctactcggggaggctgaggcaggagaatcgcttgaacgtgggaggcggaggttgcagtgagccaagatcacaccactgcactccagcctggcaacagagcaagactccgtctcaaaataataataaaaaaaaatttataaaatgctctacaagtgaatggcactgtaactattgtcatcatctacttacaaaatatgaccaaaagcttttcagattacttagtaaaagatggctagtagggctcagcatctgaaattaataactttggggtgacacatatgaatgatggcaaggcttggggaaacaggtaagaaggtggttataaaatccgcatcatttgaaaacattgtgtgctggtctgatctatgtagaaatttcctgaggttaggggatgagctaaagatgcttagtaatggtttccttctaaaggttttggatgtcacaaacctcgcataggttgttccttttagagaacgaaagtaaaatgagcacatactcattagctgttcaacgttggtgctgatctgtgctatcagagcttctctgtgctgctgggctcgctcttctagggccctgcccataaagtagtgttgcagtcgttcttgagcttgggcatggagctccctactgaccacatctgacattggagagccctggaaacacaggacagaaaaacctgtcacagagaggacataggtatcaaagtacccaaccacttagcagaggttttagactgcttagctgtctctcattttatcaattgaatcttatgattgatgtctatcttgtactcttatgcaagtattaattagtctcttaaaagttttagataaaaataatggtggagaagttttttgtctttcttttttgtatgtgcctatactttactttctcagacactgtggaattatgggagaagagataagcttgagagatcacagtgaaaaattacaaatggtttcgtaaagacactggcctggggccgggtgtggtggctcacgcctgtaatcccagcactctgggaggccaaggtgggtggatcacctgaggtcaggagttcaagaccagcctggccaacacggtgaaaacccatctctacaaaaattagccaggcatgatggtgggtgcctgtaatcccagctactcgggaggctgaggcgggagaattacttgaacctgggaggcagagtttgcaatgagccgagattgcgccattgctctccagcctaggcaacagagcaagactctgccttaaaaaaaaaaaaaaaaaaaaaaagacactggcctataacaggtgtaacaacgccaatccctttgtttctttgttttacttcttatcccattctcactcccaaacttatccaagccatatgttgtaactgcttctggatccacagaacaagggacaaaatcatccaaaggaccatgttcttttggctagtcagctaatttaaggggaacttaactgattagtttgggcaaggatgaaataatcttaactttggaggtgataaagaacctgacaccacagctttctcaaatattcctgttcctatcctggatatgaccctgttccactaaaaccttacttctcagccacaggatcttaaacagctgcactagagtatggctaaagaagcactttaaaaaaagaaaaacaggagcatgcatcagaactacatatagtgtattagaaaaagagagatcaaagacctaaacataagagctaaaactgtaaaactcctagaagaaaacacaggaaaagcatcatgacattggttttggtgatgatttcttcatacgacaccaaagcacaggaaaaaaaaaacaacaacaaaaaccagacaaaatgaacttcatcaaaattaaaaaccttggtgcaccaaagatcactatcaagaaagttaactggcagtccacagaatggcataaaatgtttgcaaatcatacatctaagggattaatctccataatatataaagaactcccaaaactctacaaaaaacaacctgattaaaaaatgaacaaaatataaccctgtggaaaaaaaaataaacaaatgacttgaacagacatttctgcaaaaaagataaagaaacggccaataaacacatgaaaagatgctcaaaatcactaattaggaaagtgcaagttcaaaccataagatacaacttcatatctattagctgctatcaaaaacaatgactacaacaaaaataactaatgttgacaaggatgtacagaaactggaaccctgtgtgtgactggtagaaatgtaaaatggtacagccactatggaaaacagtatggcagttcctcaaaaaaatttttaaaaagaattagcacacaatctagcatttccatttcggatactcacccaaaagaattgaaagcaagtacacacacagatatttgtacacacatggtcacagtagcattattcacaatagccaaagggtggacggaacccaagtgttccttggataaacaaaatgtagtatatataatggaatattattcagcctttaaaagtagaaaattccgacatatgctaaaacatgaaccttgaagacattatactaactgaaacaatgaagtatgattctactcatgaggtacttagagtaggcaaattcatggagacagaaagtagaatggtggttgccagaagctgggtagtgagggaatggtgagttagtgtttaaaggatgcagagtttccattctgcaagatgaaaaaagttctgaagatgggatggtggtgaagcttgcacaaacaatatgaatgtacttaatgctaccaaactacatttaaacatagttaaaatggtaatttttatattttatctattttaccaccctgaaaataaataaattttaaaaatacagatacatgaggccacacaaaacttactgtatcagaatttcttggggtgtgtggggcttgggtatgtaatttttataaaggtgattaaatttgtaaatgattaaaactgttaaaagcaatatagtcctctctacagagcttaggaactgattatctgtttgttggagaggaggcatgcttctgtctgtcttcattctacctctgctcacaggaaaaatctttcagttgtggttctgcccctctctccaactcggttctggtgtttggctaagggaggagttgctaatatgattgatcagcacttaagagattcactggccatatacaccatggaatactatgcagccataaaaaaggatgagtttatgtcctttgcagagacatggatgaagctggaaaccatcattctcagcaaactaatacaagaacagaaaaccaaacactgcatgttctcaaccataagtggaagttgaacaatgagaacacgtggacgcagggaggggaacatcacacactggggcctatcgtggggtagggaactaagggagggatagcattaggagaaaaacctaatgtagatgacaggttgatgggtcccaaaccacccatggcacatgtatacctatgtaacaaacctgcatgttctgcacatgtatcccagaacttaaagtataataataattaaaaagaagagattcattggccatgttttattggtggccaggctgattatttttaaaatctcaggacccctaaatttttttttaagcatttaggttaaaacaaccttttaaaaaatatagctttattgacgtaaaaataacatacactaaacaacaaatattgaaagggtacaatttgctaagctttgacatacacatacctagttcatcactacgtttccttgtttccttttgtaaacccttatcctcatcctacccatccaccaactacttatcccaagcaactacttatctatttaatgttactatagattggtttatatttttagaatttacataaagggaatcataaagaatgtattctactctgtctggcttctttcatttagcataattattttgagattcatccacgtttttttttctttttctttaaaaattttttttgaagacagggtctcactctctcacccaggatagagtgcagtggtgccatcactgctcactgcagcctcgaactcctgggctcaagcgatccacctgccttggcctctcaaagtgctggaattatgggcgtgagtcaccatgcccggccagagattcatccatgttgttgagagtatcaatttattcctttatacatgctgaatggtactccatggttctagtttttggccatgagcattcatgtacaagtgtctatatggacatatatttctttttctctggggtaaatatctaggagtagaatggctgaatcatatgatagatgtatgtttaatttttaaagaaactgttgaactgtcttccaaagtagttgtactcttttacattcccctaagtggtgactctgccacatgcttgctaacctttggcatgttccatttttaaaattccaacaggtatgaagtatcttactgtcggttattttttgaaaaattttaaatttttattaaaaaaattagagagagggtctcaatatgttacccaggctggtctcaaactgttgggctgaagcaatcctcccaccttggcctcccaaagtgttaggattacaggtatgagccactgtgctgggcccttattgtggttttaatgtgcattttccttagtgattaatgatgcatttttcatgtgtttatttgtcatctatcttttggtgaagtatctgttcaaagcttttgtccatttaaaaaacaaaacaactagttcatatgttttcttactgtttagttttgagagttctttctatattatggatataggacctttatcaaatatatgcttggcaatgatattctcccaatctgtgccttgtttctttaattctgttaatggtgtcttatgaagagaagttttaaatttcaataaagccaatatatcaaattttcctttttgaatcatgcttctggtattgtattcaagaaaggtcacaatatttctccattgtttccttttagaagttttatagttttaggttttgcatttaggcctatgatctactttgagttacattttgcatatgaagtgaagtatggcttcaagttcaattgtttgacatgtgaatagccaattgctccagtttttctgcattaactgtatatctctgtcaataattagtttgctatacatgtgctgttaggtgattctggcactgtgcacatgtcattgagtgtacctacagaaacttaaatggtatagactactacatatgtaggctatgtggtataccctattgctcttaggctacaaatctgtacagcatgttattgtattgaatacagtaagcaattttaatgcaatggtaagtttttgtatatgtaaacatatataaatgtagaaaatgtccagtaaaaatataccattacaatattatgtgaccactgttgtatatatggtccaacactgactgaaaattcattatgtgacacatggctgtaattaccatttccagtgctcttaatttctttatgtagagccagatttctctctggtatcttttcctggcatcattttaaacagaaatgttaagtcttttacaccttaaagaacttaacatttctgatttacattcacaccaacagtgtgtaagtgttcccttttctccacatccttgctaacatctgttgtttttgactttgtagtaatagccattttaactggtataatatgattatttattatgattttaagttacatttctctgatgattagtgatattgagcatttttcattgtttgttgaccacttgtatatacgtctgttcatgtttcttgcccactttttttttttttttgagacagggtctcactcggccacacaggctggagtgcagtagcatgaacatgcctcactgcagcctcaacctcctgagctcaagtgatcgccccacctcagtctcccaagtagctgggaccacagacaggcatcaacatgcctggctaatttttaaattttttgtagagaccaggtctcaccatgttgcctaagctggtctcgaattcctgggctcaagcaatcctcctggccttggcattccaaagtgctaagattacaggcatgagccacagcatctggctttgcccactttttaatggggttgtctttttcttcttgagttgagttccttgtagattctagatattagccctttgttagatgtatagcttgcaactattttttcccattctataggctgtttactgttgactgtttattttgctgggcaggagcttgcaatataggcatgtaaatgtgcatttttactccctcaatctacacaaataaaaagaatttaacatttctgcaatgttaaatcctttacaactttaaggatttaacatttttggtagtgcaagtgtactggtgatcaagtctttcagcttttgtatgtctgaaaaagtctttttttttttaacaatatttttttgccaggtacagaattctaggttgacaactttttttcctttcagtactttaaagcaagatatctttcgccgggggtggtggctcatgcctataatcccagcactttgggaggctgagatgggtggatcacctggggtcaggagttcgagaccagcctggtaaacatggtgaaaccccatctctaccaaaagtacaaaaattagctgagcatgatggcaggcgcctgtaatcctagctacctgggaggctgaggcaggagaatcacttgaacccgggaggcggcagttgcagagattgcgccactgcactccagcctgggtgacaacagcgaaactctgtctcaaaaaaaaaaaaaaaaaggtatcttcttgcttgcactgttcctactgagcaatgtaatctttgtctttacgtaacatttaaaaatttttttacacaccaacatggcacatgtatacatatgtaacaaacatgcaccttgtgcacatgtaccctagaacttaaagtataataaaaagtatatatataaaaatttttttttgtttttaagattttcactgtatcactggtttgacaattttgattatgatattccttggcacagttttttccatgtaccttaactggtttgggtatgggcttatcatttttagtttggaaagttttcagccattatttttctctacatctccttcagggattccaagttttcatttactgggccacttacagtcccacagctcagtaatggtcttttcaaatatttttctcttttttcccctctctgtgactcattttgtacagtatctactagtatggcttcacctatattaatcttccatccagcaaagtctaatctgctattattttgatcaagtatatttttcacaccatactttgaagtttttatctctaggagtttgattcaggtatttttttttacatttttcatctttctacttgactttttgaacatataaaatacagttataatgactgttttaatgcccttctctgccaattttaacatctatgtaatttctgggttggtttgactgaatatcctcctcattatgggtcctgttttcctacttccatgcatgcctttaatatttgattagctgctagacattgtgacttttaccttgttgggtgctggatattttgatatttcttaaaattttgagtctttttttgggatgctgttaaattacatgaaaacattttaatctttttttgactcttgattttataatttgtttggcagaatggagccgtctaggctaatcataatctactattaagggaaggtcttcctgagtactcttcacaataccctgtgaattatgagtttctccagcatatttgatgggaacagatactattcctggacctatgtgagttccagacacacttccgtcttaccttttcagatgactcgataatttggctttggataatttcctcacatgtacatgctgattagtattctggagaatactcaaggggtagattctgtagatatctggggttctctctctttgcagctctctttactcaggtactctgttctatgaagtctagttcccttggtgtcacctgactctcagtgccatctccttaactcaaggattctaaagagcccttctctgttctcttccttgagctatggcctagaaactctttcaagacagtaagctggggtaattatagggcttgcttcgttccctctcagagattattgttctttgttgtctgatgtccagggtcttgaaaacgatttcatgcattttatctgcttgtttctttttctggttgtttcaggcaggaagtaaatctagtccctgttactccatcttggccagaaactaatgtcagaactttttccattgtctacctctttatggtaatcacagagggcctgatatagaagggtagtcttttcctcctctctttctccacagactccattaggttttaggtccctaaatccagattagcagaagcagaaagtaagagggcttatttacacttcctagactaagctttgctatccaattcaggttttaccattgctgtgttccagtggttaccagatacatgctcagctactaatatatttgtacttcatttccatttgtacagtagtttttgtttgtttgttacaaaaagtcctttcattttggatgctctggaggaatgaaagggtgaatgataggactccctaaatatcacatcaagcctctaacatcagttatccagaaccttcaaattttagaagtctgtgtgtgtatctgtgtgtgtgtatgtgtgtgtgtgtgtgtgtgagagagagagagagaatgaactcaggcacaaacaccaccaccacaatcacaacaaaactcgtgaaaagtaccaagatacactatgagtgcttggttcaaatgagggaataattctgatagattgaaatgtataaactgctaactttctccataaaattacataagtgtgaaagcacgggagaagcagtaagagaaaagaaagtagaggtaatcagcaaaggtgcaggtgattaaaattaatgacaggagtggtgagttattcccaaggcagaaagggaaatgacctttgaagacacataggagtagatggtcaagaattcaggtgggagaagagaataacaggtgacctgccatcctgtggtcatagaaagtcaaagatatggacatttctattgggataaaggtgctagcagtattattgtggtaagatcataagaggcaaatagtcaaatgctatatcttattggcttctggaggtacattagtagtccaacaaatgtaagaatgaataatcattgattgacagttacatatactctttctggaaggttcaaaatagtccaagttttacagtactattgcaaaagaagcaatgaacaagtcttattgacatagtatgggaaaaaactgatttaaagcagagtctccttcactactgactatacctctatggctatgtaactagaaaaagatataccattacttctatggtaaagccaatgcattaccttataccagcaataaatgtacacacacacacacacacacacacacacacaatatatgtgtgtgtgtgtacagttatcaatatcatgcattggaataatgtaatactgatatggtacagaagcttcataccaaatgtcttctgacatagtcatccactcgtttcttcagttcaactcggcgtgcatcagtgagttcttggagtcctcgccaaggagcaaatagtttctttttcttacggcacttcgctaggaatttaagcgcctggaagaaaaaaaattgaaggtttgtgatttttctcccctaactaatagaactattttctcactacaacatatggtagtgatcacattgcaataatgattaactctgagtgtgtataaggaggggaatgggactgtgacaaaatgcaggagaacagtgacttttaaaatatacagtcttctgtagtgctttttacaaggatatagtcacgtattatttgtgcagtaagcaatgaagaggaaaaaaaagcaatagattctagtctcaattctagtcccttataaactatgattctgggcaaggcacttgatctctagaggacaggttctatgtctatagaaaaaagggttcttaattctacacagcctagatgattgtaaacaccaaggagacagtatatttctgtctgaattccttctcatgtccttcagaatggactctggtaaaaagaaattttgtaataggcattatatgggacaaatttgcaattattctttccaattgttttcactctgctcatgtcttcgtagtttttattttcatcaaagttacatgttcacattgtttaaagcaggggtcagcaaatcatggcccacaggccaaatccagcctgctgcctgttttcatagggcttgagagctaaaaatgtgtgtgtgattttgtttttgttttttttgttttgttttgtttttcattttacattgttaatttaaagggaaaagaatatttagtggcacgtaaaattataaaagaatatttagtggcatgtaaaattatatgagattcaaaatctaatgtttacaaataacatttttttttttttgagatggagtctcgctctgtcaccaggctggagtgcagtggcacaatcccagctcactgcaacctccaccccgccaggttcaagcaattcccctgcctcagccccctgagtagctgggattacaggcatgcaccaccacgcccagctaatttttgtattttttagtagagatgggatttcaccatgttagccaggctgtgatctcttgaccttgtgatctgcccgcctcggcctcccaaagagctgggattacagacgtgagccatcgcgtcccacctctacaaataacattttattggaagacagccatgctcatcggctgcttttgtgctataactgaatacatgtgacacactacatgacctgcaaagcctaaaatattttattatatagcccttccctgaaaagtttgctgatgtaactctattgtttaatgtgtcagttttgtaagaattactagaatgcgattgtttaatttgtcagtttcataagaattactagaattcttactagagttacccacttaccctgtcccctgattcaagggcaacaatttaattcaggttattcttttgatatttagctccatctatttttctgtgatttttttttcagatataggtatcatctattgattttcttgtatgaaaggtatgaatttagctatctttcactgtttctactccccatccatcctatattattacatcataattttagttaaattaatgttcaatgtttacaaaattatgaccacataaaggctattcacttttgaacaatatagtacactataattacttttccttccttgcacatttttattttctctggaattattaattctcttttctcccatgctttgttttccatactaccgattatattttacaaactctgccctaattttctacacattaaaatacagcagccattctatcaaattcattttcttggacacattttctcgagcttcctgacctgctgtaatttggattgactgctctctataccttgggcatagctgtcatcctgtggtctccattcaccatcatctcggtgactacttttcatctttcccttgtgtttcttggattccatgttgccttccttctcaggttattccctcttatctaaaaatgtctttggtctgtccttatctttaattaataatttggttgggtatagaattctagttggaaatcattttccttcaaatatgtgacaatcttacttcaatactttttagcttccaatgttcctgtcaagaagtccttttgttcctagtatatcttacagtattatgaaacaaatgtagaagtgtttctgtcactgtattggacacttaattggtccccttaatctaaaattcatgacattcacttcttggaaatcttaagttatttgattttccatcttctgttttttcttgttcttgatttcaaatgtttggctgtttgacctcctagactggtagtcttttctatccatcttttttttttttaattaaagattctacctttttttctttttctaatgatatttcatatgttgaccaggctggcctagaactcctgagctaatgccatcctgctgccttagccttctgagtagctgggattacaggtgtgtgccactggcaaaatcttttttccttgctttctgtgagatttctttaacttttcccccacagtccttttattagtctttcagttttccctgtcaaattttattctgtgtgctccattttatacggtatcttggttttgtttcatatattacctttccttatctctctgaggatattaataacagattaaaaaaattttttccttatacctgcaatgtttgtattctatcaaatagttttattccatttgttttgtctttggctttccttagatattcagtgatacttatctttcagctgatatttaagagtgggcactaagaagcggtttagaaaatttccctagtactcttactttttggtattttttctaagacagggtctcactctgtcaccctggctggagtgcagtggcttgattatggctcactgcagcctcaacctcctgggctcaagtgatcttcccacttcagcctcccgagtagccgggactacaggtatgtgccaccaagcccagctaattttttatagagaaagagtcttattatgtgtcctaagctggtctcaaactcctgagctcaagtgatcctcccgcctcagcctcccaaagtgctgggatttacaagcatgagtcaccgtgcccggccttgttttcagtatggtacttgagttttcaactgtgcttgcatccttctgttgagactctcttctttctttctattctcccctttccttgatttttctcttttagcaaatttccccaatttttagctcctggagaaacaatgcctctgtttttgcatcaagtaagagagaaacagaaggtggataactgttctggcctttcttttcctgccaaggacactaataaccagttcttcctgagggacacactcattgaaaggatattcctactcctttatattacttttttttttttttgaggcagggtcttattcctattacccaggctagagtgcagtggtgtgatcacagctcactgcagcctcaacttcccaggctcaggtgattttcccccacttcagttttcagagtagctgggactaccagtacatgctaccacgcctggctaatttttgtatttttagtagagatgaggttttgcgacattgcccaggctggtatattactttcaatgaggctaatgaattatttcccatttttttcttagcaagatcagttgcagtgccaacagaaatgtaaggtgagtcatatatgtaattttaaattttctagtagtcacattaagaaaataaaaaatgggcgaaacaatatttactcagttatataaaacatacaacaatatacacaaaatattagtatttcatcatgtaatcaatataaaaaagtattactgagatactttacacttctttttcatgctacattttcaaaatctggtgggtattttacacttacaacacatttcaatttggactagctacatgtcaagttctccatagccagctacgtatgcttaacgattattttattgaacagtgcagatctctagtgtgtcttagaaaaggatacttttaggctaggcgcagtggctcacatctgtaattccagcactttgggagggtgaggtgggaggatcacttgagctcaggagttggagaccaccctggagaacacagtgagacttagtctctactgaaaaaaaaaaaaaattagctgggcctggtggtgcaagcctgtagtcccagctactgtggaggctgaggtgggaggatctcttgagcctcgcagataaaggctccagtggggtatgattgcaccactgcactccagcctgggagacagagagagattctgtctcaaaagaaaagaaaagaaaagaaaagaaaagaaaagaaaagaaaaggatgctttaaaaatatggcaaaatgtaccctttattgactattgccttgttttaattttctctatttttctatttattttctcagtgtactttcccatttttctttctcttttccttctttgaaagtaattcttggccaggcatggtggttcatgcctataatctcagcacttagggaggctgaggcaggaggatcactttagcccaggagttcaaggctgtgatgaactatgaacacaccactgtactccagcctgggtgacagagtgagaccatgtctcttaaaaaaaaaaaaaagtaatcctcttatttccttttccattttggctaactttgctttgacttcatcttatttttattaatgagatgcaaagactataaacatgaccttgacccatccctttttgctcttaaacagagactcattccttttcttagctagaggagatatgaggcaaatgtgactaatcttcctttcgtgccaatggaaagtataaaagccaaaacaactttgccttcgtagccttcagatatgttcctatgatgacccctacttttttctctaagaaatggtaggcaaaccaggatatttcactttacagtacaggatacttttacaaagtattggggtcatctaaatcaggcaaggtagtaagtcaacctaataaggacccagctatttctatgacagggaagactttaaaaaggaggtatttatgaggtaaaagtattagaaagaagccaaagcttcctccaaaggaagtgtctccaaccctaatatcaactggttaaccccttagatggctttgtttagcagaaagtaaaaatcaggagtacgtgtgatacagtgatggtgcaggattgtttgttgcagacacaatctgagatccccagaagagcctgaagaaggagtaggagacaggcatctcttcctgtttctctagtatttattctacaatgttttttggatgattaaaaaaaaaaaactttgtaaaaagttaatcacagagactgttcaaaatctgtcacagtagaaaactgaaattgacctaaaaattcagtaaggattgttaagctaaatgctataggacctgaaatcctaatatgaaagttaaccatgtataagagaacaacgggatgttaggaaaactggtcattaaatttaaaaaaccacctcgtactatgcttttccaaggcaacaaaatagtactatgctctagagagatcacagaaagattgctatttaagaataagaggccgggagcggtggctcacgcctgtaatcccagcactttcggaggccgaggtgggcagatcacgaggtctagagatcgagaccatcctggccaatatggtgaaaccccgtctctattaaaaatacaaacattagatgggtgtggtggtgcatgcctgtagtcccagctactcgggaggctgaggcaggagaattgcttgaacctgggaggcggaggttgtagtgagccaagatcgtgccattgcacttcagccttgcaacagagcaagaatccgtctcaaaaaaaaaaaaaaaatacaattctacaattaaaatgttataatgatctaaatatacctaatatctcatctgtgcattaaaaaaatcaaatatcacatgctgcacttgcacagaactttgtaatttacaaaatacattcccataaattagggtatctgatccacataacaactgagtgaaaagggtaagggtaaacatctattcatacatcaagcacatgtgatgagctgacaacaataagacttagctccttattcttgaagaactcacagcccaagtaagaagggaaataattaacaaaacaacattgcagtatagtaaatgatgtacaaggttctaaggcagtactaaggactgagtgtctaaatcagctcggccagaggtaaggggtttttcttttacaaaagaaaaaactaaggctcaagaaaactaagtgtcttgaccaaggctttacaacaggtaattagcaaagtcagttttgaactcatgtttttgcctcttgattcagagctcttttcactacattagactcactgctctttgaagtgtgacagctgctttatactctatgagagactgcctctgttggtgaaaatttttcctttccctgtaccctctccaatgtttctggataatcagtgctgatttctcttccatttcccgatagtgtttctccacctgacctaaaaagatgatagacactattacaacatactcactgccatgctttcttaagttctggaatcaggacaatgataataataatcttgcattctttttatttttgtcaatattgttcactaattttcccaattctactattttaccatggttctaagattttagaaacaaagctttcccagattatgcagcttcttcacagaaagaactcatataatatttttgtggtagagtaataagaaaatggctgaaaatccaatacaaagaacactaaaaaaaaaaaaaaaaattcctaagtacatgattaagaagtcattcagtaccaccagagggaaagggcaaaatgtgtgtatgtgttctctactctacatgcttccaaatttctcttaagtcactcagtcagttatacagatgactttctttttgctttcttggagttgctcagcatacagcccagggttcacagtatatatgtgacagaataaggcagtagaattgttaataaaaaggggggcgtatttggggaagtataagaaactgatataatttaatgatcaactggatacggaggtaaaagagggaaaggactctaggatgtctcaaatgggaaactgagtaagttgttggtgccattacctgagatggggaataaaggaaaaggaaatctgaggggtaagataatgactttggtgtttgggatgcctgtggatatccaggtaaagctggatccaataggcagttggctacagaggtgtgttattcaatagagtagaaactatccacaagtggctacttgggttaaaataaagtaaaattaaaattcaggtccttcagtgcactagccatatttcaaatactcaatagccatctctagccactggctaccctactggatggtacagatatacaacctttcatttttgtaaaaatttatcttgggcaattttgctctaagagcttaggagagtaggtgaagatggagaccagatttgagactgctcagcactcagctgagagttgagctgcagttatggatggataccccaggaagagaaaaatgacaggaataaggtgaggatggaaccctagaaaacatctatatttaatggagatgaagtgaaataaagggctagtgaaggaccctggattgaataacaagaagacaggtaaaataatttgaagataatattgaaaccactaagacctctcagaccacatcttcttattaatttcagcttagtctgtcaaaggcggcaagaagatgtcacaacatttgtactaaggaatgagttaaactctgatggcagaatgtaataatattccaactccttgtttcagttcaagaagtatctttgtgtctctaacagctatctttatgcatacatttttatgtttcactaaattatctgaaggataagaaaaaaaactggtggggagattgttcatcgtcaactaataggtctgaattgaaaaaacagtaaccgtttttgaactcagaagatctaataaagtttatctgaaaaacagagaaaaaggacaaaagtccaaatttaaaaaaaaatcatcacgtagctagaaaagttggtttgttaaaagataacctaaatattcttatattgataaagttgatactgccactcacctggatgaactatttcgagcatactcagctgcaattctcgggaaagtctcatggctctctgtctttgaagttgcaattgtaatttgaggtcctcttcttccttctgcctatttatctccagcaacatctttgatcgtttggatctgtgatggaaacagtgtgttatacataattttcataaatcatatgaaaaaatgcataacctcactagtaatcaaataaatgtaaacagaaaaaattttaagataatttctagtgttaataaggtatgataaaatagcttgtcatctgctgctgttgtgcaatctttctgtagaaatatttgaatatatgcattaaaagtctggaaaaatatttgaaatatataaataaaaagccttaaaagtgatgaccaattaattctattacaaataattttcttaaggaaataatcagatatatatgtaaaaatttatgttcaaaaatgttctccacagtattacaacagtaacaagttgaaaacaaactttgtctcacaacagcgagttggataaacagatactggttcattcacctgatgggatgggattctatgaactatgaaaacataaaatgttcgaagaatatttagtgacatgagaatatactgatgatctaatgtcaggtaaaaggaaaatcaggatatagaagaatgacatcaaaattgtgtcaaaaaacttacatttacttacacaaaaaaaaaataaaaaacattaaaatttcaagtgatttttactgcatgatgtaattacagttgatctttattttcttcttatgcctatttctcaattattgacaactgaacattactttcataactggttatgaaaattttcatgtgaccacaaacattttatataattataatttctgtattatctgcttttattcaccaaaatttctccttagccattcccatctagtttttgttgcttccaatatcactatgtaaggagactacaagtgtcagtttacagtaaatatactcaaaatgctttcagacacccacagaaaaagaaaacgaggataagaagaaaggcagaataaactacttagtttaccgctatagacttaatttgacatgtgtctccctcaagaacattttctcttagatcttttttttaaactgtattcttagaattaaactgtaaacaaatgtggtaccttggctatagctttgtactcttaatagtcagacttcattatagtatagttaggattattatgatttttcaactgaattttcaactcaaaatagtttattttgattttgataaaattttgtgtgcctgtggttgtttctcataaattcttccatcaattacaacttaaattttctctagctttctacttagggcagagtagagaatttatttgttttgaaacttctttcttatccctattatcaagggtagagaagacctcaaaagtgtatgtgtgtcaaaagattccagagaagatctagggctagttgaatagttctaagtgtctcttgctctttgtgaaagctggaaatgaagtaggtaagggcctctcccttcccaaagaatagctgatagcaacttgcctgttctacagaactccatcacctcaaaacttctgggttatacagcatgcagataataatgttttatctcttacccattcatagagggtaaaagagagcaggccctaaacagagcctccttttaaactgatttttaaaaaactacctctgtggccgggcgcggtggttcacgcctgtaatcccagcactttgggaggccaaggtgggtggatcacctgaggtcaggagtttgagaccagcctggccaacatagcgaaaccccatttctactaaaaatacaaaaattagctgggtgtgatggtgtgcacttgtagtcccagctacttgggaggctgaggcaggagcttgaacctgggaggtggaggttgcagtgagccaagatcgtgccactgcactctagcctgagtgacagagtgagactccgcctcaaaacaacaacaacgacaaaaaactacctctgtttctaacttctaattggctatagattataatgtctaatactgcattatcaatattttaaataccattttacactattagtatgaaaaacatagtaatcattaaaattgcatctgctagaatatttaatctgtcagaaaactgggtttgggaaacaatttaggcatgtaggctatcaaatatggcaaaaatgaaaagactatggagcatgaaggtggaagtaaagtacaaaccagaaagacaggacaaaagtgagatttgggccgggcgcggtggctcacgcttgtaatcccagcactttgggaggccgaggcgggtggatcacgaggtcaggagatcgagaccatcctggctaacacggtgaaaccccgtctctactaaaaaataacaaaaaaattagccgggcgtgatggcgggcgcctgtagtcccagctactcgggaggctgaggcaggagaatggtgtgaacccgggaggcggagcttgcagtgagccgagattgcgccactgcactcccgcctgggccacagagcaagactccgtctcaaaaaaaaaaaaaaaaaaaaaagtgagatttggtgatttaaatagggactaaattgtaaacaggtgtgcttattggattcatatgttttactttcatatctgaaaacatttattaggaactgaagtgattttgaatgtaattcccccatttattattaaataacatcgagttattttgttcagagtttctctaatcactcaaaaatcaaacaattattcttccaactggtttctttgtaagaattagtaggcactggaccacctggcatctgtactacacttctgaagatgaaatgactgatcagatgtcatattctgaaataagtaaattccatgatttacatttaatcaatctgaatttttaccattaaagtgggagttgaccaaattttctgctgccaagacactgtgcctcagagggagagagagaaaaaagatgctatctgcatttaagaagctcagtttcaagatgaaatcaacaaatgtaattaaaacacttaaaaatcagcactatgatagaggtaggtaaattgtgaggtttctctaagataactagagcagctgttagccgcttcagaaaaccttgctgaataagagtacttaagagacaaagtttctgaatacgagaaatgactaaataaaaaagaaaccactatgaaagtgcattagcaagggcgtgactataaaagaatgcctcttgctgaatctaaagaacactaatcaacctggacccataagtgtgaccagtgggcagtctctctcccaaaaccatgggaaggggaaattactgagataagtcctgagcacaaaaagacagaaataacctttgaaaaaaaaccaagctacaaaggaagcaagagacatttgcatgaactgttacaactaatagaagagcgaaggtgctgaactggagaaaactgaaaattaaaaaattaaatagaatccaacaggttagaaccgcatttcagtatattctggaacctcaaatgcaaaaatactggaaaggcaacaaacacaaaatgtgagacttaaataatttttgcttcacagcttatctttttaatggaagtatttataactcttctggttacataaagaaagcaatggaatttctattttaaaataatggaatattagattccatagatacacttctaagtagaaaaaaatctgtaatcctgggctacttttaaatagagattttaatattgaaagagagagtatatgagcaaatttgggaactcttgtgggactaaacattaatgctctgaatccatgtataagggtacccttaaatttaagatgacaggtaactaaggatgatagcaggtggaatccataagtaatacctactctatctgaattcaccacagaggcaataccaagagcacctcagatgctttgggtagaaaaatatacactgtgactcaaaaagtactcaatatttcccaaatttatctaaccacagaaatgcttttaaaaaaaaaacagcttgtaagataggcaataaactttgagtaataatagatggataatacttgcttctcattagtactacctatttaatgcatctatttgtttacctagatttgtaaattttcaaggacagaaaatgtgccatatgcatttttccttctatcattttttaagtgccagataatatgctaaaaactttgtattatctcaaattttacattatcttgatcatacaagtgtataaactattattctcattttatagattggaagtttgaggctgagagaggtgggggattgtccaagttcactcaaccagtaagctgctcaagtgagatacaaactcgaatctgttaaatgcctagtacatatatcatatactaggcatttgatatatatttaaaaattaattcttttctttgctaccaacaatattcatgcccaataatatttaaaatccatctttaattcttccctgaagaaaacgttcatcaattaataggatacccactaagagacacagttagctagagtgatttcaatgtcttcaactctgtgactacatagtattttgaaccccagagctatttttaaatgtttttataactgagaaatgcatctgcagttattaaaagaatagtttcagttttctttaaagaattaacttctgtaaaatgccagtttcattttagcaaactaaagcttggctttaagttaggctgcatgaaaaagtcacctctgaaacagatcttctttaccataaattacctagaagctaagttattttttcttgttctgtgaccttggaggatctggattggttaagtcattgcagaaagtgggctatgtcttcagtatttccttttcagtctacttgaaataaatgccgaactatatcataattcaatgaagatatccatccatgccatatttattcaggaaaatcaggttaacagacttaaactcttatacgcatacatgttattgttataattatacacacgaaattatgataactgttggtttagagggtttaataatataactatcattggctccctttgtaggcttggcccctccccaaatatcttattaagtggataggattgcatatttgacacatcagattcctgtcttacatcctttgctttgaaagtgcatctggttactggagtgttggtacccagaaacgtatggaaaaaaaatgaaaagataacaagaaacatactaggaaattaaaaaaaaatcacctaaatttcaattcaactgtactctagtaagattctatgatcatcaatcccctcaccaaatttttttacctgaaactcctctgcaaagcaatcacagcagatggaagcttctttaatctctttcttgtctgaaaacccttccaataggcttgaatcaagcatgctgcttgatgtagtttctgaaatgccgaaaataatttagagatatctctaggaaggtctttaaaaaaaaaaaaaagtttacctcttaaagtatcaggttagggcaaatattaatctctagctctaacaagatgggtaagaatattaaaccttacctcccaaaggaggtatgttaggcttggtaaggcaatttctagaacatactcaagatatagtctagttagctccaaattctcccagaataatctcacttccatttccttttcaaagatttcatagtccgcctgacctttcataatcttttttgagctaacatgttaatgtttttacttaataggcaatcaacctagttaggttcaaactataagctctgttgaccattgtggatggttgctcgaatctctgtttagttctgtaagcttttgatatgctattctcctgatagaccattgggcttaaaaggtcagtgagctgtctgagttcttgactgaattctgtcccagtctcctgtttacttaatagacttctgagtcctcaaatggaatggcaaagggtacaactattaataataaaatatagttttatgattttgttacctaatcaatatgaatttgagcatatgcatagttttgagattaatctaaactcacgatggttcatatatacagaaaaaaggaattcccttcttctgcactcttccttccagcctcccccaacccattctcctgccttactggacttattttcatggtttctgcttgtatttttaaatttattgtctttttggttttggattttggatatacaatgtccccttttccttttaaattaaaaaatatctttagtcattttagatgttttccatatttaagtctttatctggaaatcagaaagcaatatgcctcttcctgttgaatgggctatttagagccatcattttgagtatgctagaggaagtatgatgaaataatcaataacttgctgcctcaaatttctaaataattttattaataccatttcttacacaaaggaaaaggcattattgttgtatctcaaagaacaagaagggtagccataggtaaccataaatacagtttgctacaattagagattttttttggaaaaacagttttaaaagtttaaatagcttatagataaaagaagataaacatcagagatggggctttcatgagaaatgatgaatgaaactgatgtggcagtatttataaacagatgtaaatgggagattgaaattatgttttccagcagattgaatggcggagagatacaattttgtaacattatattttaaagatggggttttgctattttgaccaggctggggtgcagtggctactcatgggtgtgatcatagggcagtctccaattcctggactcaagcaatcctcctgcctcaacctcctgagtaaaaaatttaaagatatttctgttttgggggtattttgcttgaaatcttaagagaaagaaagtgaggaacatttaaggaaaactaaggtttaatatagtcagcaaatatcatgcaattttttttttttgtaacttaatacctgctcttctacttcctgatagaccattgggcttaaaaggccaacaagctgtctaagttcttgactgaattcagtcccagtttcctgtttacttagtagacgtctgagtcctgaaatggaatagcaaaaggtacaactattattataataataaaatatgattttgttatctaatcagtattaatttgaagctaaaaagtctggcttaaaaacaaatgaaaacaagattaatcatatgatttttctttttccttttctcagagaattccaggttgaaatctttaagatattcctccctcctgagaattcttacgtgctcaattgtggtatctgataaaaaaaaaaaaatctgtctagacaatctctttaataaaaaaaaaaaaaaaggagtgggatggaatcactgtggtaaatcaaaaagtagagataaattttttttatttgaacaaaaatacttaaatggagacattttaaagataaattactacagacacatattcagtaaatgcttgccctgtggaagcacttatgcagattattattagtcattattagttgaaaaagattattaaatataaacatatggtaacatatataatttggggcaaatcaataggttcctgggaaaacattataggtgaagtgctacaacactaggatagtacattttcatgccaaaataatacatagtagtagtgaaaggtacaaagtaagtactgtttccagggtacactgaaatgatgtattataatgtgtgtattcaaaataaatacataaggtaaaattgccttgtagtgtataattggggaaaccactatatggatcttttaatgccttatactctcttcaacacccaagttctcagcagtattaataattgtaaaatatcttcaggaatctgaataagttctgctattgagatataagtcaaagaaagggagaaggattcaggtaaaattcctttataacgactctgttggacattcacatttctttaggaattgaattacagaattgaaaaatgtctatctggcacaatatcaactaaagagctctattactggtactttccttctctattcctacaataccctcagtaatgactaattcaaggtacattattacaatgtcttcaaaatcatcaagaatgataaagacctttctagttgtttaggtattaaatgcatcatattatattctaacctttaaaaattcccatacagtataaccctatgttaataagtatatttaatgaactagaatcccatttcctgaccacgctgaataagaaaaatagattataatacatacatggctctggtcagcaaagaaataaaacaaagataacatataactttgcttggcaattaaacaatatatatactacctttgtgatcttgggcaaattaccatgtctctgtttctatatctataaaataaggataagaatatctatcccataggattgttgtaaagattaaacattttaatgcatataaagtatatggaatgtgcctgacacacagtaaatgctcaattaaatgaaagctattatatgagaatgtatatacgcttactccttttatcctcaaaatttctgacttttaattcacatatgtatttgattttggaggtaaggcaattttttttgtttgtttttgaggaaaggcagtgttaagtaattattgatagttcaaaataccataagggccactggcctctcaagcacagctccattttctccactaaagctggtcttgataaggtcactgatctttttggtcattattttactatactatatggtatattcaacacacaaaacctttttgtcagagagggagtaaatatttatggcaacctgatcagaaaagtatcttccacatgctatctgtagtgacatgaagatagcttgattatataaagacttttttttttctgaattggtatctgttgtgagttttatctacataggtcagttatcaactctttaaaatataagaattttgtttttcataaaccatcaataaaaattttctttttgagaatcccaagaaaagaaagaatgaatgtactacctttgtagcaggtactttgtctcagtaaaatcaaaatttcctgatgggattcagccatcaacagtaggagttttgtagcagtacttcttataactggactaggagttgaaaaaagcttgaaaataacttcatctaaaattgaatacagggcttttcttcctattctgagtaaatcaccactaatagaacaaaataaaaaaaaaagtaccattactaattgatgtacaggtatcacaacaaatctaaaatataagattcagtaacttgatgccggactgtgtcctgatccaagaatataaccactttttcaaatatatgttggttccaagaagatatcatattcagtcacttaatatttattgaattcctactgtgtgcaaggtgccatgtgtgctaggtacaatagagaatacaaagtagccaaaggccttctccttagagaagcctgcaatcaaatcaaggatgaaatataaatgtgcaaaatactaaacaataaataatttaaaagcttcaaggcaatgataaaagtgaaatcaagacaggtacacagttaatttttaaatgatgtacaaagacaaaaatgccataggaattctatcatgtgcttaatataggagaaacttaaaatctttccttggtatttccttcattatactaacaacccatcttgtattactgatgttgtgaaaaattatctaaaacttagaaatagtcaaaaggaaagggttagtgagtatccttttatttacccccttaaggagttatgtgattttctaggcgtatgtacctctgtttaattttctactcactattaaaatactttacaattctgtaaaaatagaggttggctggtagaaaacaatgctaaagattcttatctaagagcaatgtaaacagactcttattcaaagcaatacaaatgatttctgtccagtagaaaaggtaattctagaagctacattgctttataagtcatattttcctattagcaaattttaaaaatctatcagcaaatttacttctacatttcttcgacaaaccaactccataaatctattttcctcaaattctcctttgaccctgtataaatatcttatttgttccctcattaatgagttgcataaaattttgagcagtcaaattttatatttgtataagactcatgtttgagctttttgaaaattgtactttagtagttactaaaataattttgttaagagaaaagagatcagcaacataccttaaatgtaaaaatctctgagttgaaagactttataaagttatccaatcaaaatatgtgagaatctttgtgacatctacttctgtgccactgtgtctcttacatgctattccctatgcctaggatgctcaccctgtcccatcagtcaatgtcatcacactattcaaaactcagattaaaaaatatgctcatctcagaaagccttctacagatatccctatcccaatcttatcacatctttactccatatcccaccaagagtttgtgctataatgtaatacagtagtttaaatgcttttagatgctcttcaacctcctaatcttaaagacatcctctctataccactaccatcttatctctctgcttctcttctaatccaatttctgttgccactatctcacatctcatttctcaaaccactgcatctagttttcattttttactatttcactatactatccttgataagttcatcagtataacttcccaaatgtcaagtcacatatataccataagtgattcttttcctagacttgtttgtatctgatactttctacttactcagcttctgtgatacaaagttctggtctcccctctaccttccacccatacttttctgaccattctttttcatttgtctttgtgggctccacttccccagtataaccctaaaaggttattccccaagactccattttcaagccatttattttctcattgtattcacacttcctactaatctcactttctgtcatgtttttctctaccatgtataagctgatttgtaaatctgtaactctagtcccaatctcttccagaagttagtttacctattcacctgatggacatttgagttttagctagtccttgtttttcacaaataaagctcaatgaacatttgtgtataagtctttatatagatacttacttttactgcatgttgaactacctatactcaacataaccaacattgaattaatcatctgtctcacaaaaccaacttcttatatattccacataccacagtctaatcacccaatacagaaaacttggtatcatatctgactgcaccatttattttatctaccccatatcaaaacattcaccaagtcatcataatttttgttttaaacagctttttaaaaatataattgatatacaacaaactgcatatatgtaaagcatataatttcatcagtttgacatgtttcaccaacataaaacaagaaaatgaatatatctatcacccctaaaagcttccttgtatttcattgtagttcctcccttgttgccttccctatcattctatgcccaggaaaccaccgatctgctttctgagaaagttcccttgtattactactttgctgcaaggcctttttttttttttttttttttaattaaaatcagggctagataatggattttgtcaaaagctttttctgtatctactgatatgatggtatgttttttccatttttagcttgttaacataagttacaatgactgacttcagaatattaaaccagccctgaatgccgggataaaccagaattattcatgacgtattaactttttaatatattgttgaatttgacttataaaattttgttcagaacatttctatctatgtttatgaatatactgatgagtagttttcttttcttataatgtctttgtttggttttggtatcaggataatgctgaccttatagaatgagttgtaagtgtttcctccttttcgattttctagaaaagtttgcttaagattattatttcttcctgaagtgcttaatagaattcacagtgaaaaagccatccagacctggagttctctttgtgggaaggtttttagctacaaattcaatttttttttatagctatctagagtatatttgggttctctattgctccttgagtaaattttggtagtttgcgtctttcaataaatttgtccatttgatctaagttgttaaatttataagcataaagttgtttatattattcccttgtgatatttttagtatttgtagactctgttacgatgttacctctctaattcctgagattggtcatttgtattatgtcttttcctttccatattaatcttgctacaggtttcttctcaaagagccagtttatggtttgttttctcaaaaaacttcaatcttcccaaagatccagtttatggtttatttctctatcacgtttgcttagaattttattgatttctgctcaacctttatcattttctttcttctgcttagagtttaattcccccttcttttcctagtttcttaaaggggaaagccgaggtcaatgatttgagatttttcttcttttctaatatataggcattagtgatataaatttcccctaagtatcattctgctttaattaagaatttccccagaaattctcatgttgtttttatttccattcatttaaaaataatttctaatttcacttttgatttctcctttgtcttgtgagttatttagatgaatgttattatttcccacatatttggggacttttcagagatcttcttggcatcaatttccaacttaattccatcgaggccagagaacatactttgtataactgaaatccttttacgttgcttttttcttttttttgagacagggtcttgctctgttgcctaggctggagtgtagtgatgtgatctcaactcaccgtaacctctgcttcctgggctcaagagattctcccacctcagcatcccaagtagctgggactagaggcacctgccaccatgcccagctaattttttgtactttttgtagagatggggttttgccatgctgcccaggctggtctggatctcctggacttaagtgatctgctcacctcagcaaagtgctgagattacaggtgtgagccaccgtgcccggccccttttgtgtttcttgagactttatttatggctcggaatatgcacccttctttgtaaatgttccatctgcatttgaaaagaacatgtattctgctactgtttggtagaatatttgtaaaatgtcaatcaggtcagattggttgatattattgttcaaatctgtggtcatactaatttttttgtctacttattctattaaatatcaaaagaggtatattaacatcttttgctttaattgaggatttctccttgtagttcttgtcaatttttgcttgtgtattttaaaactctattaggtcaataaacacatccttttgatgaactgactttttttatgattatgaaataaccttctttagcactagaaatattctttgttctgtaacttactttatctgatactaatacaggtacttcaactttctgtggtataagcacggtatatcttgttccaccccattacttttaacctacttgtgtctttatatctaaggtgcatttctggtagacagcatatagtaggcttgtactttttaaatccaatctgtcaatctgtcttttaactttagtttttccacatttacatctaagatagataggtttaaatctaccacttggttttgtttctcctttgttcttcttttttttttacttccttcttctggattgcgtattttttaatgattaatttttattgcctttgttggcttatcagctgtaaattctttgttttgctattttcttcactgctttgaggttcaaagtatacatttcaatttctcacagtcttatcacttatcacagtgatattataccacttcatgtatagtataagagtcttacatcagtatacttccatttatctcctcccagccttaatgcccttttggaatacattctacttatacatatgttcctcaaatacagcattatttttgtgtaggcaaacatattatagatatattaaaataatataagaaaaactatcttatatgtttatgtaatcaccatttccgatactctatttctttgtgtagatgaatttcccttctgatggaaggacttccttgaatattttttgtagtgttggtctgctggtgatttctgaagaagtatttcatctttgcttttgaatatatttctgctgagcatgtaattctaatttgacagttttctttttcagtattcaactgtctttttacttgtgttgtttctgataagaaagttgctgtcatccttatctctatttctctatataatgttttttcatctctggttgcttttaagatttttctctttatcactggtttgagcattttgattacgatgtgcctcaatgtggaattttcttcatatttattgccctcagggtttgacgacctttttgcatctgcatgtttatagttttcatcaaatttggaaaatgttaagtcattacttcttcacacatttttttgtgaccctactgcctgctttacgtactctgattacacttatgtaaggttgctcaagttgtcccacagttcactgatatgcttttctttcctcttgtttcttctttgtttcattttggatagtttctactgatacgccttaaagttcactaatctgcaatgttaatctgctgttaatcccatccagtgtatttttcatctcagatattgtagatttcatgtctagaaattcactttgagtcttatatgtctgtattcaactttttaaatatatggagtatggttataataactagtgtccttgtctgttaattccaacatatgtaccagtcttgattaattcttctcattttagatcctgttttcttgtttatttgcatgcccagtacttcagtaccagtaaaatcaaatcacccgttgaatcgtagtatgttttgtagcatagtcatgactgtataatctatcatgtatcagtactgcaagatacatgcagtactgcaagtagttatcagtaactgcaagaaatagtcattttacagtaataaagaaatagaaaaaaagagtcatcaaagcaaatattctatgatggcacaagtgggatttttctcatcctttttaaagccaaatcgaaggatagccatttctagtgaacttcctacctttgtataacctacaataaaattaattttaaaatacagccaggttcaataaccacatgcagttaagttacttggaaacagtttgacccttttgggtcttgcttttatgatctggaatagtgctcattctaatgctaattattcctcactactggagtaaaaccttcctgaacactctacccaatgacgcactgtttatgaggctttccagtttggctgttggaaacaggcactatttctggccctgtgtgagctccttgcactgttccttttaatccttttggattattgttttccctggcattgggtattccttacaatgtgcagatcagtactctacttaatacttgaaggataccctctgcagatctctggggttctctacatgtatagctctcttctctagtattctgacttgtgaactctagttatcttgttctctccagactctgagctctatcacttcaactcaagctggctgggatgcctctccctatacttcaacctggaaactctctcaatactgtaagttagagcaattgtaagattcaccttgtttattcctttttctctgggcttactttctttcactgactgatacccagtttctcaaaaaattatgtgtcatgtttttgtcctttttttcaggtgggaggataaatgcatccctactattccatcttgatcagaagtggaagtaaagtcctgatgattttaattcattattttaaaacctccatatcccaggtaccaatgcccaaggacaagttatcattacttcacttggattagtatgattgccttttgtgtctagagttttcttccccttaatctaccttcacatagtcaccagagtaacaaaattgaaatgtaatctgaccactttcgtctactttaaaaatcttcaatggtccccgttgcctataggattagactccgtttcctcaacacagcatataaattcttcatgactttgagtctcagccgagcttgctagtcacctccctatatggaactttatatcccaacaataatgaatttgtacctacttttcatcctcagcatgttgtttcttatctctgtgcttttgtttatgttgcctggaattactgctttctctttctcctcttcctccctggccaatataccatccttgaagtttcatctcagatattaccttctccaggaagcacctcccctcggtttgggttagaaggtcctttaacatttatggtcacttttaatattgtaatttaatgtatacaatgatgtttgtgttttccattctattgtaagctctttgaagacaaggtttatatcttaatcaactctataattgcaatgacagacagcagctgcataataaattcatactaaactgaaagaatggattatttcaattgtgtatactctgcccttccatgttaccctgaataattgccaattgcttcttttatacccttcttgagcatctgtaaaaataccaagcttgaagtttattaaataaatgtgattaaacattttttgttgtgatctcaatatttttcttcagattatcacactaattctcttctttaagcctgagatttgagctaaaaatcttaagctctggtataaggtatcaatttaataataaatttccagtcttttgtagtattttatattaatttttctgaaagacaatggtgatggaacttcagcattatatacaagtatatagtgcatatacttgtatatacattatatacgagtatatagtgcatatacttgtatatacattatatacaaatcatatgcggtcaattttagcaaaattggaataaaattggtaatgcttctgataaaaaaaaagcagtaacattttgtaaaaaccaagtcacctgttgatctgtagtatattctgtagcatcatcatgactgcagatcctatttggacattgtcagcttgcagtaaatgtaagaaatgatcactttgtagtactaaaggaaaagaaaaaaaaagaaagattaaagtaaagattttatgataacaaaggaagattttgttcttttcaaaccaaatcaaagcatgaccatctctgctaaactttctgactttgtagactctacgataaagaagactttaagatgtaaaattcatggcaattttaaatagcgataaataagtcatttcatttttatgaatatagtcagaaaataggcataaatactaagctaagaatctattgttatctctttaaattgaaaatatcatatcctaaatctgaatctttttcttctatcaatgaatttcagtgaataaaaacaaatttcctgcaaagacagaatataaggaaacggaaatggcacagatgactataattggttgctcacaaccttaaaaaatttaattttgtgacatattgttttatataataatgaatacgctaactacaaaaatttccttttattgatttgtaatctttaagctctgagcagccagttataacgatttagcactggatacttatacaagttgcttaacctcttagaaaccatttcttcatctgtaaaactagaaataatagctctcacatgagctaatgtaaaatatcctagaacagggaacatttctaataaatgtcagtttccattccattccatgctcaataactgagcataactaccaaaggtattagttatactaactgaacgtagttgcctttggaaaatgggaaatggagtgggcatgagggtcagggattgtgtgtgttttaatgatccttacagaactatttgactctttaaattatgtgcatgcaatgattctgaggagaaaagcttaaagtaaaatttcagttcaagtattacttaaaaaatattcttaagagtgttacatctatattagatgaaatttttctagggagagcaccatgaatgtaactaagaattattttttcagtcttaagaaaacataaaactcatacatgtttatatctctcaatgtaaacagaaatatcctataacttccaagtttactaaaaggtcattaaataaaagcttactcttacttggatagttagactatatgagttaaatcatatccaccctgaacatagggatttctctcatgataggtctaaaacactgactgtaatcttttaaacttaaaagttatttttaggaataaactgctcaaattatcatttgtctttatcttagatttgctaaacagaaaaagctaaagttttatttcaacagtattctccttaatttaatattcacattgttgatgtaggctatgtaaaactggaatatccattttaaaaaattgtgagcttatttcaacatggtttcatttcagtgtggttatctgcacagttcatgtggcatttgtttttggaaaaaacgatcaaactgttagcagttgactctacaatagctattagttacattaaaatcttttctcttaccattctgaataagttcaacatggcctcccaaaagccagaagagagaatcagtcacaatttggaaaaagtgtagtaattcatctttttcttcagccttaacataaaagataagcccagtttacttttctatagtttttttccttttttttttttttaaggagacttctctctggggagttagaggatacagtttctggatctaacttagctatttatgagggacatgattttgttgcctttagtttcttaatttgtaaaacttgtggttacaggatagtaatatctactagaaatggttgttatccagataaaataaaacaacataagtagtgtaagggctacaagttgatacactaggatgtcttaatacttgctatgcatcagaatcacctgttgagctttttaaatacatctatgcacaagctttagttcaaatatactgaatttgaatctccaaaggcagtctggatatctgtacttgcacaaagttaggtggttgatttggttttacaacttgggtgaaaataactgcaatatgcaaatgtagatgtcagcatgagaagcattattaatagtgtatttcagttccagtttctactcataagtttaggagggcaaagatcgtgtcatttagctccccatacaaactcagtttctaggacagttctgacacatagtaaatgttcaatcaacatttagtcaacaaataaatgacagttttttctggctcttcctttctggaaagtagggtgagaaattattataaattagagtgccacaaggagaaataagaagtatagattccatttacaattttgtcatttattggccatgtaactttagtggaatgttggataaaggtcactaatcttatccatgtcctgaatgtttgtactatagcacaaaagtaatgatgagacccgcaaaaatattatgattgccatgattattctttataataatgaaagtatttttttcctaatatcctaggaatattctaggacaagtgctgacttgaatataacaatggaaaaaaaaaaaacccataagaaacgtcacattagagcaagaatccttttatccttttagttcaggaagctacctttgccagagttttacctaaagatacatcagaaagggcatggtaattctcattgttgtcaatcccaaaagatagtgttgtactcttagacttcctactttccttaaaatgcacattagataatgtcacccacaaattcatggttcttgaggcaggttaacaaaatttacctttaaatcgaaattctcacatatactcacacaaaaccactttgtattttaggtcagaacgtgtatgtcccaccatatgatctactaactatgtactatctaattaaaacaaaaatctgattgaaaagctcctaggtaaatagactaataaattaattcaagtttttgccacatcttttttatgcccctgttttaattttgccctgtggttaagtggccttactttttctgtagccaattaattcttggataacattaaagaatctttatctcaataaaaatacaataataaaggacagaaaaatattatgaaaagtattaaggattctataaatgaaaataattaactgaataagtatatttataatgaaagtaatatacaaatacataacatattaatacataattttaataatatataaggaaaaagaattattaatgctcttaaataggaatattaaataaaggtgctttgaagaaaagataaagcttacataatggtctgagctattaatgggacagaaattattttacaaatgaggaaaatgagatacagtgaaatccagtgatttgctatagaacctagagttagtttgtggcacagccagcaaaagaaatcaaatccaacacaattcctatagtttatgtggcttcaactaacctgaattaaactaaatctagcaaatatttatttagtgctaacatcccacaaaatgccagtggagatatcagaaatggaatttgtaacctgttacatggaacacatatgctctaccactgagttaaattctctgccagggggatctggcaagatggttgaagaggaacagctctggtctgaagctctcagcaatagcaatgcagaaggcagtgattctgcatttccaactgaggtacccagttcatctcattgggactggttagacaatgggcgcagcccacagatggcaagcagaagcagagtggggcattgcctcacctgggaagtgcaaggggctggggacctccctcccctagccaagggaagggagggactgtgctatctggcccagatactacgtttttcccatggtttttgcaacccacagaccaggagattccctgtgtgcctaaaccaccagggccctgggtttcaagcacaaaactggtcagctgtttgggcagacactgagctagctgcacgagtttctttttgtacctcagtggtggctaaaaccccagcaagacagactgttcactcccctggaaaggggtctgaaaccaaggagccaagaggtcttgttcagcgggtcccactcccacggagaccagcaagctaagaaccattgccttgaaattctcgctcccagcacaacagtctgaagtcgaccaacctgggacaactgagcttggtggtgggaagggcatccaccattactgaggcttgagtcggcagttttcccctcacagtgttaaggaagccactgggaagtttggactgggtggaactcactgcagcacagcaaggcagctgtggccagactgcctctctagattcctcctcactgggcaagtcatctctgaaacaaaggcagcagccccagtaagaggcttatacataaaactcccatctccctgggacagcgcacctggggacaggggagactgtgggtgcagtttcagcagacttaaatgttcctgcctgccagcgctgaagagagcggcgcatctcccagcacagttgatatactgaatttgaatttgttagtgctagagctctgctaaggaacagaatgcctcctcaagtgggtccctgaccctgtgcctccagactgggagacacctccaaacaggagagctctggcaggaatcaggcaggtgccactctgagacgaagcttccagaggaaggaggtgtgagtaatatttgctgttctacagcctctgctgctgatacccaggcaaacagggtctggagtggacctccagcaaactccagcagacctgcagaagagggacctgttagaaggaaaactaacaaacagaaagcaataacatcaacatcaacaaaaaggacacccacacaaaatccccatccaaaggtcatcagcatcgaagatcaaaggtagacaaatccatgaagatgaggaaaaaccagcacaaaaaggctgaacattccaaaaaccagaacgcctcttctccaccaaatgatcgcgattcctccccagcaagggcaaaaactggactgagaatgagtttgataattaacaaaagtaggcttcggaaggtgggtaataacaaactcctctgagctgaaggagcatgttctaacccagtgtaaggaagctaagaacattgaaaaaaggttagacaaattgctaactagaataaccagtttaggagaacataaatgacctgatggagctgaaaaacacagcatgagaacttcatgaagcatacacaagtatcaatagccaaattgatctagcagaaggaaggatataagagaatgaagatcaacttaatgaaataaagtgtgaagacaagattagagaaagaagaatgaaaagaaatgaacaaagcctccaaggaatatggaactatgtgaaaagacaaacatacgattgcttggtgtacctgaaggtgatggggagaatggaaccaagttggaaaacacttcaggatattatccaggagaacatccccaacctagcaagacaagccaacattcaaattcaagaaatacagagaataccactaagatactcctcgagaatagtaaccccaacacacttaattgtcagattctccaaggttgaaatgaaggaaaaaaatcttaggggcagccagagagaaaggtcaggttacctacaaagggaagcccatcagactaacagcggatgtctctgcagaaaccctacaagccaaaagagagtgggggccaataatctacactcttaaagaaaataattttcaacctagaatttcatatctagccaaactaagcttatgaagcttatgaaggagaaataaaatcctttatagacaagcaaatgctgagagattttgtcaccaccagggctgccttacaagagtcctgaaggaagcactaaatatggaaattaaaaactggtaccaaccactgcaaaagcataccaaaatacaaagccccatgacactatgaagaaactgcatcaactaatgtgcaaaataaccagccagcatcataatgacaggatcaaattcacacataacaatattaaccttaaatgtaaatgggctacatgccccaattaaaagacacagactggcaaattgtataaactgtctaaacccatctgtgtgctgtattcaggagacccatctcacatgcaaatacacacataggctcaaaataaagggatgcaggaatatttaccaagcaaatggaaagcaaaaaaaagcaggagttgcaatcctagtctctgataagacagactttaaaccaacaaagatcaaaaaagacaaagaagggcattatgtaatggtaaagggatcaatgcaacaaaaagagctaactatcctaaatatatattcacccaatacaggagcacccagattcataaagcaaattcttagagaccgacaaagagacttagactcccacacaataatagtgagagactttaacaccccactgtcaatattagacagatcaatgagacagaaaattaacaaggatattcaggactcgaactcagctctggaccaagcggacctaatagacatctacagaactctccaccccaaataaatagaatatacattcttcttagcaccacatcgcacttattctaaaatcgaccacataattggaagtaaaacactcctcagcaaatgcaaaagaacagaaatcataacaaacagtctcagtccacggtgcaatcaaattagaactcaggattaagaaactcactcaaaaccacacaattacatggaaacggcacaagctgctcctgaatgagtactgggtaaataaccaaaggcagaaataaataagttatttgaaaccaatgagaacaaagacacaatgtgccagaatctctgggactcagctagaacagtgtgtagagggaaatttacagcactaaatgcccacaggagaaagtgggaaagatctaaaatcgacaccctaacatcacaattaagagaactagagaagcaagagcaaacaaattcaaaagctagcagaagacaagaaataactaagattagagcagaactgaaggagatagagacacgaaaaacccttcaaaaaatcaatgaatccaggagctggttttctgaaaagattaacaaaatagaccgctagccagactaataaaaaagaaaggcgagaagaatcagatagacacaataaaaaatgataaaggggatatcaccactgatcccacagaaatacaaacatcagagaatactataaacacctctacacaaataaactagaaaatctagaagaaatggacaaattcctggacacatacaccctcccaagactaaaccaggaagaagctgaatccctgaatagaccaataacaagttctgaaattgaggcagtaattaatggcctaccaaccaaaaaaagcccaggaccagacggattcacagctgaattctaccagaggtacaaagaggagctggtaccattccttctgaaactattccaaacaatacaaaaagagggactcctccctaactcattttctgagagcaggatcatcctgataccaaaacctgtcacagacaccacaaaaaaagaaaatttcaggccagtatctctcatgaacatcaatgcgaaaatcctcaataaaatactggcaaaccgaatccagcagcacatcaaaaaacttatcaactatgattaagtcggcttcatcactcaatgcaaggatggtttaacacatgcaaatcaataaaagtaatccatcacataaacagaaccaatgacaaaaatcacatgattatttcaatagatgcagaaaaggccgccaataaaattcaacaccccattcatgctaaaaactctcaatgaactaggtatcgatggaacatatctcaaaacaataataactatttatgagaaacccacagccaacatcacactgaatgggcaaaagctggaagcattcccttagaaaaccagcacaagacaaagatgcccactctctccacccctattcaacatagtattggatgttctggccagggcaatcaggcaggagaaagaaagtgtattcgaataggaagagagaaagtcaaattgtctctgattgcagatgatatgactgtatatttagaaaaccccatcgtctcagcccaaaacctccttaagctgataagcaacttcagcaaagtctcaagatacaaaaccaatctgcaaaaatcacaagcattcctatacaccaatgatagacaaacacagagacaaatcataagtgaattcccattcacaattgctacaaacagaataaaatacctaggaatacaacttacaagggacatgaaggacctcttcaaggataactacaaaacactgctcaaggaaataacagaggacacaaacaaatggaaaaaaaattccatgcttatggatagaaagaatcaatatcgtgaagatggccatactgcccaaagtaatttatagattcaatgctatttccatcaaactaccattgactttcttcacagatttagaaaaaactactttacatttcatgtggaaccaaaaaaaaaaaaaaaaaaaagagcccgtatagccaagacaatcctaagcaaaaagaacaaagctggaggcatcatgctacctgacttcaaactatacaaggctacaataaccaaaacagcatggtactggtatcaaaacacatatatagaccaatggaacagaacagaggcctcagaaataacaccacacatctacaaccatctgatctttgacaaacctgacaaaaacaagaaatagggaaaggattccctatttaataaatggtgctgggaaaactggctagccatacgcagaaaactgaaactggaccccttccttacatcttatatgaaaattaactcaagatggattaaagacttacacataagacctaaaaccatacaaaccctagaagaaaacctaggcaataccattcaggacataggcataggcaaagatttcatggctaaaacacaaaaagcaattgcagcaaaagccaaaatagacaaatggaatctaattaaactaaagagcttctgcatggcaaaagaaactatcatcagagtgaacaggcaacctacagaataggaaaaaatttttgcaatctacccatctgatgaaggtcaaatatcaagaatctaaaaggaacttaaacaaatttacaagaaaaaaaaccatcaaaaagtgggtgaaggatatgaatagacacttctcaaaagaaggcatctatggggccaacaaacatatgaaaaaaagctcatcattactggtcactagagaaatgcaaatcaaaaccacaatgagataccctctcactccagttagagtggcgatcattaaaaagtcaggaaacaacagatgctggagaggatgtggagaaataggaacgcttttacactgttggtgggaatgtaagttcaaccactgtggaagacagtgtggcgactgctcaaggatctagaatcagaaataccatttgacccagctattccattactggatatatacccaaaggattataaatcattctactataaagacacatgcacacgtatgtttactgcagcactatttacaacagcaaagtcttggaaccaaaccaaatgcccatcaatgatagattggacaaagaaatgtggcacatatacaccatggaatactatgcagccataaaaaagaatgagttcatgtcctttgcagggacatggatgaaggtggaaaccatcattctcagcaaactaacacaggaacagaaaaccaaacactgcatgttctcactcataagcgggagttgaacaatgagaacacatggacacagggaggggaacatcacacactgtggcctgtcagggggtagggagcaaggggagggatagcattaggacaaatacctaatgcatgcagggcttaaaacctacatgacgagttgatgggtacagcaaaccaccatggcacatgtatacccatgtaacaaacctggacatccagcacatatatcccagaactgaaagtataataaaaaaaaaagaaaagaaaagaaaaagaaattgtctgccaacagtatttcttatactcaaagcagcaggttgtctgtactattatacctctcattcaatttcattcttctaattaaagaaaaattcttaaactaaaaatacatctattttaggttttctattaaaaatggctaagaccttttctactctattagcctgggaattccttaaatgtaagactgtgtctattctttatatactcaaagcaccataaatagaacttaatataacctggtgatcattatggactgtttgtgtccctgaaaactcatatgttgaaaccctaacctctaatgtgatggtggagactttggaggtgtagattgggtcatgatggtggtgtcctcaggatgggattagtgcccttataagaaagaaagaaagaaggaaaagacatgaaagagacaagagagctccctctccctctccacacaaacacaagcaggaggtcatgtgagcacacaagagagtggctgtctgcaagccaggaagtgggccccatgaggaagtggatctgttggcttcttgatcttggacttcttagtctccagaactataagaaataaatgtctttaagtcaccaagtctatggtattttgttacagcagcctgaacagagtaagtcaagtgactgagttattaatatctgtccataattgacaacagttgtgaatctgctcaagctctgatatagtagtaggcccaaatgtacatatagccaagaactcttctaaggtaaaggagtttcagccttgtagacttatcacttcttataaattctaagatgaacctctgctgtcaaaaggtaaaaatagtttgcatattaatataatgtattcattaatgcccagttccactcttctcattacttatttttggattcccacttgcgggtacctagtgaggaaatatcattttttaaaaaatcaaatgacagcttggagcaaaataatcctgctacattccccatatggagctaagaaactgtcttcaaacagggatgccaaaagaagagagaagcatgtaagtaaaccggacttagggcagggcccagcagctagaagtcaaggtagtactaaagacatgtgagcttgtagttattagacaacttgaagatagagcccaaaggagagagtaaacacttttaggaaaaacaaacaagaaaacaagcaagagactgattgataattgataagtattaccaaaaaaacctgaacagattttaaaagagagattataatatctatatgtcaaatgcatgcaggtgcaggcaataaaggtcagaagatgaccacgaataagaaccagaaaggcacctagaatcagtgtgtaaatgaagaaaaagttaaatttagaaggcagtcagaagctaggcattcagacaaagcttaagaggacctaaatctgaagctaagtaaataaactggaaatatgttgtgagggtggaagcaaacagcaacttttaaaagcgcctttcaataaggaaaatcaacttaaagttagagaactgtgtttaaaattacttaaagcagtggtctctaaccttttttgcaccagggaccggtttcatggaagataatttctccatgaactagggggtcaaggggaaggatgttttggggatgattcaagcccattacatttattgtgtgctttatttatattattattacattgtaatacataatgaaataattatacaactcaccataatgtagaatcagtagaagccctgagcgtgttttcctgcaactaaagagtctcatctgagagtgatgggagacagtgacaaatcatcaggcattagattctcataatgagcctgcaacctagatccctcacctgcacagttcacaataggatttatgctcttatgagaatctaatgttaccgctgatctgacaggaggcagagctcaggcggtaatgtgagcaatggggagtggctgtaaatacagatgaagctttgctcactcacttgcccgtcacttacttcctcctgtgtggctgggtttctgacaggccatggatgagtactagtctgtggcctgggggctggggacccctgacataaagaataatgcaataagtacctaaaagtatctagttattcatatttttaatatcttatacccaattatgtacttattaaacatagtaattaatgattaataattatgctttttcaactttattagtcttgttttaagagaatgagcatacctgaaacaaatatcatgctgaattttgaatgatttttactcatgagtaatctaactctatagtgttgccatccaatagaaatataatgtgagccatctagataatgttaagttttctagtagcaatgtttttaaagagtaaaaagaaataggtaaaacaaataacaatatattttatattagcatttttagcatggaatatatataaaaaatttttggtatttctttgaaatctggtgaatatttatacttggagcagatctctacttggaggctaaattttcattagaaattcttggtatgtatttagattttataaaacttacagttgtaaaagtagattcacatactcaagttgttccaaacacacttaagtttcctaacagaattgatcatcaatttttaaatttaaaataattaaaattaaataaaattttcagtctcagttacaaaggtacatttcaattgctcaactgatacacagggttaatggctaccatattataccatgcagaacagaccatgaggccatgtactagacatcactacttaaattatttaaatggcaggtagagcacctagcaaattcatctcttcgagatgacaaatatttattaaaaaattaaaaatggcctcaacttctttgccttcagttttcttcatccatctagcatattgagccataattcctcaatttgcccaaatacattgcatctatgtcagacatctctaaggctctgaacacagccttcagatattatctctacaccacatccctaggaaagctcatcctctagtatgctcctcttcaaagttttaattagcattcataagaggactttccaacctatagccatagtcctgatctctcaatccaacttcaattccatcctagacatttccacttgaaaatgcaactaacttcaaagggattgcatcctttttcccagtttttacctctggcttatcacttctcttaaacatctgtagggccttgaaaccttagactcaacttagactcatcattaatatattatatattatctgtataaaagcagtgtctgatagtacaccttttatattcttacaatttttttcttaatatttcatttgaccctctatttttccaaagtcatagtgagtcaagacacttattaccttagttcttctagcttactacaataatttaaaatggtctcttcttccgctctctccagcatactcttatgtctcctcaaaaaaaaaagcctcttcactatcgtagaatcaagttcaaactttttctgttttttccttttttttctttttttctttttttttaaagagataggatcttgctctgttgccaaagctggtgtgcggtgacgtgatcatagctcactgcagccgtgagctcctgggctcaagcaatcctcctgccttagcctcctgagtagctaggaagacaggcatgtgcaaccacacttggctaggtcttgctatgttgcccaggttggtcttgaactcctggggtcaagtgatcctgccatctcagcctcccaaagtgctgggattatacaggcgtgagccactgcatctggccttcaatctttctgaatgagaatactctatctaactctggtaggaatctgcactgggactcaaagatgtcatacttattcctctttcctggtcttgtccatttccgctgcctgtaatgccctcatatttccaaatctcatccatgctttagagatagatagaccaggtaccattggctccacaaagctttttggaatcactcttgttcacattggttgttccctactcttcccctttatagaacttactttcctgttagttgtgggccagaaaatattttaggcattatagtctctagaaactactgaactctgtggctatagtgaaagtagtcatggataatataaacaaataggtgcagctgtgttccaatacaacttaatttttaaaaataagctggatttagcccacaggccatagtttgttgacctaagcttttgctgaccaaatgtataaactcgggaaaaaatataaaaagcaactgtttgaaggttttagatagcaagcaaaggcacacagacatgatcctgaaataaaatgtactgactgaaatctaaatttatcttgtgtgattgtcaaagatattctgggtgtttctgtaagggtatttttagatgagtttaacatttaaatttttagtctgagtaaagcagattgctttccttaatgtgggtgggcctcatacaatcagttgagggcttgagtagaacaaaagattgaccctctcccacataaagggaaattcctcttgcctgactgcctttgagttgggacatcagtatttcctgacttcagactcaaactgaaacactgcttcttcatggatctcgagtctgctggcatttggactagcactatgctatcagttctcctgattctaaggcctttaaactcagactataccatcagctctcctgggtctctagcttaccaactgcaaatctcaggacttgttagcttccataattgccaattccttataatcaagcactttctctttctttctctctctccatatatcttctattggttctgtttttctggagagacctgactaatatgcctggcttttcccagtgtgtgtttatcaacatagggaaagagttcaaataagaagttgcagtataacttggctgaggagtcagaatttggagcttggggctgccagaacagttaaagaagtgatccacaaagtacagagcttcaaaatctatatacaaacttccattgaattcttgactcttaaactgtacatatgagagaaaaggctccacggagcccagaagaatctacagctgaaaggctgaaagaaattaccagcaatttcatcttttgcctagtgctgggtatacagagtttggagtttaggttcttccaagtcagatggtctgggttaacatggtgggctttccatttaaaccacagaaggatctcaccttaggtataaggactgtgaaccaggactaagggcaatactctaatggcaaaactgaagtaaacctctccaaagaaaggctaaaaccaagcctccacaggaacaattgatctgccagaatttaactgctctcaagtcttcagaggaagatacgaatttctacaatgtgtcattcacagttaccattataaaacaaaaaattaacagagatgtgaagaagcagaaaaatttgacccagataatttgacccagagaaaaaacagataataaaaagactctcaaatgatccaggtattggatttataaacaacaacttaaaaataactataataaatatggtaaacaatcaataagagaagcaaataaaaatcatagaacaatacaatatatgaaatgaaaaattcactaggtaggattattagcacattagacactgtagaagatagggtcagtgtacttgaagacagaacaatagaaattatcgaaactgaagtaaacaacaacaagaaaaggatgaaggcagcctcaacaaccagaagtcccagagtgaaggtagagagaatagggcaaacaaaagtatttgaaaaaatattagctgaaaattttcttaatatgaatacattaactcagacacatgaaactcaggacctccaagcaagatagacatcaggaaatctacaacaaggttcatcaaagtaaaattgctgaaaataaaacaaaataaaccaaacaaagagaacatcttaaaaaagccaaagataaaaaggtgcaatatgtataggagaatgacaagaagaatgaaggctgaatttacatcagaaacaaaagatgccagaagacaatggaaaaaaatctttaaagtgcaaaaagaggaaaaaaaattgatgaagtagaattatacacatgcaacagaaatattcctcaaaagtgaaggcatcatgaagacattttcagataaccaaaaagctgagagaattcattaccagcagaattgcactgtaagatatgctaaaggaggttgtcaggcttaaaggaaatgataccaaatgaaaattcagatctgtttgaaggaataaagacaaccagacatagtagatataaaaaaatcatttttctttcatttctttaaattattgaaaagtcaatacactatttaaagtaaaaataacacatggtagatttcataatatatgtaaaagtaaaatacatgacaaaatagcacaaaagatagaaactgggaacaaatttcttaaaaatagcaaaatggtagaattaaacctaaccatagcacaaattagattaaatgcaagtaaatgataccctttaaaacaacagcttgtcagactagatgaaaaagcaagacctgacaatacgctatttaaaacagactcattttaagtataagacagaggttaaaaagtaaaggttgagaaatgatgtacaatagtctcccccttatccatggaagacatattccaagacccccagtggatgcctgaaggtgtggatagtactgaaccctatatatacttttttttttaatctgaaaactgagaccagctactaagtgaccaactggcaggcagcctgtacagtgctgatatgctggtcaaggggtgcttcacatcctgggaaggacactatgagacttcatcatgctatgagaacagcatgccgtttaaaatttaattgtttatttctggaattctccatttaatatttttgaaccactattggccatgggtaactgaaaccatgaaaggtgaaactgcagaaagtgtatcatgtaaacactaatcataagaaaactggagtggcaatattcgtaatagtaaacaaagtagacttcaagataaggtctattatcagagataaatatcatttcatgtgacctgagtccatgagtaaggttgaaaaaaaaaaaaaagaccagttcataatgataatagctttcattcatccagaagatataatattcctaaatgtgtatgtatctaatcacagagctttgtaatacatgaagcaaaaacatatagaactaaagacagaattagacaaatccgcaaccatagttggaaattttaatacccttgctcactaaaaagtagaactgtagacaagaaaaaaaaaagagaatttagaagacttcaacaactctactaaccaaattgacctaattaacacttatagaacattacatacaactgcagagttcacatttgggtatacaagtagtcctagcttttgcatggcaccatattaaataaaacctgtgcatatcaaaacctttgcatggttctgacatgcacgagtttcagttaagatggaactgtgcaaaacaaaggtttctttttcttttcttttttttttttttttcagatggagttttgctcttgttgcccaggctggagagcaatggcactatcttggctcactgcaacctctgcctcctgggttcaagtgatcctcctgcctcagcctcccaagtagctgggattataggcatgtgccaccatgcccggctaattttgcatttttagtagagacagggtttctccatgttggtcaggctggtctcaaactcccaacctcaggtgatccgcccgcctcggcctcccaaactgctgggattacaggtgtgagccactgcgcccagcccacaaaagtttcttttaatgaacattcacaaagataaaacatatgcggagggccataaaacaagtctgaaaaaattccaaaggattgaaatgatatagagaatgttatctgaccaaaacataattaaattagaaattgataacaataaagtatctagtagatcttcaaatatttggaaattaagcaacacacttctaaatccctgggtcaaaaaaagagcacatgtatagcatctagcataatgcaaccaagaaatacttgaaaagacccctatgtttgggttgaatattttgactggagaagatatgagagatcaaataggaagttcacctttattcttcactactggagctacttagaaaagccctagccctagagaacatactttcctctactgttaatttaagtaaaaagtatgtttagaaagatgttatggaaataattgtctatgggtgctgcccaacaagtaaagtagcaaggcagatccttcaaaaaatcaaatggcaagcttcagtcagcattaaaaatttttcaaacatagagatgatttttggaaggttgtaactttgaaaatgtttaaattcactactttaattgtactttcagccaaatattgcacatttaaaaaataacagaacagcttcttaagaattaaactgatttagctacaaaagactaaataaacacataccttagctgcattgataaaacatgtttgtaattgtctccccaaaactagaaaattttctgcagctgatggaagtaattcattgtaaaattcctctgcatcttctcctggctccaagcccacacagcaatggctgaaataagagcacaagttcgtgttaattagaagtttatgttgaatgctcaagcttctagagacactgtgccttattgagaatttttagtatgcttcttttgttaccaagacaataaagaatttttgttgaaaaattagtctaacaactttctagaaaagtaaacagtggtatggaccatgcttgtacttaggtctgggatttatgtatcctaaaaacctacatatcagctcattcagcaaataaaagacacttggctcacaataaagagaagctaagttttcagtgaattggctataatcattctcaaagctataggataccttgagagtttaatttatgaaaagcatttgtgttaactaatacattttagacacctaatagctgaaaaatgcccaagtaggatttgtttgcaagggatacataaggaaaccaaacactaatttcataccaattttaccttccaatagatctactttttgcaaaatactcatttgcatattccttatatcagaaggacaaacggcaaaacctaactctagtaggaacactttacaatatacattagaggagagaaagtcacttagagaaaaaggtcctcttaaaattgtacataaaagtcatttcctgtacataagtcagaagtcccaataataaaaggtttttctgtaaactaacattcaaaagagcctcaaacccaagaatggtctctatgtgtgtactctaatgaacaaaaactgctgtttgagtcttttcaacaaaatgtatggacactaataagcaataacaactatgtattgagcatgttaaaaatctaagtaatcaatggcagactggataaagaaaatggtatatttctttggggtggtacatatacaccatggaatactatgcagccataaaaaagaacaagatcatgtcctttgcagcaacatggatggagctgaaggccattaacctaagtgaactaacacaagaacagaaagccaaacactgcatattctcacttataagtgagaacaaacattgagtatgcaatttacctataaaacaaacctccacatgtacccctgaacctaaaataaaagttaaaaaaaaacctaagtggataatatttacatgtatcactttttgttgttgttgttgtttatttgcacctgggttcctaaagttaatgggctaatgctcacatgtatcagcttttcttttctctttggttcctaaagttaattacttaagagtatcttttttgattgagaagattaacaaatgaaattatgtttatttgtgcattcagaaacatgggaatttcttaagtcttgaattccacccgagagcctggcttaatcaatatcatcataaactagcatatcgaatcaaaacaaaaacataaggctttatttacttaagaaaatcaatcttgaaaattaaagtatgaaaaagaatatcacatatatttttcaactgttctttgtaactgtgtgctttaaatttggcctttaccaagtaacacagtaggattaagcagcttagaaatctagcatccaagacaaaccctttcagtgggaatagcttattaaattcaaatggcttatttaggaaaaacaaaaaaagaaggctaggatccagttagtaaatacacactttcacttattaatcaggaagtagcttaggcactaagaacatctggtttattttactacctcctttaaaaaatgtttatttctcttctattaatttctagcatggcagtagatcagtaaattctacttctaaattttattgacagtatttgggttgcttaatgaaatacacagttgatagctacattgatatagtgaaataaaatgtttctttatcagttctcctatagtacttgcttgcatactttcattttagcactgatttcattctgctttgtatcatatacttacatgactgtcacccaatctctattttaagtttctcaggtacagagccagtgccttaatttcttcacttctttaaaaattccttaatcaataaaaagtatattaggcacttggaattcagtggtgagaaaaaaaatgatcaccatcttcattaagcttgtggaggaaaattttagacagtcaaataatctgaagtaaaattatgaataataacatataatatgaaggaaaagtacaaccaaaacctacaacaggaggttgccaatgcttgttaggcagataaataaaaagcaaatgttgaaaatcagaatcaactactacatccctcaagaacagctgacttactgctttattttaccttaatatctgtgtaagctgggaaattgtagtccaaccaccctggattcgagaataatcttgactgaggaccaagaggcaatattgaatgagatcataacaatatatatcttgtttgattttcttcaactctgagcttcctaaaggtgtgatgtttattatttctaaggcaaaaggaaataagatatatttatttttgcttaatacatccaggagctatttgtatttttatatgttgaataatcactaaaaatatattagaaggaaaaattactgttctattatagtgttaagacctctctgaacaaatttaaaagaaatgttaaaattgtaccaacgatggaaccatttttcacttaaaatgctatctaatcacaaaaagattttcttaccttttaacttcaacagtataacagggacattctgctcagggctttttgcaacttcagcagctatagataagatccttgggtctgtacctgttggcttcatttctcttattacctatattttaacagaatcagagaataaaggtcaaaaagccaggaaatgttcactacctaaataatgtttgaaatataatttcaatataaataaaaacagcttttcttgccttgtttgagaggcagaatgtagattttttcatttcttccttatagaaaactggtttttctaaccagtgtaaaagagctcaagattcctatacctcacatgtaacagctatagcaggtattgtttattgtgcactcactaagagtcaggaactgtgataggagcttcacattctctctctaatctgcacaataattctaggataggaattaacttcctttaatcacacaagaagaactgcaaaaaagagctaacatgacaggcctaagactactatactttcaaaggtgtgcttacaaggttggcctttgactggcatctagaacttagatttcaggagggtttctgccattctctggtaagagtggctccctgtgcctaaaactgtttatgaaaaacaatgtggttcatgctgaatacccgccttccttccaggagtcttagaattctggtacatgccagtcgagagtacctatacagagggtgcctatgtggccatcctccaataaaaattctgatcactgagtgtctagttgagcttccttggtagacaacacttcaaacatgttgtcatagctggttgctggaggaattaagcatatcctacgtaactccactgggagagaactcagaagtttgtacctgatttcccccaatatgctttttccctttgctgattttgctttatttcccttcactgtaataaatcatagctgtaagtacactatattctgagtcctgtgagccctcctagtgaagcactgaccttcaacacactaatgctcagaaatgttacataaatataagataatcaaagattgcttctaaatagtatagtgaataaggccaggggcagtggctcacacctataatcccagcactttgggaggccaaggtgggtgaatcacttgcggtcaggagttcaagaccagcctggccaacatggtgaaaccccatttctactaagaatacaaaaaatcagctgggcatggtggcgcgtgcctgtaatcccagttactcaggaggctgaggcagaatagcttgaacctaggaggtggaggttgagtgacctgagatcacatcactgcactccagcctgagtgacagagctagactctgtctcaaaataataataataataattaataaataagtaaatagtatattgaataaaatcaattctcctaacattaaaaaacaaggtccacatcctaatttgttgctaaaactttctctatgtaaaaaaagtttaaggctgaagaatcgcttgagaattggtgttcaagactagcctggtcaacaaagcaagaccctgtctctaaaaaaaaaaagttttaaagcatttgaagctcaaagatatccttatataataaaagcgtatttccttatttatagtaaagctaacatgtatcaactgtttaatataagctaagcactatgttaatatactatacactgtcttgtgtaatcctcacaacagggctatgaagtagatagagcgtgtgatcatttccatacatacatatatacatatacatatatatgtttttgtccacagtttctggctcataactcccatagcctttgttacagtcttgttatgttagggtgctttaggcctcagaaaacagaatctatttctgacttcctcctctcctcctttcacctgctccttctctccaaagcagaactctaatcatccctgcctttctctgacctatcttgtctagctgtaggtcataagacccctgtttcagaatgggtcttgccctatatcctggaaggaatgctgaacagagaagccaagaagaatctgagcagacaggccttgctgggtttccccactcagtctgttagtatcagatcatatcttttttgtccaatcacatttccaaaatgattgtccatgcttcagtcatgcctatccattgaaatctccataaaaggctcaagaggatggggtacaaagagctactggatagctgaacatgtggaagttcctggaggaatttcctggatatcacaggcagggaggacatggaagctctgtgccccttcccatacttcacagtatgcatctcttcatttgtatcctagtatttttttttggagacaggatctcactcctgttgcccaggctggaggacaatggtacaattatggctcactgcagcctagacttctcaggttcaggtgattctcccacctcagcctcccaagtagctgggactacacttgcaagccatgacgctcggctaattttttgtatttttagtagagacagggtttctccatgttgcccagggtctctgtaatatctttataataaactggaaaacatgtttccctcagttttgttagctcctctagcaaattaatacaccccaaggtgtgtattaataggattcctcatgtgtagctggtcagtcagaagcacaggtaaaacaacttagggcttggattggcatcagaaatgggggtccctcttgcaggactaagccctaaacctaagggatctgaccctatctccaagtagacagtgtcagaattgaattagatgatacccagctggtgtccgctgcagaattgattgcttgcttgttggtggaagaaaactccacacatttggtcacagaagtcttttgtgttgattgtcatgatgtgagagcaaaaactgtttttccattcatatatctcttattaggtacaatataaatcattaaaagacaggtttgctgaaaataccttaaagaaagcccagtgcaactcccggcacatagtagtcacaaaactttcaaagagagtgcatatagttatctcattctctccaaatggctgcattatgctacatttccttttaagaatgcagcaaaatatatttaaacatcacctctactggaggtcactcaagctgtatgctattacaagcaacactgcaatgaatatacacatgatcctttacatttttgccaatctgttagatgaaaattggtatgattgtgttttaatttgtatttctttgattattagggatgtcaggcacatttcgtgttcactggccattatttcttttatgtattttctattcatatcccttgactatatttctatcggtttgtcttattcttttgcagaagcttttcatacatggataggaatcttttctcttttatattggctgtaaaattttctccttgtcatttatttttttaaatttgactatggggtctttaccataattttacaatttttttttttttttttgagagagagtctgactctgtttaccctggctgcagtgcagtggtgcaatctcagctcactgcatcctccacctcctgggttcaagtgatttcatgcctcagcctcccaagtagctgggattacaggcgtgtgccaacgtgcccagctaatttttgtatttttagtagagatggggtttcaccatgttggccaggctggtcttgaactcatgacctcaagtggtctgcccacttcggcctcccaaagtgctgggattacaggcatgagccacagcgcccagccatttttacaatttttacatatgaaatataacaatcttttcctctatggcatctgtcttttgtgtcctgtttagaaaggtcctctctaacccaagagataaaaaacattctccaaatcttcatgtttttttggttttgttttccttacatatcttctaaagtaaggtatttttgtgaatggtgtcatataagaatctaatttttaatgttaaagttattgatggattaaaaaatgcacacagtagtcataaattcataaggtaactagttatgaatagacataacagaaacaatctgaaacgtcacattttcatgcactatgtatacatacacatacacagggtatctttttggactctacttagtttctagtaatttaatctgtttgtctattcttgagctagtacaacatagttcattttaatatatgtttggagaaaattcacctcagaaggtaagcttcatgagggcaacctacctatcccttagagatgattaaatgagttaatacatgaaagcaattggaacaattcctggcacatagtaagagctctccaaatggttattattaaagcccagttctaccatcatactacattttaagaccatctttgctggctgccttcttatatctttggttcacaactgtattcccagtggctagactagtacctggcacgtactaggatttgctaaatacaggttgaaagtatgagtaaatgcacaaacctcaggcattctgagcctcaatttcttgactttctgtttttctcttgttacaatagagaaagctcagatttatagttggaagcctctctaacgtaaaataggctcaaaacagtttgtgccctcctggctaccgtaataaaacatcactaaatcattattgtcatcaacaaatatgtgcagagcagtatggtagatgcaggggatgcaaagattctacacaagacatactctctgctattgttctggttgggaaagaaaagtatgtttatgtacatgtgtacacacacacagatacaaaaaaatatacttaagaatatcagatatatgttaaatgctaaatagatgacacagataagaatacaggccataaagtcagaggactgggcttctctgaaccatttttcttgctgtaaacaaaatagcaattcctacctcctagaatgattctatttagaagagaaggcagccaccaagatggtcttaaaatgtagtataagtgtagagctgggccttaaataaccatttggagacctcttatcatgctccaggaattgttctaattgctttcatgtattaactcatttaatcattccaacaactctaaggaacagatactattatttttttcccaatttgaacaatgagcatacttaaactctggagaatgtaattagctggcacaaagtcacactgttaagtataaagcaggggttcaaactagagccaccatctgccttaaagcatttaactacgatatgaaacagcttcggcacaccttcaaagggtaggatttacacagacaggttgaaggagacataaccacctaccccaaaatcaattgacaaatgtgcctaaggcagaaggtgagggagtgcagttggattgcgtaattaccctgaaaaaccacctgttatggaaaccatctgtaaactttctcgagtgtttctcctataattcaacacttctcccatctttacattaaattcatgaaatttgacacaaaaagacaattatttatctattttaaggctactaccctgttgccaggccaccgggtccggcccagccttgattcttcgggaatcacttctccctcgccgcgcctgttactgcctccacggatcactgtgaggaaaataaatgaaaaggaaattcagtgcgatcctgttgcggctgatcctaaatgtctgcagttgctatctccgaatcctctttctcctccccactacacatccccttctccagtcctaggaccacaagaaacttcctctggtacaaaaaggtcagaaaacgattactgaggtaacagcgtcgcttcaagtctaaggaccgagattctggggcctctgggctcctttactccagattctagacccggctttcgcgctaccaggccttggataagacactaggccctgtgcctggacactgcacctccccaggcctcagtttccacaccagatctctacagagtgggcgtgagggcaggccgattctcccgttaagagctcttacaagccggctgacttcgtccaggagcctggggtcctggcctcctggtaggcgccctggggccctctccctccccagccaccacctcagataagttacctcatcctcgcttcgcgttcttccactaaagaacctggggctcccacgccgcactacagcgccgcggccttccggggcagcgtgcgtcgcgacgcgggaaggggcctggaggcg

SEQ ID NO: 216 - DNA, 65317 bp, Homo sapiens; identical to SEQ ID NO: 215

SEQ ID NO: 217 - DNA, 164691 bp, Homo sapiens
gaggcgggggattggtatgcgagcgaatgtgcgaggggagggaggcgtcccggcggagcgtggtactacgaccagcgcgggccggagggggcggggggatgcgccgcggcggcggcggcgcgggagctggggttggtgtttggcggcgccagagcagcggatcccggtctcgccgcagcagcagcgcgggtgtcgtgcaccgcctgaagacgccgtacctttctaccccccaccttttttttttttttttttaaataaccggaaccaatgaacgcagccgggatcagagctccggaggccgccggtgccgatgggaccaggctggcgcccggcgggagcccgtgtctgaggcggcgggggcggccggaggagtcgccggcggcggtggtggcgcctcgcggagccggcgagctgcaggcggccggggcgccgctgcgctttcacccggcttctcctcggcgccttcatcccgcctcgactcctggcccagcgtggggctggctgctgcggcggcggcgctgggctgcgttgctggtgctcgggctgctggtagccggagcggcggacggatgcgagcttgtgccccggcacctccgcgggcggcgggcgactggctctgccgcaactgccgcctcctctcccgccgcggcggccggcgatagcccggcgctcatgacaggtgaggggccggggggcggcgggcggggctcggccggcagcgatgggacccccaacccgtgcagaggtcagcatctccgccggacgtccgctattccgcggctccggccagggcgcgatgcggagccctgcctgctgcttcgtcgcggtcccctgcactccggacgtctttccttttcaccccgacaccccgccctcgccgagcctctcgacggcactgattcccctcccttcagtcgggctctccgatcttccaagctgagcaatgcggtggtttctctttcgtgctgcagaagtgccagcagggtctgcaggggactgggctgattttttttttttttttttttttgaggctgctagaaaaagtcagcagcagcattgcggtattgagtctacctctggtgctgcttttgcaaaggcagctggcagcgagtctcaccggttcaaagctccgcttgagcacagcgtcccaggggagcctgctaaaggggattctttgagagccataatacctagtgatattagtggttccgtgttagtatgcagaaatgcctaagtttacagtgcattttttgcggggtggaaggaggccgttttaagtggtgatggaaagtgtttggtggtgggagcatcactgggtgacaaagggtgtagaaacctcagcaggtaaccagaaattatacctaaaatttgcaaagtgcagcatactcggggcttgcagctggcagcacagttctgatagactgcactagcaccttttttttaatatatagaacgatctcataattgaaaacttggaaacgtgttttgtaaggttaagtgcagaattgtatcctttttaaagccttccggtgttatgtacaactgatcagttgtggtttaagtaaaagttattatataaggaccctgaaatgatttctttgggaaaagtaatggagctaaaataatggtttttttttttttttttagtatttcacttatttttaaagtagatctgtagatttcctacaataattgtaagactaaaaagtttaaagtggcagaagatgacccgtgattaatttaaccaaaatgatagtcctgcgggcgtctggaagttactaacagcttctctgacaagtgctcaggaactgtattctttaaagccaagcagtttctctgatttctatgataggatatttactattctagagagaagaaggatgttggtaaactttaaaagctttggaggatgtagagtatagaacataatggtcagcatgtttaactttaccctgaagcatatcaagccctattaaatggaacttgatacatcaaacctaccaattgggtaactgggataaagtgattatagaataatcagtattaggagcatagtacagtttgagtgagaagataggtcagacagctttatgcttgaatagtatttattctccaaataaaaatgtggcaagtaacagtatagtgaagaatagtgattattaggaaagttgataaataagactataatttgaagatttaatgcctcatgcaggaagggaaggagcaggaatatttaggcttctagaaggtataagtggttctaggtttctcgagcagaaaaatgtggttaatacataattggctaatgctctgtgaaaaagtaattggtaaaaaggcaagcaattcagaaaatttagtatttattgactgctaataagtatattttatactgtgtagatcacatcaagaaaattggtcagatggaattttaataagccatttacaatcccttttaagacttaaatttctctatacttatttaaggcatgggggaaaaaggtgattcttattggaaaaaaatccgatgtatcacacaaaatgagtttgtgccatagggctttaaaataagtttgctagaagaataccctggaattatttctaacgttcttttactttccttttgtcagaatattgatttttaacaagttaaacgtttccacttaaagtttaaatcataaaactacacaatatacaaattaaattgttattttaataagtttatgtaaatacagtcaatagcacccatatcttggtaaaggtaaactgaaaatctatgatgaagttagaaaatattgaaaatttctttgaactatatggcctctatagggctctttcccattcttaagagtgtatgaatagtgctttcttttatggttctatttgtaaatgttatgcaaagcctagaacctaatttattagcattagtgtacacttcaggaagtaaaaccgtagactgaatttacaaaatactgtggtgtggtatcatattgtaggcagcgttaatggatagagatggagtagagcatcagtaataagagaactaaacgtcacgtgaattttgaaaattgaaaatttttgaaagcattctgagagaagaattggtctctttgtctcctgattaaagttgtgatttagctgtgagtattctcaatagctctgcaaaatgacagccaaaatcacttttctgttttcttctcgagattggcatttttaatacttacctttagaagctccctaagagttagcctttgactaataaaatgtataaaacattctttttcactgcagcttgcctctcaagtgttttactttagggatttagtgtactttaagagtaaattgcctttaaattatcctgtgtttatttgctcaaataaactgttattgctcaaaactatacaaatcatccaaataaacagacccattgtcataatgaatacaggtttatattttcttttcctttttaaatattaccttttcagaattcagtgtgcaaatgtttttggtgagacagaaccaatattcataacattatatagtaagggttttaaattacatatacagcgcttatatatttagggcacttactttgaaagtgattgaaatttaaagcaagttagggataggtgactgagagcttggtgattgtattctaaagcagtgctttaataactcaaaacaatagttttttttttccttctttgtctaacagatttagagttgatgaattgatcctggtagggagtgaccgatctcatccagatagggtccctgagaaatagcttatgaaagggaaacaaacaaacaaaaaaatgccgaataattgaaacattacattatttcttacggaattgtttcagaatttttgggaacaaattttaactgaaaatatttgcctctatccttttaaagaatgaattaaagtaacattctttagtgcctatgtgaaggttttatcttaactgtaataccatttcactgatttggcatgttattagaaataacatatataaaaacatgtttcttggaagtattaaaatctcaattaagatttaatatattcttagttcaacatataataccacatataatagcatttagaatggccactttacccagtactgttacacacatctgtgttgtggggctttcattaatttagatggaaatacctcaaattagcatgattgtcattggcaaaatgtgaaactgaacttttaatgaaatcagttgtattccttatttatttttattagtagttggtttgcctgtgggatatatatgttgctttcagtaatattttacaaataacttacacatgttaatgtttccattgtgaccgtagactcaaagtggattcagatagcctgagagacctttgttcctcttatgacgttgttctttctgaacttcctaaagccatcatttactgtattctctttctctttcccctttagtatcattaccagtgcttttcttcaccagtctttggtcattgctgtagttgtattattgttgctaactacaggattaaagaatctcttcatatccatttgatctagtcgattctgaacatttaagaattgatagtaatctaattggtctggaaacattgcatcccttggtactcttaagaatacatggcagaactggcctctgttgggaatctcatagaacaggaagcattcagagggccagttagaaaagtggatccaagatttagcttccttttatgcaaaaggaggacacaggatgatttagcttgccaaagacttgctttgtggctggatacatgctagtattttcagattaatttaggctctttttgcgtaatgatatcaaggatttttgatagtggcctaatcattgatgataattgtggtgtgaacactttcacaatgattgttggacgtctgcatttatgtaatatgatagttaatgtatatattggctaagctaatactaaaactaactgctaataatatggataataagccattttttgacatttactggagtttggacttcaccttgttaagatctacctaggaatttacttctgaattgatcagattttattaactaaataattattaagtacaagcagcataacacaaaagagaagtgggaaagaattaaaaaaaagaataagatgtaggtgtgaccattttggactcagactaggtaataataggcacatttattaaactgttcctatgtgttagtattgtgctaagtgctttttatattatacatcactgtttttgattctgagactaatcctgttagatagctactgtttttttttttccttctaacttttattttagattcattttagattccaacttttattttagattcatatgcaggttcattgcctgggtttattgcatgatattgagattttagttaccaacgatcttgtcacccaggtactgagcatagtactcaatagttcaatagtttttcaacccttacccctcctcttacctcccccacaagtagtcctcagttttctattgttgctgtctttatcttcatatagtagattaggaaacatgctggatgatcttaagtaacttgcccaagctcacttctagtaggtagcagagttagaggttgaccagggtttctctggttccaaagcttggattcttagctggtatgttgtatgcatccttatacaaacaacatgcgatggattgtgattagcaccacaagggactgcaaagtgtaggagaaaggaagaggctgttagagagtattacctggaggagggcaggatttgagctggaccttgatgtataggtaggacttcttgtggagataagtgaaaaggctttctgggaggaggcatatgcaagaataggggataaatacttttctttagagttaagtataaggtatatgtagagtagtggggaatgcaagaaggaagaagattggggccaaattatcaagagctttacagtcccctagtgtattcagtatgtatcaaaatgtcagcacatttaaaactggggtactcggctgtatactggcaagaatgagacatccaggacaaatatggtaccttttcttggcatatccattttattagattatttgagagatataaaactatttgaaggtttctaaatatgcacgttagggaaaatgtacatatattttaatttttaaggtaaaaggcattttgaactttcagagtgttttgttaataaactcttgaagttgcaaatctatatcctgtcattaggaggtgagaggcattgtggtttttgaagatgggggtgacatgtcctttgtgtttgagaaagctaattctgggtggatggcaatgaggagataacagagataaggatatcagttaggaaactatttagaaggagaggtcttgagaattctaattatggagtggctatgaaaatgtttagatgaaattttataaaatcgactttattcttagcttaggaatctggctatttatatgaagtttaagatataaaaattacctttagcattaagcatacagaatttatagaatgatttaaattagtataagcccttgaaaaatccaagaagaaacacactatttgtgatagagaatcttctttatttcaaatgtgcctatttcttaatataaagattagtttttaaaaaaatataatcgggcttatgtgatgatttacaaagttgtcgacagaaaaacagttgcaaatgtatttgccagttgtttgacaaataaaaccaaacaacttttgatatccaaagacaatatatttgccataaaatgcttatataaagcttttagaattccatgtataaaaaggataagtgtttccagattaaactaaagttataagtcaagagtcgaagtctctccgaccccttagctatgaataacaatatttcagactactggcatattacttgtttcaatattaactcctaaatttcattgttgtgtgaatttcaagcttaatctatagatgatgatttctaatgccaaatctaaaaggtttgttctgttctttagctatctagatctttatattagtatacattggatattcagtctttcttgacactgtctaattctaccttctgtaactgttttccttgactggtttcattgttgctgattttaagggtggttccctcttaagtctctgttctcagcctcctcttcctctagtctagctgaacatttcctcctcagagaacttcattactaggaaagttctaaattgggggtagggaaccccaggccaatgattgatttgatttttggctttatttcctttggcccttggtgtgctatagcacaagcatcatggctgcagtcccgagagtaatttcctttctactaggctttgtcagccatatcctttaaagtgaaacaatttcaggattaaggctaggagcagttgcagaatgtttaataatgtctattcagtgttttcataagatagtggtaactcccctccagtacacacaggctgattggagccacagagcctggcaagcgcagtttacttggactaacattcatctcagagcccaagtacctgtatctgtccaagtgtttctttttgcgtatggatttgtttttttgtgtgcttatggatcttgacctctgtgtaacttttttctctagtcattttcattttctctacctctttttgatcttcctaaacttgacattatatggaactgaaacacctcaaaaactgttttgtttaattaagtgctgggattttaatttaaaaaatgcttgaaatgaatatctcatttatgtgattacagaatactaaacagccttatcataagcagcctcatcaaaaccccctagggtagtgaaagtgatttgtagtttcttacaatattctcaataagtaaaaaggctttttaaacccttgtttgaagtttttgtctcctactcagcacactgcaagttgcacaggcccatgttttctattactgtcttttttttcttttttaaaaaatctgatgttggataactagataatcttaatcccccttctttattcctattgtccagcaatacatctctaacgttttcattaatgacgtgtatgtaatttttgctctgtttccctgatgccttgaaccattgtcatgtttagctcttatttctgctttgccacacatattcagactgtattaatcctcgccgtttctttcttctgggtaccacattaagaaagaaaagctaaagtgcaattataggtacccctggctatttttgaatttgcatttgtaactataccctctgatgtttattccgtgtttgtttggggtcgtacgctgtagcttatgcctgtaatcccagcacttttcgaggccaagatgggcagatcacttgagcccaggacttcgagaccagtctgggcaacacggtgaaatcccatctcctcaaaaaatacaaaaaaattagctgggcgtgatgatgtgcgcctgtattcctggctactcaggaggctgaaatgggagaatcacctgagcctgggggaagttaagtctgcagcaagccctgatcaggccactgcactctggcctggacggcggagtgagaccctgtctccaaaaaaaaaaaaaaaaaaaaaggaagaaaaaagtttgtttggttctaggtctgttacatatgggtcctaaaaagaactatagagggttaaagtgagaaagccagtcgttggtgaatatgtctgtgtgtgcatagagttttaaacattatttagtgactgttttgtgccagctatggtatgagtaactggaaatataaagatgctgaaattgactatttaaaaacatttatgtatttatttatttttagagatgtggtctcactctgttgcccaggctggagtgcagtgacatgatcatagctcactgcagcctcaaactcctggactcaatcaatcttcccgccttagcctcccaggctgtgaggcaccacagatggctaattaaaaaaaactttttaaaatgtaaacctgaaaattgcctgagagtggattgcataatctaaaaatatgaaaatatgtataaatattttgtttcttaaaaggccactgctgtggtagcttatctagtatccttgctacatttactgaaaatatatgttagagatatctgcactgctatgttcttttcagcatttttcacaatagccaagatatggaaacaaccttaacgttcatcaatgaatgcataaagaaaatgtgatacatacgcacttgcaccatgaaatattattcagcattaaaaaagaagaaaatcctgccatttgcggcaacatggatgaacgtggaggacattatgctaagtgaagtaacgcagccatagaaagacaaatactgcatggaatctgaaaatatcaaacttacagagtagaatggtggttaccaggggctagggaaaggagtaaatggagagatgttgaaacttcaagtacaaagattcagttatgcaacataaataagttcggagatctaatgtacaacagtgtgactgtagttaatagtgtcatatactgtaattgacatttgtgaagagggtagaccttaaaagttcttaacacaccaaaaaaaaaaaaaaggtaaggatgtgatgtgatggattatgtgaattagcttcattgtggtgaatatttcataatgtatgcatatatcagatcaaattgtataccttaaatatatctactttttgtcattatgccttactgaagttataacaaaatatatgttagaatatttaatggaagtttttgttatacatttgcagtattaaaaaataagtctcccttcccccttctttggaacaaagtataattataaataactataatttaaaaaatttttaactgatatatgatagatgtacatgttttcaggtatcattcctttttcactcttttgtatactttattaaaaaacaagcaagcaaacaaaaaatttcagtgagtcccatgtgccagacaccagttgggtgtttggaatttcaagatcagtaagatattcaccctagcttgtagtctactagaaggcatacccacttaaagggtgatgatacattgtgataagggtaaaagggcctaaggctatgtgctgtattttactgaattgcaaagatggagttactaattttgatgtggagatgcaggttattagtaggttattagtgaatcctttttttttttttttaaatatccagagtaggaagtatgtgccgagaatgtatgagtttgtcagacagagaaaggcatggtggaaaaccataggtgtgaagtgaggaagctgggtggggagtgagattattataggcattgacatttgagaatgctaaatgtggttgtgaattaccaaatacccaggatgacagagtcaatgctgggcctgttcgcagtgcagcagcatccatatttgcatgtgggatttaaatttttgccaggcattttgtatgtttcatccaatttaatccttagagaatccctgtgaggttatctccatgagttagtacatataacagaaatttaggattgctctcaaatagttcgtactttaaaaaacccccctgtgccaaggatctttatgttaaagcataaggtatatatggagttgaatcaggaaatgaggctggagaagtagcagatacaaacattgtgattaatgttacattgtagatctttattgtccaatggccttatgagtttctccttcatttacttctggtaaataacaaaattttgctattaaatattctgaaatcttggaatatgactcctataaaatatatctgaggcccaataatttgtcctttttaaaattaaactttgactcgatttgttcagtttgactcggcttttcagtaagtgcgtaatttctgtttgtgctttgttttcataaatacaaggatgacggaatgtaatttttaagaagcatagcatcttatatcttgaacttttatctggcccataagtctgttttcacccttttttttttttttttttggtagagacagagtctgagtatgttgcccagggctgatctcaaattcctgggcttaggcaatcctcccacctcggccccgcaaagtaattagattatgagtgtgagctgccatgcctggcctgtttccacttttgtatagtgtgatgaagagcatagcctctagactagggcaggatttcctgagtttgaatcccagtctgacagtggttttgtaattttgggtagatgatttagtctgttagtgcctaaatttccttatctctaaaatgggatgcaaagaataaatgaattactctgtgtgtgcttagaatagagcctggcaagggtaagtattcaggtattattgacttaaccattattctttttatctatagatacagaggtaggatagttgtagaaatgtgctttgatttattgagtgttattaagatattttatgttgcatttaaaaaagtatgaagacatagtttgaggcagttagttgatctaaataaccggaccatgagtggtccgagattagttaaaactctgtagaaatatgaagctaagtatagacagtgacattgagaagcagtgtgatattaaaaaaaaattagttgtatcataagcctgagtcattttgtacctttattattttatatgatttaaagatttaaagcattttgcagttgaaatgttagactttaaaatctttaatttctgagcttaaaggtttactataaaaaatttagaacatactgaaaagtaaatatagaaaatacatctacttcaacagctaaaaataacaaagataacatcaaaattttgttttttacaatcttttatagatatgtatgcatattgatatatttaataataggctcatagagtgattttttaaaaatgtgaaattacttagtaaatatttgaatgccaagtatattacaagcatatgataagtattggggacacaaagatgaatgagattgaggtttttgttctcatggagcttgcatttcagttgggaagatagaaaatacaaatactattttgagttgtgagaaatgctattgaggaacaagagagacataaaatagaaaataatgtggggtactttttaatttaggtaggctagttagagaaggcttctgagaaggtcacatttaaggtggcatcttgaaggacaataaagagccaagtctgaagaattggggaatagcattccacatggacaaagactgtgaggcaagaaagaattggaattatttgaagaaatgaaagagtatcattttgacccagcatcttgagggagggggaatgttggatgagatctggctatagaaaagggaagggctggatggtacagagcctcatagaccttgttaccttgtttgggtttaattcagagggtaacaggccgggtgtggtggctcacacctgtaatccccacactttgggaggccgaggcgggcggatcacctgaggtcaggagttgaagcccagcctggccaacatggtgaaaccccatctctacaaaaatacaacgattagccaggcatgatggtgagtgcctgtaatcccagctacttgggaggcaggaaaaactcacttgaaccctggaggtggaggttgcagtgagctgagatcgtgccattgcactccactccagcctgggtgacagagtgagactccgtctttaaaaaaaaaaaaaaagtcctttccattctcatcgctactgtgttagttctgaactaaatcattgtggctagatgtggccagagcaggggggctctgggtcccttgttatttccttgttagcagtagcccagggtaactctgactactttgtccaggaagctcatggggaagcacagacatactgggtgtgaagttttggtgatcagacagggcttgtttcctgcagggcacttccttagtcataaatgagagagacgctcatgtcaccactctcttctgccataatggcttcatccagctcttgggacagcttctggagatgctgaatttctgcctccacaggctctaggtcactgtcagactcactgggagagcagaggggctctgtcaaggggtaaggggctctacaaggcagactcccgcctcaaccgccgtagtgggtgggtacgtgaacccatccgggcagagaggcagtgatgctccttctcccaggggtctgcggctgagtggacaggggcgcctccagacagctgggtgctcttctggctcaggctgtgagtcagggatccactgctcttctgtgcccctctctttctcctcctggccttcacctgagtctccaccagccacttggtgtcaggactcctggattctctgggacttggcacctgaggtactcttagctgagcgagctgcagcttggaggctctgctgccctggctctggggtttccaagtgtttgcaggaggggtctccccagagattgaggttgatggctgtcaggggcagcctcctttggaactgtctgcacagggaacccagggctgcggcaggggtctcctggatggctggccacaggctgcagctccttgctgttcttgagctgctcctggtactggagagatctccggcgcacagaggcccctacaccctgccgctgagaagccatctgcctgcccaagagtcttgtctgaccactagggcccagcacccccaacgtctgcccgacgccaagtactgtaaagtacttttaggaagaactgtggcacatctttattggtgactggtaacttctagtggacaaatgttataggatcagctttcagttcttcatttacataaaccaagcagttattgttaatatattactcattttgcttaagtatgaactctcctcttttaatggataatttcatatcttttcgagtttagggaaataaaagaatgggattatttaaaaggttacaattatatttgatttatagtctcacagattttaagaacattaaaaaagtgctggttaatatgaaattggaagtagtaaaatcagtaagtattaggcatagactgtgaggttacattgtgccacttagttgtggaggatatttattaaacaaatgtttgaatgtctgctgtgtgctagacagcagacactttttaggtaccggagaagtaggagaaaactaaactaatgaaggtgctgctgtcataattttacttttaatgctgtggttatttgttgggcaaatgtagttttgctacatgcagtatgtgatcttagaataaaattggcagcttcttcgtattatgattgctacgcgttccagtactcactagtttgcagattcctttaattgaagctgaatggcatattggttttattgattaatcttttaactcatagtatcagttatacaattcacaatgataaatctctttgagttttatacaaagcatatccatattcttaacttactatcaagtttaacttagtgtaatcgacctaaaattagaactcagatctattaactccttgttttgtgttatttttgccatatgctatatagtattttttatgagatctgttcaaaaatcttatagaaatatgcacatatgccggtcctctgaatgtaaccaaacttatatatgaataatctatgatgagttgtttaaacgtgtttataaaattatctggtaacttttatagtgtactaaaaatttagttttacgttttgaagtctttaagtttgttttcaagcaggtagctggtagtcatgatagattcatcataagccctaaatatgttaataattaggattattttttctttatattctagattagtaaaggagtaggaagcctgtatgtgtctcaggcctctaatttatcatataacaacgtgagaacactctgtaggaatgaaaagataataagtctttgtattttgtcagtcttcaagatttctagacaaatgggagctgtttttagttaaatacaaattcccaagcaagacatgacatatttatagacaattcctttctaattattatggggatgttcttgaaaaatcttatactagcagaatttcaaattgaaaaacagacctttgggaaaaataggctttagagatactgtagccccacaaaagcccttactaatatttatattcgctaaaagaaagtaccatagtaatcatttgcgtgttctgaattagtaattcagaaaagttagtttccatttatcatccttttattattaggaagagttcagtgtttccttctgtagcttatgagatgtttgaaaaaccattttcgcttgtagtatatagtatgtacacaaaggagcatattagtggctcagtatccagtccatggaaaagctagatgtcttgtttttgttacttggaattgttgattcacatgtcttgggggtccacacagtctcagacatgttgactgatttggatgaatcaaatggaaaaggtttggggtaaacttatttaagaagtctttaatttctccgctactatggatgaaaccacttcagtaacagggtattggtaaaattagaattcttcctgtagagcctttatattaagacatgaagatgttagacagtctctcctggctctgttcccaccacttaggtaggtctttggatcgtagcacttcccacttttgagtcacaggaatacacttttaaggtcaagtggactttacctaggtttcctttaactcagggttgcattttaaaagtcttaaaactcgccctgccttgctttactcttatcaatctctagatcccttctttttccagttactctaacataaaaagtctcacaatagtggaaatgagaaaccataaataaatttgtgggtattagaattttcacaaagtggaattatcatcttagaggatttattaaatttatatataatagtttttgtaactcataaccaaatgcctttatttaatgtacttgctgaaaattgacagttttttggccaaagcagtatagtcaatgtcttcattggtttagtggcttttggcagaaaactatagtatgtgtttaattattggattatactttacagttcaggttttttctgtctcttactgtctttttttctgttttagactatttgagtttattttcatgtggagatggtaaatagaatgtcatctttttataggtgatagaaaatatttttacattatctgttacatatatactttccaatagttatttcaagctgtatttttttgtattaaccttttgctttgacttgcctgatttaaggtaactataacttaaccaattttaagagggctttctgacctctttggatcttggttgtcttttgttaattttggaaaatcttggctattatcttttcagataattcttttttcctttgctttctctattctccctttgggacaccaattaagtatatgttagactgtttgataatggtgttcctttatggtttctttattttaaaaaacacaccttcccttttttttctgtttcagtttggatgacttctgttgacctaagttcatgaagaatcctgtcaaagggattctccatctttgataaattcttatttttaattttagcattgccatttgactctcttacagttttcgtatccctgctaaaatttcctgtctgttcttatgttgtccagatcctttaacatattaatcttttcctttaccttttttaacatatttatgaatcatagttattttaacatctctgattagttccaacatctgggtaatctctgtttggttctgttgtttgctttatctcttgacgatgggttgtttttttttttttccttctttaaatgtgtcatactttttgaatgatagaagaacctgtgtctagaaatgcgtatacctcctctgtcacactgttggtatggtaggttgagttagttttgtcactgcttgggctggttatggctctgttgttactaccatccccttcagtgcaccacagacctaaatttctctggcggcaagttgctgttattttgtgctttagatggactgagtggtgttcctacttgctatggtttgaaaatttgtcctctccaaaactcctgttgaaatttaattgcctttgtgagagtactgagaaatgggaccattaagaggtgcttaggccatgagagctctaccctcataagtgggattaatgttgttataaaatatagggcaagcatggctcccttttgtgtctctctctttgcccatctgccatgtagtgatgcagcaagaaggctgtcactagatgctggtgtcttcatcttggacttcccagcctccagaacagtgaggaaatataaatggattgctgtgccttataaattacactgtctcagatattctgttatggctgcacaaagggactaagacactgctctgttggcagctatcagcaacatcctgttctatagtggattcttttttatatgtgctaggtttgtgatgggggtggagaagttcttggttttcctggtctaccctcagtcttaggtagggctcgtaagcctgagtcttgagagtagaaccttttcggtcgtcccttctccccctaatctttcccctcccatggcagccaaattttgccttgtgactgaggtagtacttgggacagagagttttctgtccttcccctagcagtagtatacttctgattagttttggtatgggatcatgggtcaggagggtctctgtgtccttgaagcatagtaggcttttacttctatctctcccctaggagcagtggatctttgcctgggccttgtgggtgggagaggtaattacctgcttctcctagtctgtaattgtctctcagactctgactaatcctgatttttggtatatctctttttcttttccttccaggttttgtgttctgttctcttatttagccactgacttgtattccccatctgtattagttcattttcacactgctataaagatactacctgagactgggtaatttatgaacaaaaggggtttaactgactcacatttccacctggcttgggaggtctcaggaaacttacaatcatggcagaaggcgaaggggaagcaaggcacatcttacatggtggcaggagagagagagcaagagcaaggaagtgccacacttaaaactatcggctctcatgagaactccctcactatcatgagaacagcatgggggaaactacccctgtgggccagtcacctcccatcaggatcctccccccacacatgaggattacagttgggggtcagatttgggtggggacacagagccaaaccttatcaccatctaacttttgacgttattttaatattttcttgctgctttgtctcccctgtcgtgtgctctttttgtattgcattcagattgactcatcagcctgtaagtaggccagtaaacttttcaattacttttgtgactcagaaacttacctataattctagttaatctacttgactatgtagttacttaattatgtaatcgacatgacagcatagatcttccatttttgtatagtttgtaccaaaaatctctaacgaggatttcatggtttcacttagttgatttcacaatctaatggttgtgaaactgttaatcttttttttttttacctgcctgtggtgaagaatgcatagttttgtagaaggattatgggattgagtcaggtgacctgggatattataccatttcttttatctgcttgtctattcaattacaaaacatttattgaataccttttttattctgggtggtgagatattattactatgaattctgatagctttacacagtcattgtgttaagtttttcataggttcacatttaattctcccaacaactctatgagagcagtaggtattatatgtagtaattatttgaggaaaccgaaggactatgtaagtatcatgcccattatctcatagatagtaaagagaagcaagccttccacaaacattagtaatattccatctcatggatacttcataatatatgtaactattccttgtcattagaaacacactttaagttttagctttgtaagtaatgattcagccagagtcctaagaggtatacttgattgttctgggccctcatcgcccacattctgacctcctgccagtaaatactatgggttctagccaccacattatgtcttgagtttctctgcttttttctattttcattgccatcactctggtctgggctaccattccctcttactgggattcctgcagtaccttcctaacttcttgttatcattctttaccttctgcagtctaatctcagaagtacacataagataattttctccccccgctttagaggcttatgtaattatgatagaatagaaaccttttatgctggcctgcaaattgctgcatgatctggcccctgtctacctttgtagcttcatctgtttttaccatttccatctacccagcttcctttctgctgctggagtatgtgaaactctttctctgtttctgggccctggcgcttgaggtttcccacatcttgattgttccttctcatctttttgcatgtctggatgcagtatatttttggttttgtattttttcaggactttttttggtgacttcctataggagcaggctctgtctttgctgtccctgataaacatacacggtattttgttaatttcctttataatacttacaaccagaaattacattttaatatgcttattaacttgttatctgtacttatccacagaaatataagctgtaaaaggattgggcccttgtactcatgtagtatctagatagtacacagtgtctcataggtaactacataaaactttttggatgaatgccttggttcataccttttgtgcataaaccttcatatatataaatatatatgtaaatatatatataaatatatatgtaaatatatatataaatatatatgtaaatatatatgtaaatatatatatatgtatatatatatctaattttctttttcccgaggatagacagccaaattagaattaagctagaggaaatatttaatgcattttaaaccagatacggtaacttaaaatgttttagaagtgatttttttcaaagatcttagaattcttaaaattggtactttgttatttttattttattcttctcttgtatacataggttctcttattttgaacttggaaaatatatgcaagtgtagacaagagaataaaacaaattttactcttcagaaagaaccattttggtattgttcttttctatatgtatatgtagtattattttatgtagttgtgctatgttctgaatatatgtgtctcctcaaaatttatatgttgaaacctaaacctcaaggtgatggtggtactaagagttatagcgtttgggaagtgactaggtcataaggacaaaacccttatgaatgggattagtgcccttataaaagaggccagacgggggctgggcgcggtagctcatgctggtaatcgcagttctttgggaggcctaggcaggtggatcatctgaggtcaggagtttgagaccagcctggccaatatggtgacaccccgtctttactaaaaatacaaaaattagcccggtgtggtggtgcatgtctgtagtcccagctacttgggaggctgaggcagaataatggcttgaactctggaggcagaggttgcagtgagctgagattgcactgctgcactctagcctgggcaacacagtgagactccatctcaaaaaaaaaaaaaaagccacttttgcctttcccttctgtcatgtaaggatatagcaacaaggtgccacctgtaaagcaagagagccctcaccagacactgaatctgctggtgcctttatcttggacttcccagcctttagacctgtaagcaaaaaaatttctgttctttctaaattacccagtataaagtattttgttatagcaacctgagtggactaagacaagttgcaatccttttagatggaattttgcatcttttaaaaatccaacgtatcctgagctttttcttaactattgaatggaagatataaattatttcctcattgttgggtagattctcattgttggatagttttcagtttttctttaaaaaatattgttgtagacatttatttgcctaaatcttttctccactgtggattttaagggcagcttcctagaagcatactattaagttaaaagatatgtatattttacggtttaaaaaatatctatttgtatgtatttactgacagattgctttctggaaggattgtgtttttgagtgcccaatagtgtttttattgaaacagaatctttggtattttcagtgaaatgtcatgtttttatttctttgattatttagagtatgattggtttcccttttctgtgttgttaaatacactgtcccttgtaactgggggttgagattgctccagcaaaagatgtgttaaactaatgagaagatgaagactgattcttttctgacattctcttatggtgattcttgtaaaaatgtgctatcatgaaaagggttgagctttctattaataataagttaattgtggtttcattttttccagttttgtaaagtttcagttgttgctaattttttttcccccaattgtaattctactcctgatcttagccaaaaggccaagaagcaatgcccccttgtaattctggttttatctagaaacctagtttcttaaatttctttctttctttctttttttttgtttttgttttttgagacagggtctggctctgtcactcaggctggagtgcagtggtgccattgtagctcactgcaacctctgcctcccaggctcaagtgatcctcctgcctcagtctccctagtagctggaggtgaattcaggcatgtgccaccatacccagctaatttttgtattttttgtagggacaggatctccctatattgcccaggttggtcttgaactcccaggctcaagcagtccttctgccttgacctcccaaagtgctggtattacatgagccacggtacctggcccattagtctcttcttatggcttcaactactatatgtaaatccaggtgctatctgtgtgtcttttcttgtttccttttctttctttttttttttttattgagatggaatctccctctgtcacccaggctggagtgcagtggcgcgatctcagctcactgcaacctccgctgcctgggttcaagtgattctcatgcctcagcctcccgagtagctgggactacaggcatgcgccaccatacctggctaattttttttttttttttgtatttttagtagagacggggtttcaccatattggccaggcttgtctcgaactcctgacctccggtgatccgcccaccttggcctcccaaagtgctgggattacaggcatgagccactgtacccggccttgtgtgtcttttctgccatggggactgatgatcagagaagcctgccctgaagcatgagaaagaggggagggttgggagggaaacagtgtgtgaaatagaggaataaactaggctttataaataaacttgcatgtaaatggtatattatttgctaactcagaatctctttgcctcaatttctccttgggttaaaaataaagagataatcactatctttcaaggtcatggtaaggattaaattggaaacatatgtatgcacatatatacctgtcttatattgtatataatttggtgttcagtgaattaggtatttttttcccttggaaaacagagggattggcacaatgtcttggaattactgtattatagaaacacaggaatgaggtatattagtatatgctgggacattgcctgaggtgccgaaagtgtataataagttacattatggtgggcaaagcagtttaacagatccattctttgtaacacagctgcagtaaaaatagaattgtataattaaaataagatatgaaaagactctttgaaggttaatttaaaaatgaaaatttactgctgtgtttattaatctctttgaaggagacttaatgctgtatcaaatgttccttttgtaattgacagaaacaaagcaccatgtacagtgttagagtgtgtagctgtgctgagtgagccatgtaaatctgcaaggttatgtattttggtatgatggtgatagcttattttcatattatatagccatgaaattgatcctcagcatttatcttagtctttgaaaagttactgtgaacagtagtattatcagattgttacctgattaatacgtcacaaatggatgagcctctcagcaaaccaaggaagttatctcaaatgggactgaaataatggtattagatacctgagttccttatatttctctggaaaagaaggtgctcactgtagaactcacccaaatgcaagttgggcttgagagttacaggcaatcatctgtataacgaaccagttcctgcaaacagtcctgagccccttcgatgtgggagactgtgtgtgcctggttaggaaggtgaaaaaaatgaaataacatgtgttctccagtaaaagagacttaggccattttagtcagggtgaacaacatacccacttaatagggttgttgtgagcaataaagatcagtataggaaaatgtttagtacagtgtttgccacataataactcttagaaagcattagctgttactgtattttaaaatcctacagtttccttctatgatgatgctctgctcgaaatggttatttaattcttaaacctgtttgtaataaaggtttagaaaagaaccagaatagggctggagtgtgacttactgcttctactgcaactgctttaggaaatttaaatataaagaaaactaacaggaaattgtgtcgttgtataggcagggtaatgtacaagctattttaagaaggggctctttgcatttcagtgttcatctgtcagttggctgtagtagaaacaccctgtttatttagcaccattgggggattaagtatcccacatgagtgaacagccatttattgagtacttacgtatatcaggcaactgttctgaatgcttcacatgaaataactcatttagtcctcacaagcttatggggtagatccgtatcttataggtaatgtaacggagacccagagaggttaaacacgagttcacagaactggcaagtgggtgagacagaattctcacaacaagattcacatccttaaccagtactcttgcctcttgagtaattgaaccttgactcctttgaattataaaacttgctttatttcaaacattttggagtcaaattatttctaaaacgtgtgacttatttctctactttcttaatcagaatgtattgggtacagttaatgggtacaatattagggttagtacacatgcaaaaacacagatactcttaaggattgttgatttgtgttccactgttcatgttcaaccttatttttcatggttttgaattgctgtaatatctagttttccaaaagctttttacttaaatacagtataacagtacaggaaagggctcaaatcatcagtatacagctcatttcaaccatttttaacaaagtgaatactcacatgttattagcacccagatcgagaaacataatgttgcctttacccagaagtccttcatgtcctcttgaaatcagtatgtgcctttgcctaaggttaaccactgtccttactttaataccatagatttgcttccctatttttgaatgtgaataaatggagtcatcagcatatgattgtatcagcttatttactggacagctgtcattttattttttggtatctgctaagactggaaaataggggtatcaaggcttgaattgtaaatcttgatggtatgaaggatcctcctttaactaaagcatgtaggattttaatgtgtgatatttgtgacatagttttcatttctgactattttttcaggtttatgttttgcctgggtgaattcagaatgtaactttcagatatacaaattgtttaccttggttaccaggctatgtagtttataagagcagtaaaactgaaaatatagcattcagtgctagttgtattatgagaatgaagccaaatttagcacctcaggttatatatatatatatatatatatatatatatatatatatatatatatatatatgtatatgtctattcatgtaaatatgcagtgttgatttatcctaattactgagacattccattatggcttattgaaaattacatataaaccttattttaaatctgatttttagatacttgagttttaagaagctgatcaccatgcgccagttcctcttatttgacaaacaaggaagttgtggctatgtgagctcataatttgaggttcagtggaacagaggagaactgtgacgggcagaacatttactttcatattctctgtaaaaccaaatcagtgagaaggatgcaaggagaactaggacagtatatgaactttttccttcttaaagctttttctgtgtaggagcatattcatataactgagaagattgtttgaaattttagcttaaggctaatatattatttcaatatatactcattgaacacttacagatattgttgtaggtattggagcaatgaagaaaacgatgagcttaatttcactgaggataagacagttaacaagtagacaaatatttatcaggagatgataaatgcaatgaaggaaaataaaataggtgagaaggtagagaatgttagggaaagtatatgtgtgtttgctgttatttaaggtggtcagggaaatcttcatagttgacatttgacaagagagaagggagagacagagggatgagacccttcaggtggagagaatggcatgtgcatgggccctgatggataccattgttggatttttggagaaacttccaggagaccacagggctggtgtagagtaagcaatggagagagtaatagatagatcagagaggttgtctgggctagaatgtacagtcttgtagacatcatctacaagatgtgaggacattgtcattgtatgtcatgtactctgagatggggagctactgcagggtttttgagaagtgtgacatgatttgatttatgtttggaaatgatcacttcagctctttcactgaaatgacactctagaaggtctagtcttagagcagggagaccaattagtaggcttttgtccggggagagaaagtgctagagctcccttgttagctatggaggtggtaataggtggtataggtggagctatatgtggatgctaaatacagtgaaagcccttctgttctgttgtcctgaaaatcaagttcattgttatatgaactttattgtgaagtaaagacataaaagcttatgcctttataggatataatttaaagagctaggaaattggaacaacccgtagtgttcaactgctgaatgttacaagatacaataagcaccaaaccaaataattaaacttttttttttttttttttttttttgcctcttgccttgtccgtgatccctttaaaacttagaatttatttgagctttttttctttactgttttgtttgatgttgctttcattttctacttgggttaagatgtatcttgctaataatctaagatcacaccgtgctgttacagaattacagactttgattgaactcaaggaagtggacaaagcctaaagctcaaactgtctgctaattacaggaacttctccggtgtatcccttatagactgtcattcattagctcctcagatactttgggtggttgggaacttattgctcctgaacaacttttccattagtaggcagttctggtttgtgagaagttctttgttgcattaaactaaaatctttcagtactttctttgggttctagatgtatcctttgaagcaaagagtggctattttttctcttaatgttttaaaagaccctgtattagggttctgtacagaaatagaaccagaaggaatgaatgtatatgttcattattacaaattaataatataattttatatagtgcatatctgtaattatattaccaattatttagttgcacttaaaatactcaaagatgtaacttaaaataattaattgttttatacatgtatctacatatctacatagatagacataggtaaaacatagagacttatttcaaggaattggctgaggtaattgaaaagatccaaatccaaatccaaaatccataggataggctggcagattggaaactcttgggcaggcgatgatgctgcagtcgtggggcagaatatttctttctcagaaaaggctttcctgctgattggatcaggcccacccacatttccaagaataatttcctttgcttaaagtcaactgattgtagatgttaactgtgtttacaaaataccatcacagtagcacccaggttagtgtttgattgaataactggatactatagtttagacaagttgatacataaaactgtcatagtccatccttgtcaacttggcgcccatacacatcttcttaaatgatacttaatctccaaatgaacgcaataacaaagtcatacttctgcctaacataatatgaatatccttcaaacaactgaaaacatgccaaccctttccccagaagaggatgcggagtccctgggtaatgttcattctccctaataagctataacttaaatatcatgatgtaaagttagctattattaatatatcttatgtcagatgataaagggattaaagagcaagaaaacaaagatatttgctaaatatttgaatacattcgttacaaaataagacataacagttacagttttctgtggctggtcacatggtcgtagctggtttttgtttatgattaccttcttgcactatccattccatttttccctttcccttagcaagcaccttagctctttgtggttctttgcctgttggggtgatccaaaactttgttcctgaagggtctgggcatacccaatttaagtagtccttaaattgggttattgtagttttccattgactttaatcacagagcatggcagtaattacaagatctcttgtattccggacttagtcttttaatcacagagcgtgaaagtaattacaagatctctcgtattctggacttagtctttcatacctccattgtatggtagcagttgaatttcttcttagtaaccagcaaccctggtcagtacactaaccctgggtcttctttgcctgttcattctgaggcatgaggagttcaaagtggccaggtggtagtcttaatgtcggttcagtggaatcattctatctcccagtggaaacagtcctctttttggaaataaggcctctagaccagcagaggataaggttaaagaataggcaacaaaaatttcgctagtgaaacaatagggataatagtgagtggccccactcttatttctctctctggattctgggatccatgaatcctggccatgggagaaatagcaccatacattggatgctgatttagagcatacatagcctcatggaaaacattgcacaagtttttgtcaccttgctgacaacgtaactgagtcttcaaaaatccattctaccattctattaagccagctgcttcaggatgatgaggaacatggtaagaccagtgaattttattagtatgggtccactgttacacttcatgtgctgtaaagtgtgttccttgatcagaagcaatgctgtgtgaagcacctagatggtggataaggcattctgtgggtttggcagaatgcttgcatgcagggaagagaaatccatatctagagtatctgttgtaataagaacaaaacagtgccccattcatgatggcagtggtccaatataatcagcctttcatgagatagttggctgatcactctggggaacggtgccatatcagggactcattattggtttctgtaactggcagattgggcctcattagcacctgtagccaggtcggccttggtacatagaagttcatgttgctgagccaccttcctccttcctatggcctcttcgttcatgacagaagtggctagggaaaaaagctggctgggatctgcagaatgagttattctatctacttgattattaaaatcctgctctgctgaggtcaccttttggtcagcattcacgtgggacacagattccttcacattttttgcccaaagaggtctatctacattatttctccagatcctcttgttaccattttcccaattatgtccttccaattctgtgaccatctagctaaacagtaggccacatcctatgaattggtgtacacggtggcacctctggccatttcttcttccaagcaaaatgagagccaagtgtgctgcccaaagttctgtccacaggagagttttccttcattactatccctgtcccagaaaggcagttagtgctacagccatctgctttgtgatggtttgtgcatattgtccacagtcatctgtaaactaggcccacttttttttcttcggtcaactgatagtaggaaacttcccctgaggtcataggtgtgggctgggagagagaagggaatgtggtaggaatggggaccgtgggcatttgtacaacttcttcatataacttacttgaaccttcagggcctgcttgatcttgatctgtcatattccattttcattcagtgatggagtactgccatgcatgccccactttatgaatcgtggggccagatagcacccagttcataatgggcagctcaggtctcatggcaactccttggcacattgttcagcatttagtctctaataaggccccgtagcaagccaaaatctgtttctcaaaaggagagtactcggtggctcacgcctgtaatcccagcactttgggaggccgaggcgggtggatcacgaggtcaggagatcgagaccatcccagctaaaacgttgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaggagagtacttttccagagaggatggcagagctttgctctaagatcctaagggtcttcactctgattaacctatatgagcctgtcagtagaggcttcacacagaagctctatctgcctctgaaacttgaagcactattggatctactggatcacatgtcccaagtggcacagcagcttacaatggcagcctagtctgttgcaaagccttttcttgttctgggccacattcagaactaatagctttatagttcagtttgtgtgatggataattttttgtgtgtgtcaacttggctggtctgtggtgtccagttgtttggtcaaacactagtctagatgttgcatgaaagtaatttgtagatatgattagtatctgtaagtagttatgctgagagattgcccttgatgatatgagtgggccttatccaatcagttgaaggccttaggagcagaaactgaggtttcctgaaaaagaagtatttctgccttaagactgtaacctagacattttgcttgagtttctagcttgctagcttgctcttgtgacagaatttggactcaagtaaaacataaactcttgcctgcactacagatttcagacttgtcagcctgtataatcttgtgaactagttccttaaaataaatctctatatttatacacatatatgtgtgtttgtgcatgtatatatacatataaagatatgtgtatacatacatacacacacacacacacacacacacacacacacacacacacccccttttggttattggttctgtttttctagaaaaccctgactgatacactcagtaaatgggctagagtagcacacccaaataaggaatatgttgccttccaaatacaaagaggcctactagacattctgtctgtcttgattttaggagggactagctaaaacaacttttacttcacattagaagggatatgtcaacatgtaccacatcactagacccttagaaatttcaccgaggtggaaggctccttgtctgttcaggtgatgtgggttggctctgtgtctctacccaagtctcatcttgcggctcccataattcctatgtgttgtgcgagggacccagtgggagatgattgaatcttgggtgtgggtctttcccatgctgttctcatgatagtgaatgggtcttgtgagatctgatggttttaaaatgggagtttctctgcacaagctctgtctgccgctatctgtgtaagatgtgacttgctcctccttaccttctgccataattgtgaggcctccccagccatgcagaactgtaagtccagtaaacctctttcttttgtaaattgcccagtcttgggtatatctttatcagcagcgtgaaaatgaacgaatacatcaggctttaagaaattaccaaagactgcgtggcttaaacatcaaacatttatttctcacagctctggaggctgagaaatccaagatcaaggtgctggcagatccagtgtctagtgagggcactcttctgttttgcggccatctttttgtatcttcatgtggtggacagcagagagagcgagtgagctcctgtttcataagagcactaatcctattcaagacggcgccaccctcatgactgacagacctcccaaaggtctcaattcctattattactttgggagttaggattttaacatatgaatttttttggggggggacgcatatattcagtccatgacacccctggatttttgtcttactcatttcttaccttctgacatgcatatgttttaccaataagcttagagtaattgcagtttcttgctcactaggtccaattagcataaggtcatgaatataatgggttgttgtggtgtcttgtggaagggaaagttgatcaaggtctctggattaaattatgacgtagggctggaaagttgatataaccctgaggtaagagtgaaagtgtattgcctttcaatcttgctagctaaaaacaaactacttctggcagtttttattaacacacgttgaggaaaaaaagcatttttcagatccatatttgcaaaccagttaccagggtatgtgttagtttgctcaagcagtgaaaccacatctggtacagcaattagaattggagttacctagttaagtttataataatgcactgtcattctccaaaattcatctgttttctgcatgaggtaaacaggtaagttgaatggggatgtgttagaatcactacccctgcatccttcaggtccttgatagtggcactaatgtatgcagttttagagtgaaacatatttggagtgacatataaaatacacagaagaacattaaatgtttatgtagtctaatgaataataaagggaaccattaaaccaccttcaggtcatgaaatagaacttcatcaacacccctagaagttccccctccccatagtccctcttcttaatcacaacctctcctactgccagagttgtcattatttctgtcatgatactttcctttctttttactttttacaatttgtgtatgtttacctagataatattatttagttttgtcttttttggactgtatattaataaaatcattgtatgtgctttttgcctgtcttgcttttgctcaaaaaagtgtgagatttgtccattttgttctgtgtagctgcattcattcatttttattgctgtattccaattttgaatacactgtagtttatccacttttcttatgaagcttttgtttctagttttgaccttttatgaacagtacttctgtgactatttctttattgcacattttttgagtgagtttttcaagggtgtgtaaccaaggaggttgctgggttaggtgatatcagctttccttagtaatgccaaattatttgccaaagcggatgtatcagtttactttcccagtgtcacgaacattggtattaaacattcattttttttttgaagttgagcatcatttcatattactagttatctagatttcctcttttggagattgtctatttaagtcttctgttcatttttttattgagttggagtgtttttttcttacagataattattttttgagacagagtcttgttgtgtcgcccaggctagagtgcagtggcgtgatctcagctcactgcaacctctgcctcccgggttcaagcgattctccttcctcagcttcccaagtagctgggattacaggtgcccgccactgcgccaggctaatttttatattttcagtaaaaatggggtttcaccatcttggccagactgggctggaactcctgacttcgtgatccacccgcctcggcctcccaaagtgctgggattacaggcgtgagccactgcacctggcctaattctttatatttctgttatatttgatcacaattgcaatatctcttccgaatttttgccttgtctttttatatacttatgtgtgtatatatatatatggtgtattaataaacagaagttcttaatgagagtactgccaaattaactggattttccctttatagttaaagctttttgtgtcttactgaagtaatccttttctattctgtcttttattgtctttagtttaacttagtttgtatttcaaattcaggtttttattcactgagaattgattttgtgttttttgagaatcaggtctgatttccatttttttccttccgtgtggatgttcagccaattgcagcaccatttttttttttttaacaagtttgaattttccccactaatctgtggtgctagttgtgtcgtatagcaagtgtctgtatgtgtgtgagtctgttctgggctctttattttttcactgatctatttttctgttgctttgacaatactcacagtgtttttaagtcactgtcatcttatatgtcttaatatttggtatagcaagttttatttgttctttttcaagactgggctattctttgccctttgcatattcatataaactttgcaattagcttgtgaagctgcatggaaaaaaacctattggaactgcactggttctattaaattgatttggaggcagttgacatacttataacattcagtcatccagtctaaaaatttgataattatttctggccgggtgcggtggctcacatctgtaatgccagcactttggaaggccaaggtgggtggatcacctgaggccaggaatttgagaccagcctggccaacatggtgaaacttcgtctctactaaaaatacaaaaattagctgggcatgatggcgcacgcctgaaatctcagctatccaggagggtgagttaggagaattgcttgaacttgggaggcagaggttgcagtgagctgagattgcgccactgcactccagcctaggcgacagagtgagactgtctccaaaataaattaataaatacataaataagtatttgataattatttctatttaagtctgttttagtggctctcataaaattttatagtttttccctagaggtcttgcagcttgttgtatttattcctaggtactgtatttattcttaggtactctttgattcaaaacataaacgtttttattttcaaaatggttttgccagttcccaatgtttaaaataacaaataccatcatggatccatacgttttgagtttttttgcatgttaggaagcatgaacttgcaaatatttttctccttttcctaactttttttagtatggctagagaaaggcaagattttgaccttaagttgcgatgagaaatggaagaaacttttttttatgtttttgaatttgtccataacccagtttcatcagttttaagtctccatcttgcactgtcatttatgagagcaaactagagttgcagtcccaaaccatggaacttctttgtgtagtttgttctcatgaaacattcagccagaacaggagggcctaagtttcagacaaattttaaattagtttggaaaagtaagtggatctatttttggcttatctactacctcaaagtcattctctttgtaagggtgtttgaagagtaataatcaaactcagtgtgttagttttctactgctgcataatgaattaccatacactcagcacctcaaaacatcatatgcttgttatttaagagtttctgttggtgatgagtctgggcatggtttacctcaattctcagattctcacaaggctgaaatcgaggtgttggttgggccatgtcctcatctggagcatggagtcctcttccaggcttattctggttgttgaggtaattgagttccttgttgtagtactgaggtcttcaattgcttgatttgaccacttgttgctcctaggaatagcctgttgttgcctgatacatgactccacaacatggtagtttgcgccttccaggccagcaggtgaatctctttcacacttttcatctctttgactgcttttaagagctcattagataaggtcatgcccacctgggataaatttccttttgaagtgaagtcaattgattagggctctgaattacatttgtaaaatcctttctgccatgtaatgtatcataatcacagtagtgataatcccatcatattcacaagtcctaaattatacagggtgtatcaacaggggacaggaatcttgggaacaatttagaattctgtcttccacactctcatccatacatgaaaatttcgtatcttcatatgagatgatgccttgactcttcttgcctgaatttttttaaaaaacgcttttattttgaactaagtgtattctcacaagcagttttatgtgtacattgtaatattgaatcttccaattttaaaattggaagttttccccagatgtgacatcttacataaatatagtacattatcaaaaccggggaaaactgatagtagcataatacaattaagtaaactacagacttcaacttcaccagtttttgcaggcattggtatttctttgtgtataattctttgtacagattcatataaccatcacatttcaagacacaggactgctctgtcatcacaaaggaattccctcatgcttccccttcatagtcaaaccctattcctaaatcctgttttccacttttatacttttgccatatcgagaatgttgtgttaatggaatcctagattatgaaatgttctgatggtggcccttttcattcagcataatactcttaagatccattcaaattgttgagagtatcaattgtttgttcctttttattgatgagtaaatatttcattgtatggaggtacctcagtttgtttaaccattcacccatggaagtccatttgagttgttttcactatgggcctatttacaaataaaatgcttataaacattcatgtccaggagtgatgtttaactttttaagaaactaccagactgatctccagagtggcagtatcattttacattcccaacagcaaagtatgagagagagagtttctctgcatcctcaccagcatttggtactttctgtatgttttactttagttgtaataggcctatggtgctatctccttggggtcataatttgaatttccctaatggccagcagtgttaaacatcttttcatattttatctgtcatctctgtatcctcttttttcatgtctttcactgcttttctaattggaatttgattggattttactgtggacattttcaggtaaatacaaaagacacagtagtgtaataaatttctattatcaagcttcaagagttatgacgtttttgctcttttgtttcttttgagtatttcaaagaaaatcagatatataaatatcatgacatttcacttgtaaatacctcactatgcattgctgtcctttattaggacatttgaaaactgtaaccacaaggatagcatcatatttaatttaaaaataattccttaatatcatctaatacttagtccatatttacattttctctctcaaatatgtattttatttattttttgagacagggtcttgctctgttacttaggctggagtgcagaggtgtgaacatggctcactgtagccttgaccttctggggtcaagggatctttctgcctcagcctcccaaatagctgggaccacaggtgcaccaccatgcctgactaatttttatagaaatttttgtagagacgaggtttgcctgtgttgcccaagctggtcttgaattcttgggctaaagctgtctgcccaccttggcttcccaaagtgctgggattatagacattagtcactgtgcttggtcccaaacatgtattttaaaaaatggttgatggaaatgagaattcacataagattgattgcatttagttatgttcacttttcagacagcacttcttttttcctcaggcaattgatttgtcttctggactaatttggatttggctgattccttccttattttgtcatttaacttgttctatctcatttcctctaaactgatagtaagatttagcagcttggttagatttggtcttaagtttttagacaagaatacctcgtagaagtactgtgtacttcttgttatattacatcaggagtcacatcatgtttggttttcccactttttgaattactaggtttgatcagtgggttcaggtattgtcaactccattcctccatttaaaaagttttcatttatccttcatgtagtggctgtggttttccattagtctttcatctaatcatcactattgatgattgttgcctagatccaatatattggtgttgcaaaatagtgattttctgatttattctgcatttagtagctggactgtcaagaactttgatcagtattttggttttcatgaaatacagttgataaaaggcaggagaaatgctcatttttttcacccttatgtatcaatttttagattaataagttgatatccttgcaatctacagaagacaccaatgggatatttttcctttcatttctttatgtatcattttgaatttgtaaatttttaaaaaggcattttatgcattttgatgacattaaaaaattcattttctgtctgcaggcatttagaaatacaattaatttttacacatttaaaaaaatttagcaatctttctaaattcttgttaattttatttctagattattcctctgcaaatgacagttttttttttaatcccaagtctttataccttggatttcttttttttccttactgtagaatagaaccttagtaaatgtttgaatagaaatgaagataatacaacccttctcttgttcctcactaatggctgtattttgctatagattatttatcaagattaaggtattcccttatatttctatacattttatcaagcattaatgtttaattttatgggctactgttttacgtctattcccatgattacatgagttttctacctttaacctgttaatgtgaattatgttaaattattttctaatgttaaaccaatcttctgtccctggaatgatctcaactgtcatgatgtattattatcctttttgtggttaaatttaatttacaaatatttttagagctttacatttatgttcatgaatgaggctggctttataattttcgtgtctagtactgttctgttggttttggtataagtgtttcactacctttttaagtaagtttcttctttcaaatctctggaagagtttgagagtggaattcttctttccttgatttttgttagaactcactaatgaaacaatcaaggtttagaagtttctttgtgggagaaattcctagatagtttagtttttagttctttgaagaatatagggtaaaagtatctttctttgatgacagagctgataattataagtgaaaaattcagtcactgatgaatactttttcctgagtagtttgaattgatctgttttgtgtctattttttgaggtacatgctacatacattttgtctgtaaacaactatttagcatattgaataaaattacattttaaaaatagactttgtactatatatcactttaatacaattgtttagatttgtgttttaagcttttcacacttgtaaaatttctgaataatgaatttttaaggaatctttgaagggcttttgagctaggttctacttctggctctgccaattactgtcttgagtgtgtctcttattttctgggcctcacattttgcatttgtaaaacaagtatctatctatttcatatagttttcatgaggataaaccgagaagtcttttattaaccataaacggaaagttttgaaattagggaatgtaggcaaaatgttcaaagagagggagtagaaggagcctttgaaatctgtgtgagtccctccagtttataggaaatagaagccacagaagctagagaaacgcccaaggttatctctaagtagctagtgtacagaactgaccttgcaacccagtcttcctgctttccaaagcagtgggctttttcagttttgcctttcttcaaatgaaatactaggtaattgagagaagctttgactttagcaggtacatagttgagtgtattatccccaagagttaagtagaaaagtgtacatgacattagggggaaagaggaattttaagactttagtttcttaagttactaataattaaaactgctgtcaaagtaattattgaatttttttcccgctcagaatctagacaaagagagccttgttacacttttcagggattaaaattaatctaatacagtaagaagtaaagtcttgtgtggttactgcatggctttgtactagaaattcagttgaaattttactttaaaaactattacttcagtataattttagtaaaatcttaatttataattggcatgaaacttccaagctaattgttagaaatagtttcttggaatccagtttttctacttaattccttattttctccaggtgtactctggaaaattaatattgtctttaaattcttgaagtcgatactacaaatggaagggtttatcattatctcagtattgaaggctcaatatattgcacagtgtttgtagtgtcttatcccctggaaggggacttcattcctctctgtcactgctgtagcttactgaagccaagagcaggaaaaggaaatcccagactgcagacccctcttccctccagcattgtcttttctccccacacccttcaaaaggcacagcacatatttcagttgctgatccttgtcccttggtctgtgtctgatctcatttaagaatttcctctttccttcccttcttgcgtttcctctccagggtgtttgctgcctgagagatggggagacacctaggacatgctacaaggaggggcccaagtttgcagaggcagttttaaaatctcaagcgtgcttgtccgtgtagctttgtagaaaatatgttttgcacattttcagtaagttttaaaaatttttacttaggtaattttcaacacacttgtagttttttttggaggtaacaccatcaaatgctaaatttgtcaagtgttttgaataaaaaatttctaggaactgaggttatgttctttctgtttaaatactaatttctatgaggattcaataaacatattaaattcattatacttttattgacttaaagctgaagggaagatttaatgctgttttagctgttttataggcttgtgacttttttccttggaaaatcagaacattttcttttaaaaacatttattacatatcctcattgcaaaggtataacttgcgtctgccacagagaagagtttgtcctttaaataaattttcctttttgggccttatagatgttgttagcgatattaaatctgtggttttctagaactatttattattctttctttatttttaaaatttattcacaggaacccatgagggtgaatattttatgctaattttgtggtggaggaagctaagatccaaagatgttaagaagtttgccgaagattacatctttaataaatagtggaattgcgatttgagcttaggtctgactccagacttggtggtctttgtgaaattcttcttatccctttgagagactgattatttggaggaggatatgggttgataggtaaacagttacttgcaactataatagttatgcataaaatgttattaagagtgcagagtaggaagcatctaactgttaggaaggtcaggatggctttatagagtgaatcaatggcgaagtgattcttcagggatcacagtgtgcctgtatttcatgctgtggaggttggtcttcattctttttgggggaatgggaggcactgaagggtttcaacagaagtggtgatgtgaccagattcatattctgaagagatatggtagctgtaaaggggaatacaatgtagcgtggtggtgctagagatagggagaccattacaggaacacttcgggagaagggatgaggttgtttcttagggaagtggtagagagtgggagaggagggaactggctttgaacttttaataattagaaaatatgcagatgtcgttctcacttattttctcacgctgtcagaaatagtaagagccaaatgtttgtgtttagaagattgtcctagtcttgtgattaccttcaaattactgatctgcaaagaactttaatcctaagtgttaagagtatagctacatttaggagagaaatcacgtctttcttgacaaagccgtgtctccagatggaagccaaatttatgcctggattatggtaataatggaataagacttttcagtataggacctacacagtaacagcagttcaggaagcaaagctaatattactttgaaatgatcagcactgttttatgaatgacttctttcattttagatcattcaaaatcatttcttagaaatttctgatttgagttctgcaggcaggaagaatgcggtaattgtcagtcttttgacagtgtgtcctccaaggcccatttctatccatttgatgccacactgcatcttgtcctttcctcatgtcctgagccggaggggaactattgcagagttccagtctactatgtggtaggtggagttttcttggattgtccgtaagaacactcttcctgttgtttatggggccaaaaataaaagtttgtgatagtatgtgtttagtttttagtatctaatcattcataaatttagtttaactacctagatttgtctttctctaatattacaaaatacaaagggaaatggtagccgtctttgtgcttgataatgaataaggtcttttcctgctcggtgacatctctgtattatggagtctgcatactgtagtggaactagtgagagttctacgaaatagtaaaatgttccttgtaaaaaagttttttttggccttacctcattaacacagccttagtttagacttttattgcttgggataataaaataacttggccccctacctctagtctgttgcccttaaatccatactctgcaactgtatgaatatttgttacaaaatacaaatctgacattgtccaacatgtgtctccttgcatctcttattgctaatgagttctgttaaatgcttggagttgtaaccagagaggctccttggacatttgattttcgtgaagtctcactagctgaacggttttgttatacacacgtgcatacttgtacttgatttttgcaaaacattttaatgaactagttatttctgtttgcttcaagtactcttttacttatttgcttgtttcttaatggcatttattgaagtacctgatactggtaaatgttaattgagacaagagcataaaattataaaaagatagaaaagaggatatataacttataataaataagaaaatggcacaaatctcttgacagctgtcttcataatactaaaggctagctcagctgaggcctgcaaagaatactaagaataataaaagacattttcagatgttaggtttggagaaaaaacaaagaaggcagcaggttatttctgatcctgtaatgataatagatgacaaaaagtgtcaaattcgataccacccatctgattcttttttttgttaggaaaataattgtttaattgaaaatggtagagccaagttattgagagataattggatgagaaaggagctaactgttctcagtggctaggatttttttttaatcttagggtctaaaaacaactttttttttattatactttaagttttagggtacatgtgcataatgtgcaggttagttacgtatgtatacctgtgccatgctggtgtgctgcacccattaactcgtcatttagcattaggtatctctcctaatgctatccctccccctccccccaccccacaacagtccccagagtgtgatgttccccttcctgtgtccatgtgttctcattaataattctgttttcatgatctctgagcaatcttggagactaggaatggcatgtacaggctggcaggttttttgtttgtttctttgttttgttttttaaacattttttcaggtataattgacagacaataaatgattcatacttaaagtgtacaatttgctaagtgtcaatatatgtatatactcatgaagccatcaccatagtcagtataatgaacataattatcattcccaaaagttttctcatgccctttgttagaggtgactgagaaggagcagtcagtaaggagaacaaggctattgtgctgtcttggaaattaaatgaggaagaaaatgatcagctgtggcaaatgcttacttataggcacgataacatgagaaatgagattgtccattggatttagtaatgttgaggttataggtgatcttgaccaggccagttttggtggagtggtgagagcagaggcctgactggagtggattttaagagagaaagggaggagaaaaattagagacagccagcgggaatatttttaagattttctgcaaagggaagaaagaaatggagaagtagtgaagtggggttgagagtgttttgtctttttttttttttttttaaaggatgggagcaaaagcccagcatgtttatatgcccgtggcaacaattcactgtgagaaaaatgtaaaggatgaattagttcctggagtgatacccttgaggggctaagagatttagtttacaagtgtagggattgacatatagaaacttggataatttatctgtgtcagtgggcagagatacagtttgaaagtgtagacagtggatggtggttgagtgggttgtgggagtttatggaagttctcttcaaatagcttcatgaaaaatattttctttcagtgaagtataggaagcaaagtcttcactgtgaaaaaagataggaaggaggcattggagttgaggatcaagaagatacgaaatagaatgggagagtgaatagaccagaaagttatggtatgtttggctggcagcattaagggttcagttgcagtctgtggttattaatttaaagcatcatgattagccatattgagataaaaagtagttgacgaattagatttaaccaggttatggctttgctagccaagtatgatgaaataagagaagggcaaggaagtcgagggtgtttgtaggtgggtgatgatgagtggccatgggttaagctgtgaaaggaagcaagagaggacatcaaagggtgagggacagtaatctatgcaagaggtgttggtggcttagtaaagggcagagtctggttaatattttgaagatagagccagatttcctgaagttggatggatgtgtgtgggaagaataatcaagaaagagtgtttgacctgagcagttttaggaatggagttgctgtcaactgatgtgcttagtcctttcttacagtcttggtcgtgttttgttgatccttataaaaaagagaaaattttgtagcataattaacatagaaaaatataaatcggctaaatccatggctatgtattaaatttctatgctgatttatttattcagtaaatatttactgagtgctatgtgccaagtggtgttctgggtaggaatatagcactgaacaaaacacatacattaagaacttgcattacttttagttcacacagagaaaatagcattttggaaaatgtatgagataaaagggattactgtatcttaaattatattgtttttgtatttaactgttaataactggtttagttggctgtttatgtgtgtgtgtatatgtatatatatacataaaatatatagacctaaaaatacatataaggccagttttatatctttaatccagaaatttatgaagttattttttgatcattattttttaaaaattaagatattatagaatactgtgcagccataaaaagaacaagatgatgtcatttgcagcaacatggatagagctggaggctgttaccctaagcgaactaatacagacacagaaaaccaaatactgtatgttctcacttataagcgggagctaaacattgagtgcatatggacacaaagaagggaacaacagacactgggtcaacttgagggtggagggtgggagggaggtgaagattgaaaaaccacctattgggtgctttgcctattacctgggtattatgctaatctgtacaccaaacccctgtgacacacagtttacctgtgtaacaaacctgctgatgtatccatgaacccaaaatacaagtttgtttgttttttttttttttttttgaaaagctattgcagagtttcagcaataggtgatataatgattggactagtgcgatcataatgaagatgcagtgtcatctcaaaaaaaatttaagatattaatagtatattctaaaaaatataaaatgttagtaaatttgagggctaatgaattggaatttattttacagtttgtggaccacatgagaatatctgtttttctttcctagcatgtgatacctcatttggactggaaatgatattctgtagattgattgcctgagcagtttccaaagtttaaaggcacactgaatgtaagaaattatgctattattaaacacatgcagtgaaaccccatctctactaaaaatacaaaaaaattagataggcatggtggtgggcacctgtagtcccagctactcgggagactgaggcaggagaatggcgtgaatctgggaggtggagcttgcagtgagccgagattgcatcactgcactccagcctgggcgatagagtgagactccgtctcaaaaaaaaaaaaaaaaagaatatgcagaaaacattgcatgtgctttggtgtaattgttttgggtaattaatgagtctcaggcatttgggatagtggctgagttgttggagtaagtgcgggtatcttcctaaggagaattttttgaataggaagggcaatattaacttatatgcatatattttgatgtattaattaaattatttcattatttttagtgttattttcagtaaaacttggtgttgagagagtgagtccctaaatcattatcatggaagagttgaagtaaacacttagaactatatagttcttagaacatatagttagaactatatggtataaaaacattatgtgaaaaaggataggtagaaaggaccatagtgaagaatgaagttagtgatcttagagttagctgtcacttctctcttaaactattaaacagatgctttgcctgattcagcttttacgtgaaggctttttgcaggctgttaacaagtactgaagtctccattttctccctcttgcttttggatgtcttaaagagggtattaaaaaaaacttggaaaatagtttccttaacattgagagacacaattacattttctgctttgatgttttaattatcaataaagatttcagtacactttgcaactgtgcattactttagagccttgtgtgttggaagctaaattatcgtactttaatatggaagggttttgtaagacttcctcctccccaaacaaaacaaaacaaaacaaaacagaggctttctatttttggaggtttattcatgagaaaagggattggttggctgtttctttccatgttggataagcagttcccaacttaaaaatacttaatttacaaatatcattgaacatcaagtccctggtctggcctcatttcccttgctatgtggctggcacagcgcacatatgtctgattctcccctcttcccttatgattgtagcatagctttgtaaatctgttagcttggaacagtacacggaaggggaattacccatttttgttgctgagaccaaattggtgggactctgcttctcagttggaaatgtttccacttagaaacattaagaactttctaagataattgttcaaaaaaaatccagtaaacacatagcaacacttacgtctcaaatgaacatttcctttttgaaagtagtgctttggaggttatacttctgggaagtgatagctttaatgaacctgcttttagagttcctgttttggaatttactttcagaatattctcttttgggtattttgaaaactagaaaacctttttcttgacaggttgtgagatatagggaaagatagagttctttggatttggacagacgtgggctgaatttcaacaaaacagttaaccaggtgtttaaccttgggcaaattgcttttcctatgagaatcttggtttagtcatcatgagaagtggtagtatgagactaacacagcatttgaattagataatcaagtaaagcacccagtcattttgtttgtttgtttgtttgcttgttttgagacagagtcttgctgtcgcccagcctggagtgcaatggtgcaatctcagctcactgcaacctccgcctcttgggttcaagcgattctccagcctcaggctcccaagtagctgggattacaggcacatgctaccacgcccggctcatttttgtatttttagtagagacagagtttcaccatgttggccaggctggtgtcgaacttctgacctcaagtgatccacccgtctcggcctcccaaggtgttgggattagaggcgtgagccactgcacccggccacagtcattgttttatataatacagtaaatgctctatttccactttatcctctctctttgtattttagactatatttggttttggaatcagtcaaaagatttagaacaaagtctaattttcattctaaatgaaagactgatatttttgggccaggcatgttggctcatgcctgtaatcccagcactttgggaaattgaggcatgaggattgcttgagcccaggcatttgaggctgcagtgagctatgattgcgccactgtgcttcagccttggcaacagagtgagaccttgtctcttaggaaaataaaagatatttttgataactgttaaggtaacagtaatataacaaaaagctagacttagatttcaggagacttagcattgaattccgactgtgtcgtttattaactaattactgtaggcaccttactcctctctgtccatgatagtatttagttatctattgagttacaaatatgtgccatactctgttaggtgttttatacattgatatatcatgtaattctaacaataaccttgcaagggtgctattatttccattctacaggtgaggaaattaaggcaaagtagttataactttcccgaagttatatagtaagtggcagggtgagaatgaattgaaagttctttttttctctatggagtattcaacctttctcatctgtaaaattgtgaaacttactttattttgcatgattgttgttaaaagtccttgtactgagagagaagtaaaacaacgtattgcacttggatcaatgcctggaactaacaacaatattctctttatttctctagtgttgatatagttaagatagtattaatcatctttgttcactgtagcttgtgtttggttgtagcttttattgtggtaaaatatacgtaacataaaattgatcattttaaccgtttttgagcatacaattcagtagcactgcgtacatcataatgttgtggttgtagcttggaattaccatattctgccttccaaaacaacacaaaataaatagaaataagcaaagctcttccgctgctctgtgctcataacgtggttaatgaaaatgttagtagcatgagctagggtctcaaaagggccagtgctgcttggaatcctggttcttaattattttggtcactttggtttcacttgtataagtcagtgagatttttatcatctttggagagaagttgaaaactgcttctgtgattttatatatgtgtgtacccaaatcttttgcttaagacatttttcattaaattttcaatagcatccctggaaaccaggagtcaagaaatttgcatgcacctgttaactttctttttctgcacctagtcaactattttctaagataatgatagatgctacaatgttatatacagaaacatcattgttttctaggaatttacagtataaaacagtagagaaaattagaaagccggctggtcacggtggctcacgcttataattccagcgctttgggaggccaaggcaggtggatcacttgtggtcaggagttcaagaccaggctagccaaacatggtgaaatcccgtctttactaaaaaaaataaaaattatctgagcgtgttggcgagcgcctgtaattccagttacttgggaggctgtggcaggagaattgcctgaactccggaggcagaggttacagtgagctgagatcatgccactgcactccagcctgggtgatggagtgagactgtctcaaaaaaacaaaaaaacaaaaaacaaacaaaaagccaaactaaaataaaaaaattagatagctgtcagtgaatatagagataaatacagctgtatgaatacacctactcgcttatttagatacactgaaggagcatattggttaaccatgaatataagtgtagatactttttggatagaggagtatgttagtaaatgaattgcatattaataagacagttgctgaggtagaggcattaccttctggttcccacctatagagaggctctgagatcagcaggaatttaagttgcttggtggtggtgtggtggggtacaggtggggaaatatgtaggagtgaaataatcagaatatggtaactttttaaatgtctctggaaggtgggaagggacctaaggaattgagtttgtatgatagtctgtttaaagcatttgaggtcgggtgcagtggctcacgcctgtaatcccagcactttgagaggctgaggcgggcagatcacctgaggtcaggagttcgagaccagcctggccaacatgctgaatccccatctctactaaaaatacaaaaatgagccaggcgtggtggtgggcgcctgtagtcccagctactcaggaggctgaggcaggagaatcgcttgaacccaggaggtgtaggttgcaatgagctgggatcatgccactgcactctagcctgggcgacagtgtgtctcaaaaaataaataaataaataaataaataaaatgaaatgaaataaaataaaaaaaatgaaataaaacatttgaaaggtatagatgaagttagcaatcatttaggggaacttttagctaacaatcagggaaactactttgtttttgctagggtccaggtaaattagcaggtacttcttatgcaaagtgagtgattacagagattcagagttctaagaggcagtcatcagtcagaaggagttttcaccaaaggtcctgtattttctgtttagaatagtacttaagccataattagagaacatctgcagtggtttctcagccctctgttggtaaagtctgtctcctttaattgttgaacttttgaaaagtctgaatagataatcagagattatctagagtcttcttcctgcatttttatagcattcctggtatagcatttggtatatctagtccagttacaactttccctttcttatttgctgttctagcatgtaatatatgctctcaataaatattagtattttttgaatgcctatcatcatgtaacaggtaacatgtataaaaggctgaaactcatttttctctaaaaaatatgcagcagcttttattatttatgcattactctttttggagaaatagccattaatcctgttatgtgctaggtgtttgtagtatgctagatactggaaatataagggaatactaggaatatgaaaaagactttgccctagagagggtatcagaagagaaggaagacattattcactttccttttgagtttgaatcaggtctttgatatattgaaaaatgacacctgaaaattttctcgagaatttactctgaaaatactcacgttgaatatttgaagtattgaagtatttgattcggtaaatgcttgagcgattagtggaagtactaaatacaaacaatacttatttaaaaagttctctcagtggtagtaatgaagaaaatcctaatcatgagattcactaaatagttgccagcgtggtaagccaagttctcggcggcatatgctgttaaacactgttagtgggctgcagtccttagtttgtgattgagtcacctggctccccttcttagttgttcttttctgcatgaaatttgctgacttaaataatattataggagggaacctagctctaaagacttcacttacttttttcagcttcatttctttcttaagctcttaatttcataagtttctgaactgtattccccacatatatcaattgactaggatgacaaagtatagaatatgccatatttattcctctagtgaaggcaaagggaatagcatttgatgcattttgtaattctgtgtttggtgtggctcagctagatagatgaaaatgtaccttgttttacctaggatgacttttaggcctgaaatgccagtcatatttgtctgttttctcttaatatatttagttctcacttcaatatgatcttttatttctgtccccactatcatttctatagtttatattctattacttcttgcctagactgttgtgataggcattctttggtagcaaacatatgctgtagattaaaaatgaaatggacacattcacctttgattgctacttcacctgtcttttgctggtgtttcttctttccattggggagtactgttggtatagcagaggacagttctttgttgtgtgggagttgtcaggcttgtgcattgcagttaactcagtattcttgccctccacaacacccccgccattgaccgccagtagcagctgagagagggtgagtgagcagggaggcggccttaccactctcagttgagaactagcctgctagccagtctgtgcttattgtgggttccagagctcatcttatttcctgtttatgtttattcttgttttccctttttctactcccaattaccaaaatccagtttcactttcataaggtcactgaaaatgcaattgcttacatgtaaaagtcaggcaaagtatgtattagatttggtaacatacaataataatttacatataagatgtataacagtagtaattatatatagtaatatagtattatactatgtatagtaactatacatagtaatattgtatagtaatcaataaaacagactttattttcgacttcatggagttttcactctatcacgagagtatgagagccttaagcactgtcttaaatattttaaagttccccttggttatttttgtatggtatgttgcatattttgttcaataagtatttaaacaataatatatgacagtgaatagaatttatactttaggcctggggaatactgaatagttttaagcagaagagtaatgttattagatttctactaactacttaggtttaaattcagtgttaaaaggtgagttttgttaatttctccatcctgcttttctaatcagccaaattatttcttgaaaagcttttttctttcaaacattttggaaatccaattaggtaagtaatttagtaaacaactatatttatattgaaagtcctgttagataagtaatttagtaaacaaatatattttgagcacttactgtgtgccagatactggtttaggcactgggcaaagaggaatgatcaaaacaaagcctgtgatctcacggttgcattatggcgggagagttagtaagcaaacgaatcaactcatatactgccctgtgataaagtgctgtgaagaaaaattaaacaagtagaaagagtgaaggagaaggctatcttacatagggaaataagacagcctctgaggaggatcatttaagttggaatgaaaggagttaaccaaccatggatatatttggaagaaagagctttgccaatggaggaaactgcaagttagggctttcagtgaataatttattaatgtttttttctccttgattgtcactttaggataatctgtagatccctccatgatctggccttcgcttatactttttctgttaattatctaattaagtgggaataatgcctactttgtgggcaaagtgaaatgtgtaacacttaatttttatataagtatattttatgcaatataaatacaaggatgctccatattcatagttattatcacccttttgttatataataatcattagcttatgttcttgcctatccctgtcttcctagagagcacttgctcatctttcaagaatcagtgtaaatgtcactttctctttgaagcctttcttgctgtgcatgtagacatgactattcccttagttttgtcaccattgtttatttgtatatctgtcattgtatctgccatctttatttatttgtttttaccttttgtgtacccagcttctaacctagactctggcatttagatatttgctacataaatgaattgtatttagaagctaattcatttggcttctaatatttacatatacttaaaccattcaacaaatatgtcactgtggtagatactgagaataaaaaattaatacaatgcatgttcccaatcaagtttagggtaaagttacgatacaatataatatacttaatataatggtttgttcaaggggagtgtaaattaaagtggagatagattatctaaaggaaaagtaaggcaggaagtatagatatgtattctagattgtgaatatcattccacaggtgtctgatgatctccttccacggggcacatttatgcttcttggtgcagtcagcttctcagccaggtcctggcaatatctgtgatagcggtacttaattctctgatgctggtgacactgacccatttatgttcgttatactgacacttgagcatagatttggagttgtgaatacttagaatcccagttgtcatttctaggagtgtgatcttaagcaagttactcatgagtcttacttcctcatctggaaaatagagatattatctgccccatacagggttgcagggaataaattatgaagataaaatagtattggtttctagaatgtagtggataatatttcttccttttttattttttatttatatatattttttgagacagagtctcactctgttacccagggtggagtgtagtggcatgatcttgactgactgcaaccttcgcctcccaaggtcaagcgattctcctgtctcagcctcccaagtagctgggactacaggagcatgccactatgcccggctaatttttgtatttttcgtagggatagggttttgccatgttgtccaggctggtcacggactcctgacctcaggtgatccgcctgcctcagcttcccaaagtgctgggattacaggcgttgagccactgtgcccagcctgtagtagatatttcttggtgggtgaaataattttaattcattttactttatttctgtagaaccatactgagcatttggctctaattacaggaaaacaaggtggaatttaataatggtgttgatagctgacttgggttaggtctcattctgttgcagctggtttcttttccctcagcgcaaagtgctgctgttaatccagagaaaagaatgcttagcatataatactcaaaagctgtatcacactatgttgcatttaacacaaggtgagggcactgaggggaggacatttgtcttagttgttgccttgtgtgcccagcaccaagcacagagcctgacgtattataggcactgcatatcgtgtttaaattagcgagtgaattctgtttagatgaggaagatgtactagtatggagtacctgatgtccactggggcattttgggtagctaaagaaagtgtctataaaatataagcaaaggagaacaatattggtagcagttgcctttcaaaccattataattataggcacagaccttttttagcaggttgtatattttaaaataagtataggccagctaatttgagttaaaatgatcacatgtgctgaattaactagaaggtaaacaactaaaaacgaaaagagacattagaacaggtaatagagttcagaattcacagctattctaaattagatttgtaaaagccttgagtcttactttaaaggaaataaaatttcatgtgaagaaatggatcactgttgccataacttcaactcctgtctttcctctgctgctcaaacttggcaaaacaccaaaccctagagcagtctcatcatctaccgtttctgttccttggaggcatggtctgttgagtgctgccaggctgactgtcagctgtgtctctcagtcttgtcaccatcctattccactgtcaccagagggatctggtgaattgccatcatcccattccattgtcaccagagttatcagattttaaatgaatctgattgtgttattcccctccttgaaatccattaatagcttctcagtgtttttaggataaaaatccaaatatcctggtatgagaaacagagcttttagagatctggccttttagcagtctctacctgatcttcttttttctgtatgttggtatctttgtactacagacatattaaaccacttgcatttttcttaatgttttatgtttttttttttatgtcactgaacgtatgatgctgcttctaggcatgctgttctctcttctcaaggttgtcagctacagatgatttaaaattctttaagtttacctctagaaaacttttacctaacatgatacattgtaggagtctacatgtcttccttctcacaaaactgtgagcttttttgagtatggatactctcttatctctttaattcctaatgcctgtcactgccttgcacaggatagaagcctagaagtttgtaatttagttaatatatgaagtaacagaatttatcagaggcttaaaatatgttcagctaaaatgggtattatgtgagaagtggagaaacatggtccctgccctgttcataatcttagttgtgtggacaaaaatgacacataagcaattaaagcttaatcgagtacagcattaagtgaggacttaggtagaatgattagaaaatgaagataaaatcgaaaatttcaaatcccttgacatttcatatctgcttttcactttccccttaaatgtttaccactactaacatgcctataccgtttacttatttatcttgttaggttcatagtccccagtaaaatataagttttatgaggatttttgtctgttttgttcaccatggtatttctggtgcctgacatttggtaggtgctcattagatagttgttgagtggattgaatggagtgcagagaaggaagtgatcactaggaaatagtgtttatgaaagacttcatggagaagtattaacatcttgaagtagacttgagagagagtattttattagattagctagtgtttatgaaatacgcctatttaaataaataattaccaattttattttcctatgactttttcaagtcatgttgctcctaatttctcttaaagcttcctgtggttatatggtcctcactgttgactcctcttagagactttcacaacaaggcctatttaaccagagtgagagatgctggccctttccttatataccagttggaatgaacaccttcactttgttctttagcagattaaactatgtgtaaaaaataggtctgctggaggcaactacgtattatatacagatctttacactatatgttgttttggtacctgagctcttatcttctattttgcatcttttaaataattgcaaataaatccaaacttacgggcacatcagggtcttgattgttctgtgaattagggatcatgattgaccattatgcctccgagttcttggattttagcaaatcttgactggcgttccaaatatttgtatgtacacgtatttatatatcacacagaacttataattgcatttcctacttttatagtttcctttcttttctgattacttcccttctaagactaaagaaattaaaattagattttgaattaaaactattaaaaatgttaaaacaccaaaatattttttcagctgtaattggaacatgttaggtaatatcagtttgacttttttttttttttttttagaaaataaaattatctgtgggcctcaaatattggcttctcttctcccagctttttttctcctaagcacagaattagatattcttaggcccttatagctgcaatagatcttagtaagtatctctacttgctttattttagggatgaggcaactaagatgcaaggacaagtgatttgtccacaattaactaatgacagctaattgatagtagggccagatgatagactatcgatgagataactaagctgtggctaacctctgtcttatgctaaccactttcaactttaaggccatactatttctggaaatatatgtggttctgatggcattttaaagaaatgttattgtagtgacttgatagaagagaagtaagttcctagaattttgtcagtccgccagtcagccagactgggtataagtgaagctgcggcagtactttcccattttggtatataggttgttagctagttatgtgcacaggaagtaatttccatcagtcatgttaagccattgaaaaatgtttcatgctttctaacttagtttttgacaacctgaatgtgaggattcacatatattccatagggaaagggttgaccagtaaatgtgtattaaagataacatgaagaacaagatttaaaaacatctggttagtctttttcttttgtttgttgttgtcatagttgaacctaagaacttacgtattttgaaaaaagctatatgggtagactcttggattatcttaaatagaaaaatggaaacaaaagggtcatgtgactattttacatttcctttccctttttttggtgatattttctaggactcattttgattaaactggattgtgcaaaaatagcactttgtattctgtgattttttagtgttttttttttttaatggaaggagatcatttgtttttttggtagggggaatgattagtaaatcatgattagtaaatattcaggttggataagaagaaatggttaaagatgtagagattttagataacctgaagttagtactgacataactcctggttgtagttgcctgatgttaattaaattggattatttctttttagtcagttgtgttcatatattatacttttgatgtgaagaatattctgttagacgttttaaagtctcttagtttaacttagtctgaagtttaattctgttggttttcttttaaattatactctctaactatagcctttgttttggtatggcaagttagtaattgccctttgttctctttcagatccctgcatgtcactgagtccaccatgctttacagaagaagacagatttagtctggaagctcttcaaacaatacataaacaaatggatgatgacaaagatggtggaattgaagtagaggaaagtgatgaagtaggtggaaaaatgttttccttgctattgtcttagaacagaatgactgcatttctgtttctggtcttcaattttctctttcctcatgtggctcattgccttcatcttcaacatctttaatttttctttttacatgttaattttacccttaataaacatttacatggtttttctgtttttccccccatttggatataagtcttcccagttgtataaaaattttccatctcatgttcctgtatttctcaaacatgtatcctattctgactgtattttatctattgttgctttacaaaccactccaaatgtagtggtttaaaatgacaacagtttattatttctcctgattctgtgggatcactggccccagctgagcagtttttctgtacccttagatatgggccgaggtcactatggaagttgcattctcttgggagctctgttggggctggagtatctaagacagcctcttattctgcataatgtctttctatgttacctctcatcattcaggagcctagctcaaactttattacagcacggcagctagtgttccaagagggtaagttcccatgtgcaagtgtttatcatgcctctgcttgccagtggttgctaatttattggccaagacaagtcatttggctaagctcagaatctgtgtggaagaagattctacaaagatatagataaccaggaaatgtgattccttggagaccaccagcatggtaatttactgtacccactgtctttagtttttaagcattcccatttaccctaccggtctggtttctgtcttagtttctccctaaaagttggcttctttgagtgttgtctcattctaaccaaatcccctggtcatttttcaggcctcttcagtccctttgttggatttgtcactgttgaattgcttctctttcagattatattatagtaaattacattattttctacattattatctcgtgatgtaacagtgacagtgtctagtaacattgttatctaacggagacattctctgaagatcacttcttggcttgctatacaaaacgtttatttgagaatgcccatctgttttcagattgccctgattcctctatctctaggccagtctagatccctgaccttttgctttctgcctgatgtttttagagggctcttactgttgctttaaatttagtatgtgtaaaacaaaatctcagttttgctattttaaatctcttgttgttcagttgcacctctggacctatttctcgattcttcttcttctaaagtagatgttggcagactttttctgcaaagggccaagatatgggttgaaatgtgttctctaaaaacatgttgaagtcctaaaccccagcacctcagaatgtgaccttatttagaaataaggtcattgcggatgtagttaagataaagtcatactggagttgggtgggcctgtaattcaatatgactagtgttctgctaagagaggagaacgccatgtggagtcacagaacaggagagaagatgactctgtgacagtggaggcagagattagttttatataactgcaaatcaaggaatgctaaggattgctgccaataccagaagctaagagaaaggcatggaacagattctcccctagagcctttgagagagcatgattctgtggacacattgattttgaacttctttctagccttcagatctgtaagagaataaatttctatcgtggtaagccatccaatttatggtactttattatggcagtactataatgaatggaaacgaatacaggccagttggcaaattatttagctttagtgggccatgcagttgctgttgtaactattcaactccgccactatagtgtgaagcggccatagacagtacaagaactaacgggcatggctgttttccaataaaactttatttgcaaaaacaagcagccagccatatttggcctgcatgctgtagtttgccaacccctgctgtaaattaagctcctgtgttcttaaaatatgttcctttttcttcctttccccactaccttttatccattctagttatttgcttgttctgttctaatctaggtatttataatcttgtgtctagattactgtctctaagtttttcctttctaatccatcatgattatcactttgagagtgtgatagctaagagacttagtgatttctaattgcttattaggtcagatattaaatcttcagtcttataatatctctgcatcagttgatttctgctatttatcatgattaaaatcattcgattagagctcagtcagtaccagcgataccaaaatcattactttcgattcaaagtagatcaatttatttatttctagaaccaccgactatatgataattctatcttacatagcttccaacttaaaaagtatttgaactgtatattctgttggtcataaggaagagtgaggtaaaactgatggattattaagagttttattgttattggaaaacaacgtaaactagttgtcatttattgtgggccgttttattaaaatgagtggataattcattctctcaacatcattatcattactccttttctctgtttgtattatatttttatatttatatttttataaaatagaggtaatttatagaggtaatttattctctaaaccaaagagattttctaaaattattattgtacattttcttagtcatttacaatatgacaggattagctttgtcaaacaaattccatgtcaactctgagagtatacagtgttaagtagatgaatgctctgtgcagttttagattttaacccaaaaactgagcttctgcagtttcaatgacttgctaaaatggctcacagaactcaggaaaacactttactggtttattttaaagtatacaactcaggaacatccaaatagaagaaatgcatagggcaaggtatgggggcggtgtgctcagagcttccatgtcttcttcattccaccctcccagcaccttgatatgcccaccagcctggaagctctttgaatcttgaaccttgtaacagagtttttgtagagctcagttttcctggaggtcagtgggtgggacttaaagttacaaccctctaattacttggtctttctagtaaccagctttatcctgaaactatttagggccctatcctaaatcactttgttagcataaactcaggttggtggatgggggcaatagtgaataacaaaagactcacctatcaggaaatttccagggttttaggatctctgtgcctggaacctaggacaaagaccaaatatatttctcattatatatattatatattaacagtaacctctgcagacttaaatgtccctgtctgacagctttgaagagagcagtggttctcccagcatgcagctggagatctgagaacgggcagactgcctcctcaagtgggtccctgacccctgacccccgagcagcctaactgggaggcaccccccagcaggggcacactgacacgtcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaagaatttcatatccagccaaactaagcttcgtaagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacacctcactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaacaacagaaattataacaaactatctctcagaccacagtgcaatcaaactagaactcaggattaagaatctcactcaaagccactcaactacatggaaactgaacaacctgctcctgaatgactactgggtacataacgaaatgaaggcagaaataaagatgttctttgaaaccaacgagaacaaagacaccacataccagaatctctgggacacattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaactctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgaaaaacccacagccaatatcatactgaatgggcaaaactggaagcattccctttgaaaactggcacaagacagggatgccctctctcaccgctcctattcaacatagtgttggaagttctggccagggcaatcaggcaggagaaggaaaaaaagggtattcagttaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtaccaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcatactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaatacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaaaaaaacttgaataaaaaaaaaaactgactgaacttagccaactgctaaacccttaaaaaaaaaaatattattaatataataaaatatataaatataatgtaattataaaatctattaaaaatatgtaattatataaattatatattaatatataattattatataaattatatattaatatataatataaatatatattaatatatttcttagtctggtgctgctatagcagggtactatagactgggtaatctataatgaacagaaatttattgactcacagttgtggaagttgggaagtccaacatcaaggtgctggcaggtttggtgattctgatttcaagatggctccttgaatgctgcgttgcctggagggaggactgttttctttttatggggtggaagtagaaggcccaagaggcaaaaggtgtgtaacttgcccttttataagggcattaattcctctcctgagggttgggcccttatggtcctattacctcccagaacctccctgttacctcttacttcctaacactgccacaatggcaaatttcaatatgagttttggaggggacaaacattcaaatcatagcacaccacaattacaaaaatatttaaatatgaaaaatagcagaaatccacatttcctgaatcattaaaaataccttcaaaggaaagagcagttaaaattgtgcatgatatatacacagagaaagtatcaaggaagcttttgcagatatttgacagcctatttgtaattgattgcattataattcttagaagtacaagttattttaatcttttttacctcatcagatatacttttttaatttttaattttttttacttttatagagatgagagtcttgctgtgtggctcatgctggtttcaaaagcctggtctctagcaatattcctgcctcggcctcccaaagtgcttggatgacaggcatgcaccagcgtttatcagatattaaatgcacatgtgcaaagtgttatcaccactctgcaaaacaaattaagcatacatggctgtgtaatttatatttcagtggaaatcttattgagtcttttaaatttcagtggaattttaggcatgttgtaataaaagttagaactaaataaaacttaggcttaaaaagtagagcttagaattctttgatatgagaggtgaattttaatatttaaaaacagaagatgatatctttctgtatttctcttactatttaaatgcaaacacaacatgcctttatattttactactacctaaaagaatgtagaaatccactgtccagtgtggtagccactagccatatttggctattgagcattcgaagttgaggtgtgctataaagtataaaacacacttgaaattttgaaggcttatatgagaagaataatattaaatatctaatttgaaaatattgattacctgttggagatattttagacatattgggttacatgaaatataatattaaaatttacttcctttgtttttactcagtgtaacttctagaaaacaaaattatgtatgtagctcacattttatttctattagcactgatctaggctctgtgtgatgtgtttgtatgctttaaaggatgaattattaattctgcagttcttgtactatagtccttcagttcaatataggtgcattttggtttgtatttcttgttaaggtgtctttttgaaagaaataagcaataattattttatggacctttactggccttcactaggagactttatacgtttgataggaaaccttagcccaaattttaaagtacttaatttcttgtgattttagcccaaattttaaagtacttaatttcttgtgatttttgttttgttttgaaatgttgcttttctaaaaaaaattcagaaaagtatttagcatttgaaaattctgtttaaaaacttatttttttttctctttagtatcctctgttttgtatttggtcatatgaaaaattctttatttttataatttatttaatattgagctaatatctgatggcctattttataccagatactcaaatagttgcttggaatagattaggaacaagatagacaaaatctgtgcctttaagtgaacattcaggtagggcttgtgggaaggagactaaacaaaataagtaagcaggggcagggggatcattatcagttagagatgatgggggctgtaatgttctatagggtggcaggcaaagtgagggtaacacttaaagtgtatcatgtgtacagtacttggacaaataagagaataaatgtctgataactttccagggctatgttaaaactgaatttggagtactttgggtgcttcagatcaggaataggatataaagcttttgctgtctaggtcatcatcttctggaccaacataaaaaaggttagatgtcaatgtgtgcagaatctgtgatctgttaagattgaattgttgattgcattcaaggctgcacggtctgtcaattttagtgaaattttggaaagtgtaggtatttggtcaacaaataatttaaataagagaaattaatggttttgttgccctgagcacagcagtggagttcacattgttattgctcattttgtgactgaaaagttttatcatagattctagtgtatatgaattttgttttctgttcttacctttccctctttttctttgaatgaacatttttttcattcctttccttgttctagtttttctttgtttttatttattctttttcattttaccacctggaataggtagttttagaggtttttttttatcagtttgtttgatatacatatataaaacaaaatcaactttaagacctacttatctgaaaagtccattgtacctagtatttcagtattccttatgttacatatgctgccttcacaatacattctttgccatgatttttatacctgttggaaagcttagttaacaacacagatgtgtctgtggagagtcacttaagaaaataggcaaaattaggattagacaaaaaagaaggcaatgcattttaaaattgaacagtgtgttttgaattatgtggggtattgtgtccaaaagattaaatacatatattttttgctgaagttttctaaggttaacttttaacttatgtgttagtttattgctatgtaacaaatgaccccaaaacttagtggcttaaagcaacacacatttctcatttcatggtttctgtgggtcagaaatcttagtgcagcttaggtgggtcttctggctctgggtctttcacagggctgcaattaagatatcagctggggttgtgtcatctcaaggcctgattaggggaggatccacttaaaaacctactcatatagctgttagtctcagaggtcctcaatggctgttggagataccagttttctgccgtataagtctctctgtaggcagtttataacatgacaatggggttccctcagcccactgtttcactctctcagagtgagagggagctctgagagaaagagaaggggcagtaatgtggacgtcataatctttttgtgactaatgctggaagtgacgtcccatcacttttgctgtattctactcatgggaagtgagttactaggtccagccaaccatcacggggagacaaatacaaggatgtgggtatcattgggagccatttcagagactgcttaccacagtttattttgataatttactaactagaaatatttgatgggagattctcaagccatagaaatatagagtataaaagcagtaaagttataaaatttcctttaaaaggctttgttttggaaatgtcccacaataaaacccattgtgttcatctttgtaataggatatgtgtagaattttaaagcctgattaaaagttatctattgagtagagctttgcagtgaatggtgactctaattacatgcacaaatgtaccagtgtaatttgtttgactgaaggatcacttgacattcttctgaaagaacaagcagggcaaagggaagggaagggcataggtgctagagaagtcttgctgtctattaacttacagttactgaggtactttcctatatactgaaattttcataatttcatgatttgtttagttaatataacgataccataaaaatagagactttaattctttctggaaaataatggcaatcagcacacaattaaagtagcagagaatgttagtaagtgttttatgggaaaatggattacgtggtcaaaattgggaaatgctggattagttttgtaggacttcttaaacttaaatttatagatttatatactaagataacatttattgagcatttactatttgttccatcgtataagcacttttgtatgtactatggtatggactccttataacaactgtattagctaagaatctactcttattatcttatatgcagatgaggaaacagtttggtggattaggcaatatgcccatagttacaagcttgtaaatgatagagttgaggttttgaagccaggccaactccagaacccatgttcttgacttctagtgtttcttgtttctctgtgttaatgtagattattaatcttcaaaggatggtgaatcttaacgtctgtttgacaaggaacttttgtaatacaaactgtctcttaagtttggcataatgtaagtggtcagtcggtttttgtttgagttttttttcctgaaaattgataattgctaccaaaataacaccacacagatttttcagtgactttaacataactcgttagtactgacactaaacttactgtagcatctgatcaaagataaagtcattttagcaattgataaattgaacatcgtttgctaaatttgatgcttttgttttgcatttattaaatttttcatggtagtatatcttggctataaatgtctaaatagtacttaataagcatctaataaatgtttgtttaacgaatgaatattggaaaatcaaacttttggaatggcctgggcctgtaagtgaccatggagagcccatggtgatcatgggttaggagcactctctggagctaagcagcagcagcaactgcttagtacttgtcaacaacagaaaaataattaagagctgaagaaactaacttcggttcagcagtcttttattgagcacctattgtctgccagacagtgtgctagatgttggctttgcaaagataaacaaaggcatctggtcatttcatggaaaaaacacataacgacttgtcctgaaagaactgagaagtaataaagaatcaatgtgtacatgagagactagaagtgagaaaagacatgagaaagcagcagattaatgctggtatgatctgtggatatcaagaaagtaaggcaacagtggaaaacataaaagagcttgtgggagagtgaatctgaggtaagaggtctctgtaccccggatatattagcgcttaatgcagagggcacgcaagtcataggccagcacttctagtctgcagaactgctattgagagctcaaaaaaaaaaaaaaaagttagtgtctggaattcttcattttttcatatctgttcttatgaaaacattttatcgtacttaaaggtaaatattaaggggaagttggaaagttaacagaaaagttattatatgttgaagaaaattatggatttttagatatagaagtgagtcttctgctgaacagatttacaagttgaggaaaaggtgaaagatacctagtagatttgatgcaaatgtggagaaacctgtggttcaaatacagtccttcaaatggcattgttgaatcaattagcatttctgatagcagcaaaaaggaaaatgactttctataggtcaaaagtggctctactgtcatatttttccaaactgtttttatattatcatcctcatatttttccagactgttttttatcatatgctttgggttttgcagagggtggtagcacacacttgtaatctcagccaactcaggaggctaaggtaggaagatcacttgagctaaggagttggagactagcctgggcagtataacgagacctgatctcaaaaaaaaaaaaaaaaaaaaaacaagaaaaaaaaggtttttgagtatgtgcttcctgatataattttaaaataaatagctgtatataagtagtgtgtatggatacatatataacatatataaacacattcaaactattgtactaatgttacatgtttttaaaatacccgcaaaaatacggctgggtgcattggctcacgcctgtaatcccagcactttgggaggctgaggggagaggatcacttgaattcaggcatttgagaccaccctggccaacttgctgaaacctcgtctctactaaaaatacaaaaattagccgggcgtggtggcacgcgcctgtaatcccagctacttgggaggctgaggcagaagaatcacttgaacccaggaggcggagtttgcagtgagccgagatcgtgcccctgccctctggcctgggcaaaagagcgagactatctcaaaaaaagaaaaaaaaatacccacaaaaatatagattaaaaaaatgagataaaattaaatgtaaatgtaaattctaatattttctcaaaatttcaagtggattagattatacatcctttttgggtgtcggcaacccaaatttggagaccactgtgctaatgaattgtaaagcaatgtcatattataagtcacacagatttcattccattttcataagaacagacaattgtgagaatttctcaagaaagcaagttctagagacacttgctaatgttaatatttgttcttctctaattttcatggccactgtttgcaggtttcttcatcatatagcacattagttgctgaccttttaatgatgtccactgtgcattttatgattaaaattagttctgatacttgtgatacctgtaagaagtggtaatataagaatagaacaaggctaggcgcggtggctcatgcctgcagtcccagcacttcgggaggccgaggtgggtgaatctcctgaggtcaggagtttgagaccagcctgaccaacatggagaaaccctgtctctacacaaaatacaaaattagatgggcatattggcacatgcctgcaatcccagctactcaggaggctgaggcaggagaatcacttgaacccgggaggtggaggttgtagtgagccgagatcgcgccattgaactacagcctgggcaataagagcgaaactccatctcaaaaaaaaaaaaaaaaaaaaaaagaacaaagttcacttatttatactagtttagggaaaaaaagcagagaatgagtgaggcagaaagtgtagatatcattttgataagggaagacatgattaaactttttaaaatatcttttcctataaatttgccactatgtctttatattttagctgcaaattctattttaaaatttaatttatatctggattgtggatgtctgttgatctgaagagacccaggaagtaatgattttggacgccattgattaggaatctggaagaaagattcttatgtaggtggaagtcatcttatagggtatgtgtaaggtattttggtcttcagcaactcaccaaagcgtgctgagcattacatacttgtttgtcattttggttacctcttctttgtttacgtatatgtaactatagtttaaattattcaaaatgagataggcactctatacatcttttagaagcaagatattaaatagaaaaaggttagggccaccctaatacttctcatttagcttacagagtgagaaaggagggaaagaagtagatgaaaatggagttggtgtagttccaagaaattgctctaaggagtaaataaattgatgctcccttgacaagcagtattaacttaacatgaaaacttgttagaaatgcaaattcttgagccccaccccaaccctactgaatcagcagcttggggatgggacctagcaatccgttttaacaaatcctctgggtgattctgatgaagtttgagaaccactagactttcaggactctgatagtagccagaagctctttatcttgaccttttatgagtagacagtatagttacaaatcttactttttttatgattaggtctttgaaaatatggttcatgacttactctttgtaccttgataaatcttaaagttttgcattatatttttacagttcttttaatctcaggcacaatatttataaatataaatactactgtgatgctcttgcaagataccttgttttctgctcctgtattttgtgactttacttttgccaagttcaaccttaaaaatttctttgtatgttttataggaagtcattgacattcagttactataaagcagggttgtatttgtcttttttatgtgggggaggatcttttggtttttaaagtaagatggttctgtaacctagatggttaagaatcattgtgcaagttattgagacagattttaagaaaacatctgatgattttatattagaatatttcttacttaaattgtgaaacttctacctggtcccagcatttatttagtttagtacttatgtccttatgtcctgacaattatagtaacctatttactggagtttcttctctgtctcttgcttttccagttcatttaccaactgctgttgagttatctttttgtttatgacatttgataagagctgatcctcccagagcatttgtggtcatgtatctgcttgtccctcaaagcaaccacaatagaaaacagctttctcttattctactgtttcttatcatccagactatctaatctctatgcttgagttctgatttattattgggggttccctcttgctgaggctgtcttagtcataggccatttgagaaacaccattggttgtatatagttcagttatatacagattaaataggattttgtgaactaggaagttaaacaccataacatagtttctgtggaaagatatgcttcacttagtggatacatactcttaaatgcaacctacttataaactgagaataactgactgtagtatgagatctgtgtatgaagaaccaaaaacttctgaaatcatttcatagtatggagcatcgaaacattcaacccagtgccttttgccttttttgtttgagacagcatgtcgctctgtcacccaggctggagttcagtggcgtgaacatgactcaccacagccttgacctcctggactccaggcatcctcccacctcagccttccaagtagctgggatacagtcatgagccaccatgcctggctaatttttatattttttgtagagatggggttccagcgtgttgccaggctggtctggaacttctgggctcaagcgatttacctgcctcaacctctcaaagtgttagaattacaggcatgagccactgtgcctggtgccttttgcttttttctgggagttgccacaacccctgcttcaactaatgactgttttagcccctttcccaaattatttttgctttcattagtcagaccatatggtaattatgtattttttattaaaaattatttctaatttctgtttcattaatttttagtttactgcaacaagaatttcctattaaacattgttacagaccggaagggggcagagcagtgggagtagggttgtgaattaggacaggacagtgtgtctgcacttccctttttcagttccagcctgatggtactgccagtgctgccatctccccactccttccctcagccttttcagcatcacagcacagcattgcattgatctaatatacttttttgcgagtttaggacacttcacatagtatctcaccttaaagatgttttgatgagtacagacctgtttattcccatttcacaaatgaattgaattgtgcctttactgtaacattaacattattagccttgtattattattattatagataggatggccatataatttattatcccaactggcattttttctgagtgaaagagagtgttattaataattacatccagacaaagggtgtaaacgaggactgtcctaagcaaatgggccatataatcaccttcgccatatggcttatcagcctgcttcagttgtacttacctttatctttgtcttgctccctcactaagttgttattaaattgatctaagttttgtgccaagatttctgctactgctaaacactggctctacctcagtttggtttatcagtctgagtctttttgtattgtatagcttgttttctactaacatgacggaaacactcagcaactttccattcctttttcttttttgcagataagtgattttttgtctttttttcctctggaaataaatttaaatagcttaataatttaaatagcttaaatttaaatagcttttaaaatttttaaataaattttaaaagaaaaatagctttttcttatattaaaataatgttgactctttcattgacttttagaatttttttttcagtagcacatttcttggttttcccaaattttctttttttttttaaaacaaaaaaatgtccccagctttattgaggtatatttaacaaataaagattgtgtatatgtaaggtatatgatatggtgatttgatatctttatacattgtgaaatgattattatcgcagtcttatcacctcacatgtcaaagggtacaaactttcagttataagatgaaaaactctggggatctaatgtgtagctagttactatagttaataatactgtatcatatatttgaactttgctaggagagtagatcttttgtgtttttaccacaaaaacaaaggtaaccaagttttcataactgaagaattttatataatagtcttaagttttcctatgaacctatccagcatttagcctgcaggaagttctccaagcactgactgctgcagtcactgatcacatagtctcaggagagagttctgctctagaaagctgtttggattgtcgtaaggtaaagtgctaagctatatcagggaggtgtaaggtaaatagttcttatcctcagataacctcacatttaatgctgtctcacgttatcttcagcagtacttttttgagatggacagaagtgttctctcttatagataaggagacagaggcttaagagagattaagttatttaagttacatagtgtgtgtaaggagcactaggattagagtccaactgttccaactactgttcattcttcataacatgtttaggcataatttccagtttgtttttttttaaattttaaaatttttaacttgtattcagttttgagccgtggaagctgaaagaggctctctgcatacattcttgaactgggtttctgttaatattggatggtctgttaatgttaatattggaaacttctgggtatttagttcatttactaggacctcataccctgcttgttccctgtattttggtttgaatcttaccatactgagtaaattagcactctaggggcttgctttagtactttttccctgtcctgcccctacatcttggcatgtgcttcctatcatctaaactcgtgagaactattcctatttgacacggtccatcttaaggactctaccaagagttatcttgagtcttatcttgagcttggctggaggattcaccttgcctctttcccctgcttactaaatctgtattagactttctatcttggcctttctgggtctggcctgatattgttcttgacttagcattggtactaccaaatattgatgacatgctttgtaccaccccactggccttttaataatcttactggatctaaagggctgaatcggataaagataactttttaaaattaaagaatattttgccgggatcctgaaaatgttacaaacaattgataatgaatatttaagagccttttactttaattgtcagtccttgctaactgacctttattattttttaatatcatacaagtacctgaaatgtcttttaagtgttaattggggatgtttgaaaatttttatgcgtggtttttgttttgttctcattttccctttgttttcttttctttggcctcctgaagggcttggcaaacaggtctaagggcattgttgaccacttggttaaaaacaaaacacatgtaagattttgaagttctcgtttatatatttagcactgtactaaatatggggcagattgaaaaactgaatataggccccatgagttaactgtctagtagggcatataatgtcatgtatgtatataccacaaggcatgttacggcaaacgatgtcctagtaatacacatgaatcgtggcatgctcttgtgatgcacatctgttaggggagcatcaaacaaagctctgcgtagagtcgttaagacgaactttgtgaaatgggaatagttttcatgggtttagatgataggaagcacatgccgtgatgtaggtgcagaacagggaagtactaaagcaagccccttgagtgctggtttactcagtagcaaatcatgcggtctgactggagtcttaatgttgttgaggataggattgaaaagaacctgcttggttttccttcttcctgctcttgcctttcctccaccataagtgtgtatgttttcggtaagatttttatctttgggcctctttctttcacttcctaggacattttattcaggcccatggttttaatgatcacttctgcaaatattcagttctttcttctgtccacaatttcattctcatgtttggcctgtgcagatctccaactcagtgtcctaagtgctaatgaaatacattgctttctgtctgtgcttttctttttagaaagtctcatgctggacccatcactgccttccttaaaaacactgattcttatttctctttaaatgtggtgttgtttttattagtggtatcactgttttacctacaacggaggcttagtgctccagccttatctttgtttgctgctttgtctgcctctctgagttgagttttattattattatttgatttctaactagtcttgccattgcttatcttttcctttttgtaaatccattttgacaattattacttagtttaaacattttagaacataatattttgctattctctcccctactcaaaaatttatattagagccccatagtccagtggtctcaaattttagtatgcattaaaattgccaggaagacttgttaaaacacagatggctgggcccaccctcagagtttgtgattctgtaggtctgggatgagacccaagaatttgcatttctaatagattcccaggcagtgctgatactgctggtccagggaccatgctctgagaactgctgccatagtcttccaaatatggtttgggcttcttagtttgacattcatgatcttttacagtctggtcatattctgcctttgtagccatgatcacttactgtgaagcttctttgtgtgctctttactttaaccaaagtgacctactgacagacagctttttgtacacatcctgtattctcatgagtatacaggcatttcccttaggatttcgttcagtctcttgtttcatcttgcttgtcaaaccatcttttaagattaatttaaagatttagttcaagtggaatcttttctctgtttcttgttttttgtattttcttctatcatccttcttccaagccaaagtaatctcttgcattgcactattcctttatggtatttgttggtttgtagtttagcttgacccgtatttccattttccatcccttatccagttcactctttgtgttttacctgtccaacattagttacagagcatatgtttggtgatgggggaaatgaaattttctgtagattataagcagaaggcctaataagccagtattccctgaatattgatagaggattttcatgttcaaagaaatgggttatagttattaccctgaatctcactgatggcagcgagatttaaattcttactttctccccttaaaaaaggacatttaaaaattatactatgtagcaaattaatgggatctcctaattattggctttcttaaagatcctaagagatgagcagtaccttttaaaggtaagtatctttttaatgaataaaattgtgcctatataacataatgaattccttcaaattcttaatggcttaaagttttttgagttatattttatatacaattcaatgtagagattttaggtgtatagtttgatgaattttgaaaactacacactcaattgtattaattgagatttgattctcaaattttaaaactttcactttcttttgtagaagacaatgaagagaaatctttgtattactgtaaaacctgttgtgtattgtttggtcactaatttaaaaataaattccattgctagtttatttcccatacttggtgatatgtttaaaatcttatcccagcaatctaacaactaactgtagatgttacgattggggttgggaagtttttttctctcactgtctgtgtcagataaccactgggggctcaccatctgcatttgtgtccataagctttatcttctctcctactactgtggattcactgtctgtgttcttgcaaagtgaatttctttacctgtgtacttgatctcatcccctatccctactctaaggcagtccttttgcaatttttctctcctcagcaaccatattttcccttttctactgtaatttgctcatgtgttcaaacctggcattatttttcttacctttacacacaacagaagaacttcttgactctccttctccctttggttattgcctcattcttccctcctttgattagaaaacaaaaactctcaaaaggacttctgtactgtttctctcctcttgttttttcttgagctcacttaggcttttgacttcattacaccaccaaaattattcttattgtgcttattagtgatgtccatgtggctatgcagtgttcagttctcagtcttcatatcactcactagtgtcatgatatggtttaatatattttcctttttaaagcaattttttaaaaaacttgatcttagagaaaccatgccatccttattttatttctactatattggttgctgcttttcagtttttttgctggtttcccctttatctccttggactacacgtattagtctgtacattgctttgcttatttttactgaccctcttggttatcttacctaatttcaaggcttttacataccctgtaaccgagtcctgagctctggcttcatatatccaactgcatcaacatctctacttagatatctattagtcatcttaaatttaaggtttaaaattgagtcctgatttcttgcttgactcaaatctcttctctcttgtctttgttttttacaatggagttgctgtttaaacagctgcattataacaatctttgagtgggcccaaaaatttggcatcatccttgatgttttgtgatctcatctgccattgttgatcgttgctgggattcattaatttattaatggttgaaaaaatgccagtattttaattctatccttttttttcattaattggaatactctttaaagaaacattttaacacatcaattatttggtttcctgtttgtataggaaaggcaagaaaaatgattgattgaatccccttatttacacatattcaaaataattaggtagtttccaaggatcctctaaaggcaatgagaggcaggcttgtgtgtatgtttagtatcatgaactcatgattttaaatgagcttcaggctatgttatcttttttgttgttgtttaaattgccccagttttggccagtggaaacttacttaggctcgcacctggatcctttaggcacaacctcgcctttgataggtttcttgctttccgcagtgacaaaatgttccatgtccagcttgtacatttctggccccagagttctgctttcttcagctgtttcttcaaggagctttaattttgtttagtcagaaacagtatctgatagaccccaatccaagtgctagcagcgctccgttagtcattgtttctatgtcttctcagtggatggggctaagaaatattttgttgttacttttttttcaaagataatatacactatgaattcagtctgatatttatgattcagatttagtactacagggttttaatttaactttattggtcttacccctgtattttcctgtagtcacactgaaaattttgattcttaacaataccagcataactagtcaggataagaatactaatgttaaaaccagtggtgtaattaccaaaaacagtttaattatcttggagttcttttttttgtttatagacatatccctctaggcaaatatgattaaaatcagtgaggatagttcctaactgtatggttataccactatctagataatgtggttaggttgaattgttttattttacttgtgatttttaaggattaccttttaaaattaattttgtttttataattattgttttatacaaatatatacatggttccacagtctaatctaggaaacaaagtatatgcaaaaagtatcacttctgtctttgtctcatataccgtattttctccatccctttaaagataacctttccccctcttattttatggtttacttgttctttaatttttaaaatacaagcaaaatatttaagtatttttattccctatttccttagcagattaaccttacttgcttcgagtaacaatatacttttgatttgacttgttttcttagtttctgggtctcacatgctaggaagtatgctctctgagggtagggatttttgtttcttttgtcttgctctattcccaccattggtccataatagatactcagtaaatatttttgtaaataattgcattgtgcattcatggtgttttatctcaatgcaaattaaaatttgttaaaatagaagccattactaaatactccaattaagagtgacaagataccaaggagctcacactagtattgtaaaagtttatttttttctattgtgtaataatcttttctagtaacttgtgagaagcttctcacacaaagttacaaaatgttgtttgtcaattaacaataaatgaatatctgtttttctcgtcaatcacgtgaatagtattttccccaacactatctgttaactctatgcgtatgtattcttatgtacatggatttgtgaaggtggttcaataaagattttcaaatctaatagtgcatggtgaatgtttaaatgaataaagtgtatgttgtgggaatagagagtatttgggaacttttttgtttgtaacttttaagttcaggagtacatgtgcaggatgtgcagatttgttacatcattaaatgtgtgtcatgggggtttgttgtacagattatttcatcacccaggtattaagcctagtatccactagttacttttcctgatcctctccctctttttaccccccaccctctgggagtctccagtgtgtgttgttcccctccatgtgtccatgtgttctcatcatttagctcccacttacaaatgagaacatgcagtatttggttttctgttcctgtgttagtttgctaaggatagtggcctccagtttcatttgtgtccctgcaaaagacatgatcttgttctttttatggctgtgtagtattccatggtgtaaatgtactgcattttctttatccagtctgtcattgatgggcgtttaggttgattccatgtctttactattgtgaattgtactgcagtgaacatacatatgcatgtgtctttataatgatagatatgatttatattcctttgggtgtatacccagtaatgagatacactagtttgaatggtatttctgcctctaggtctttgaggaatggccacactgtcttccacaatggttgaactaatttacactcccaccaacagtgtaaaagtgttcctttttctctacaacctctccagcatctgttattttttgacttttaataatagccattctgactggtgtgcagtggtatctcattgtggttttgatttgcatttctcttatgatcagtgatgttgagcttttttcatatgcttgttggctgtatgtatgtcgtattttgagaagtgtctgttcatgtcctttgcccactttttaatggggtttttttttctcataaatttaagttgtatttgggaacttttcgtacttttcactcagtgttgctgtgaacttaacaagcctgtgaacctaaaactgctctagaaaataaagtctcggaatccatggcatgtttacaacattatagtgatgtcagttagatttgtgctatgtgtcttatatgtaaaattgttgcatttgtatatgatgtcattaatgttagttggacatgcaaaaatcattatttttcttctattagtattaaagtgaaaaaagtaaatggaatatcccagaaacagaactgtgtatgtttatggttaagttgaaccataggcaaacattgatgtcctaccatgtttcagttgtataaagatagtgttgcagattattgggaatattaaagttatttcaataagtaatgcttgagtaatgagttaagatttagagaatgaaactcaattctgacctttcaccttatatcaaaaataaaccagatatattaaaaaattgacaaatgtgaaactataccaaaattagaagaaaatataggtgattacttaacagaacttattggaacctgtgataagaacctgtccgttcccttaatgtagtctgatcaaacctgattctttaagattagtaatggaggaagaatctgatgagtggaactgctcaagtcatagctttgactcttacttccagatatctttcttctctgtgtgaggggcctcactatttgctgctgtagtcacctgactagtttgtgtgtgtgtgtgcgcacgcatgcgtgcacacatgtatgtccacatgctcctgtatgcttgcacttctgtgcactctttttttctgactttccgatggcatatccctttccttttgcttcctacaaagctgaaacaaattttgaatggctttatatcccttaatctttagaaaaaggatgcatagacataaaaatatgcagttggataatctggtttattacatcagtttaccagtttggttttgtggtttcttataattcgcggtctcttgtgttatttccctgtgtcaaaaaccatctttgcttactactggtcattaaatgattccagaccctgtatactagacctaagatatggggactagcaagctagagttttatttgactatattttaggatgattttggctgcaagtaatagaatacctgaattcaagtggcttgaacaataggagtttaatatttgaaaatgcattatcataagtgaggagctaaatggttttaaggttagtacagaggctcagtgatgtgtaggtctctgcgttagcttttctttcattggctttctactcatggttggacatggctgcagtagctccaagtgttgtattctcccatgataacatcagaacttaggaggttggagggatgctgttcttctttcatctctgtctctctttctctgttttattagagagaacactgacagattcccatattaaaataagtatggaataaacattttacatacgaaatacaaatagttaataaaagtttgagaatttataatcttaaaattataataaattcatatcgaaacgtattacattttatttttcaaatggtacaaatatatatataaaatgataaagcttgtgaaaatgtcttgattcaggtactcataataccagtgtgggtggggagtgggggaaattggccgggccagggctctctttgcagattatctgcagtcagaagtgtgggacttggaggagggggctgaggccacagccgcatcttgatcaggctttctccagccctccatcagcctcaccagatctccattctttgccacgagggccaacacgtgagaccccatcttcctgctcgccagccctagacctgttggagcataaagcgcttcctccccaggtctgagtgtgtggggctctgctttggcactgccccacggaagccacggcctcttcattctgtttctgttgttttgtttttaacaactgtactttgcacacatgaaaaaaaaataataaaagttgttccagaggcaacttgactctgtgtatcaaaagccttataatcgtatgtctatctttttctaagaacctatccaaaggaaatcatcagaagttggcaaaaatatatatacagggatctttctttataatcaggaaaatttttacatgctgtaaacattccataatagggatattgcaggtgaaaattccattctaatttacaaaagcaaaaaggaaatgtattgggtcatatagctgaacaatctagaattgttcaggtatgattggattcttgtgctcgaacacctgtcatcagaactctgccactctctctcagctttgctttctttgctggccgtattattctcaggttcattctccctgtatatctctcaacagctctaggtcaaatcctgctagttttctgtggccacagcagagagagcttattttttccaggtgttccaacgaaagtgctgagtgggattcatattggttctaatagttctgacatggtcatatgcctacctccagcccctccctgtggaatagggatagtcttattggctaggcttcctcaattcaaacatgcatctccacagaggggacgaactggcagaccgtgacatgtttgcaaaaagaagtagtgttcaaaatgatggccttgtatttgatcaggcacagtggcgtacgcctgaaatcctagtatttcgggaggcaagttggaaggattgcttgagcccaggagttcgagaccagcctaggcaacatagtgagacattgtctctataaaaagaaaatcttaacccctccccaaaacttcatatgataaggcagtttattttagaatgttttccactaaaattgcttaaaattagaatgttttggtgctaaaagaggcagccttcagtattctggaaatgccttcattttctgacattgtgggataaattatgtattactaattctttagtttttttttttaaaggaaattgtaattaatattgcagtgaccattagtagtcttgggattattgggtaacaaagggctagtgacttctcagaaaccaagtctttggttgttagaagattcttgttagcttccttgagaagtaaaaatgaggagaactacagaataatgactattaagtggtgatgataggtaaggcacaccctagtgaattgacacagtacatacagtgtattcattttgtttctttgtagaatattattttttcttcagtcttaatcttccaatatcactttttacggacttagaatagaattgcttttctttttgtttagatagtctcttatttttccttatcctattacatagtaaatcttgacaaattaattttgatacattatattttgggttttattaatattatccatatttatagccagagttattctctgaatgctgagtgccacaaagctttctcataattatcaatgtctgtattcattcaaaatatttctaaaagtagcaactccagaatttactttggtatgatctgtcttatggtctaaattattgacctttattttatctcacagtcctctatgtattttaacatagttaagtagtaaaattcttttattggtgactagatgaactatataactcatcattaaaattataagtactaatgtaaagtttctttttcaatgagaactatgtgtggtttattatatatatgtatagtgaaataaaggccctatagtggttatgaaattggtatccagcttctctttccaaagaaagtggtaataacctctaatcagtgtgcttgaggaacagttctgatacagttttaggtctgcttcctgtgtctcactctgaaatgcctccatcttacttcagggtctttatggttgaatttgcgtatgtgtgtgtattaacttaagcaggtgctcacagtttaatgtgtaaatattgtatttcctccttggctcctcctcttatcttcctgatggcccatcccatcccccattcattatcagtgttactgcttgtgatttttctcctgtaacattctttatgttcataaaatcatatgcaaatatatacataagtttttacgtttttgctttataaaaatattaatcaaattgaatacttaaaatattttaatgaagaatatttctaaattgtattttataaatacaatatagctttcttttaagtgcttacaggtactcacttaacgtgaaagtaagtgtaacacacggtattctcagtgatggatactagaaataattacctggccttccatataacacataatcttatctgcaatatatttccactgttagtgctctacaacttaattagagctctagtatcaaaaagaaccagtgacagctatttcatgttttaagcattcagactaattgtagtctttatgtttttatgacacaaaacagctttcagttgactctgttgaaattaaaagcttcttcaatatataatttttgtcttattggtattatcttatgtacaaaaactgcatacctatggtacaatctacacactcctgttttagatagaaattttgattctctcttgaaccataaattcagattggaagaagcattatggcttgaatgtgttccccaaaatttatgtgttggaagcttaatccacaatgtaacagtggtgggtggtggggcctcatgggaggtgcttagactatgaggggattagtgccacaataaaaagggcctgtgggagtgggtgctcttttatgccctttagccttctgctatattaggatgtagtaacaaggcactcaccagatgatgctggtgccttgatttggacttcccagcctccagaactgtgagaaaaataaacttatgttctttataaataatcacacagtctcagttattctgttatagcagcacaaaatggactaagacaaaggtgttttttgatagaatgcctcctttcatgtgaccctatgactctgggaatgctgtgttgttcttgggagttagcaagcagtgccttggtggacccaagtaacattaggctagaagttaagagagagtatgaaaatgtacattagaagctttcataggtttgttgttcttttttttttaaatgtatcagatcagccatcaaagcttctaatcagcatgaaacaaattccagagtgatcaaactcaactgatgtaattttattaaatatcagatagctatattgtaagcttttcttttttattaagggtaaacggatatacctgcttttacattttgccctgatggtgtcataatttgtcaaatgtttattactggtgggcagtttggatagtcataaaatttttattcataatattgcaatgaaaactcttgaactttttatacagttatctgagcgttactatagaataaattctgaaaagtagaaattcttggttaaaggtaatgagcatttaacattttaattgatattgctagaattttccccctgcaaaggttacactagtttgtactcccacagatgtacgaatgtgccatttcccacacaaagtcccgtcttttcaactcagggaaactgcgtggcactgttgggttccctcttcttgcaccttttcctagaaattctctccaggaactcatttagggcagtcatacggcacagttgtttgtttctggtcatctcagggatcactgttctttgtgttcagtgccttgtgttcatgccttgtgttcagtatcttgaaaactgttgtttgtatattgtgtctgttttttagttgttttttgagggcctgtgagtatggtaaatccggtccctgtaacctcatctttgctggtaatgcaaattctgacttactaaagtttagcaaataaaacacagaaggagatttttttcatttgttaaatctgaaatgcttacctctacttaaagtgaatattaacatgaatattaatgttaattccaaatgacttgctatatatatttttgatgtaatggtgattggatataatgttaacttatgtgattgtgtgagtattgatcatgtctaagtaatggatggcaagaaacactcaagtgggtatttaggtatgcagagttctggcatcagaggccaaagcctaatggtagattttggctggatcatggtgggaggcaaaaggacttcttacatggcggcagcaagagaaaatgaggaagattcaaaagcagaaacccctgataagaccaagaccatcagatcttgtgagacttactaccacgagaacagtatgggggaaactgcccccatgattcaaattatctcccaccgggtccctcccacaacaggtgggaattatgggagtacaattcaagatgagatttgggtggggacacatccaaaccatatcagaggatgagatcaaggttattaaaacaaagaatgtcttaatagtaacctctatctctatacaaattacggtgtcttgggttgtgagtttcagttaagatttggtattgctgttgtttgtagatttaattcttagatcagtgattatcagctggtgtttgtagtacctcacactgtcttcattcgtgtccaagaaatcatacagaatatgtaaatcaaggtaaaaattcagctcattattttgaaaaataaatgatttacaataaaatagttgacattgagtgtcgactatgtaccaagcactttttttttgcacttcatgtgaaataaagaacttaatcctcataaccctttgaaggtgaccattttgcaggggagaaaactgaagcacagagagtcaagtaacttactacagtcataaaacaagtaggagatttgagatatctgtgtagtctagaccaattctgtgctctcaaacactgtgctatctgtttgatagaacagttttaagatgaagagagaaacatgggcagttcatgctttattaacatgttatcacatctaagagtttaggatccatgcatttatacagaacatccaggtgagcatggtggtgaagaacttagactttagaattctttaaaacttacttccagaattgggtctccttttaaatagctatatgaaatagaatacattactgactctctcttagccttagttttttcatctttaaaagtgggaataatagtagtacttttcttgtggattttttcctctgagacattatactaagctattttagtagtattttcaagaccttgcaattgtttatgaagaacccatctgttttactgactcacatatcagaccttggacattgtgttgttttgatgacaggtgtcgtttgggaaagtctctgcttacattgtcagtaaagaaactgtggtggttttccgctccatccctgttatgtattttgtttcaggatatctgaaatgggtgtattgggaaaccttacataaatgtctgatattccccaaaacatgtattaaaccttccaatataatcagagtgatgctcatttattcatgttttaaactttgacattgattcaacatggacatataaaaaccactcaaaatattttgtctaacacttttgcatatactatgtatgccttttaatttaatctttgtaaccttatgtagtagacaattttattttcctcattctacagaagagaaaaatggggctaatgagcacttaaatgcttgcaaatgtcttatagtaagtagtggagtcaggttttgagtatatgtcagacttgagtctgcatgcctatgatgataaatcacctctcctgagtattgacgtcttaaaattatgtatctaaaaatagaaggggaaacagacttatggaaatcaggataaaaattgtgcaaaacaggcctcccgaggaactaaaagtagaaagtcaccaagaatggaggctgttcctggtgctatgtctttccctgtggtcacctctgttctctttcattattttctctttctgcatatttattggcttcctctgtttgccttaccacctagactgtctcgactactcataaaatggtacattcaacatcagtgtgtttatcaccctaaaagtccagagccatggccaagtggtccagtttttcatgatctcagttataatttactgtgagaagaatcctgccatcctggcacaggctcagggttgttctcctctaggtgaggtgtctgtcagtcctttgatcagatagctgtggttatggatgatagattgagagggggtgactagacacacacagggatctacactaatgttggtgagtatttgtctgggaaaagggtatggcctgaatacagccccagaatgtgtctataataacatatatcagattttattaaagtggtgtcataaaaataacagcacaaatacaacatttaagttacaggtatgagaaactgaaatcagtttattatatgaaaactaacttccccaaactggatatgtaaagcattaactttcagtggtactagaagagtttatttaaaagaatcgtctgagcgaatcttttaaaaagaatattcagtagtcatttatttgctgagcactcccttatgtaccttgtcaatttaggattccctatagtaggtttgcatataattgggtgtatttaccagggaactctacattatttgccgtacattatttgaagactcacttcattgaatttcagatcctattttcagatttctcaattcatgaattccaaataagaagtatttgtcttttgacaaatgaatacaaagaagaagtatttgtcttttgtgtatgcattttcagttattggtgactgttttaaaatttctgtagttaccctacttcattgctaaaatgaggaggggtttttaataaagtttttgaaaagtctgaacaatcagaattatatgcttttttctttaggatactgggaaaaggttccatagaacctgatgatttttaatgtgtttggttcatttaaacattttctaaacaaaaatatttctaattatactggtttctagtcacattccgtgatcagcatgttgaagatctgtaagatacagaatatacttttatttcatgtggtttgttacgagttattgtgatatcctggagacatacttctgttttaaaacagaagtatttttagatggtaattccagggaaaatacaattcattgtgtttattcaattttcacccaactttattaggaattttatttcttaggaattctttattattttttcttagaaatttcttagaaattaaattccttagaaataaaatttcttagaaattttatttctaagaattcttaggaattcttaggagttcttttataccatatgagctataggtatcttcaaaagttttaaaaaattaaaaaaatcttttattttgttaagtatgtttggcatatatccataagctcattctggcttttctaaaatagttaagtggctagaataccacatctagtcatgtggaaatttgcttattttctgtaatatattgatcctgaaatcacagaactgcacgtttagattgtttgagttcatgtagtaaagataattttttaggacattgtctttaatatatattacgtaaatgaaacagttgccatttgttccaactgattggaccatttccaaggcagatttcctccctgctatgtccattattatgattttcagtctagaatttctttccagctcttggactttttccaagatagagacaacttctgagcatctctttggtagtctctactgaattttgaaggtgtcagtcaagaagagttggatgacaggaggacttgtagcattcaggcaggcccccttaaatataacttaaggcagcatttagtaaaaaggagtaaggcactatttagagcagacaacagattacatagatttttttagtttagtacttttcaaacttttgatgacgaaagaccagatgtttaatttccagtatatatgtacagggtggacaaggtgagcatatttatcatatgctcggcccagttgctgtggaagtgttttctaattgccataatgctgacactactctgctgaatgaccacatgttcaacagtgttgttgatcctagaacattgtttctttattttgctcccaaggttgttgagcctcagaaaagttaaatgatttgctcaatattatacaattgttaaaattttcttttttagtttcagtagacagcaactctactcaggcagaatttggtgttttgtctgaaggtgatgttcattgccagtgtaaaagtcagaaaaatatgcctctggcatttgtagctgtgggggaattttcagtttctgcattgtggacttctgaaatcttttatgtgatcttatagttttggaacaatagaaaaaaaagataccatataaaataacgagacaagaaaaataaaaaatattgaggtagaaaaagcataaacaatttaaaaactattagtttcacataattagagtaatgggtacatatatgagcaaagtatcaagagataaggcctaaaagattctcagagataagattaataagtggtattaagccataaaatggagtttgctttttattgttagacaatgggaaatggtttaaaaagtaatatagaacaggttagtttttagcaaagatgatttcaatgccttttttttttttttttaagagacaggttcttgccttgttgcccaggttggagtgcagtggtgcaatcatagctcactgcagcctcaaactcctgggctcaagcaattctcctgcctcagcctatctctctctatatttcaaagtaagattaatagaaggtatacttcagttttgtaaagtatactttagctctaaacaccataatcaaatgtctttgaattaaaagtagtagcttaaaaaaggcagaagaacatagaaatatgatgcagtaattgagaagattattatttattatgttttgaaacatcgctgtcaccaagtatttggtaaaaatgaatgcagtgatattgaggcagtatattatgctgttgaatataaccaaatggcttgcgttggaatttcagctcgatattcattattttttcaaccttgggcaaattacttagcctctttgggccttggtttctcatctattgaatgaagataaataatgctttccttataggactgtcgtaaaggtaaatgactttctctgtatggacagatatacagtggtcccttggtgtctgtgggggattagtttcaggactccctcttcccctgcggataccaaaattcatggatactcaaatcccttatataaaaatgatatagcatttggatataacctacagacatcctcccatataaattgtttctagattacttacagtacttaatacagtgtaaatgctatgtaaatagttgttgtaatatattgtttagggaataatgatttttaaaactctgtacctgttcagtacagacacagccatccattttcccccaaatattttcaatcccacgaatactgaacccacagataaggagggggtgactgtatacacctatttgttatataacttagaataatacccggtaaataataaacattgactaagtacttctactgctgttgctggtggtggtggcgttacgattagtagcagaagacatttcattaaatacattttacaaacatgtaagaataatgtgactacaataccaaaaatttgccagttactgtttgaaaatagtcacccactggatatcagatttcatctttttctctagttgtcaagactaaggtaatgaatttatatttaacttaatgttttctcttctatagttcatcagagaagatatgaaatataaagatgctactaataaacacagccatctgcacagagaagataaacatataacgattgaggatttatggaaacgatggaaaacatcagaaggtaagactgcctttgtgatctggccccctccccttctgcacatctagcctgcttagttgttctcaactcacttatagtatgcttttaccaaaaaaatcaaaataacatttctgtgaggatatttatattttagtaaataattttcccttcttgtttttgatagatgatttttatctttctgagagtcattaagcatcaggctgttctcatataattatagtagaataaataagataatgcatgtctgagagcctaaagttgtaaagcattatttcagctattacgtgacattattataaaaggtttagcaaataaacatatggaaacacaaagttttccttttagttgtggagaatagttcctaatgtttttaggaggctattactgttaagctttttcttaagtaaatcctttatgatgtctcgtaataggtgtatgataaaattggataattggtattttattccctttctactgttaagttctcaaggtgtattatggacagtaattgtttagtacaggaaaagtctgtgatctaaaaatctcaacttggttccatatactaggaagttactaaaattaaaaaaattttacaagtcccctaaacttacattttgttttcagtaactcaactaaaattccttctttctaatgcttctgttctttcataaaagtcagcaattatattgtaagcatatatttttctctgaaaaattaaacgaaattaaagggacagattaccaattaagagtgtaaagaaataataaagtttacttgagtcattatgataacatttagaagtgggaaaataaataaaactgtcccaccaatgctcagtatttttcttagtgtagaagatggtagatagcttgcttacatgtgtttctgttgaaatacacttgggttggggaagaaagaagaaaacaattatgcacttaaaagaaaaatatatagacttttaaaaaaacctctccatttctcttccctacaccattttaaaataacatgagctcggataggaatagaaataaacaaatatcagtttcatgaggaaaagtgaaaatggtggggaactcagcaacaaacttattttattgacacgacatagctcagcaatccatagatactaagaagggaggtggagatccattacagagtctattgctattagtatttttttaaggattaaaatatgtaatacattgattggaacccacttgactgtgtttgaatgaagaaaaaaatatttgaccacttaggtcttgtactacctttgttcagccaccatcgtctcttgcctggataattgtgacagcctaattcatctccctgtgtttgtgctctgctgtagtctcttcttcacctagcagagtactctaaaatgtaaattagatctgctcattactctgtagtgactcagagtaatagtccaaatctttacaaagacccgtaagcctctacatgttctgccttctgtttccacctctctctcatctcttacctcttctattccatgcatctctctcgctcactgtgctccattcattctggacctgtggctattcaacaaatgcaggaatgcacacatcctcatggctaactccatcacctcctttgttaaagtctttatcaagggttatggtctcagtgaaaccactctggccaccctgtttaacattgctaacctccccttttactcatttttttttctggtactcttgatctttcttactcagcttcacactttccttttccccatcgtgtatcaccttctaagatactatataattgacttgctcattatatatatctccctttgcctcacccccaagaatgtaagtgttatagagcaggggaatgttgtatgttttgtttattaatgtatcctaaataaagaggactctattcttaaactcctttttgttttcccaccctagtgactttggtgagatcttttgtgatctatgagaatgtttgtttacttgattttttttttttttaagctaaggccttttcaagttgaatgacgtcttaaacctctttttccctaggctttcaccttaatctgagatctaaccattatgataatgagggatttcctcagttcaaacagttggcctaagttatctcctctctgcttccttttctctaagccccagttggctatataaccttacagagtctggcagaagtagtctcagtattcctagtaatgcagctgtatgggatgaaagagagaggagtcaagtgataataaactttcactagaagctttataatgacctaattgatttttctcaacccatgtcagactctgtttattaaaggggtcatgtaagggtggggtattgttgccagagcactggtttttaaaacattcaggctccaggaggagtcccagggacagggcatgttgagtgtgccgggctctgcttttatctgttatattttgtttctgttgaaaatttctctggagaaacgaaaagtagttcttctgaaaaagtttgaaaactgctgaagtagagattagaatgtacccctaacaataacatgtaattcaaggttgtttacttgaatatatacaaaagtgtgtgtatgtgtgtatatatgtatttatacagaaagtgtgtatgtttgtgtgtatgtgtgtatgtatatatatgtatatataaaacacacacacacatacatacacatgcaaatatatgcattcattctttgcttatcattgttgtgtctcccatgcctagcacagtgcattcactttgtattcagtagtaaatattcactttgatattcagtaaataattgttgaatgaatgaaagagtaatgcctgataagtattggatgcttagtaatttagttggtcaaatgttttgagtacaggcatttctgttattagacattatgtgcatttcttaaaaacttaacgttttttaaaattttggacttaaaaatgacagtttatgggaaaaatgggactgaaggagattactcaaaacctgtacaacttattagccatggcattaacagtattaataaaaatactagtacaggccaggcgcagtggctcatgcctgtaatccagcactctgggaggcctaggcgagcagagcacctgaggtcaggagttcaagaccagcctggccaacatggcaaaaccctgtctctactaaaaatacaaaaattaactaggcttgttggtgcgctcccgtcatcccagctactagggaggcttaggcagcagaatcacttgaacctgggagtgcgctactgcactccgtctcaaaaaaaaaaaaaatacttgtaccgctaaaaagaatttcaaattcctaatcaatacatactatatagtagatataggaatttacattaaaaaataatgaagataactttatagaaggatggatggggggttctagtagagttgaggttgctaaaaaatgaagacaagggcaaagtgcatgaagatgagaaccgagcaacaagcatttccaagacagaggctctggccaaattgagcaaagataaagaaggagggtaagtagaagctcctgtttgtagcttgctgtattggcagttagtacaccttgcatccatttgataattacttggcaatgtgaaatgataccatgtttggaaaagtcacatgtgaaatgatgtgacttttgcgttgatgtgacccctaattactagtggcacataaagtaattcatgttacagcagcacgtgcagcaaaatagactgtatctattaggtggtaaacaagcactgcattggatcctggggattaatgatgagttaaacatgaatctggtgtatacagagcaaattgctgggtaggaaagacaaagaaaacaaataattacactataaggtgatatgtacaataatagcagtaagtttagggtatggaggtagctcactggagggagtgattagctcactattatacacagaaggtggtgttcgggttgacccaggagttctagaaggagacaagaagtagaacataaatggtagctcccccatggcatcttttttttttcttgaaatagacaaggttttgctctgtgacccaggccggagtgcagtggtgtgatcatacctcactgcagcctcaaattcctgggctcaagtgagccactagagtagttgaggctacgggcgtataccaccacgactggcttattttttattttttgttgggacgggatcttactatgttgccaagtcttgtctccagctcctggcctcaagcagtcctcctgtcttggcttcctaaagtgctaggattacaggtgggagtcaccacacccagcctccttctttagttacctgaaaatttgctagaagtgaaagtggaggcggcatgctatagaaagtatgtaggctttcaaactatacagctttaaattctggctcttctatttatgaatagtgaggcattggacagattttgaaaattcacttataaaatgtaattcttgtgtgacataaatcagtaatgtagtgaaagtacttgacataatttatggcaacacctgttaggcgcttagtaaaggttgattctctcattcagtaataatgcgaaataaactaaaaagttcggccatattcaaagttttgtactgtttttgacttagtctcacaatatttattgataaaatgaacagactaagctatatatttaccagcattgtgtgcaaactctggacagtgaaatgtacccaagatctttctggaatgttgtcaactgtgggaaagtaaaattgttttatgcagaagttgatcctgacctcaaatagaatttcagcaatgactttaatgcagtgtgtgtgtgtgtgtgtgtgtgtgtgtgtgtgtgtgtgtgtatgtgtgtctgtgtctgtgtgtagagagaatgcttggtcaagttgcacatggcagctgtctaatgcaaatgaaagccatttaaaaactagtgttagatttcagatagattttgataaactggatacattgtgagaattactgaatgtatttaaatagtagccagatacctaatgcaggaaattgtacatagaaaatatttgttatatacaagatttagagactatagtagataaaaaactgattaagtaagacactgtttttaaaatgaaaactcactgggttagttattataacatgtgacaaccatgaggtaatctttccatcctgttcagcacaagtcttaacctacctaaggtcactgtttaattttgggctttacaaattgaatagacatttggaaatttaagataatgtttatttatttaagggttaaaaatttaaagcaactgaaatagtctgagagaagaaagatacaggcacttaataatggttattttcaagtgtacctaaaggctagccagagactaaatgaccaagagtattttctttttgtttaggacagcgaaaatataagtattttataaaaggaaatataaagaaaaaaatttctggccattgatacaaaattcctaaaagtaagggaagttataaatattttaaaaatatctagaacctttatatccataagatttttcttctgggtatgaaagtataaagggatttctaaatgttgataaaatccaccagctctttaaagtgtatgatgttggttgcaatgagactagaataaaaaaactgtaaatagaaaagtgtgtattgtttagcattatcagaagaggaacttaaaacgtaagccttgcagatctaataaggtagtgttatctttgtggcatccatcaacaaaatatttatttgtatatttacaatatgcatcacactcattagtagaaaataaggaagtatgagagacaacctttctcctccaggagtttaacagtgttttgcatgtatgcagatgaaatgttaaatagcaattcaagaaggtttgattaaatactatataaatgacacgattgcaggaatctaagagaatggacagatttattacagggaagtcttcattagggagatggctcttcaacaagactttgaaagataaaattttcatagaaataagagagggatatacaagttagcacattaaaatgagtccagatgtaaatgcgaaatccttcaaataagcataatttacacaagagataatacatttttagtgtatgtgagataataataaacactttaaaaattttgtcttttgctcttaccatgtagtgcataaccatctcatgtcttagttctgtcatctgttaaatgggagtaaaagttgtctaccacatagtaagtgatgaacagatatctattactactgtttttggaaggtaaatctgaccatggcacatttatgggatattgcaaactcatattgctggaagaggcagctgagttggagaatactgggagattgggtcagagaaggagaccagactgtagtgagtctctgtgtaaatctgatgggcagctccaagagtggcaagtatgattccactcatattccagtgcttaccaatccatagtgattcgctggagcactgtattaaggaagcttggtctgtatctgtcttgatagcaaaaaagggtattattttagcaattatctattagcaatatttactgtgtgggaggtgatagtgtattttagcattttatcatcattgcactaagtattaagagctactatagcttcttgctttagaaggcctggtaatgtagaagagttataaaaagacaaattcactattggcaggaacattagcattgagttgaatataatgtggctttgagtgggaagaatgaaacttgaattctgagcagtgttttaaaggaagatttgggttaacttttcccctgtgtttagaatgaattccagtttttttctccctgtgatttttggatccactgggcttggagggggggtttatttaactgattcatacaggaaaaattttctagtaaatgcttattatgagaaagcccttgtcctaggtacaaaagatacacagatgaagaatgtgttctctgtcctccacccatctacagtgtgttggagaaagatcttttaacaagtaattaagggatgtgctgtgatctgtaactgagattatgtagaaggcactgtgggataataaaaggaaaagcatgtccatccacctacagaagttaagtaaagccagacgagctgcattaaggaacatttactttcatcttttgtcactccttcagtgagagacgctgtgctagattaatagctaggaggatatttgtacttaatgtagagcattgaaaaaacacaaggctgttaatatgctacaaatacctgtgctgttttagtaaatcaggttttaacacttttccactttcctacagtgcttttagctttaggggaagctcttattatagccacagtggagggattgagttttaattgttcacagaaagcaccttatgcaagggaaggtccattcttgaggtagagtgtagtttcagagtaacagatgtcatcatttctaccactaacaaaaggtctttaatagtccgggtttcttctgtgaagagaataggtgacaccagtatgttgctcattcactctgtcaaccaacatttaagggagtttaacatgggtttgctagaaaaatagtgtctctcttgattaatttacaaatttggcaaacattgttttgtattaatcattagttataattgatttttgtacttcatacagagtttgctcccttttccctttattatcaaataactttcttttataaaattatccaaatgagttcagagcactcacagtaagttgctgattgctcttaatcatgatcttatgttagcattttagtgtctctattcccttcacttcaaatctacccatcagggctgttttggttttattaattttcttctttttctctttctctttttgttttattattctcagttcttcctctttcacttaagtacacttgtgttttggagattttggatcattgcatatgctgatttgctgggattaattctgtctttttagtttgtggaagatactttgagacaatcctgccttctttacatagattgttcttggttttattctgaaatagagaccccctctcagaagaagatgcagagaccactacctattacatctctctgtcctgtagaaaacttgacaattctattctgtaggaacacgtgaaataaatgttttgagccttgttttttctcacataacaggttttccagtatataattcaacatgtgaagcttttcttatgatttaaggaggtactattctaagattgtttgtgagtttgccttattatggttttctatacacctgaattctacatttctcctctgctatgttcacagactcaagggatacctcaaggttggagtacagtaaaagaaccttctgcagaaggtaaaaatgagggctgtccacttttcactgtgatggactatctaggaaacagtagccttttttggacatcatattgtcctttctacccttttcctagtagttggaaatcagttgcatatgaatgtgtgttacattttcctttatccatctttgttttgggaaagaggtgggaaggagtgactcaggaaatagttttagattttgaaatgtatgttattgcaggagagtcactatattatattctactttatgtagaacaaatattttatttgctgcttttgaataaaggacttgtttgttgagaatgacattgtcttcaaagatggtcagttaacttttgtttctttctcagacaagtcttatgcttacttaagtctttttccccccatttaactgaatgttacttagcattttaatagcgactgtaatagaaataatgtaaattacaaatattaatacaatgaaaactaaaactttccaaggtattagccagccttttgaatttgaatatgacctttgctctttctaaaaattctaaacatttctatgattctgatatgtatatttatgtatatattacatatataaatgtatagctcagaggaaatgaatgataaaaatagaataaatcacttagcatgtttttatatcttataattaaaaaccgtttcaatctctggatggttactctgcatagaatagaacaaataaagcttatatctttctatctttctcatctcatctggttttatattttaaagataagaacctcttcaataaaaggtcctcagtaagcattcttctaacccttggataatcttctgtttctccctctctttgcatcgacattaattctttcaggatgttgaaaataatagaccatttagatacttttgatttcagtgttttaatcagataattacttaatagtttgaaattaagaatctatatcagtctgacaaaatgaaacagaatggcacttttcatagagggaaatttatcgtttttatttccagcaacttttcttaccaagtaatcagctaaaaaaatgcaaaacaggtgtttatcactgggagattatagttgcataagggcaatgttctaaaagcaaacaaagagatttgtgattcactcatgtaaaggtataataattgaagtcatataaattcagagttcactaaaagaaggaaagggagagagtagccttggggaagactggcattaaggcaaaggcaaagaactgatgaatgaaatcagtaatggccatcagagacatggagggagaatcaggaaggcacagtgtcatgagcatctagagaggggagtgttttcaggaagggatagacggtaatatagtagggcgcatagacttgccatattgcaaagtgtctgccaagagtcctcctgaataattcttcatttaggtctcagtaataagaatagatgtactgctgagcagacattttgtgtttatattgtgaatcctgtgactgattttgcttccttctttgtctgccttttttaactgttattaaggatctcatatattttgtaagtgtctttacctcagcttcattttatcttcctggtccagcgacatctttcatcttttattctctttgcattgtatgcatcttcgtaagtgatttcttccctccactttcctcttccccctcccccctcctccaacagtgggggttagagagaggaaagatgaaaagtggctagtagcttgacacgagaaatatgatatacgtgaaaaaacccattagatttggcaagaataaaatcattattaacaggcaggaagatcagtagtttgagactagcctggccaacaaagtgagactccatctcaacaaaaaatgaaaaaaattcgccagtcttggtagtatgcacctgtggtccctgctacacaggaggctgaggcaggaggatcacgtgtactcaggaggtcaaggctgcagtgagccatgtttgtgccactgcactacagcctggatgacagactgagaccctgtatccaaaaaaaatcattaaccttcaggaaatttaaatattggtatggggaacggagtgacatacatgcacactcacacacacacactcaaatcttgagcaagatttaagtggaagcaacccaagtgtccattgatgaatgaatggataagcaaaatgtggaatatgcatacaatggaatagtaagaaaattctgacatacgcacaacatggataaaccttgagaacattatgctaagtgaaaaaagccagtcacgtaaaaaatattgcgggattctacttccgtgaggtacttagagtagtcagaatcatagagacagaaagtagaatgtttggttgccagggtctgtggggaggagagaacagggagttgttgaatggatacagaatttcagttttgtgtaataagatgaaaagagttctggagatggattgtgatgatggttgcacaacaatatgaatatacttcataccactgaattgtatacttaaaattggttaggatggtaaattttatgttatggatatttcaccacaatgaaggatttaagagaatgagtatgtacaaagtagaaacagtgggtgacctcctatttaaggaataggcaagaaaatggagagaaatgtaatggtaattttaaatgggtagtctgatgaggtagaaggttttcttaagaactggtagatctgggctgcttaaaagacaaaagggaagcactggactgatatttttaaagttgaacattaaaaaataattcagcaattactttttgaacacctactatgtgttagtggtagtcttattatatattttgttttatgtcagccttattacatattttgtttcatgtcagctttctttttcttcatggataattgtgtcagtttatggattgaaaagattttgttaggctaataagaaaataatgtaagctcagaaaggcaagaaacttgctgacagaataattctccattgctggatggcagtgactcacaggcatatcactaacaatttttaaatccttcttagaattcattttctgtgatgaatttgagtgacaatccttgttgaacaatgtcttgaactttgtggaaggggatggaggcgggttggggaaagtggcagtggaggggcaagtaattagagaagggaggcccaagagattccttaacttttaaattggcttatgcatttgtttggtttctgaattatatattgtaagcatatagaattctaacatcattattttccctgttttgaccagtaccaaatattttatgggagacttttaatgatagtgctacagctctactgcaatgaataataataggtttctgtgtgctagctacattcccactgatcccgagcctgtgaccttagcaaaggtaagcatatcccagattgcaatgtgagatagttgaagattgatctgctttgttagttgtctaaatttctctcatctgtttttaatgagcatgctcaactgcatgaatctgttgatgaccttagactgcattatcttttagatgtgtaaattggaagcttttgaatgagggaaggtgaagttttaagttagtgaatatatgctttaggactgtgtctggattctgtgagtggttttcaaggatgccccaaagagtaatcactctagattctagtggaactgcagtatattaagtatgggaggctgaatttatgacaaaactaaacgcttaataaattcctctgcataactgattgttcaacatgctttgttgagtggcttgaaattacagtatagtgtatcttctcttttagtacaaagtttcattttaaaatttgagcagtttgtctaagtcttttttaaatataaaagtaatctttttatttaaaatagattatattttccaaaataaaaaaaatgagaaggctaacattgtcttgcatttttgcaaacctcttcaatgtctgacttactggagtgtagttagattctcatagctgcttctgtatccaatctgttttaggatattgtttcggttttagtgtgtgtgtatatatatatatatatatatatgtatatatatatatatatatatatgtatgtatttttttattatactttaagttctagggtacacgtgcacaacgtgcagttttgatacctaggtatacgtgtgccatgttggtttgctgcacccattaacttatttacattaggtatttctcctaatgctatccctcccctagccccctaccccctcacaggcccctgtgtgtgatgttccctgccctgtgtccaagtgatctcattgttcagttcccacctatgagtgagaacatgtggtgtttggttttctgtccttgtgatagtttactgagaatgatggttcccagctgcatccatgtccctgcaaaggacatgaactcatccttttttatggctacatagtattccatggtgtatatgtgccacattttcttaattcagtctatcattgttgaacatttgggttggttccaagtctttgctattgtgaatagtgccgcaataaacacgtgtgcatgtgtctttatagtagcatgatttataatcctttgggtatatacccagtaatgggatggctgggtcaaatggtaattctagttctagatccttgaggaatcaccacactgtcttccacaatggttgaactaacttacactcccaccaacagtgtaaaagtgttcctatttctccacatcctctccagcatctgttgtttcctgactttttaatgattgccgttctgattggcatgagatggtatctcattgtggttttaatttgcatttctctgatgaccagtgatgatgaacattttttcatgtgtctgttggctgcatagatatcttcttttgagaagtgtctgttcatatcctttgcccactttttgatggggttgtttgcttttttcttgtaaatttgtttgagttctttgtagattctggatattagccttttgtcacatggctagattgcaaaaattttctctcattttgtaggttacctgttcactgtgatggtagtttcttttgccctgcagaagctcttttgtttaattagatcccatttgtctattttggcttttgtggccattgcttttggtgttttggtcatgaagtccttgcccgtgcctatgtcctgaatggtattgcctaggttttcttctagcgtttttatggttttaggtctaacatttaattctttaattcatcttgaattaatttttgtataaggtgtaaggaagggatccagtttcagctttctacatatagctagccagttttcccagcaccatgtattaaatagggaagcctttctccatttcttgtttttgtcaggtttgtcaaagatcagatggttgtagatgtgtggtgttatttctgaggcctctgttctgttccattggtctatatatctgctttggtaccagtacccttctgttttggctactgtagccttgtagtatagtttgaagtcaggtagtgtgatgcctccagctttgttctttttgcttaggattgtcttggcaatgtgggctcttttttggttccatatgaacagtagtttttttccaattctgtgaagaaagtcattggtagcttgatggggatagcattgaatctataaattaccttgggcagtatggccattttcatgatattaattcttcctatccatgagcatggaatattcttccatttgtttgtgtcctcttttatttccttgagcagtgatttgtagttctccttgaagaggtccttcccatcccttgtaaattggattcctaggtattttattctctttgaagcagttgtgaatgggagttcactcatgatttggctctctgtttgtctgttactggtgtataagaatgcttgtgatttttgcacattgattttgtatcctgacactttactgaagttgcttatcagcttaaggagatttggggctgagatcatgggattttctaaatatacaatcatgtcatctacaaacagggacaatttgacttcctcctttcctaattgaataccctttatttctttctcttgcctgattaccctggccacaactcccaacactatgttgaataggagtggtgagagagggcgtccttgtcttgtgctggttttcaaaggggatgattccagtttttgcccattcagtatgatactggctgtgggtttgtcataaatagctcttattattttgagatacattccattaatacctagtttgttgagagtttttggcatgaagggctgttgagttttttgaagcccttttcttcatctgttgagataatcatgtggtttttatctttggttctgtttatatgctggattacgttcattgatttgcgtatgttgaaccagccttacatctgagggatgaagctgacttgattgtggtggataagctttttgatgtgctgctggattcggtttgccagtattttattgaggatttttacatcgttgttgatcagggatattggtctaaaattctctttttttgttgtgtctctgccaggctttggtatcaggttgatgctggcctcataaaatgcgttagggaggattccctcttttcctgttgattggaatagtttcagaaggaatggtcccagctcctctttgtacctctggtagaattcagctgtgaatccctctgttcctggacttcttttggttggtaggctattaattattgcctcaatttcagagcctgttattgttccattcagagattcaacttcttcctggtttagtcttgggagggtgtatgcatccaggaatttatccatttcttctagattttctagtttatttgcgtagaggtgtttatagtattctctgatggtagtttgcgtttctgtgggatcggtagtgatatcccctttatcattttttattgtgtctatttgattcttctctcttttcttctttattaatcttgctagcagtctatcaattttgttgatcttttcaaaaaacccgctcctggattgattgattttttgaagggttttttgtgtctatctttttcagttctgctctgatcttagttatttcttgccttctgctagcttttgaatgtgtttgctcttgcttctctagttcttttaattgtgatgttagggtgttgattttagatctttcctgctttctcttgtgggcatttagtgctataaatttccctctacacactactttaaatatgtcccagacatcctagtatgttgtatctttgttctcattggtttcaaagaacatctttatttctgccttcatttcgttattttcccagtagtcattcaggggcaagttgttcagtttccatgtagttgtgcggttttgagtgaatttcttaatcctgagttctaatttgatcgcactgtggtctgagaggcagttttttgtgatttctgttctttagatttgctgaggagtgctttacttccgattatgtggtcaattttagaataagtgcgatgtggtgctgagaagaatgtatgttctgttgattagggctggagagttctgtagatgtctattaggtccgcttggtgcagagctgagttcaagtcctggatatccttgttaaccttctgtcttgttgatctgtctgatattgacagtgggttgttaaagtcttccattattattgtgtgggagtctaagtctctttgtagctctttaaggacttgctttatgaatctggttgctcctgtattgggtgcatatatatttaggatagttagcacttcttgttgaattgatccctttaccattatgtaacagccttgtttcttttgatttttcttggtttaaagtctgttttatcagagactaggattgcaactgctgcttttttttgctttccatttgctcagtggatcttcctccatccctttattttgagcctatgtaagtctttgcgcgtgctgtgggtctcctaaatacagcacactgatgggtcttgactctttatccaatttgccagtctgtgtcatttaattagggcatttagcccttttatatttaaggttaatattgttatgtgtgatatgatcctttcattatgatgtttgctggttatttttcccgttaattaatgcagtttcttcctagccttgatggtctttacaatttggcatgtttttgcagtggctagtaccggttttttctttccatgtttagtgcttccttcaggagctcttgtaaggcaggcaggcctggtggtgacagaatctctcagcatttgcttgtctgtaaaggattttatttctccttcagttatgaagcttagtttggctggatatgaaattctgggttcaaaattcttttctttaagaatgttgaatatcgacctccactctcttgtggcttgtagggtttctgccaagagattcgctgttagtctgatgggcttccctttgtgggtaacccgacctttctctctggctgccttaacattttttccttcatttcaaccttggtgaatctgacaattatgcgtcttggtgttgctcttctcaaggagtatctttgtggtggtctctgtatttcctgaatttgaatgttggcctgccttgctaggttgggggtgttctcctggataatatactgaagagtgttttccaacttgggtccattccccccatcactttcaggtacaccaatcaaatgtagatttggtcttttcacatagttccatatttcttggaggctttgttcgtttctttttactcttttttctctgaccttgtcttctcactttatttcattactttgatcttcaatcactgatctcctttcttctacttgatcaaattggctattgaagcttgtgcatgtgtcatgaagttctcgtgccatagttttcagctccatcaggtcatttaaggtcttccctacactgtttattctagttagccattcgtctaatctttttttcaaggtttttagcttccttgcgatgggttcgaacatcctgcattagctcggagaagtttgttattaccgaccttctgaagcctacttctgtcaacttgtcacagtcattctctgtcctgctttgttccattgctggcgaggagctgcaatcctttggaggagaaggggcactctggtttttagaattttcagcttttctgctctggtttttccccatctttgtggttttatctacttttggtctttgatgttcgtgacctacagatggggttttggtgtagatgacctttttgttgatgttgatgctattcctttctgtttgttagttttctttctaacagtcaggtgcaggtctgttggagtttgctgcagttccattccagaccctgtttgcctgggtatcaccagtggaggctgcagaacagcaaatattgcagaacagcaaatattgctgcctgatcctttctctggaagcttcgtcccacaggagcagccgcgtatatgaggtgtctgttggcccctactgggtgatgtctcccagttaggctacacagggatcagggacccacttgaggcagtctgtccattctcagagctcagacgctgtgctgggagaaccactgctctctgcagagctgtcagacagggacatttaagtctgcagaagttgtctgctgccttttgttcagctatgccctgcccacagaggtggagtctagaggcagtaggccttgttgagctgtggtggctccgcccagttccagctaccaggctgctttgtttacctattcaagcctcagcaatggcacacacccctccccaagccaggctgccaccttacagttcaatctcagactgctgcgctagcagtgagcaaggcttcgtgggtgtgggaccgccgaaccaggcacaggagagaatctccttgtctgctggttgctaagaccttggggaaagcgcagtatttgggcgggagtgttccgattttccaggtagtctgtcatggcttcccttggctaggaaagggaaatcccccgaccccttgcacttctcgggtgatgcgatgccctgccctgcttcagctcgccctccgttggctgcacacgttgcccagccagtcccaatgagatgaaccaggtacctattggaaatgcagaaatcacctgtcttctgcatggatcacgctgggagctgcagatcggagctgttcctattcggccatcttgggagtcttttttttttttttttttttagtggcaagagatggagactcaaattacctcaagtaatgagaagttgattgtaaagatgcttcatcaccaatgatttgattgattgcaagttacaaaaatcagactcacctgctttctttatttatatataatcaaaactttatgctgtaatcccagcagtttgggaggtctaggcaggtggatcacttgaggtcaggagtttgagaccagcctggccaacatgatgaaaccctgtcctactaaaaatacaaaaattagctgggtgtggtgcgcacctgtaattccagctactcgagaggctgaggcacgaggattgtttcaacctgggatgcataggttgcagtgagccgagatcataacactgcactccagcctgggtgacagagtgggactctgtctcaaaaaaacaaaaaaaattatttttcctgtgagacaggacaggcattattctaggctttggggatagagcattgaacaaaatagatattcttccctgatggagttaacgctcttttagagagacagtgaacaagtttgcatgtatgtatgtgtgtagctacatatacactcacacaactgctggtacaggttatttatgtgaaaaaataaagcagggtaacagtatagttagtgagcagatggaacaagggctagttagataatgtggtcaaggaagaagtcccccaagaagaggtttttggttatagatcagagtggcgctagagggtgagtcaggggacaatctgggtgaagtatattccaggtttagggaccagccacaccaaggcttacggctgacacaaccttaaagtgtttaggaaactgttggaaggctcaagtagctagaaagtagtaaggaatgggaagagtggtgggagacaaattgatcagggagacagacagggacagatctcataggacctggtagggccaataaggaatttgagatttactatatggataatgtaagtatattgcaagtataactccatttaggagttttgagcaaagtagtgatgtgacttatctttcaaaatgattattgtaattactgtgtgaatattagactcttgaggagaaggggtcaggagtagaagtagaagacctgttgaggcttcgcgtgaactggtgagaggtgatggtaatctggtgagaaggaaatggctggaaagtctgatttcatgatatattttgaggaaatagctggcaggatttgctgtggaattgaattcaggttactagtgggggacagggacaggaataaaagttcattcttaggttttatgtggcattgaaatttcttgggaataggagtaattaggaaaaaacccagaaatctgaagtctcatgggggaggttgttaataatgggggaaaacattgaaaaatactggttgagatcatggcgcaaagagggaaggactgagtgctgtgaggtcaagaagtagaggaggaccctggagagaaggtggggaagaaatggccggtgagataggaggagagccaggagaatgtggggacctagacgcttagtgaagaaagcattttaagaaaaagcaatgtcacatgttccagaaatctgaataagatgacaacacagacttgacaattggattggcaaagtcgaagttaaggttattgatcttaacagagacagattcactgtaggagtagaagtaaaagtctttgattggaatggattaaacaggaagtaaggacaataaatattgttgactttaaaaaggaagagccaagaaatgggactctgatacatgaagggagataatgttgtgaataattttttttaaatgataggagattttaatcatatatacatatatacacatatatacatatatatttaaatcatatatatattttcatatatatgaaaatataaatctatatatatgaatatatattatatatatatggaatgacccagttaagaaataattgatacaggagaagatcaaactatcttaatttaaaaactatccctatttaataggagagtgctggtgtatagtcaggggcttaatccaccctggcccaggtcctgtctttctctgtttctttctggattttggtgttattttctcctcctgtgtttcctagaggctagttctgtggctggtggcagttgcaggcttatgttttcctaggatcatggccaaagagaactaggagtcttgcctgcctgttctagttagagaaatgccagaaagtaactggcttaggtcttgtggccaaatctagatctgctgctgtgacctccagaatggggtcctgtgattacttctttccccatctgcctactccgggtgatttggagtcttgtctccaaagaaggaagagagagaaggagtaacctagcagccagccagccattacagattaatgaccaagaatcactagactttgagaagagcaggtagaagaaaaccttgaaaggatgcagggttgggtgggtggtgtctggcagcatgggtcatgtgatataaaatatagctactctttcagaacatctctaagttcctgaaacttgcagttcaaaacttttggaccataaatggattttctgaaaggcctcttttggtcccactctgaattttacggtaattgagtgtatcacttcctaaatagagacattttattaaatcccattttggtattttaatgaaatgagctaatgtaactctcaccactgaaaacttccaaaatcttcctggctattacagatttttactattgcctggtactttttactttgaaaccctaggtgagtttacctagaatctccaaacatgtctgtattgttaaagatgaaacataggtatttttaaaagcatcaatggaggaggagaaaagtgaatttgaggcagcaaaaagtaggcgctgtctgtgctgagttagtttgaaaatcttgagaaagagatgctttctgaatactggtaaatttgagtagatggttcttcatgagctaaccactctcaaaagagaaatagtaattgtcacacttcagtaatatctaagaataccaactactgttacactttgtactgaagcttaagaacgtggaaggtttttgcagtgccatgtcttcatactgtactagagctcttgtcgtttgggttactggtgaatttttgccaaatgaagccttctgaagaggaaaaggaacaactataaaatttagagggtatatttaagtgagaatatttaaatatactcatttaaagcaaatataattaaaacatataaaggcatccagataattatctaggagagcatgcctttatggaattacaaagagttttattaaattttaagtagttattggtaataatttggtgttatcaaatataggaaaagcagtacttttatatgacttcacctgctatgagaaatggtagttttatagtttattgtgctgtcttcattttctatatttgttaatgaaagatttggtagtatgtttttgaaaattcatttgatgttattatgaacattttctatttttcttttttattttctttttatagagatgggggtctcactgtgttgactagactgttctcgaactactggcctcaagcgatcctcccatcttggcctcccaaagtgccaggattacaggcgtgagccactgggcccagccccacttttctttaaattaatagaatgcaaggatcataattatctaaaatggcaaatgggttcagtgtttagtgtagactaaaggcatgtataaattacaaataggtcttatatttgtcttatagaatataagaatttgcttattttgaaagtaaattgtttaggcaggatttagagatcatttatagtttgtcaacacttccgttaaaacaaataatcattacttcctagataataaagattttgtttgcatatcacatcaagtataagaaagggcaatttataatttaaaaaggactctgaatttaattatttgttaataacttgttggtttgtctccaacactgttagaccagagtaagtagaatactttcttcctcattggcataactaggagcctggaaaaaaaaaaaaggaaaaagttaaaaccagttcgtgcctctggatctgggaaatcaatcagttgccagagaacaaagaattaccaaggaatataaatgggaattattgaataggcaattagaaaaagaaaaataatctgaaacaggttgagggaagattgttgtaaattctagcccataaaagttgagaaatggaaaagtttaagtgttttaggaatttaaactaatgtaatcactgtgtttctaaaaagactgctaaaatttcagattatttccaaatgcaaacagagtcaagaaaggaatcagttttcctttaaaggctagttttcaaaaggtatcataagtatttttatagtgctttattaatttttttgctagataaacatcttaaatccatattagaagctttttcaatattgtgggttgacgagattacatattagaagctttacttctaatattgtggataaggagcccttccttactttctggcacgaaaagatgtttgaactaaatgaatatccagcaacaagtaaacttaggtattctgaggcttcttaaatactaatacctacagaaaccccaaggtacagctattctttcccagatagacaaaatccaaaagtgagtaagaatgcagagcttgactgcctgtattcaagtctctacataacacttactagatttgtgacatcggacaggacaaataacttgatctctctgtccctaactttccctatttgtgaaatctcgctaataagtacccaccccccaccttagagggttgtgctgaggattaaatgagtcaacaagtatatagagtttagaacagtatttgatagctaataaagcctaatgtttgctgttattaatattgttaaaaggctaccatactttcttggagaaaatcacaagctacaaagtaatggagaagctcgcaattagtagaattctctacctgcataattgaagaagaactgaaagatttcttttttaaattttaatttcttaattgaaagtgatttcaaatttagagaaaagttgcaggaccagagcaaataactcccatatacactgtgtctagataccctccgctccccttccagtgccaccatttgccctaataatggccttttatagccaaaggatgcagggtgatgcattgtacccggttgtcctatctctctagttgtcttcagtatggaaaaattccataatactgcctggacttttacgacgttggccagtaatcttcaaaaacatcacttttgtagtaaataactaaattaggatttgtttgatatttttacattgttagacccaggttatgcattttgggctggactatcacaggagtgattctttttattatatcattttgggtggcacttggtatcatttgccttattacaaatggtgttatctttgtcatttgatgaatatagtgtctgctgtgtttccataactataaaggtatttaccccacaccgaacaaatgtgtaattcttttttttttttggtggagagatacttgaagactatttaaaatcacattcctcatttcactttttagttctagcatctataaattttttttgcctgacttaattattgctcacatggttgctaaatggtaactttttgaattccatcattccttctacttactagttggcgttctactataaggaagagaattaaacagagtgtatatcaacatcttgtccgtgaagatgctgggagataacaaagacatattttgaaactaggaatttgagaaagactgattctcaaaaacttatgaatgctttgaagattgatcttctgcatttattcatttatatcctattttattcagtcagttttgagtttgttactattatgattttgatgctcaaattgtcccaaatttagttaatgggaggcctttctaactggcttctatatctttttatatcctttctaactggcttctatattctttaaaatatccttttctaactggcttctatatccttctgtatcctcttttaaggattaaggatattctttattcttttatatatccttctatatccatcattttttgagctcttccctacttattggcacaaaaagtatccaggctcattgtgttatgtcttaacctcaatcctggaaacagccatttctccaaggaaccctggttatttttagctgaattgctgtttagaaaccaagatttgggcactaggtatgttcattgctactgagatattgttgttcccagacctcagtggacagagttaagaaacatgcacaccttatatttctttttttttatactgaaaatcatgaattcacactgatacctgataaactccaatttcagtccaacactttgggttaattctagcttaactcctttttctatttgtacttcactgacagtgaaaacttgactctgttatcttaatatgtttacgtagttgctcagtccctctgtaggtagccagggtcctgaccccacgggctgctacctctttcaggggcctgccttatgtgggcctcggccttcacaaggctgccaccctgttgtccgcattatagagatactagctgctgttaacctgtctcatccccatgtgggaccagattacttctgggtaattgaaagacactgaaatgaatatgaaaattgaaaaaaaacttgggagaaaaatcggaatgcacactatccagtaacttggtggaaatgaatcagtctttttgagtttgatgactgaagcactttattcacattttgcctttctcatatgattctctggctgttgacaaaggtcccctatgaatggggagcctatttagtaatttaatcctttaaccattgtgtcagtactacaattaaacaaacttttcctaaaagttatttttgccactgataatattagttaaaccactgctatgtataccagctgaaggccaagttggaaaatgttatataccaggtaaatgtagcttaataatatttgtgaattattagatttttaaatgctaaatgcactaagaaaaatcatatataattgaagatcaaacaaatttctgagtacagttgccttgaaaatatttctaccattggaattggctaatttttctattattgaagaaatcaaggtttacaagttctgaatgtattgtgtcttcttacctggaagttgtttggcaactagagtgaaaactcaatttttagctggcctttgatataataaagaaggtatttattaactaggcttttgtattcattttttgttgaactccctctaaaagttaatgcatttcttacatcatgctttctggtagtcttggtaataactccttgattctgatgttttatttatttaatccagtgcccaaagtaattactgtgcagtcagtaaatatttgctgcatgaaggaattccaagttgcctacagaaaatcttttgaagaaactttcaaattctaagagaaaaaagtgttaatagcagaaaattaaagcaaacagttgtaaagctataattgaaaagctataattgaaatgtttctttattgttatactttggaaaatagcaccctcttcattttatgaagcttagtcacacttttgaaagtttgttgttttatctagaaatggttctaaaaagaatcaatgaaagtgacattttccttggcagtcttggttaacagaatcattttgtcatccattcactcgtccaataaatactaattgagttccaactaactatgtacctgccattccatgtttgttaagtgcttgctgtatttttggcattgtataacatgttgggaatatagaatgaataagaaacactatctgcagaacaaccatatgattttgagacccactatttctccaattttttttgtttttggagatggagtctcactcactctgttgcccaggctggaatgcagtagcgtgatctcggctcactgcaacctccgtgtcccaggctcaagtgattctcctgcttcagcctcctgagtagctgggattacaggtgcatgccaccacacctggctaattttgttttgtatttttagtagagatggggtttcgccatgttggccaggctggtgtcgaactcctggcctcaaatgatctgcccgcctctggctcccaaagtgctgggattacaggcgtgagccacttgcacccagccttcaatttctaattttaagatatatctttgttatttctcaccatcttcatggaactaggtattgatagtacacttagtttcattgataataagattggagtttctaataggaaaggtaataaagccttccctcagtgtcccctgtaccactgttgggaacaaaacaccttggtaatttttaagttctgaatgttcaaacatttgccagcatttacctagtgtctctaaaaattacatgtaattcttgcataattaaagagaaggagctcatgagcaaaagtgtatatttctctttggtacaattactaatatccgaactcaagttcagggtgttgctttaggtatccaaatatagcatgttgcaggaatttactccatgttacaaagacatgccctgctgaccactgtgcaaatgaggagctcacattctggcactgttctaaacataaacctgtcttgactgtgctgagcagctgagcatctaaagtctcgttcagaagtgaccccaggaagtctataaaatcaactgagttaggatgaaatgtgaaaggcccgaaacttactcaacttttagatttgaaaagttattattttctttcttttatattagtttaaaaattcttatttttaaatccctgcaatactgaaccttaggttaattcagttttcctgtgataaattatgtgtatcagtgtaaagagaaactgagattttttgtaacttgtaacactcaattgaaattggatttaaaagtagtcaatactggtgtacacctgtgttgttttagaatatggtattttatataaacattccaataacacaaatatttttcaaactgctaataagtttttagcttctatcaacatttcatatagccaactttaaatatatttacttttattaataatgtttagtctttcttcttcctgacccccttgccaaaccttttggtagatataaagatgttttcatgctttaagagaaggcagtatatgtttgtaacacatactgtttgtaacagtctgtactgtttttaactctactctcctgtctcaggatatcagaagttgatttccctaaaatgcattaattttcccaaagaaacttttatgccagttgcttttaattaaaaaaattattaacaagccagttgctttcttaacattaagaatgacattactaatgtttttaaaatcataaatttaggacatagcagttttaaaaaagtagtatgaaagctattaaaaaatgaaaagcagaatacatgtaatgtgtatgcttgttatatccaaggtctgccacagctgatggtgaattcggctgtatcttgaggtttgaggtttcctcagaacgcaggagatggttaagagttggcctttgaactcagtgggcgtagttctaaatcctgtttccactacttacttggtctgtgaatttgagcaagtggcttaaactctgagcttcagcttcctaatctataaaccaaggattataatattacatctgatacctacttcatagggtttttgagttttatgagaggattcatgtaaagcatgtagcagagtttctggaaattgccaagtgctcacaaaatgtttggtactactattattaacatgtctctacatacacaaaaatgctttattattagaagttaggttttcccccacagtatttaggtgatttcacagatcatctttaagatattttggatagtatatacttatattaaatataacaaatgaaaagttatatggtagtacttcactaggctgttttgtatttttaggcttgtaacttaatacaggcatatggctaagtgctttgggtgcattggttttgtaagattgccttttacacatgaaaggaacaagtaaatacatatattttaatcttttaaagtttatcttttatactgatttgtttatatcaggtttgcttaaagcaaggcacacaaattctcttccgataccactgtcgaccacacaactttaaattgctacctccactatgttatttataagcctctttggttctgttctggagccaaggattcaccagtgctgctttaaagtgagatatcaggcagacagtattatttatctttcacacaattatgggatagcaaattgataattaaaaacaaaacaaaacaagttcttttatttaaggaagactaaaagtcagttatacattcagctaatacttaaatggcaacttggtgtgttttctacagtccttgtcttatagcagcttgcagtatagcaggaacataagatataagcaaacagttacaaagtaaggcagcccatatgatgtgccattttgtagaaatagttaagcagtatagaaattcatgggagaaagagattgctttcagctagagtatttcattcacttaaacctagttgtacagctgggatgtacctatgcatgactcgtgtcttttttggaaggctgcttcagctgggtggccacagccagttgcttttcttctctattggtggctattttcaccccttacaatctcttcattctccctgtgattaggaccccactgctgtcaaaaagctttctgctcttaggcacagttttcatccctttttaagtgctgatccaaaatagtgacatggtggtgggaccgaaagtagcagacagatggggagaagaaagggaaactgggtgcagaatcaggaacctcattctctgttgtagaaattgcccttttgatagcagcatgggtgaggagtaatgaaaaggagaaccctctgttcctgtgaaaatccacaaatgtatagtcccgcccttccccatattttacctccccatactctctcatctcctggaatttcgattccatacatcatcctgtccccactttcccatcccccaccatctcctttgttccagagccatgctgcagttctgaatctcctggctgtttgaaatgttgcctttcgagctgttagagcccctcttccaagttgtaggaatcacctccatgatgaagaactgacgtagctccattgagcttttctgttactccctccaggcctttagtaggccccaatgtatacttgatgtctctaggagaatcctgagtccattaatgtaattgcctgtggcagattgctcatatataatgtttaactttggcattactgttagtactatatgtctgaaaggtttgtttctaagagaaaatatgtttcaagttttaaacagtgagctgttctaaatcagccatctatattagtagtggacttacagtcagaaggttagagttcaattctagctctctcagttattctgtgtgaccatgtgtgtgatcacttggcctctcttggcctaggttgtttgtatagaatgtagagataatagatttctttcaaagatagttgttgggggttaaatgagaatgtatgtaaagatgtatagtaaaatataaagccccatagtcctaaaggaatgtggcatttttttgtgtgttaatcatgactgtgttaggtaaaataacaagttcctgccctctaagaactcatcatccagaggataagatgaacatggacaattacgttatggtatatgataaatcctatggcagatataagtataggtgaccaaggagcacaaagaagagcagctctaatctggaaatgaatggatagagaaaacttcatgaaggagggagcttcttatctaagtcttaaagaagagcgagcctggcaaagaaggaagaaaggaaaaacattccatattgaaggagagacagtggggcctgggggaacattgtacagaaagctccaagtatggctgcaagtatgactagaccataaactatctgtggtaccttatctgattattaggaccacttagcttattttgaagaggcggtgttcctgcacaatgtttaacaactctagaaacaggtttggtctgaaacttggtttgaccatttacgaatcttttatacctaattaagaacctcgactccatacacttttagattcaatatgatgataaaagtgtctacttaaaaggcttattacaatgatcatttgaaataatgtttgcaaatctcctggtatttaatgaacacttaataaatgttagcagttttcatcgctatcctgaaagttcttagggccattctttccctctcagtattctgtaatctactgttctaggctaacactttagcaatgttttattaataaataccaactcttgtttattataatggaatcatagaaacagtttaaatgaaatttttctttggagtgggggacggagtctcactctgtctcccaggctggggtacagtagcgcagtcttggctcactgcagcctctgtctcctgggttcaagagattctcctgcctcagcctccggaatagctgggattacaggtatttaccactatgcctggctaatttttgtatttatagtagagacagggttttgccatgttggccaggctggtctcgaactcctgtcctcaggtgatccacccaccctggtctcccaaagtggtaggattacagacatgagccaccacacacggcccagtttaaatgaattttaaaggtggtctagatcaattttattattttgcatgttaagatgcaaggactgttcaacacacaaatcaataaatgtgctacctcacatcaatagaatcaaggtcaaaaactatatgatcttttcaatagatgctaaaaagcatttaataaattcagcatcccttcatgataaaaaccttcaacaaattgggtatataaggagcatacctcaacacaataaaggccatatatgacaagcccaaaagctgtgtgtttcgtgccgaatggggaaaaattgaaagcctttccactaagatctgaaacaagacaaggatgcccactttcaccacttttattcagtgtaataccagaaatactagccagaataattaagcaaaagaaataaataaaaggcattcaaattgaaagggaagacgtcaaattatccttggttgaaggggacatgatcttatatttagaaaaacctagacttcaccagaaaactcttagaactgataaatgaatttagtaaagttacaggatacaaaatcaacctacaaaaggcagtagcatctctatacattagcagagatcactctgaaaaagaaatcaagaaagcaatcttctttacaataggtaccaaaaaatatacctagaaacgaatttaaccaaggaagtgaaaaatctctacaaagaaaattataaaacactgattaaagaaattgaagaggattcacaaaaaaggaaagatatgcttatggattggaagaattcatcttgttaaaatgtctttactacctaaagtgatctacagatttaatacaatccctatcaaaataccaattatatccttcacagaaatagaaaaaaaaatcctaaaatttgtatgaaaccacaaaagaccatgaatatctatagcaattcttgagcaaaaagaacactgctggagatatcacactacctgaattcaaattatattacaaagctataataaccaaagcatcatggtaccggcataaaaacagacacatataccaacgaaacagaatagagaacccagaaataaatccatacacttttagccaactcattttcaacaaaggcacccaaaatgtgcattggggaaggaatggtctgtttaataaatggtgctaggaaaactggatatctctatgcagaagaatgaatctagatctctaccatatgcaaaaatcaactcaaaattgattaaagacttaaatgtaagatctgaaactattagaaaacattgaggaaaggcttcaggacattaggctggacaagaagctttttgggttaagacctgaaaagcataggcaacaaaagcaaaaacagacaaatgggattgtatcaagctaaaaagcttctgcatggcaaaggaaacaatgaacaaagtgaagagacaacctatggggtgggagaaaatttgcaaactatccttctgacaagagattaataaccagaatatataaggaactcaaacagctcaatagcagaaaaacaaataatctgagtaaaaaatgggcaaaagacctgagtaggcataaagacataccagtggcccacaggtatacgaaaaaatgttcagcatcactaatcatcagggaaatgcaaatccaaactacaatgagatattatcacactccagtttgaatggctgttatcaaaaagacaaaaaattacaaatgctgttgaaggtgtggagaaaggggaactcttacatactatttgtgggaatgtaaagtagtacagttattaaggaaaacagtatggaggtttctcaaaaaaactaaaaatagagctagcatatgattcagcagattcactgctgaatatatgtctaaaagaaaggaaatcattgttccaaatgatacctgcactctcatgtttactgcagcactattcacaataggcaagatgtggaatcaacctaagtgtccatcatcaggtggatggataaagaaaatgtggtatgtatacacaatggaatattattcagccataaaaaagaataaaatcccgttatttacagcaaaatggaactgaagatcattatgttaagtgaaataaaccaggcacagaaagacaaatatcacacgttcttcctcagatataggagctaaaaaagtggattttatggaagtagagagtagaatggtggttaccagaggctgggaagcgaagaggggaatgaagagaagttggttaatgggtacaaaaatgcagttaggtagaagtaataagttctagtatttgatactaaagtagggaaattaaagttaacagtaatttattgtgtgtttccaaatagctggaagataattataatggttccaacatggagaaaagataaatgtttgaggtgatggatatctcagttaccctgatttgatcatcacacattgtatacgtgtatcaaaataccatatgtactcccaacatatgtataacatcaatttaaaaaagagaatctgagctgtagttaaataatgtggctatgatattatcctgaatcagtggcacagctgggagtaaaatcaggtctgtttccattccagagttcttttcattagtcttagaataaattgccaaaaatccctttgagacactgacctgtagcactggccacaacttcaagcagaaacaatataagttaacattttagaagctggcatttctgtagctctgcagattgggaaagatacctttaaaaggaatggtgtatctctctctgcttgccctctgatggaagtgttgtttagcaacagcatctataaaagatcagtgagaggcaggtaataaggaaccagataattcttaaatgagtaattcttttaccatcaagaatttcttatgtaatgaaaaatcgcttgtaccccaaaagctattgaaatttagaaaatgttaaaaaagaatttcttatacatacaaatccttgtctcaccattaaaatgtaaaattagattttcataagacttattaattaaacatgttctacgtcattcaacagcatccaacaaataatttgttgagtgcctttataccaagtgctagggttagagtgatgagcagaagacttatactttactgaaataaacagttgttgaagtaacaatcatacagataagtagttatagttatttaaatgctatgcataaaagctactaagggattaataatcaggggctgggtgtggtgtctcatacctgtaatctcagcactttgagaggcagaggagttcaagagatcagcctatgcaacatagcaagaccctatctctacaaaaaaaggaaaaaaaaggttatatagtaatgttcagaaaggttcacttgaagaattaaagttttagctgagatatgaaggtttaatgaaacaaaaaggtggagggatagcaaaaaggagcttatactcagcaaacagcacgtacagaggccctgaagaaggacatagtatgatctgtcctaagaaatgaaagacaactagagtatttggaacagagaatgctaataaaaaatgcaagtcctggtcatgagaagagaagtgaaggtgtttactaagtatcaccaaggaaaccacagcaaaaggagaagtgaatctccccccaaaataaatggttctgttagatctgttgttttaaagattcgttgtcaagaccactacaattttcaatttgctaagcagagtattactaagatttgggcagttttaatatgttctttttcatttgatttttcttcctttctgtactgacttactggaaattgtgggatgactttgatgtgctgaagtgtttagatcaggaattttcactgttgaacagtcatagagagaatcttatcttgttttcttggctggggattttgtgtgggcgtgtgaggtacagctgcaccatgagttttttggcagtgaggacagggcaattctcaatgcagttcatcttgaataggaagaaacttaagagtaaaaagtctactttgaatgcactaaattcagtggaaaacacccagggcctgaaccttcagctgacatcctgttacttggttaaatggatacagcagcctcaggcccatgtccaggttttatggtaggaacacatgaaggggagaacagtcaaggctttgtttcaatataaaactatcagttaccacatctagttttaaatgtttttggtttttgtttgtggtttatttaagctttttctctaaagaacacttaataaaaaaggcagattgatggaaacctagctttgcttgcaagtatgaattcatatttttatgtagcttatcagaaagatttttttcagatttatttatatacagatggattcccagatctgcttttattgctcacgttttcttcactctcccttgatctcttctgtagtctataagcattaaccctcaaattaaatgcagacagtatagaactattcatttgtaagcacacttacatccttccctttgcataaactcatcattactcttcataagcagaaacctctgaactgcgtccagcgcttaactgcttgtttatatctttactgttatttagtattactactttcagagtagtataaagttttgttctgtgaacagtttgcctgagttcaaatccagtcctgctgcttactttgttggttccattagctttttagtttttaacttccaaaataaagataattatgttagaacctcgtaagttttttttaagacttaagaaaatgcatacaaaggacttaatttaaaataaatatccaggagaagagatgctagttattttattcttgatttaggtccagtcttctagaatctattaatagctgtcttttctggttgatgtcatttagtctaaagatcatctgtatgttggtgacttcccaccaatacctctgttcctaacctcactttttcctaagctccagacttgcagatctgactgctgctctattatctacacttaaatgtcaaatgcatacttcaaacataacgtgtcttaaaacaacttttgatctctgtcaccggcccctgctcgtttccccaatcttttcctccccattcttttctatctcagttaatggtagcaccctctgtacttttggcttttgtttagctaccagcccctgtccatttcatcagcgcatcttaatagcattatccccagaatatatcctgaatctgactccttgttgtcatcttatctactactatcatagtctaagatgatgaccctttcctgtctaggcaattatataaggaatggtcttcttatttctccgtatttcatgataagactggaccatttttagtcttatcatgaacaatctattctccacattgaagaacaacattctaaaaaaagattattccccttctttttattgaaattagaaaactgtccagagttcttgaaagcctttcatgacctagctcctctctgactttctgccagtctctcaaacactgctagttcattccatctgaaggcttttttttacagccttttcctctctttgggatatttttcacccatgtcttcacaatgggactccttgcaatttttaggtctcagatgtcagctccttagagaggcttaccctgacatctttcctgcttttcttaagttaatcactatctgaaatttcccttcctcttcttccttctttcataaagtgcccctccccaaacccaaaggaatttaagttccatacaaggactttatccgttttattcactgccatatgcccagtgcttagaatgaaatctggtattcagaatgttttcggtattacaatactatatgggtggatggctagatgaaagaatgaacaagtatgtatctggtaattttctacaaccagaaaaatgatagattatttcattcttacaaacttgtataggtgtttattttcgaattaatcatgctaatctttgtcctaattgcttttactatcacttctgtttttgattgtaaggctttcttcttctcatagagtgctagatacagttttggtacttaatgttgattaaattgaaaatgcaatctaatatctttatattctctgaaattatagaatatgtatttctgaaagcaggtgtgtttaaaatatgcattccccttttatctcctgcagttcataattggacccttgaagacactcttcagtggttgatagagtttgttgaactaccccaatatgagaagaattttagagacaacaatgtcaaaggaacgacacttcccaggtgagtctttgttatgcaaatgtattttccactcagggagaattatatgctagatgtcatttccccatactgaatctacaagttacttccgtggctgagggcacaaaggaaatataaatatatccattctttaatctttctaaattatgcattttcaagttttaatcaatttttcttgtctaaataatcaggctcttggaaaaattatttccaaggaacatgattttgagtttcagaagatgggtcaactatatcatttgtaaataacatcaagggtcaacttttggccaatctaagaaaaacttttttatttgatactgattcatttttatgaacacatctacttgaatgaattaatgtgcgtctctttcttgtgacattttaaatgacaataaccatcgaattatggcgtctatacgttatacctgaattttaaaaatgaaattaataaaaaatagcaaccattttaaaatgtatgctacatagaagtactttatattatctcatttaaccctcatgattaaaatgaggtatatattgtccttcccattttacaggttaaaaaaaccaagtcagagacaagttaaacattttgcccaaggcagcatttaaacccagatagatttgatagcaaagtccaggttgccagtttatcccttaggtgtctgaatccagttgttctctaaattttattttctaaattatatctaaattgtatcatttgcaagtaccaaatgatataatttagaaattataatttttaattaatttaattaacttaataatcttgaaggatttaaatgtcaaaatttgcaatgattctaccagaattttttacccttacaagattgcttcttaagttttatttttccctggatgatttcctacatccaaaaagactctaatcagttattacaatctaatcattatatgtaatgaaatatatacattgtgtccctagtcaacttccttacatgccctatttagataagtatcctttgttgctttgaggtttgtattttgatcaagttgaaagttttcaaatctgttttaaatgtattctgaacatcaacattagtatttctgattttattatacacatgactagaatgatgaaattatagggataagagtcaatttgataagtacttactgaatatcttttatgttcatggtacaactagatgcttgaaagaagacaaaaatcaaataaaatatagttattttaattaaaacaagttcttaaattaaaacagagtcaaacattaaaatgagattagaatttatttatttatatatgttgccctgggtatgaggaacaataggaattttcttgttgccttttgagaaacttgtttgtttaacaacaacatgaaataaaataggctaatctgagttttgacagtcagtgttatagctactcatttcctttggttaagtaaagatgatcagagatgcttccaattctggtaaaattgtgacatcacacacttgtcaagatcaactccttaaatagtgaacatgttactatagaaaaacattataacttcagttttcaggtcagcccattggaaccttttttagtggaggagaaaggagaacagtaaactcttccttaagcccctattatatagtaatggaaattagatgagtcaacttaaaggggcaatatcaattaatttcaattattatgtaagttccagagctctttgtatggtatctgtagacataagaactagttacaagaatgtataagaaaatgtattacatattctatagatagttggcctacaacagtccattatgatgtttcttttctgtgacattaaaaccctttacatttgctaaaggtagccaaaactatgttttatgttggctgtagtggttatcttaaacctttcgctgtgttttctatactctgtaattcttactgccaaacattatactaaggctgtcttcacctgacacataccacctcatttctttcaggcctatgtggccttccctgacaccctcacccactcaggtggaatcatttttacctctggactcatattgaatctcgcataaaattttgttatgtattttcttttttactacatctcattgtctttcttagtctattgatagtttgctattaattcatgcatccatacctacatacattcattcagctattatacaaacatttatcaagcttctacttttggcaagtactacattaggctttggggatacagagatacgacatagtctttgccttcatgcaatttgataagtgtcatgttaaaggtgtaagggaagcattatacgaaagtacctgtggagaagataaaggaaggcatttcagagagggaatgttacagttctttgctctttaaggttttatagaagcctcataggagttcctgtaatttttccatacttagagagtactgatatctttctatacaaaatgtagtgtttcaaagtagtctttggaatcgtacatatttgggtttgaatccttgccttacctattactaattatgtaaccttaggcaagttactcaacctctcacaagtatcttcacctataaaatggaaatactattataaggttttcttgagtattaagccattggtacaggacccagcatatattatatgcctgtgtttattgtcattgttattattattagactttgtgtaatgaaatctttactagcatcatacttggttgttaagaaatcttagttgagtactgggttgcttgtatttacagtccataataaagtgattttatttccttattttacctgtgcctcctacgtgctttcttcatagctaataaaatggtttagtacttattattatataaattcctctacctacctacctcaatccatgaaggctttttatttcccacttgtgacttcaatgtactttgttcaatttttaaacagttaaacattagaatgttaaaagtatagattttttgatacttttaaagaaaatcaatatgatctaaattgaaaacttaattgttttttaaagtctgctatagatgttaaattaagttacttatggttttattatcctttgtgaaaggataataagtgacagaagtaattaatgactataaaatattttcaactttaggctgggagcggtggttcatgcctgtaatctcagcactttgggaggctgaggcgggcggatcacgaggtcaggagatcgagaccatcctggccaacatggtgaaaccccatctctactaaaaatacaaaaaattacccaggcgtggtggcacgtgcctgtagtcccagctacttgggaggctgaggcaggagaattgcttgaacccgggaggcggaggttgcagagagccgagatcgaaccactgcactccagcctgggtgacagaatgagactctgtctcaaaaaaaaaaatttttttttcaactttataaatttctaaatcatagtaagtcataacagaaagtaaccttagaaaaccaaaactttttcaatgtagctactaaattattaacatacaggagtctttctacagctaagtttgcactgaagaggtttttgaaacatgtaacaaattattaaatcacacatggatgagctccaacagtgatcatcaataatatgtaaagtgttaaatgtgttgctcaaatatttaaatttgtatactagaaatattttcatttaatatatatatatatgtgtgtgtgtttttcaaataaacaggatagcagtgcacgaaccttcatttatgatctcccagttgaaaatcagtgaccggagtcacagacaaaaacttcagctcaaggcattggatgtggttttgtttggacctctaacacgttagtattctctctcactcagaggatgatgtaaaagaatatcctgatcatctctgtgttatttaaggaaagagaaaaataagatagtaggcctctaagaagaatcatctattacctgtgaaagaagtgtaatactaccttaaaagatttataagataggattttctgtcattgaaacatgagtgtgaaattttcaaagctggttactaatgtaagaagttatataaaaaactatatttagctgttaatttagaatttttagatttaaaactttggatctttggaggagttttaatgttgatgttactataattggatattcactgaggaatctcttaaaaaataatatagtctaaccatcttgatggcatgaagcaatagagcctaacagttttcactaaacaccaagaaaatggatttttaggtatagatggaaagcaaagactcacttgaagctttataaattaacaaactctactggcaggagcaagaagtagaaaatgttatttgattgttttgaagagaaacatttgagaaagtgttatgcaatatctgtaaagaaaataaaccttgtatttatttactttgacaggaatattttttccccagaagagaaatttaatatgtttgttttatttaatttcaattttttcagaaagctttgggagaaagtgtttgaaaagtacaccttttaaaggaattatgttttttttttttagtcaaaaaagtataacaaaattaatacaagaaaaatgccttccacaagttataaagtaggaaactaatgtttattctccctgaattcttggagttaggagattttcaggtttctatgataccatcttgggaatggcccttctaaaaaagggtaactagaattggttgaatagattttatgactttactggtggttcttttttggcttgggctaaaagagcagctggtgaaacagctggaactccccatatgagagctggtggaaatgcactgttggtggaaattacaaaccctaggaaatagaacactactgaaatgccgagcgttccatagagatgatgccctttccaaccttttccttgtcctcacttccagactgaatccattgggggattgtcttctgtgggattctgtccaatttttctcatgtgagtggttggtaaaaataggaattaaagtatagaatttgtttctatttacaacttgatcaggaatactcatattttattaatcttggaactaacccctttctaagccccaaaaattatattaccaagtcatttgaaaagaaatcaaactagtctcaaaaaagattgtaaacaaatatttaaataaaccaattaaaaagttaatgattttaaatatgtttgtcttagaatggttgagtgaatgtgccccatagtcagaacacttatgttagatttattttaaaaaccagcattgtcaaatgaacagagatacattttaaagtttttttttttttaatcttttccagtctgtggtgcttattattgagtgtaggaccttatttatctatttattgttatttatggtcagagaatagggctcacagttgaaggagaacctgaattgaacatctcagtgtgaggcagaaataaaaaatgcttttgagattgtagctttcagcagtacatttcttcccctacaggtggaagggtgaaggtgtacactctggcaatgtggagaactgagagtctctgacatagagcatgctacatatcacactacacaaacatagccaaaccccagacttgtcagcctaggaacttctgtagaactcttttatgtcaccaaacttcaaaatatgtttctgccggaggcctgggcatttaggcagtttttcactgtgagctgtatctctttggagcattaaaataatatattagctatcattgtgtctctgttcgagagagccccgtgaaaattagtgtgtactgactgggctaaatcaggaaatctgaatagtgatttctgtgttttgtatcactgaaggcagtaggccctggctcctcactctttgttttagacataaggctgggggttaacatcataccagtaacccccatatctctggcatatagacacctaaaactgaataattgttattactatttaacccaggctttatcagccttagcactagtcactctttgggctggatagtttctggttaagtctttgtcatccgcagaggggacacagggaggaggttgtcttgcgcactgtagggtgttcagcaatacttctgatgtctgcccactaggtgccagtaaccactcccccaagttgagacaacccaaaattgtcaaatgtctgctaggggtgggtgaggaattatcaccagccttgagaaccactgattaacctaacctaattagttatatagctgcctccttggggaaaatacattttggtgagtgatcaggtttataagtgtgagagaaacgtgacagctgcctagcttgactgaaggaagggagttgggatgatggtggtgatacttttgatgactcccttcaccccacagaggaccattctggcagcatatgattggaggtgctgttgctttttcaagggtccccatgactttgaccactccttctcccaccagcaggggcgtggtgtgtctatatgggtttacctctgcccttctataagtctagtatatcaaagagttacaagaagcacagtcattatttgaagaaagaattttaaaaggctagagcttgtgcatgggaaagagatctccaatttttggttttgttttagatactacttaaaaaatgtctttttgtattgaggtcctgtcatactcaaagattaatttaatcatctgtaattcttttaataggcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaggagaggtaagttcagaaaaatcataactcatttatgtaggcaaatacaatttgtaaaaaaagtgatatgggcatgtgcttaaatacttacatttaggttattatacacatcaggaatagatgcatatttgatttcacatttttagaaaagtatacttttataattacagatttattataaatgtgtatacttgagaataaatgagtagaagaacagtggaggtaagtcaaatatagtggaattagatgtgtagttaaattttatttttaacttgatttaaataattaggaatttttgaaaagctttttgcggaagagtatttccctgctttccctgtcatttgaacccaggataaccaaaatagctgtatagtaagttgcctgatatttgtattaaccaaacttaaggctaatgaaaaatgctatgatttctgattgaaatatgtatttaatcgcttgacccagtattcattattttgtaaaaaaaaataaaactggaaatttttgtgaggaatttttatttttattgttctataaggcttgaaaaggcacaggaagaaaacagaaatgttgctgtagaaaagcaaaatttagagcgcaaaatgatggatgaaatcaattatgcaaaggaggaggcttgtcggctgagagagctaagggagggagctgaatgtgaattgagtagacgtcagtatgcagaacaggaattggaacaggtatttacattaaaaaaaaaatcacttgtaaagatgttaacattgccactctgaggagccaggtcctgtttttcttcagtttcctacatttagttccactgtagttcctcagttgataaaagactcatttgtttatgttgttagcattgatcaaagttcatatagcaaaataacacagtagtaactgaaagatagttaccatcatgttcactcattcatgaaatcttaccttgccatcttcactgtcttgagtaaatttaaggtgtttgtttaacatctgtaatatgtttaagtttctgactataatgtagtaagatataaagtatatctaattttgaacttctctgcaaaggtaaaggatctctattaaacatccatttgaatcctgttaaatagttttagaacataatctgctaaaagttctgaagctcctttccaatacctgcttctcctgttcagttacttaagatagaatataggcatttaggcattgcacggagtcctttggagaaggtgaggtgctggcagaatttaattatagacagatgcattagtttcctgttcctgctgtaaaaagaaaaaaaaaagccacaaacttagtggtttaaataaacagaaatttatcatcgtaaagttctggaggtcagagtgagttgaggcgagcctgcaggactgtgttccctctgcaggctgtaggggaggacgtgtttccttgccttctccactggtaaaggccacccacatttctcagctcatgccccttcgtctgtcttgaaagcccatcattccagcctctacttctgtggtctcatctcctccttctgactttgatgctttctttactgataatgaaactgaagaacaaaatgaggattataaaacttgctcaaaattagaggtgactcagttataaagcaggggcaagaacttaggtgttctgcctccactttgttttatgcgctgttgctgccttcttaatagagtgctaaataagaaatgcaaattaagtgatgaatgacataaggtcaactcatgagaatacattactgtttccttcaagattgtcattttatgagaatatgtctgactgaacacagccatcttttttataactgttaaccactccttctctcacacccccagatgtctgttttttggagctcttccctctaaggactcttagatgtattttacagtcatgcctcattcaactaacaaaccatatcagcacagaatgtagcaaagaatcagggagttgacaaaaaaggcctagtcgaaatcatacggtatccgagaagtgggtactatgccctttgcactcctgtaagaactccctgcctttttccaccaagacatccaactctcggtttgttctggtatatttctgtctttctaaactttgtatataaaaaagagcgaatcagaaaacagtagtttggaattcttctacagagatataaactgatggtagtacttcacaggtgcctgcctcacagtgagggagaagagacaatataaaaaaagggcccaagaattgtggacattctaacttgaagctttgggagagagaccatgcacacctcagtagaccccgaagttaccaaaatgtgatgtattggtattattggtatgaataatctcattagatccttggtcaataaaaggcggtttaaaggaaggaaattggtattttaaaaagaacactgtctggcatgatcgtattaataagaaacacaattttctgagggcttactgtgtgccagaagtgtatgctacacacattgccagtggtttgctcataaattttaatcctcacaacacataggtattatcttcatttacaaatgagctgtgtagagaggctagataacttacttgccttgggttacacagctattaactggtaaaggcaaggttttgcgtgtcatattccaaagtctgtgtcttcttatactgctattaaaagctttgcttgtagaaataagtttaactgagaaatgatgtataatatgacataacccacaattccacgtagttcaaggaattactgtattttgtctggagaataatcaacataaatttagaagtcaggaaaatctggtatgttttttatatagtgttatttttcctagaacagagactttgggtgactaatagtactgctttatgttttgtgtgatttaagtagttttcacaaattaatttcttagaaaaagtctcaggaagcctttaatcagggcaagtgataatacccctattatacgtgagacaataagccttaggaacttactgaaggttacagagatgaaaaataatacagttgggtctagaaaagaagttttcagatgtttaggctgtttttgtgacatcatgtttttacttactgttgttttattccaaagatacaaaaatcatgtaaataattattacattttaaacagttatttattgtttgcaaaagctgtttattactcaattttttctgtgttcattcccctgtaaacaacaatgtgatttaaactaagggttgggatttagatcaaatgaaacattcatgagtaatagcagagaaaacagttaaatagttgccactattggaaggtcagactttccacaggtttgagtcattatttggcaatcaatctgaacattgttcagcttcaatttatgctaaaaatatgtaagtagtttttatgttaaatgtgtttcctttgagctcttttaggggaaatacatttatggaaatattaagaaaaatctatgattaaagagagtaacttgaatgaattttgttgagattctctgtataattccttggaagtgaaaattgtatagaaattttagctttaaaatcttctgagaagaagggcttgcggacttacattttgtggtgttatgcaggtctgcatgaacctgagcttaaattttatctccctgagagattagcagggacgccacacagcttacccaactgacttattaaacacagtattgtcccaagccattgcagttagttatgtaggcagatgttgctcgggatttgtttgcagtgagttagtgctcttccccttactttaatgtgtctttttgaactgtcacctagtgttgcattgtgaattttgtttttaattttggaatcttaaaatatatttttctacgtaattctttgttttcacactaactgacagctgttctatttctttatcagaagtttgtgtatagtactcttgttggtttattctggcacactataaagtttattcaaataagttgggtttgttcagatcaaacattcctttgctcttcagtgtccttagttagctttggggaaaattaatctgcggggtggtgctcgacacgcaggatgctccgtagtcgctcgtagctttgcctcaaggtcttgagtgtgagtgtatgtgcacaatttcataattacatcctgtgtctttatatatctttagtttgaaagctcttgctagtttttaagtaaatcattccaagaatgaattatctattccttttgtgtctttccttagtgaggctttccttatgatactttttcttagcacttatcacctaaccaccaagcatttttgttttttctctgcttattgtctggctccattaaagggcaggtggaagaaatactatgacatcgttatactgaagactatgcatagtttctcatgagaaaaatcaagtagactctcagaatctgttttctcaaaatctgtacatgctctgcagatgttcacttagctagtttctggtgtattcaaagcagtgaattatgtagcggaagtggtaaaacagacaataataggcagatatacttggaaacagtaagaaataactggccataaagaggatgtcatgaaaaactacagaaaaatacaatttttaaaaagtgagtatatagtgaaggagctacagtaggctcttctggaaacattaggaggaggagtagaacgtgtatccacccaattttggacatttctttatataatacttcataaatgaaatatgcattatgggaaaaatatgatcagttttaatttgtatatacccttgacttttttttccccctcagtgagtctggttttcataacatacaaaactaaatattgcaacttaagatataaataagccctctctaccctccttcacaactttgcttagtggatttaagatgcacttgaagctcagccttcattttttttttttttttgagacggagtctcgctctgttgtcagccttaattttaatgctagaaatctactgtatttagactttgcagtttaaaacgatgtttacaaagagcataattaaaatagcttttttttttttttagtttgggttctaaaaaatattttaatccttccttcctccctctctcctttcttgcctccttcctttccttcttctaggttcgcatggctctgaaaaaggccgaaaaagaatttgaactgagaagcagttggtctgttccagatgcacttcagaaatggcttcagttaacacatgaagtagaagtgcaatactacaatattaaaagacaaaacgctgaaatgcagctagctattgctaaagatgaggtactctcttgtatttcaaaatttactaaatttgtttcttaggctgcattcttagagggattactcagctgggatacacagatctgaataaaagttttattattacagattcttttttcaaactggaacttattgtgtaaatagactctagtaatcataagctttaaattaaaattactgcatttggagaagtgtatacttttcaaagtgaccttagtgatttaaacattattcttttttatcattatcataaaagttttatacagagcttttttcctctaggttgctgcttcatatctgattcaggttagtagttactggaaattaactttgacacttaaattgtgtggaatgagaataagtcttaatctgaattctagccaaaaaatttaaaagcttagttcactcactagcaccattgtagtataatatagctaatgttcttctgttacttttagtacaagattcgggtcttcctgaaccatagaaataagagaaaaattctccagaataaagttttgaattacatcgattggcttaggaaagcacgttttctccctcatctgttttcttttttggaatgcagggatatcttggctagtaattctctactggttttatgattgctaatatattcaaaaccaaaacaaactttattatgttatatatacaaaaatgtctgtatttttttcaaacctagccttatttagtccttttcggtttctaggcagaaaaaattaaaaagaagagaagcacagtctttgggactctgcacgttgcacacagctcctccctagatgaggtagaccacaaaattctggaagcaaagtaagaatgttgttttcacttttatttgatttatgtttattgtgttaaaatgagtaatttgtgaacaatttatatttatcatttatataattacataatttacattagttttaagagtgggttatttcttcttgaaattagttaattgccatggtctgttcatgtattgccttttttcagtgccatattaaagaccttttgatgcagtaagtaatttctttattggcttttccaggaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccggtaagtggcaatttcaacaaaaattgttggtacaggttttaaagtaattttctcctatgtccttttaggaatcatgtacttcgaaatctgtgagaaaaaattgggtttatccttcattttctctttctttttgttagtaatttaaatatttactatttgagaataccatatgcaatgcatatatcaatactttgtgtatatttatattatatatttatacacacactttaaagaaatctgaatgctttataaatttgattattaagtgtttatttgagcaactgttatatataacattatattgttgaatataagactttttttaaaacattgcttgtaattaaattgaaatgaggagtcatataaaaacataattgacagtaaagatagcacactataaatgccaaatcagtgtgggaatgaagtgctgagcattcagggaaaatatcctttcaaatggccgcttaatgtatagtaggaataaaaattaggggaagatcttggaaacagggatttgaatcctagctctaccactaactaactccaggtatgtacttgtattattttgctggttttacttctctggtttgacagcagacagttaatgcaaggagagtgaggcggcactcaactcttaaaagaggcaggaagagtggacagattgtaaatacagcaaaactagaagtgtgtgactgcattcatttcacttgctccacactgcaaggtcatgacggttgcaaagttatgtctagatctgggccagctctgcagttagaatattctcagtttgtatttgtttatttgaattatatgcacttaagcttgccaaatgcaacactgattcataagtacacgcttttgtttgaaaactatagcttttaaaagttgaatttcctccttaaaatccgtgtttaatatctgaattgtgcatgaaagtgcattatctagattaactagtttttttctttgctttttaaaaaacactttttgggttgggggcagaggtattggatatccatatgtccgttaaaaggaaacaattgtactaaatgtgaataattattctagttttaagtgattgtggaatacaggcaaatttaaacttttaaatcagaaaaaagtacaagagttgattttaaatttaatgttttagaaatgttgtgatcaggccaggcacggtggcctgtaatcccggcactttgggaggctgaggcaggcaggtcactaggtcaggagttcaagaccagcctggccaacatgatgaaatcctgtctctagtaaaaatacaaaaattagctgggcgtggtggtgtgcgcctgtaatctcagctactcgggaggctgaggcaggagaaacgcttgaaccctggaggcagaggctgcagtgagccgagattgtgccactgcactccagcctgagcgacagagcaagactcagtctcaaaaaagaaaaagaaagaaatgctgtgatcagatttattatctctaaaaaataactcatgtcaaagattacaatttgagagctctgcctccacccagtggcaccacagaggtactccactctgcttagttacaaaagcctaatttctggacctgataaatgggaaactctcggcaatagaagtctagggaaggacgaaggctcttcatttctataccctcctgagcagttaaaattttttttttaccatggatatgtgtaaattttacaagtttgaaataatgacaaggaaacatgcctgtagtatgttaagaacaaagtaaaaggttgtaacaatatacacagaataatattgtctatgtgtaattatatggaaagaaaaaacacagaaaatatcaatggttagctctgtgtagataggggaatgggtgttgttttcctattactttttaaaatgtcttttcctattcttaaatatctgctaaatgctttccttggtgagaatgtgataacaatttatttaaactttcctataaagccatccacacacacttaaagtgactgaaaataatatgcccacctaccaaaaagataaacaggttttaacatttttctttatctttttctctgaaataaactattacaaatacacttaaaccacattgcctacccttccccactgttttaaagttgtgacttatgctaaagcctgttgtacttttattacatacatatatatccataacattatatacaatggttgcgtgtttagaagtgtatataaatgttatcaaactaggtgatattttacaactctttttgctcaaaagttatgtttcaaaattttttcatgtttatgtagagatgaattaaagtcactgcttaatgagttaaccataacttatatgtttatttattgtatttaaaaatccatagtttatccgtttttctactttctactttcttggcccttacaaacaatgtgcaacaagcatctttacctgtatttccttgtgcataactttgagagtttctctgtgtggacacctagaaacggactgctgggtcattgggaaggcaccttttactagtcattgtcaagttgctctcaaaatagtttacatacccactgttttataagggtgcctgtgtgcctgtatcctcatcagtacttggaataacctgatttacttgttttgcaactcgaatgcgtatgaaatgatacctcacaattatgaaaatttttatttccttgatgactgttgaggttgagtaccatttcctttattggcatttgttgttcagatttcttcctgagttgcttgttcttgctgtggaatccctgcaagattccatactgatgtggaagtgttctttctattttctggttatttgagagttgcaaatatcttctaaactttggctttttgaatggcaaattgtgaatctgatttgtgttttttatgtctttttcaacagatgataggttgttgtttgctctccttagagtttttaagtttttctttaatccattagccctttaatccacctagaagttatttttgttcatagtgtgaagttggaatctaaatatatctcttgatatacgggtaaacagttgtctcagcttcattcctgttctatccttgctgacttataataccacttctctccatagatacataagtgctcccagctctcccattttgtttcactggccctattctgctttagtttctagagttttataaaaagttttgatatttgataagaccaagtcttcctttattgttcaaattcagaatttctacccttaactaatcttctgaattttaagatcagcttatgaaattccatgaaaggttccattgggtttaaaaaatttttttttgaatttgtgaatttatttgtggagaattattaatcaattccatttatcgagatcttttctatctttaagtaaaattgataatttattttctctgtgcaggtcttgctttttttaaaaaaagattaattttaggtaccttaataaatttttggtaggtatatatgttacctttcttataaaactgtatttcagattgcttgttgctgatgaggaaatgccgttggatttggtgtgctgaatacagaataccaaatacagaaacatatatttaagtattttatggtagtcttggatttttcatgttaatactagtagattttttcctctttattgcccaagctaagacctccagtaaaatattgaatgaaaatggtgactgcaggcaatagggattgccatttctgactttaaagagaatgctgccagaatttcaccaggaagtattttttttaatgtttttggtagattacttttaagttaaggaaagtcatttctatttctgtcttgctaagaatggttttttttggttaatcagtggatattaaattttaccaaattatttttctgcgtaatttgaagtgatcattcgttttttattctgctgaattttaatctgtttaaataaatcctttaagtgtcagtgaaactatatttgtcacaatgtacaatttttagaatgagttgcgtttggttcgttatttaggatttttgcatctttaatcacacattggattagccagtaatttttcttcctgacactatcttagattttggtatcaagattatattaacatcataaaataaatgaaagagtagtccccctctgcccatatatgtggttttgcttttcatggtttctagttacctgtggtcaactgtggtctgaaaatagtgagtagagtacaataaggtatttcgaggtgggggtggggggaaaccgcatttacataacttttattacagtatattattataattgttcttttttattatctgttattaatctcttgctgtgcttaatttataaattaaactttattataggtatgtatgcataggaaaaacatagtgtgtatagagtttgggactatccatggtttcaggcatccactggggtcttagaatctatctgccaaggataagggggaatactatactccttattctttcattccattcttttctacttttagagaggcagcaatataaagtagggttaagatgtggaattctggaacaagattgcttgggtttgattctttgttcaccttgtagtaattctattaccttttactcaggacactgagtgggaggcactctcctgagtttcagcttccttttctgtgaaatgtagcctaccttgtggagatatgtcaaaatttaaattaagtaatacctgtaaaacacttggaaccagcccctgggtgggctacaataatcacccattaaatggtatgattttattctgtaccttgaaatagtctaaggtatggattatttgttctttgaggattttaaatacattgcctatggattgaccttgatgtatatatgttttggcaaggaacagagttttaaactatagtattaatttaacttctttaatgattaaaagtgtagatttgtgaagttacatgtttctagaatattgtgttttatctgagttttaaaatttattggctttaagttgtttatactgttttatatgatgtaaaaaatctcagttacatctttaaatttttttgttcctaataattacttatctgtatcttcttttgtgtcctttatcaggctgacagtttgtctattttatttcactcttgtcgaaatcctgtttgttttgttaatattgtctgtttatttctgctcttttatttcctttcttggaatttacttttttacttattgttttaatatttatacacctcccacatgaattttaagtctttgttttctctcatattattttaaggctatgaattttctctttaagaaccaccttagccacctccacaagttttgatatattaatttgattatgatcatcaaatattaaaaggtttttaattactaatatgtcacttccttgaaatatgaattatctagaagcatatgttttaatttccaaatatgtatgtatgtttttttttttgttgtctgttgggttttaaaaacatctttgcctattgatttctacttgtgcgtgattagagaataggttaatatgactttttttgtatttcctgatacttgccttgtgacttagtatttattggtcatatattttaatggttctgtctatatctggaaattacattttcttaattgttagttacagggtactatacagtctgttaaatcaggtgttaggataaaatcttctgtatacgtatacatttttgtctgttcttctatgagttgcagagagatgtttgttaaaatctcccatggtggtcagtttctccttacaattctgcccatttctgttttatataatttgtactaagttatattggtgaatacaagttcaggtataataccttctttacagatttaactgttccttttatagttatgtggacactgctttatggctatgctttttgcctttaagtttatactacctgatattgaaatacctataatagctttcttttgattaatatttgcctagtgtatctttttcacgttcttcaaaatttttccattattagacactagatatatctctataagaaaatagcagtaactggttttattttgtatcctatttgagaatatgtttctggctaagttaaatttaatccaaatatatttactctccttgctgatctgtttgaatttatctctggaatcttgttttgtggtttctgtttttcacaccttttatcttctctcattctcttgaacaattcaggatcttcagaggctttaattttagccactgctctcgcatcttaaattatgtgttaacgttgtctggtattttgttttgtttcaaatgtctctcaaaacagtcactgtttttgttgtttctttcagtcataatttagatatacttatgtgtttatttctctgtttatcattgcattttgcttgttattcatttcttttttttctttcttaaaaatatgttcttcagtaaaagctacttcagtgagcaactgggaatgataaattctcttagtctttgcctgaaaatactttattttcagtctcacttgaaagtaataatgtaactagatataaaattccagattaacaattagttttcaataattatttctcagttattttgaggttgtcattgttgctgttgagaagtttgtagtcagtcaacttggttcgggttctttttagataagctgccatttctctgattgcttgaaaaatattctcattgtctttgttgtcatatggtttccctataatatgattgggtgtggatttaaacagtttttttttttttttgctaatatttggtgtgtttcttgaatctgaaggatgtgtcttttatcagttctgaaaaaaaaacactagccattatctctttgaatattgttttttcttcatgccttctggaatattagttatgtagaaatattagtgctaatattagtttattagttatatattgcatcttatcttccacatttcttaacctttctttttatagtcttttgatctatctatgctgcatttagagacatttcctcagatctgccttctagcttactaattatttcttcagttctagttttaactcatcctttgaatttttaactctaattactgtttttcatttctattagttatctttgattcttcatcaactctatgttttaatgctttcttttctcatattttcaatttattgttatatagtttcatgatgtaaaaaaatccctattttttagttttcatttgataatcctcttatttgatattcttggtcaattgttacagcagtttcttgtgtttgcatagcggattgctttctctctcctgttttataatgttttacttagctattgttaaggagattggcattattccaccctggaaaatactgtgtgagtggtaaagtgcccctcaaaatgcctttctttgcttctggcagtagtttcaaggatatcaccaagttgggagcagttttttatattaactctttggaatacagtttcatagaccctctggtagtatgaacttgcactccaatctaatatgagatgtaggctcagagtattgagtttttcacagaagccctttaaaatggctatatttagagatcttgaaataaaataaatttgcttgctaattggttagaattttaccctttcactgaggaatgtagcccttctaggtccaggcttttatccagagcactgactcattattccaatacctaacgtgggcccaaagcctaaccttacaagtgaagttgcccatgctgatgatgggttgtaagggccagtaagagagagaatgtccaggaagtgactagtgaagtggaggtggaagattcagtcatgtcccttaatagtgttcgcttcagcaggaatgcatttgtataaaaggttgtagaagtaagggtgtgcagacagtactggggagcgaagccacccactttttgttctgatgctatagcatctgaaccatgcaggagcgaacagcttcagcttgagaaggttgttattaggtgagttatgttcgttcagttaagagtaagaaatggaatgcccatttagtgaggatattgaagatgtaggggaagtttgtttacccacctgcatgagtctcaactgagactggtagcagaaatagttggatctaagacttctgtttagttccacagtagtgggtgttcaagaaacaagttttgctctgaactctgcctaaccagctgtgagactgtgcatacagtagttaagtgatttccttgatttaaaactgattgagttcaaagaacttgtgatatttcaagagataccattgcagcctactttattctgttgtcctttctttatgttaacagtcataaaaaatttgtgatacaatacaggtttttaaatttaaagatttgttgtcttaggtaaatttttaagcctttttggttagtacatttagattttctgttaaagcctcatgtttatgttcacttctgtttgttttttaaacctgttttttttttgtttctatttcttaactttcctagtgtaggtagtagagaatggtaataactgtacagtaacttcagtaaagggagatgaaacagtgacatattagtgacatcagttctcttgtgtgtatgtatttgtggtgactgtaaagggaaccctggacttcatgagcatgtttctttcttggtgtttttcagggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttacttctctgctgaaaagcaatggtattggcagtgaataatctacagggcatgttggggctgggttgggggtaaggtgtgaggagggggcgggaggagtggtgcatgtttccattttctgttgctacatatcaaggtaccacagactttgcagcctcagacatcacccattttttagctcttagttctgtacatcagaattccaagcctggtgtgactggggtttttgctcagggccttacaaggctaaaatcatggtgttggccaggctgcattctcatctggagcttgcagttctcaaagttcatgtggttgtggcgaacttcatttcctgtggctccaggacggaggtccccgtgtctgtgctttctgtcagctgcatggcggctgctctcaggtcctggaggctgtccactgttccttgccacaggatctcccatcttcaaagccagcaatagagaatttctctgctgtagattcctcctttgctttgagtctccaacttccgtctctctgatctctagactaaaatgtaaaaggctcccctggataataataatctctctatattaacatcaactagtttggggccttaattttatcttcagaatccctttacagcagcatctatttttatgtttgattggaaaactggaagaaggtgtgtgtacaccaggggctgggaatttgggagccatcttagaattctgcctaccacagacatgtaggtagatattttgagatgtaactgcttagaggtcactggacacggttgactcagatctcagagcataaacttgtcatgaacaattttatatgtaaaatggaaaagcatgagcttgaatatacttgaacacgaagaaatatcggatatgactgacttaaaaatatttgttgtcacttaatgatttattctgttatgtgctggtacttgctaacacataagcagtatcatatgccaaaggtttaagaaaatgtcaggaacttagaaaagtaaattagtaacttaacaaaatgggcatagcagcagcgtatttcagtccaacttaatgacatcagtgctccatgaaactcttaatttgaggagctctgttcttaaaccacattactctttaaaagcagtatggtattgagtggtagtttcaggtattgccactgagtagctatgtgtccccaaaggctttaccctcttctatgagaagcaaaagggagtggtctacactctttatcatgtgactctttaggtgacattatcatcaataatcatttttcattcataattatctagtagtaaaagaaaattttatgatttgcaagtgatcagtgcagcatattcctaaggagataatgcaggctttatatcttcattgcagttggagaatctgatgcgactttgcttggttaacactttatgactagcttttcgtctgtctttgcagtatgatcatagtcaccagcaagatgcctttactgacagaactggtcttgtgtggtttctggaaatcagaaggaaaactcgagagctgcactgtctaataaaacttcctgcattgatggaacgttcagttctcatttcaatagcaatgtcaaagtttcatagctagctctcataaataagagaatgatttgaatttggaaaacttttcttcctcttcattttcagtctctcctctattgaaccaccagaatccttacaaaataataatgttgaatatttactgattttttttttttatgagacggagtctcgctctgttggaatgttctatgccttatgcacatatatgctcatttaaacctcattttgagttttcttacatgtgaattcaactccatgtcactctggggaaaaaaagaaatagaaaaaaatagcataagtggtacagatagttcaacattccaaagagtatgtactctgcaagaaaataaaatttgaacttgtattatgtcttattatccaagtcagattagttatgcagaagaagcaacactttggattattgtcattacgcaattcaaatgttagaactagaaggtaacattagtgattaatcaaattttcttactttaacagataggaaaattgagacctcaagagatcaagtgatttactgaggcttttacaactgattaatggtaggaccatcttaggaacccaagtctcctgacttaaatcagtattcttttcacacattgtttagagtttagaggctagtttttaaaatacttttagcctagcttagaatttcacacacaatgcagcaaagccacataacagaagagaaaatattcataaaattataactgaatcagcttctgactttggaagctgaacagcttcagggaacagtgatatattctgttcaattaatggacagccattccaaaaaaggctttgcagaaatgcctctatcaatgattgatttctgagtctgatcatttcctcatatctgaactgcttcttgctttctgttagcactacccattattgaattataaaagcatttgagaattatgcagcacacgtaggtgtattatgtgaaaccattaggtcgttatttaggggattttgtacctttcgagagcttgtagtgcagtaaagacgatcttcatagacatatgtgagtaaagtacatagaaatgactaaattcagcaatctgaatatgtatctaaaatgtggtattaacatagaatattcatcaaaattaagtgccagacctccagtaaatgtgtacatcagtaacatgaaaatgatattaatcataggccatctaaggtaagagatcatttagtttattcattttgtaaatatgaatttagtccttgctatgagaggtgcatttgcctataacatgagctgccaagacaagtgagacaaggacctggcctagttccagctgctgggttataatcatatgtgctcttgcctttctgttctgccttcagctctgttcccttctcacactgtatttcttttgccactttttaccttgactctccctttcatttctcaatcatttcctttcatggagtgaacagtattcaccttgggctcggtgcgtgcaaaagtgaatgagactaagtagtaaagctctcaaaaaaaaaaagtgagtaagatgtgatccctgttctttaatatctcactctgttcattcattcattcacccacccttccattcattcatccaacacatttttatgaagtacctaccgtaaacttgccactcttctagtgcagagaagacagaagttaataaggctccttgtccttatttatttctttttttctgggattctgcctataaacaagttaatataaaatatcattttaggttttggtaagttttggggttgcaaacaaagacaggtaaaaggaaagagaatgctgtttcagacaaggtggttagggcaggcagcagtaacctgcgtaccctggagaagtaagccacgtggagatggagagtagataacaccaagcagagggaacagcaaatgcagggccctgaggggtctcgaggttggcatgttacaggaacacaagggagtgtgcagttggagacagccagggaccacatgtacacggcctggtacgctttgacaaggactttggatcttactctgagtatgagagaaagcactgggaagtttcaagtaagtgaatgatatgttttgcttgagtttttaaaaatcactttaatggctgtgtagagaagtagctgggagggaagaatgagaatgaaagcaggaagaccaattaggaagccgttgcaatcatttagttgagttcctggctgttgcagaggaaggatgggagcaggggacataataaggaatggtggatttgagagagatttgaaggaatgggtgatggcatttactatatgttggttttggggttacaaaatttatttttccactgtggagaaaaggaggaaaacattcaaaagtaagaatgctgtgagaatttactgaatgtctgttttttttaaaaatagcatcatatgtttgcccctcccctccactgccatactctgatgtgcctcgattccctgccccccttttaaatttggtagaacttacattttagtgtaattcctttcatgtatatttcttccttcctaacaaagctatagttcatcaagttaatgacaaagggagaggcagtgactaaaattcatcttttaaaatagcgttaactctgatttagaaagaaaaatagtattgaaacaaaacataaaagtagctgagatgatagctgaatcacccgtaaaatttaacattttaatttatttgacaaaaaggaggtgtaccttatattgtctgtagtttgtaagatttctttattatggtttatgttaaaaatccagcattgagttttgagaagccatattatttaaagaagtaatgttctaattttgctgaaatgtatatagaatcatatcatttccctcttttaaatttcaaaaagcaatgaaagttgttttagttagaatgtctgctagtactcttaagaacatactgatttaaaatttgtacctttgtttgtgtttcattcagggaagtgccagacacagcttcagaatgtgactccttaaattcttccattggaaggaaacagtctcctcctttaagcctcgagatataccaaacattatctccgcgaaagatatcaagagatgaggtgtccctagaggattcctcccgaggggattcgcctgtaactgtggatgtgtcttggggttctcccgactgtgtaggtctgacagaaactaagagtatgatcttcagtcctgcaagcaaagtgtacaatggcattttggagaaatcctgtagcatgaaccagctttccagtggcatcccggtgcctaaacctcgccacacatcatgttcctcagctggcaacgacagtaaaccagttcaggaagccccaagtgttgccagaataagcagcatcccacatgacctttgtcataatggagagaaaagcaaaaagccatcaaaaatcaaaagcctttttaagaagaaatctaagtgaactggctgacttgatggaatcatgttcaagtggcatctgtaaactattatcccccaccctccactccccaccttttttttggtttaattttaggaatgtaactccattggggctttccaggccggatgccatagtggaacatccagaagggcaactgtctactgtctgcttatttaagtgactatatataatcaattcatcaagccagttattactgaaaaatcattgaaatgagacagtttacagtcatttctgcctatttatttctgctttgttctcagtgatgtatatgcaacattttgttgaaagccacgatggacttacaagctttaatggactcgtaagccagcatgggcttgcaaaaatttcttgtttaccagagcatcttcttatctttccacagagctatttacatcctggactatataacttaaaagaagtaaaacgtaattgcactactgttttccagactggaaaaaaaaaaaatctctgcaagtgaaactgtatagagtttataaaatgactatggataggggactgttttcacttttagatcaaaatgggtttttaagtagaacctagggtttctaattgacttgatttctggaaatgaaaacccgcgcttttattatgggaagcttcttgaactgcatttactattgtgaagtttcaagtcccgctgtaaagatcatgttgttttgttttccccagggctttcactgtgatttactgcattgcaggctgtatgataaaacacacataatttaaagagagaaggctcttgattccttatgcaagtggaagagttgaaacttgattgaaggacttaaaacattcacaaccttaagccgaggtggggggatatggggattcaggcaattgtttacacactttgaataactgcaaaggatttacggtttgtgaaaaatgtgtactgtggaaaagataataaattgaagacattattgtgtgggattgtgctgatttttgttgataacacaaaaaacactatgttttctggagagctgtgtaagctgtcttgttgcttagttgcaatataagaaatagtgatgttttggacgtaagttgtcaacaaatttctattttatattgttatatttttatgtagtttgaaatgtaaaaatgttctaatatcaagattaacaaatataaatttatggtgcatttagattgcgttgtattaatttataaagtatggtgttcattaaattggtgggttgtataagggtagcttttgttgttaaaaaaacagtagagagttaagttccatatagcaacaaagtatgttaacatctagggagtttctgcttataccactttaaaaatatgcaatcataagtgatttggttactgcaatgcagatggatgtttggatgaacaactgatacattttagttagaatgctttttcagcattatggctaaaatatatgtctaacccagtgctatttaggtgaaaatgctaattgataaaccagaagtttcttttgagatttgctttaaagaaatgctttagtaagaatatgaacaatttcctgatgtctcctataaattgtgattgtttattctattactattgttaaaaacttgaatggtatttatattggctgatatttatatacttaatagattgagttctgtaagggcaaaaacggattgaaatgaacatagcgttttgcactaatgataagataacctgagaggtagggttgaggaacacagggttgaaagctgttggagaggggaaaagttgtgcataaagaactgaaaagggttctggagtgttcattcagagtgaagggaaaactttatccttctatttcttataaccagacaggaggagttcttccctttgaaaattgcaaaaggaatgagaactttgcagttggatgaatagagaagggaaaagttgctggagcacggagtgaagatgggaggagctgttagcaaggcccactgctgctcctgggtgagaagggagctctggagcaggaccagctgggggccggcactgctgcttagagtggaggaggctggccaaagagactgtgggctgttttcagtcagggagcatgtgcattgtttgtgctcaatttcagacactcatttataaacaaattcaaccaagggatatttactgctttatgttgcttatgataattattttgcattaatacagtatacacatttgtaaattcaacaggaaattattgagttttggaaagctacagtaatttctgtattacatcatttatatgtgaaaagttggacatttctgtaagtttttaaaattatccatttgttactttaacattttaaaattatggtgttttcctgattttaaaagcaatattttccttactgt

SEQ ID NO: 218 - DNA, 164691 bp, Homo sapiens; identical to SEQ ID NO: 217

SEQ ID NO: 219 - DNA, 164691 bp, Homo sapiens; identical to SEQ ID NO: 217

SEQ ID NO: 220 - DNA, 69149 bp, Homo sapiens
aagagcaaaaagcgaaggcgcaatctggacactgggagattcggagcgcagggagtttgagagaaacttttattttgaagagaccaaggttgagggggggcttatttcctgacagctatttacttagagcaaatgattagttttagaaggatggactataacattgaatcaattacaaaacgcggtttttgagcccattactgttggagctacagggagagaaacagaggaggagactgcaagagatcattggaggccgtgggcacgctctttactccatgtgtgggacattcattgcggaataacatcggaggagaaggtaagggaaaagaaaaaatgattttttgtttataagggaagtccctgatcagactctgggactggagaaagcgaagtaacttcaaactttgggcgacaagaaaaaaaaaaaggagctggattccagttgtgtgtccagagagtaatttttttttttcggaataaacttcacttggggacgggtgggagataaccatagagttagaaagtctaggtattttttttaaacacacattttccagacctatttttaaaaacaatgtttttctaacaaccctatggcctcccaaagaaattgtttaggcttacatttttgaggtttcttttgggagtgggggtggtgttcgtgaatactgggccgaacaccaaggaactgggggtggaggcagaggtgtttgccctcttcttggcagtgggtcctggaaggcgacaggttttaaatgagtgttttcattcctcgcctgcggtttggcgggacagcgctgcagcccatggtgtggagcgcggctgggggaccagggggaggtggggagaggggagcgtggaggggagcgtggaggggggcgcgcgaaggggttgcggggcgcaggaggcgggctgggctcggctggagaccggacctcggtgttggcctacagcacagggagccggccgaatgcgcgtgattactggacggcgctgctctgggagagagtcggggccagatttggcgcggcggtgaggcggctgcgggacaagcagaggcgcgcgggcgtgggcaagggtttggggcgctctggagcggtttgttgggtcagtgaggtgccagggagagcgggtgcctgccgggcagtgtgctcgggttgcacgccctagcgcgggggcgacagcggcggcgcgggcgggcggtctggaataatgacaaacacatttggccctgagtgaagaagtcgtcgtcgcctcgcattccagcaactgggatttgaggaatttcgaaccgcacaccaaggggccctcattgtgctccgtggcccccgcccccgcctgtcttcccgcgccccctcctcggtggaatcatttctgcattgcccgggggctctgctttcgctcagttctggccgcaggcaggaagagaggaaaggtctccaggaaggtgccgaacttcttgtgaggaagttagggacgacttggaactggggaaacttgtttgcaggtaagacagaaaggtgggaggtaaaccatattctccctccgggcacccgagccctggacaccccctacccggcacccttctccgcgcgggggtgcgtggcacttgccgtctgagctcgcccagcgctgctcggtcctctctagttggccttttttccattcctctccctgccggcttcagagccgtctgtgcgtacttctccttcctctgctgtctacccccatggaaaccagatttacacacgaaattaactccgcccggctgcgcccagggagcgggcggcgtccatttggcattgaatatgtgggatcagctgttctattccgggagggtgtcggccaggtcggagcgacgagtgtggcccaacccgagtacgttgccagagggagccaggagcctgggccgggccaggtgtgcgagagctgccgatggcctggcctcgcgtcttggtcgggaaggacttgctggcctggcaggctgtgcgttgtgcatccctcccgcagccagagcgccggtcccgcacttcgctccccgaattgtgctaagacctcaggatgtgcgcaaggagtgcctggaagaacttgccactcactccatcttcctgggtgggaggcaagcatggatggggcccatatcaggtccctaccgccccgcgtccgaaaagccgcgggctgggcggtgtgggaaatggctttttggctccgaggccaaattgctcaatgttttggaccgactcgcctcgccgcggtcgctcctgacaagaactagacagatttttggagcagggagcatccagggcaaacgcacgacagtcctccgcagtgcatctcaccggacaaacatccccggagccacaggaggggaggaaggggctctccgggcgtgcgcacctccccagccgccgcgctgtcccatccccgacccctaatctggtcaacctggaccccggcactgctgaattgcatcccctcttctccctttctcctcggcctcctcctttccacaaccctcaagatgaggaggccctgcctcgactccccgacaggcgcaaggccgaccaggctcgctttgacgccctggtcaggccctgcttcggagcttgcagttttgggttgacccaagtgcagctggacctcgttcacaagagtgaggggaagccaagaatgaacccgtcgttagcccccggtgccctggctcttgtttaaatccttagatcgagaaggacttgaaggagatcccaggctcccagctctgcgcccctgggccagtttcctctcgggacgcggactgaggagggatgcagggggaggggcattgggccgggctttccagctgcaaacacgtctggcgccgaggcgggcccattttgtgcctcctggggacggaccgtgggcggcgcgcagcggcgggacgcgttttggggacgtggtggccagcgccttcctgcagaccccacagggaagtactccctttgacctccggggagctgcgaccaggttatacgttgctggtggaaaagtgacaattctaggaaaagagctaaaagccggatcggtgaccgaaaggtgtgggtctcagggttccccgggtctaactcgccgggtccaaccgcagcatcagccttggggcggcagataatctttcggtctcgcctggggcgcaagatgcaggatcgggggcaaatggcttctcccaacttccccctaattcgggttctgccagatggttgtcgtttgctgaagtggctcggcggcatttccttttgttttaaactgatcaatgagcgaacctgggatgggctgaaaaagtagattgtaggagggaataatgggaaacccgacttggggcgcctccttccctgcctcctactgcagtttctcggcccccgcgaaaggggagcgacaagcgcgggtgggcgcggactcttgagggggcagaggcggctatggcgcgtgtcgggcaaggtggcaccagaaggcacttttgtgtgtgtgtgtgacaagagtctcgctctgtcgcccaggctgaagtgcagtggtgcgatctcggctcactgcaacctctgcctcccaggttcaagcgattctcctgcctcagcctcccgagtaactgggattacaggtgcccgccaccacgccaggctaatttttgtatttttagtagagacggggtttcaccatattggccatgctggtctcgaactcctgacctcaggtgatccgcccacctcggcctcccaaagtgctgggatttacaggcgtaagccaccgcgcccggccaggaacggttcttaaatgccgagagggcgcatgctagctctcctcagcattcccggtgagccgctacccacggccgtgcggctctcgtgcccataggaggcgctggcgagctcctgtaaccctaaacccctcggcccctttccccccacccgcccggattctcttcccgctctcccccctctctccacacccgcccggccccctctcgggtctcagttgaaaacaatgcaaacgcagagcgtcgtgcctggggcgcagcggcctctgcagctctgaggttcagagcgcggcgcgcaggggcgcaggggcgcaggtccccggagcggctgggcatcgccgccaaccccgggacaaccaagccgccgaggacttggtggaggtgggagggagagcggaccgcgcagtgttcctctgggtcccggggtcagaagccggacagtggcgggggctggacagtccgagcgcagagcctcccgggcgaagtctgcgcgcagcactcccggctgcgctgtcggggaccaggagcctgggctgcgggcgagctagctggcgagccgggtaagattcgcggggctgtcgcgccctctagtgggctccggggacgcatcccgctttccccagccccgggcggtcggcgccgctatctcagtggagcgcagcgctggaaccccgggggcccggagcggaggctaatctgggtcacctttcccctcctccgggcagccagtggactcctcgcaggctctgtgtgggcccgggaggcgccgggtggacgagagggggccgaggtctctgggtttggattgagaatgggacgtccttgtaattcaatgtgggagaagcaggggagtgtggaggaggacgggtcccgtgcgttcttggggggcaggcgccgtcttctgcgttccagcccctcgccagctcccttgccccgcgggcggcctgttgctgtttgtttgttttacgaccctgcgttattgtgcaacggtaacagtcgtttccaatcagctgcgcggccgtcgcggccctcgccaggctggtttatgggggcggcggtggcgcgcggacagataggacagcgcggcccgggaacggcgtcgaggtccaggcggtccccctgccccgagggggcggaaatgctgaggtggcgagagcgtgggttgcacagaaccctagtagcgagtccggctgagcctctgcggcctagcccagcagcgtcgtcttcccggctccgaagacgtcttcccgaagccccgctgccccggcgcaccagctcccggtgatggggatgatgatggggatgatggggagatgtccccgaattctcctggggtcccgaggagatttagccattttcaacagcagttttcctatttctgcttaaaccccgcgggctttcaactgaggtcaccacgaaagctaaaagtacaacctaaggaaggaagagactggaaattaacatttggggtagtggagctcagaattcctcgcagcggcgtctgtgtcgcaacccgtggacgcacgtccttggaccaacactgccatctgctggccactcgtaagaactactgcgacccgctgtgagaatgggcttcgcggagaccattaggaaggtgctttattttttattttttatttattttttgctcagtaggaccgtaataggtgactgattttcttttgctgtgaggctacaagaattgctggaagacaacatttttatttcgtggaaatttgtgttgtgtttctccttggttgttaatgctttgcatttacatagtgaacatcttattatcagagctggcctgtgaggagggtagtgggggggcattgatgttcccgtttctgagtgaggagacctatgtcggggccttggtgacctcaagccgaatgctcaaactgctactgctactcctaaggttgtgccattaggagtcacacccgtttggtgatattcaaaaggatatgtcattttattctcccgtggttaaatatatggtgagaggagagcaggcatgtttatgagcccagattgtcccataaaaggctcctgtttaaaaacactccagccccctcccattactggaatgtctgatggagctccgggagatcaaaacaacaaaacaggctctggtagggtgcagaggtcctggtaaacacaccctctgctggaaaacagggagaagtttccaccagtgtagacctgcacttggtttgcctgggctgaagttaggagactgcgtagaaaaaggaaaatgtgtaattttcacagttagaattaacttaggagagctgaaattaactgagcctcggaaatctgaatcttgaagtcaccagtggcttttggggctgtgagagagtctcctgtggtctttaatcatgtgagggtggggtgaaattcaatattcagtggttctgcaatgggatgcactgtgcaattggtgattgagaagccaactctctggctttaggagaagaatgtcttgctgttagtccttctggaaatagagccttgcattgcctactgtctgtttacactacctttgcacattgcctttggttatagagtcatgtccaatggctctttacttctgtttgcagggcaggagatggcaccctgttaaagagaaaggatagtagctgcaaagtcatttgtttctctgtttctgtgactgtatatattggctcatctttgaatggtctttatagccacaccaggctggaggtaacagggtcatgggagtggactgctggtgtgggctgaatcagagttcagatccatgtctccaggaggtaggaggtgcagggcaagtcatgtggcttctggggcatccctcactttcttagttaaggagaagttgaaggagccgatctaaaatatcttgggagtctgcagaaaaagtcgtgaaaatcaaagcactttcaattaaactatataatttagtccttacaagaatgccacagggcaagcaaccagtcaggccttggtagtcgtgcttcctagaagaaaagactgaggttcagagagttggatagagtatcagatttgggatcagtggctagtccaatgtgatttccatcctttcttctgagagaaagcataagaaggccaagaggatggtggaaaagcacaagtcacctgcctgagagtcaacagggcggggggtctctttctcagtttgttcctctaagttatggcaaatgttttttgagctgtgattattgagaatgggggctgaagttcaacatgtagttggcatgagggaagtaattatgattgaagaaaagatttgggtgaaatctagtgttcttccctgcaaagggggttgttctcacggattcttatggtgccatgtttctcagaatttgtagtttcagttacttatatttgcacacctgactttagatgagctccagaatagcagttactaattaaggatgagcatttagagtagataaaagtggcaggaacagcaagactcactcccagagagcctcactacaggtctaataggtgaggaaattccccatgtttcccatttttcttcattacctccctgtggggcaagcactgccattattcatgagtaaactgtctgagttatagataagtaatgacatgaaacttcacaaacacgctgagcacagtggctcacgcctgtaatcccagcactttgggaagccgacgtgggtgaatcacgaggtcaggagttcgagatcagcctgaccaacatggtgaaaccctgtctgtactaaaaatacaagaaattagctggccatgatggtgggcacctgtaataccagctactcgggaggctgagacaggagaatcgcttgaacttgggaggcagaggttgcaatgagctgagatcatgccactgcactccagcccaggcggcagtgcaagactccatctaaaaaaagaaaaagaaagaaagaaaaaagaaaaaaagaaagttcacaaacaggcctgatttctacccagggaaccactgttatcagagattggggtttggaatcttaagcaacaaacacatgtttattctcttccttcctgatggcttgctcagaggacctgtttccattgcccactttttttttgagacagaatcttgctctgtcacccaggctggagtgcagtggcgagatcctggctcactgcaacctctgcctactgggttgaagccattctcctgcctcagcctcccgagtagctgggattataggtacctgccgccatgcctggctaattttttgtatttttagtagagatggggtttcatcatgtcggccaggatggtcttgaactcctgacctcaagtgatctgcccacctcagccttccaaagtgttgggattacagatgtgagccaccacgcccggcctcattggccactttatatgtcagtaaataatctttcctggcagagggtccactgtatctggaggcactgaaggaaatctgggagtgtctggccagggcaaagcactgcttagagcttgcacaggaaaagcagtgagcccttcttttaagctggagaaagctttaaagatgcatctttggcaagtcttgccaaagaaatatgggttctaaatgtgataaaaccaaagacatcaagctggctctggaggccttgtttgaagtttgctgagtggattgtcagtgggaggctgatatttatatgtacaaacacacaagcattactgctaattgtggtaaatcaggctggccagcctggctctggggcccactgtgcctgccaccgcagcagtgtggaagccttgcatcccaggcacatgtcaggatcctcggaggccatcagccagccagcattgtgtgaattgcatttgggttcacagcactgtaattgtgtttctcctgctgtggtgagcaaaggaggaaaatggaaggaggaggtataatttgccctaggaaatagtcaggcaagtaggtggcacacaggggtgggatatggctaaaacactgaccttcccttgagagagaccatatggtgaagtggagagggcatggcgtttgtatcacacgaccttgtgttcaaatcctggctctgtcactggctgtgtgactttgggtcatttgcaaaacctctctgagcctcaactgccacttcttaaaatcagctctaagtaatcacagggttattcttcacaaacacagcatgcacatgcaaactttggcttagtaaataatggtttctccttctcttactttgttttctacataccccactccccttcctgtgaggagccttccacctttttctctgtgttctcttcctctcccattttcctggtagcattcaataaaacagaaatctgatttctgcaaagtaggccaccttacggtagaaatacatgattaggccccaccaaaaactttgattaggctattatcttctggatcctggatcccctccaaccaaaccaaacccaactagggctaaacacagcaatatatgaatacattgaatttctctctcactctttcttttttttaaaccagtttactcaggaatcacatgcacacatattttagcttccaaagccaatgatggaacaaattgtgtcccattaggctcactccattgtatgagttagcatcagaggagttcataccagagtgacttcatcttgaatagggcctaggtaagaagaggatgagacctgctgggctgcattcccaggaggttacacatttgtagtcacaggagagaaaggagttggtataggagttgatagatacaggtcataaagaccccagtgataaaacaggttgcaggccaggtttggtggctcattcctgtaatcatagtactttgggaggccaaggcaggaagattgcttgagcccaggatttcaagatgagcctggacaacatagtgagaccttgtctctacaaacaataattttaaaaacatgagctgggcatgatggtgcaggcctatagtcccagctactggtctgaggggcagttgggtggcaggctgagatgggaggatggaggctgcggtgagctgagatcaggccactgcactccagcctgggtgatggaataagaccctgtctcaaaaatagataaataaataaataaataagccagcaaaaccagaatgcagtgaagaagctggccaaaacccaccaaaacgaagatggtgatgaaagtgacctctggtcatccctactgcttattacacactaattataatgcattagcatgttaaaagacactcccaccagtgccatggcagtttacaaatgccatagcaatgaccagagatactctatatggtctaaaaaggggaggaaccctcagtcctgggaattacctgtccctttcagggaaaactcatgaatcttctaccgcttgttgagcgtataatcaagaaataactataggtatactcactcaagcagccatgcagttgctgtgcccatggagtagccactcttttattcttttactttcttaatatatttgctgtcattttactcttttggcttgctcttgaattccttcctgcatgaagccaagaacctttgtgacctcccaggctgaaccccaattttgagttccaccctatgacatcttttctggtgaccaatgaagggacaatggtaacctcccgttgactttaaattaaaactgattggcactgtttgggcttcaccggtgggtgagtctctccttgcccagattcaacttgctaacatttttttctcttcaattttggctcctttgtccttcctaatgttcttcattttggacagatgggaaagtggctgtgaggcctctggcttagcagcctgatagcagcctcctgttgtctgggtgccccagatgggagcacgcctggctggccacatcttttgcaacccaccttgtcatcccttctctgggaccttttctctttagtttcttttttaaaaaaaattttaaattatttatttatttatttatttttagagatagcatctcgctgtgttgcccaggctggagtgcagtggcataatcatggctcactgaagcctggacctcactggctcaagtgatccttccacctcagcctcctgagtagctgggactataggcatgcaccaccacgcctggctaaattttgtattttttttgtagagacggggttttgccatgctgcctagactggtcttgaactcctgggctcaaatgatctgcctgcctcagcttcccaaggtactgggattataggtgtgagccactgcacctggcctctctttagtttttaatgactggctgtttgacttctctgctcttcaggctgaaattcttatttcatgtttgtagtctttgccttggctatttggcaactgtttaaggcaagacacttggttttgagagttctcccgttgtgttgaccctgggacaccagggtcattgttctgtagctccaattatgttaggtctcatgcttttgggtttcactattggccaccccccagatgctctggggtttttggcatttggtgtggggacccttgttagctgatactctgggcttttcggcatttggatgctccagggtgtttggcactgacattcccctctagcattgtgggttagagtcccacccaggggaaatcttggttttgccttttcttgttttctactctaaagttatcattttctataaaaacattttcttttcttattgtcactttgtttaatgctttgctccaggaggtgggaatttgcaggggaaaataattgggctctccctatacttagaaaaacttctgtgtctagtagagatccttgttagacaaagggacagtggtgagtcccagagaactcgtcactagggtgccttttaggcaattggagcaaattcaaattagcaaactaagtttggccatttggataagtcccagttttgtcagggaaataatttgggtccagctatcttttataaaatagtgcgtttgcgttcctacattatggctagagctcaaagataaaagctattggatctttgtttatgtgtgtgtataaatgtctagatgtgtttatgtgtatgtacatttattatgttatatattgtatctacagggtaccaaattggcttataaataaaagagtgctcataaaaagagtaaataagtccaagcatttctcaagctcatgtaacttaagtttactaaaatttagagttactaaaaattcatatataactctgtataaatgtgccaaagaagatatgctcttagtgaaaataaattctttttggccaattcagatgtcatttatatgtggggtttaaaatatgaatttcgaaagaaaataaaaacaagtagaaagaaataaaaaacaataagcagtggagagagatgtgaggaaagttatgaatatgaagacgtatttttggtaaggaatgttataaagaaattttatgagaaaggatcttatatgataaattcttgtcctaaggtagaatgactgattgtttagaaaagaaggaaatataggacaagtcagaaagtccaagcatgttgtagatgacctatgtaagtcacgataaagtttatacaagagaatttattaaaatttagatgtaattagccataactgaaaggaaatttatttatttatttatttatttatttatttatttatttatgatttattttgagaaggagttttgctcttgttgcccaggctggagtgcaatgtcatgatcttggttcactgcagcctccgcatcctgggttcaggcatttctcctgtctcagcctcctgagtagctaggattacaggcatgcaccaccacacctggctaattttgtatttttagtagagatggggtttcatcatgtttgtcaggctggtctcaaactcctgacctcagttgatccacccaccttggcctcccaaggtgctgggattacaggcatgagccacctcatgcacccagccaggaaatttatatataatactctatctaaattttggtgccctatgttaaaacaagtttttcttcaagtattggtttgctttcagtaagattgcaagaaatattgacttttaattctagaatctgtttcctttgaaggcctctcagatttatatcttttccttttcccttgaaaaggtatagcctttgcaagttcaaaactgacttccctagactccttttaggaaaagcaatacagtggttgtttcaggctgtggctcaatagctaagcctttgttctttcatggtggtggcctgggttcagttcctggcttagagaatgagaggtttccagtttgctacttctgggacttttgtcatttatttattctttttgtctccatcgacagcttctgattttctcacttgaatttttttttctgtgagctaccttaagggtaatgttggatcttgtaaaaattgcttgccatctctttggagatacctcttgtgtccatggttaagttataaccttggttaaggcctgttggtttcactagggaaaatacctttaaaaaaaggcttaaaagccagagatgttggctatttgtcctggctagagtctggtattaagggatttaaaaggattttttaaaggacctctatagttataagtcagcttaattaaaaatggatattccatagtcatatttatatatatatacacacacatatatatgtatgtatgtgtgtatatatatatatttaaaagacctgtatgatttttttcttcttggaacttatttttttgagagaaagtgttttgtgtgtttgttgtttgtttttcttctcagtggactgaattatttctccattctgtctttttaccccctttaatgaccatattagaggacctaagataatttctgacagcctgggactccttgggaggaaacagaaggtgccacagacctcgttttgggagaaacctctgttttcctcatggaaccccaagagctgtaagcagagagttctccctcagaatccaaggctctgctctgtttacgtcacattacctgacctttgtgacttttgggggcatcagaaattactttgcattatgagggaacctttagcattggtgtgtattacctaggtaggatgtgtacttttagggattgcagttgcttacatgagtggttattactacagaccaatacttctttcttctcacatttaaatgaaaaaaaagcatgctcttgggcatccacctatgaatggaggatgggctgatttgctttaggttggccaccagcctttggggaacatcgttgcagtgaaatgcttggtgaaagcattgcactgtctgatcgcatagtgcacttctatgcacttctgcctgatgtcctaggctcaacacctgctacataattaagatcacttacttatcaggtttttaatcaaaatgaaatgttgctaagagttaacattatagcatatgtaattgagattactggagaaagttttacctacaagatatgtaaggaaagcaaaatgtgtttttggtaaaagattataggaaggtgtgccagtatagttttttattttgcttactttaatgggttaaaggattgttttaagtttgataggagaaagctgaagcatgagcaagttgtggaaggtatatgaaagattaacattttaaaagaaattctgtgtgtaaacattggctaaagttaaaggaggaggttggagccaagatggctgaataggaacagctccggtctacagctcccagcatcagcgatgcagaagatgggtgatttctgcatttccatctgaggtatcaggttcctatcactagggagtgccagacagtgggcgcaggacagtgggtgcagcgcaccgtgcgcgaaccgaagcagggcaagccattgcctcactcggaaagtgcaaggagtcagggagttccctttcctagtcaaagaaaggggtgacagacggcacctggaaaatcgggtcactcccaccccaatactgcgcttttccgacgggcttaaaaaaaggcacaccaggagattatatcccgcacatggctcagagggtcctacgcccacagagtctcgctgattgctagcacagcagcctgagatcaaactgcaaggcagcagcgaggctgggggaggggtgcccaccattgcccaggcttgcttaggtaaacaaagcggctgggaagctcgaacagggtggagcccaccacagctcaaggaggcctgcctgcctctgtaggctccatctctgggggtagggcacagacaaacaaaaagacagcagtaacctctgcagacttaaatgtccctgtctgacagctttgaagagagcagtgattctcccagcacacagctggagatctgagaacgggcagactgcctcctcaagtgggtccctgacccctgacccctgagcagcctaactgggaggcaccccctagtaggggcagactgacacctcacacagccgggtactcctctgagacaaaacttccagaggaatgatcagacagcagcatttgcggttcacgaaaatctgctgttctgccgccactgctgctggtacccaggcaaacagggtctggagtggacctttagcaaactccaacagacctgcagctgaggatcctgtctgttagaaggaaaactaacaaacagaaaggacatccacaccaaaaacccatctgtacatcaccatcatcaaagaccgaaagtagataaaaccacaaagatggggaaaaaacagagcagaaaaactggaaactctgaaaagcagagcgcctctcctcctccagaggaacgcagctcctcaccagcaatggaacaaagctggacggagaatgactttgacgagttgagagaagaaggcttcagacgatcaaactactccgagctacaggaggaaattcaaaccaaaggcaaagaagttgaaaactttgaaaaaactttagacgaatctataactagaataaccaatacagagaagtgcttaaaggagcagatggagctgaaagccaaggctcaagaactacatgaagaatgcagaagccttaggagctgatgcgatcaactggaagaaagggtatcagtgatggaagatgaaatgaatgaaatgaaatgagaagggaagtttaaagaaaaaagaataaaaagaaacgaacaaagcctccaagaaatatgggactatgtgaaaagaccaaatctacgtctgattggtgtacctgaaagtgacggggagaatggaaccaagttggaaaacactctgcaggatattatccaggagaacctccccaatctagcaaggcaggccaacattcagattcaggaaatacagagaacgccacaaagatactcctcgagaagagcaactccaagacacataattgtcagattcaccaaagttgaaggaaaaaatgttaagggcagccagagagtaaggtcaggttacccacaaagggaagcccatcagactaacagtggatctctcagcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattctgtcaccaccaggcctgccctaaaagagctcctgaaggaagcactaaacatggaaaggaacaaccggtaccagccactgcaaaatcatgccaaattgtaaagaccattgaggctaggaagaaactgcatcaactaacgagcaaaataaccagctaacatcataatgacaggatcaaattcacacataacaatattaactttaaatgtaaatggactaaatgcttcaatcaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaggaagagctaactatcctaaatatatatgcacccaacaatacaggagcacccagattcataaagcaagtcctgagtgacctacaaagagacttagactcccacacaataataattggagactttaacaccccactgtcaatattagacagatcaacgagacaaaaagttaacaaagatagccaggaattgaactcagctctgcaccaagcggacctaatagacatctacagaactctccaccccaaatcaacagaatatacatgtttttcagcaccacaccacacctatcccaaaattgaccacatagttggaagtaaagcactcctcagcaaatgtaaaagaacagaaattataacaaactgtctctcagaccacagtgcaatcaaaccagaactcaggattaagaaactcactgaaaactgctcaactacatggaaactgaacaacctgctcctgaatgactactgggtacataacgaaatgaaggcagaaataaagatgttctttgaaccgacgagaacaaagacacaacataccagaatctctgggacacattcaaagcagtgtgtagagggaaatttatagcactaaatgcccacaagagaaagcaggaaagatccaaaattgtcaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagactgctagcaagactaataaagaagaaaagagagaagaatcaaatagacgcaaaaaaaaaaatgataaaggggatatcaccaccgatcccacagaaatgcaaactaccatcagagaataccacaaacacctctatgcaaataaactagaaaatctagaagaagtggataaattcctcgacacatacaccctcccaagactaaaccaggaagaagttgattctctgaatagaccaataacaggctctgaaattgtggcaataatcagtagcttaccaaccaaaaagagtccaggaccagatggattcacagccgaattctaccagaggtacaaggaggaactggtaccattccttctgaaactattccaatcaatagaaaaagagggaatcctccctaactcattttatgagggcagcatcatcctgataccaaagccaggcagagacacaaccaaaaaagagaattttagaccaatatccttggtgaacattgatgcaaaaatcctcaataaaatactggcaaacagaatccagcagcacatcaaaaagcttatccaccatgatcaagttggcttcatgcctgggatgcaaggctggttcaatatacccaaatcaataaatgtaatccagcatgtaaacagaaccaaagacaaaaaccacatgattatctcaatagatgcagaaaaggcctttgacaaaattcaacaacccttcatgctaaaaactctcaataaattaggtatgtaaatgggacgtatctcaaaataataagagctatctatgacaaacccacagccaatatcatactgaatgggcaaaaactggaagcattccctttgaaaactggcacaagacagggatgcgctctctcaccactcctattcaacatagtgttggacgttctggccagggcaattaggcaggagaaggaaataaagagtattcagttaggaaaagaggaagtcaaattgtccctgtttgcggatgacatgattgtatatctagaaaaccccattgtctcagcccaaaatctcctgaagctgataagcaacttcagcaaagtctcaggatacaaaatcaatgtacaaaaatcacaagcattcttatacaccaataacagacaaacagccaaatcgtgagtgaactcccattcacaattgcttcaaagagaataaaatacctaggaatccaacttacaagggacgtgaaggacctcttcaagaactacaaaccactgctcaatgaaataaaagaggatacaaacaaatggaagaccattccatgctcatgtgtaggaagaatcaatatcatgaaaatggccatactgcctaaagtaatttatagattcaatgccatccccatcaagctaccaatgactttcttcacagaattggaaaaaactactttaaagttcatgtggaaccaaaaaagagcccgcatcgccaagtcagtcctaagccaaaagaacaaagctggaggcatcacgctacctgacttcaaactatactacaaagctacagtaaccaaaacagcatggtactggtaccaaaacagagatatagatcaatggaacagaacagaaccctcagaaataacgccgcatatctacaactatctgatctttgacaaacctgagaaaaacaagcaatggggaaaggattctttatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacatagggcatgggcaaggacttcatgtctaaaacaccaaaagcaatggcaacaaaagccaaaattgacaaatgggatctaattaaactaaagagcttctgcacagtgaaagaaactaccatcagagtgaataggcaacctacaaaatgggagaaaatttttgcaacctactcatctgacaaagggctaatatccagactctacaatgaactttaacaaatttacaggaaaaaaacaaacaaccccatcaaaaagtgggcaaaggacatgaacagacacttctcaaaagaagacatttaagcagccaaaaaaacacatgaaaaaatgctcaccatcactggccatcagagaaatgcaaatcaaaaccacaatgagatagcatctcacaccagttagaatggcaatcattaaaaagtcaggaaacaacaggtgctggagaggatgtggagaaataggaacacttttacactgttggtgtaaaagtgttggtgggactgtaaactagttcaacccttgtgggactgtaaactatttggttggtgggactgtaaactagttcaacccttgtggaagtcagtgtggtgattcctcagggatctagaactagaaataccatttgacccagcaatcccattactgggtatatacccgaaggattataaatcatgctgctataaagacacatgcacacgtatgtttattgcggcactattcacaatagcaaagacttggaaccaacccaaatatccaacgatgatagactggattaagaaaatgtggcacatatacaccatggaatagtatgcagccataaaaaatgatgagttcaggtcctttgtagggacatggatgaaattggaaatcatcattctcagtaaactatcgcaagaagaaaaaaccaaatgccgcatattctcactcataggtgggaattgaacaatgagaacaacacggacacaggaaggggaacatcacactctggggactgttgtggggtgggggtagtggggagggatacctttaggagatatacctcgtgctaaatgacgagttaatgggtgcagcacaccagcatggcacatgtatacatatgtaactaacctgcacattgtgcgcatgtaccctaaaacttaaagtataataataataaaataaaaaaatttttaaaaaataaagttaaagggatattattattattatttttgtaagttaaacattaggattaaaaagcacaacagagttttctagagcactgatctactctgtaacagaaaattgtaaagggtttaaaaggtttatgagaatcttaccttatggtcaaactggttaagattgggaagatttgtctataaagttttattaagaattgggtttgacattaatactacactaatgcaaacgtgaaatgtggctttctctcttgaataagattttcatgtattattacaagataatgaaagatttttatttgctttttaaataaactataggaaaaataagggagagaaaagtgacagatcatttggaaacccaagtctcccctatatcaatgagtaaaagtttttacctttttgaaatctttgagttatcattttggctaaataaatgctttatggtgacctgggattctattttgtaatatcaactgtttaaaccttttgtatttgacaaacgttccaaactgaaattctaatgtaagtctttttctgacctgattagtccttctagatattaggtcccctaaagtccaaaagtgacatatttggcttattagatatattaaaatcatacaggaagcactttcaaatataaaatgctatttggctttctttggactatacttatataaatgtgttattggtatatgttccaaaattatgcaaaactcctataattctgatatgacttagtgtacattatcagtcataattatagttcttatgttacattattgtgtgctacagagttaaccaaatttctttgtcaattgcatctttaatcagctgtcctaagacttttgtcacccacagacaattgtcttgttttaatccttttcaaaaggtggtttataatcagctataggactctgatgggtactctaaaatgcaagcctctgataactttgaaaattgtgccattggctgggcatgatggctcacaactgtaatcccagcactttgggaggctgaggcaggcagatcacgtggggtcaggagttcaagactagcttggccagcatggtgaaatgccatctctactaaaaatacaaaaatcagtcaggcatggtggcatgcacctgtaatcccagttactcgggaggctgaggcaggagaatcacttgaacctgggaggcagaggttgcagtgagctgagatcgcaccattgcattccagcctgggcaacaagagggaaactccgtctcaaaaaaaaaaaaaaaaaaaaattgaaaaagaatattgtgccattgaaacagaaaagaaaacacaaataaacttccaggattctcatagaaacttaatatattcataaggaatgtggcccaatatcaggcaaaacaagagttaacagcatggactaaactaataaaagaccaaaacaatcttttaatgactttttgcttaaaacattgcatatcctttctgttttgcttttcagagtcaagaaaacttttcctttggaaagtatttactgcttttaacaattgaaaaaagtatactactatggacaaaatttggagcatatgtctttctttttacctgatttctccagaatttgaaaactatttgggagtattcttaactaatagcaatatagttatttgcctaagtgcagtaagaatcttttcttttgtaataggacacaattaaagaaactgcttattttatgaaggctttgactagaatggtgtgctttcagatacaaacagactgctttaagggatcaaagttgacttatagagccaataaaagccactatggaaaactggccttattctttgtctatgcagtctctgtatggggttcctgacctgtggtaagtgaagaatgtcactttctgacaggcccaggagccccaagttatcttgggacatcaagaagaaaggaatgcacccaacttatacaggtatttgcaggcacagataaatctgtggctggctcaaggctttaagaagcctaatgtgagattctttttaaattaaatttccatcgaaaccaattttaacaagagcctatgtggcaaataattatttttgctgcactttatacaaataatcaggccaaatttcataagattaaaactttatggcaaacaaatttgtcccactatgatttgtctttggtaaaaatggaagctagagagagaatttgtttcaaaaactatgatacaccagttattagattctagtctcgtctgttgtttttgagtttcttctgcaatttaggcagaccctgcttattcctgagaatcaaccagtgatctatggctgttgctcagaagaaataagagggatggctaacgtaaagatctggattagtattctaattctaggcatgtattagaattggctagtgaccccatatcagcttggttttaacaattacccagttcatggaaagccttcttatttagtttacttgggataattgtgctgattttgttttactgttgtggaatatattgctgttgtcctctttgtgtaggaatgcaggaaaagcttacttaacattttcttaaattgaacacttattaatcttccagatttcaccttttgtcagaactcagagttatgatttgtcctcactgtactgacaacaggctctggtagggtgcagaggtcctggtaaacacaccctctgctggaaaacagggagaagtttccatcagtgtaagcctgcacttgggttgtctgggctgaagttaggagactgagtagaacatttgctgcagaaaaaaaagaagatgtgtaattttcacagttagaattaacttaggagagctgaaattaactgagcctcggaaatctgaatcttgaagtcaccagtggcttttgggactgtgagagagtctcttgtggtctttaatcatgtgagggtggggtgaaattcaatattcagtggttctgcaatgggatgcactgtgcaattggtgattgagaagccaactctctggctttaggagaagaatgtcttgctgttagtccttctggaaatagagccttgcattgcctactgtccgtttacactacctttgcacattgcctttggttatagagtcatgtccaatggctctttacttctgtttgcagggcaggagatggcaccctgttaaagagaaaggatagtagctgcaaagtcatttgtttctctgtttctgtgactgtatatattggctcatctttgaatggtctttatagccacaccaggctggaggtaacagggtcatgggagtggactgctggtgtgggctaaatcagagttcagatccatgtctccaagaggtaggaagtgcagggcaagttatgtggcttctggggcatccctcactttcttagttaaagagaagttgaagtaatcattctgaaatattatgggagtctgcagaaaaagtaatgaaaaccaaagcactttccattaatctccataatttagtccttacgataatgtcacagggcaagcaaccaatcagaccttactagtcgtgcttcctagaagagactgaggttcagagatttggacagagtgtcagatatgggatcagtggctagtccaatgtgatttccatcctttcttctgagagaaagcataagaaggctaagaggatgggggtaaagcacaagtcacctgcctgagagtcaacagagcaggggtctctttctcagtttgtttctctaagttatggcaaaagctttttgagctgtgattattgagaatgggggctgaagttcaacacatagttggcatgagagaagtaattatgattgaagaaatctagatgaaatccattgttcttttctgtaaaggggttgttatccctgattctttttttcttttttcttttttagatggagccttgctctgttgcccaggctggagtgcagtggtgtgatcttggctcactgcaacctctgcctcctgggttcaagtgattctcatgcctcagcctttccagtagctggaactacaggagtgtgccaccatgcccggctaatgtttttatttttagtagaggtggagtttcaccatgttggccaggctggtcttgaactcctgacctcaagtgattcacccaccttggcctcccaaagtgctggaattacaggagtgagccattgtgcctggcctgttctcactgattcttatagtgccatgtttctcagaatttgtggcttcaattacttatatttgtgcacctgacttttaggtgagctccagaatagcattactaattaagaatgagcatttagagtagaaaaagtgacaggaacagcaagactcacttccagaaagcctcactacaggtctaataggtgaggaaagtccccatctttcccatttttcttcattacctccctgtggggcaagcactgccattatgcatgagtaaactgtctgagttatagataagtaatgacatgaaacttcacaaacaggcctagatttctacccagggaaccgctgttatcagagaagggagtttggaatcttaagcaacaaacacatgttgattctcagtatttgcctcctgatggcttgctcagagagcctgttttcattgcccactttatatgtcagtaaataatcttccctggcagtgggtccaccatgtctggatgcacacagggaaatctggtggggtctggccagtgaaaaacactcctcaggttttgcaggaaaagcagtgaacccttcttttaagctcgagaatgctttaaagatgcatcattggcaagccttgccaaagaaatacgggatctaaatgtgataaaagccacgacgacatcaagctggctctggaggtctcctttgaagtttgctgagtggattgtcagtgggaggctgatatttacatgtagaagcacacaagtgttactgctaattgtggtaaatcaggctggccagcctggctctggatcccactgtgcctaacaccagccctgcatcccaggcacatgccgggctcctcagaagcgatcagccagccagcattgtgtgaattgcatttgggttcacagcactgtaattgtccttctcctgctatgaggagcagagagggaaaagggaagggagggttgtgtaatttgccctaggaaattgtgggggagggacaggcactgggccgggtggggggcggtgcgacatggctaaaacactgaccttcccttgagagagaccatatggtgaagtggagagggcacagcttttgcatcacacaggccttgtattagaattttggctctgacaccagctgtgtgaccttgggtcatttgcgaaacctctctgagcctcaactgccccttcttaaaatcagctctaagtaaccacagggttattcttcagaaacacagcatgcacatgcaaactttggcttagtaaataatgatttctttttgttctatctactccacctccctttcccattagaagcttgctacctttcactctgtgttttcttcctctcccattttcctggtggcattcaataaagcagaattctgatttctgcaatgtaggccaccttagagcaaaatacatgatcaggcaccaccaaattaggctattatctactggatcctgtttaaccaacccaaacccaactcaggctaaatacaggaatacaagaaaacgctgaatttctcccctttctttttttttttttttttgagacagagtcttgctctgtcacccaggctggagtgcagtggcgcgatcttggctcactgcaagctccacctcctgggttcacgccattctcctgcctcagcctcctgagtagcggggactacaggtgcctgccaccacgcccggctaattttttgtatttttagtagagacagggtttcaccgtgttagccaggatggtctccatctcctgatctcatgatctgcccgcctcagcctcccaaagtgctgggattacaggcgtgagccactgcgcccttccctccttttttttttaaaacaacaacaacaacaacaacaaacagtttattcagtaattatgtatacgtattttagcttccaaagtcagtgatggaacaaattgagtcctattaggcccactccattgcatgagttagcatcagaggaggtcaaactagagtgacttcatcttgaatatgggctaggtaagaagaggatgaggcctgctgggctgcattcccaggaggttaggcatttgtagtcacaggatgagataggagttgggtaggaatggtttcataaagaccacaggatgcaagctgggtgtggtgccttatgcctgtaatcccagtactttgggaggccaacgcaggaggattgcttaatcctaggagttcaagaccagcttgggcaacatagtgagacctcatctctacagataatttttattttattttattttatttttttgtgatggagtcttgctctgccgcccaggctggcgtgcagtggcatgaccttggctcactgcaacttctacctcaggggttcaagcgattctcctgtctcagcctcctgagtagctggaattagaggcgcacaccaccacgcctggctaatttttttgtgtttttagtagagatggggtttcaccatgttggccaggctggtctcgaactcctgacctcaggtgatccacctgccttggcctcccaaagtgctgcgattacaggcatgaaccaccgtgcccagcctctacaaataattttttttttttttgaaatggaatctcagtctgtcgcccacactggagtgcaatggtgcgatctcagctcactgcagcctctgcctccctggttcaagcgatttgccttacaaatgatttttaaaaaatgagctgggtgtggtggtttcacaagatacgggtgataaagaccccaggatgcgggccgggtgtggtggtttatgcctgtaatcccagcactttgggaggccaaggcaggaggattgcttaagcctaggagttcaagactagcctggacaacatagtgagacctcatctctacaaataattttttaaaaatgagctgagtgtggtggtgcaggcctgtagtcccagctcttgggctaggcatgggggtcagctcaggtgggaggattgcttgagcccaggagttcaaggatacagtgaactatgattgtgccagtacactccagcctgggcaacagtgcaagaccctgtttcataaacaaattaaaaaaccccaaaaacctaggatgcaatgaagaaggaagccgaaacccaccaaaaccaagacggtgatgaaagtgacctctggtcatcctcactacccattatatgctaattataatgcattagcatgctaaaagataccaccagcaccatgacagtttacaaatgttgtattaatgacaggaagttaccctatatggtggaaaaaggaaggaaccttcagttctgggaatttcctccctgtttctgggaaaatcatgaataatgcacccttagtttagcatataatcaagaaataaccataagtatactcagttaagcagcgtggctgttctgcctatggagtagccacccttttttattcctttattttcttaataaatttgcttgaattccttcctgggtaaagccaagaacccatgtggcctcccatggtgatctccaattttgggattcaccatgtgacattaggagcaacttagggatctggtgcatcccaggccaagactaacatggtgatttttggggggttatgttaaaactgggggctctgcccaggcccctcagtgtggcttcttgagtcaatacctgggtacttactggccctagcacctacaagttcattcacagttccttctcactgacttcaccagtgaccactatcagtgacttcaagggagaaatgaggggggagataaaataaagtgaatggggaagagataaagaagagaggtcttttcacagtttgccagaatagtcccttcagtggttttaccccagggcaacaggagcccccttttagtttctttctcttttaattttcttttcccttcccactttttgcccactttttgccttatttgtgtctgactcaatttccgtctctttctctacttcttcattcccagatttggctgtagaaaattagaaagttcttgaacttggtttgcacgggtgcttttactttaacatgaaaatgaatgatcagcctccttctaatttcatcctagagtctactgcatccctcctaccccctgcacaggaatttagtcacacttatctctcccactttctctcccttcttcactttctctattgctcctcctttcatgcttgtacctgcttttccatgccctgtttagcctggcttgggatccagcaggttctccaagggttcctgcaagaaccccggctgggtgcccaggtctgagcctggtatgtgcctcagtatcacaaaggcctcctgtaaatgacacacattgttggaagtttcagaaattctaggtcaaaatggcactgaaatattaaggtatttaccccaacccaagcaacttttctaaaagttgtagagagtgtgacctctttattaattgaaacgtgaaaatcagctctagtttggaagctgagaaaaaatatatatatatgtatttatttctttgttgtttgaattcttaatataaatggtttaaaggaccattgaaaactgcatgcaatcacagaaggttttggcttcaggcagctcccgccatgatcttggggccccattgattctttcatctttcaggcgtcttactgtttgaaccttgaattttaacctgggacatgtttgactaaaatgatgctgttaatattttctgttgtgcaaaacacaaagagaactaggctccagggttgtttctatttgctaatgctgtttctgttgacttttgacttttctagtttcccagagctatggggacttcccatccggcgttcctggtcttaggctgtcttctcacaggtacggagcccagtcctctctgagttccttgtttgggtgtcttgtttttttaagctttgtgctgcatgggtttattaccagtactctgcatacacagtccaaaagagtgaaaagaaatagaaaactataggacgttatccagaatgaccacaaaccttcagttccctttgctgtattgcacttactccatttcaaaaggaatgctctccagtggcagttttagtacatatataatgttggcattgaaatgttgttagtaataatgtctaaatttacttactactctcttccttttcctaggacaaggcttctattagagctggattagataaattcaggaatggtcagctgtgggaggtggcacatctgttgtcccagccccttgagcagctgaggtgggatgatcccttaaggccaggagttcaaggttgcagtgcactgtgattatgcctgtgactagccaccacactccagcaacatagcaagacctcatttaaaaaaaatgttcaaaggaaataaataatagaaaattcttgcccaagaaatcatacttgtcttaaatcataactctcttgaggaaagatgcttacattgcttctaaatctcagagtcacctttatcttctctaggaatcaaattgatagatgaatgtttggctcttggaaaatcttaaaaactttcccaccaaaaggatcattggggtaatttgttgaagtgtgtattggactgtcttagttttcctccagatatttatgcactgcagatgttcgccatgaaaccagtgctcttctattctgaggagttagctcagcccgttagtgtctttgtcttacccatttggatatggtagaattgagcaagaccagagattcaacagttctaagctccactaagtataccccatctacagagtaataggtgatccagatgtacttacaaatcctatcttaacaagctttaggaattatagtggtcatatattgaagttgggtgggagtctcacaccaggttccaagggagattacaaatcactaattaataattaagtcataatatctcttctatcagtctcgggtttcttgttttctaagttctgtgctccatgggtttattatctgtactctgcttacacagtccaaaagagtgaaaagaaatagaaaactacaggacgttatccagaatgaccacaaaccttcagttcctttgctgcattgcacttactctattgcaaaaggagtaagtgcaatttcagtctaaataagcgagactgaaatttgagcttcgaagatgaacttagagttttcactcttgggttttacttaccaattgtgaattaaaatccgtatcatctggcaccactgcactccagcctgggtgacagagcaagactccatctcataaaaataaagaaataaataaacaaataaatccacatcatcctgctttggccctggaagtcatgagggagagacggcatgcccgagggctataagaaatggaagatgtggaattcttgagcacagatgtgctttgtgttttcttcagtctgtgtccttgcctccattcttattccatgtgggtttttttttttttttttttttttttttttgagacagggtctctcgctctattgcccaggttggagtgcagaggctgactgcaacctcaatcccctgggctccagtgatcctcccacctcagcctccagagtagctaggactacaggtgtacaccagcacacctggctaatttttttatttttttattttttgtggagaccaggtctcactacgttgcccaggctggtctcgaactcctgagctcaagcgatcctcccacttccacctcacaaagtgctgggattatagacatgagcctctgcgccccagcctcatctcattttaactaaaggaaacctttgcagtgattgtgaaccataaagaacccatatgtgcttgagcccgtgccatcttgggatattttatggttacacataagagtctgaaatatggaattggaatcagacatcctctgtctatttgagtgtttggaggggtgaatctagtggggcttggtggagctatttggaacatttgctgctctcagcagatgcagtggctgttataatgggggagctttcatgggcatccaggctaacggatttttgtgtagaaatggtcattgttcatctaagctgctactgttgcttctctcagttgtcgggatgagactgtcctttctgactgcatcctattcagagcgtgcttccttttgcagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccaggtgagttggctgggtctccaggaccaagcttcttctcttcctgtctctcctgttaaatgtactaaggttttaaacatatatataaataattaatatttattgcgggaagtttgaaaaatgtaagcgaacacacacaaaaatcatttgtaatattatcaagaaatattcattgttagcatttcagagctgtattaagtttggaaagtcatctttgttatgacatgtcctgtattgatactgtataaacaatctgaaatatactcatctctattcagttcattcaagttgcacacatactcacagtgtgtccagcactgggctaagtgttgagtacacaaaaattaataggtaagccctgtcttggagttgctgatagttcattataatatcttccaaataaacactcgatttttcagattcactatcaacatacatttattcttggagagttggaaggaattttctttttccttttaaaaaagttacatatatatatatatatatatatatatatatatattttttttttttttggtaacagggtctcactctgttgcccaggctggaatgcagtggcatgatcatcatagcttactgcaatctcaactcccttggttcaagcgattctcccacttcagcctccccagtagctgggattacaggcatgcaccaccacgcccagctaatttttatattagttgagacgggggtttcaccatattgaccaggctggtcttgaactcctgaccttaagtgatctgcctgcttcggcctcccaaaatgctgggattacaggcgtgagccactgtgccctaatttttatttttatttttgtagagatagggtttcactgtgttgcccaggctggtctcaaactcctgggctcaagtgatccacagccacctcagcctcccaaagttctgggattacaggcacgagccactgggcctggcctactcctgcattttaattaaaaggacaaaagggtcgagcacaagtgatggcaatttcagtatgcagttgggtaaattaaaaaggactatggctagaatccttggttttagaacaaaacctaaactgtttatgattcttgccatccttgctgttttggcataggtgtgtcttcctacctttctgccttttctttttcagtttttaatgggctcctcttcctaccctctataactacgagtgtccccagggatctagaccctctttactttttcatgatactcttattcatatgaaccttccttcttaacaattaaaaaaaaccaaaaactttgttttgaaaagggaaggtatttagaatgtcactccaacttcattcacacttagattccttcaggaaaatcctctaggtgtggagggattttcccctgctgtgaagagaatggtaggaacgtgaatgtgttaaaggcacacgagtccctgaagttttaatccgtgtaagattgtccaaaaattcttcttgttccagcacagatgccatccaagtagcccctgcatcgctgtctgactgagatctttttattcgcaatcatgcagacgtaggggccctttctgcagctgatgtttgagactgttagaacttcttaccaccgtagcttaagtagctgtttttcttttggaaaggaaattctcaggctccttctccttctttaaattttatgtatttctcaaaggattactttttaataaacagatttctatgctatttttgaatcatactgactataggtggtaagagtttttaaaagcatttcataataaaactcgaaatattttttcctgttttaaacagagttggactgtattattttattgttaatttttgtttttagttgtttaaattttgatttagattcctggttagtatttatttatttatttgtagagacagggtctctctatgttgcccaggctggtctcaaactcctgaacacaagcaaccctcccaccttggcttcccaaagtgctgggattacaggcatgagccacaactcctgtccagtattgatatttatcatcagtattatccatcaggagacaggcaatttggtattattcatacttaaaaatcactttgtagctgtcatgataactaatgccagtggggcaattcttctggatatatgtgtaaaggtgaacttcatacctaatatcaataatgccagtgggatagtttttctggatttatgtgtaaaggtgaaattaatgtctaatagagtcttcattcttttttaaaccacagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaaggtacttgtatcatctccttccttctttaaataagagtaacaggcaaaatcataaggtgcgtgtaggatttttttttttttttaaatcatcatcactggtgatcctaaattctgatttggggatttaggaccccagctaatacaatgtctgtggctataataataagcttaaaattactaaaggccaaagcttgattacccatgcaagatttcatgtttcatcagttgacttcaaaatactgtaaggaattcttttcttacataagcctcttactttcattcacattcctgactatggcggccctaaaaacaaacatacacccagggggttagatgcctagattaattttagtaacttaagaaaagtgatttgaagaaagtagtttagacttcaaccctttgatgtccacagttagtacgcttggggaagtataatacatgctgaggtcaacagatatttcctgaacactatattacatggaggaatgggtagcagcaagagtacactgttttaaaatcagagcacagctaattttgtgccaggcactgtgctaggttctgggaaagtactgagaataactgaggagcagagtggaagagaagaagagaagaaacaattggatagaaacaaagtgtctagagcagtgtggatcagcaaatgttggttgattaaatgaataaatttattagtcaaggagattgtggacgagtataaccataactaacccactgctgaggaatgcggtgttctgtttgattggaatttatttttattgttattattttgtaattctgtattataactatatgcctaattgttgtacaccatctcacaatcaagccttgtgagattttccaaattttatcttgatcaaactggtttgcaaattatttttcagggttttcttaaaaaaaaaaaaaaaaacccaaactttataagatcctggctatcctgtggatttttaggcccttgtatttgttcttttttatagcaacatcagagctggatctagaaatggaagctcttaaaaccgtgtataagtcaggggaaacgattgtggtcacctgtgctgtttttaacaatgaggtggttgaccttcaatggacttaccctggagaagtggtaggtaccctcaaaacgtgcaatggcttggagcagagcaacagggctcagaagacctgcatttgagctcggtctgtcactgatgggcacatcactgagtttctctagaccttagcttcccacctctgggatgaacacatttgattaaatggcctttaggactccttgatcaatgggagagtttgaaatgatagttcctggaccaggcccttcagaatacataaagagtgtgccgtaagccttctttttcagaagtcagacagaaataggaaggttctctggctacaagatatcaaccaaaaaattagaagagcaaaaaaaccactggattttactattgcggagacagtgattgattctcatcgtcttggcttctgtgccctgaggtttgattcatctgatagtgttgattgcccgcaccccttcctcttctgccttgttggcacccaggacaatgtgtcttcctgttccacctcctatgtgcctgacctttgcatggctcaccttcagtgaaccgttatgatgtaatcattcagcaaaggtttaatgaagtttgctcaatcccaagcactgtaccagaagctggttcagtattgcaggaagaagggaggaggggagatggaagtggggaaggggagccaccatgctgcctcttggtcactggagatttacagagtctcagtcattctaatgcattgtcactaagtgtgtaagacagccatgtgtaagaggctatgaatgcccaaatgcaggaatgactaatattcttatggagaacaaaaacgagatatatatatttcttgcctccactcctgacttgtaaatttctgctccctgttcttttaggcatttgacagctttctgtccttctatccattgatctccctccttttatccgtttctctctcccatgcatttgccgctgcttttcatttgtcctggggcatctgataggaagttgggcattttcactattgcctcacaaacttcacacagtgaagggacatttacagtccaacaaatgtacatcttccctgaaatatgaagtgatttggttcttctgttcatacttgattgactttaatccttaacacataaacactgctttctatttataggagacagcaatttttttttccaaaccgaagtacatgctatttggcttacaaatatataatcaaagtattgtttcatacagtatgttttttccgattataaaagtaatgcaggtttattgcagaaactttgtaaaatatggagagacaaaggaaaggctacttcccagagcatcactgtttatattttagggagataaagcttttatttttcatttgtatttctttcttttttttttcttttttcttttttttttttgttgtggagatgaggatctcactacattgcccaggctggtctcaaactcctgggcttaagtgatcctcccaccttggcctttcaaagtgttgggattgattacacatgtgagcctctgagcttgactgagataaagctcttaagtatttcttatccatagataaacattgaataataggtgttattctttaaatggtaatttattacattctttatccttcagcagtatagcacaaacaccttatatgtgtcattaactgtccttttaaaaaatgggctgggtgtggtggctcatgcctgtaatcccagtactttgggaggctgaggcaggagagtcacttgaggccaggagtttgagatcagcctgggcaatgtatcaagactccgtctctacaaaaatttttaaaaattagccaggtgtggtggcatgagcctgtagccccagctactcaggagactgaggtgggaggatcacttgaacccaggaggttggggctgcagtgagccatgattgtgccactgcactccagcctgggcagcagagtgagattctgtctctaaaaaaattaaaaacaaaataaaaaatctcatgattttctaagcagctagcttttattctttaggttttatcttttagagcagttttaggtttacagcaaaattgagaggtacagagatttcccatgtgttccctacacccacacatgtgtagcctcccaccttgtcaacatccctaccatccatttgttataactgctgaacctccattgacacatccatatcatccagagtccatagtttatcttagagttcactcctaggagcgagctttttaaaagtcggttttcttccccttttgctgtagaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatggtacattccgctttctaaaatgtcagttgtccatgctgctcgggatccatatgtggtaatcattatttaatggaaactcttccctgtacagagaaaggtttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtaaagaaactctctgcccaagtatgcctttttttagtgtgcatcagaggcggactgaggtttgtgtgtgtcttacaacccagacccaaagtcagtctagaaaatgtaacaatctgagttaagagatgcttgaaatcacatccctttaatgataacattgcaaagtggtattagtatgctggtaagtatttaatgagaagatgagaagaaagaactaaaagctctggcccctggggaaagacaggtcactggattcagctagggtggaagaaaggaagtaaaattggactcaccaggattgaatagattgaatatattccctgatgttcatcatccatatcgcaagtagacagatatggtgattacacccatgaggcagttatcacatcaccttacgtgaaagttaacgtcataggcttaatctggaacccatttgccctaattgaggactccacaggaaagaagagtagagcctggctaatcaggagagagatgtgcagtgagttgcttggatccctaccttttaatcagaatggtagattgctctcatctcttaattggtggtggagttttgaatgagtcacccctcagccacagtttcctcatctacaatgtaggataaacaataccttatgtccttcaaggcaaggaattggatcagatgatatcatgaggcctcttaaggttttaagctgtgattagaacccaagagtcagaagatacatctcacagcacccagctaaccagccctatacttttgtcagaaatcatctcagaaagacaaagtcagtcctgtatttcaagccttcaggaggaagaacagagcctttctcatcagttccattcacctcaggatttgctttcttctttgtgaactaaattccacgtgtaattgagaagcaatgtctgagaaaatggaattttacagcctctatagaatagtaaaggaaaaatgaagtgggatactgaatctggaaggctttctgttgacacaaaatgaaggtgtacaacaaggagggcagctttccacgaggaacttccatgaggctgtgcagccagagaggaatagggtaacaaccctggtacagctaacacctccaacacgtgtgtgagcactgtctgcaagccataatccatagcagtggcaggacaggctcgccaactgagtggttctggaaagctgccttttccttttagtgattcaaggatgcttcaacgtggattttttagttcctgttatgagccagtgaatacaaagatgaacatggtagatgggggatctggcttcctggagcttaaaactccaggatgggggatctggctttcctggagcaagaaaaccagtggttttcttggccgaagaagtgaagagaacaaacagcagaggataatttggtaatcagcatcctagtgtgccccagggtactctcttaaggaaatccagtcctggagcacacccagtatggtccagcctgctgtcttcgtaggtctgagtgccccagtatttgcaaagtgttttggagcctatgaaatgctttcacacatacaatctcctttaattaactctcacaatgactctgtgctatgtgtacaattatcacgttttacacacaaggaaactgaggcatggagcattgtaataatacccgagatcttctcactccatgaccaatgcttttcttctccattccagttgctttttcaactgtgatgatttataaaggacaatcaaatgggcacatactatatttatgcacatacatacacacacacacacacacacacacacacacaaccagatgtcatttataatccatgtaaaatatttttggggaagtttctctttaataaagtttgaagagacatatattttttttttttgaagaggcatattttttctaacttttttttttttttttgagatggagtcttgctctgtcacccaggctggagtgcagcggtacgatcacggctcactgcaacctccgcctcctgggttcaagcgattcttcagcttcagcctcctgagtagctgggattacaggcatgtgccaccatgcctggctaatttttttttttttgtatttttagtagagatgggggtttcaccatgtttgtgaggctggtctcgaactcctgacctcaagtgattcacctaccttggcctcccaaagtgctgggattacaggtgtgagtcatcacacccagcctataacttttttttaataggtgatagaatcccgtgcttgaaaaataatcaaacaaaaagagaatgcattgtaagaagcctcactgtactcctgtccccagctgcccagttctcccctcctccccacagggaaacatcttcattagtttcattaggttcttatgaaaccttccagagtttctttaagcaaaatacaagcaagtaggactgtcatatcctgcagaccgctacatacaaatacatagaaagtgtcctcattctatcctccagtgatattccattttttggctgaaccacctaaatgatggatatttaggggaagcaagtattttttaaaaaaggtaaaaatcaaaggtttttattttttatttttttaaagaaaagttggtaggctgtgtttattcattcagaagtcaggccgtggctgaactgatagctcttggagatggccattgctcatctctgaatgtctggttttctcttgtaagaattgtgtgtatgatccagaccttcagtgtgtgcactatatattgagaattccagaagagatgatatggacaagaaaaaaagatgactttactttttacagtaaaaataaaacttaaattgaagagtacaattgtttaaacaattggaacttacttagctactgcttgttgaaacaaaatcctttttttaaaaggtatcgaagcaaattaaagctgatccgtgctaaggaagaagacagtggccattatactattgtagctcaaaatgaagatgctgtgaagagctatacttttgaactgttaactcaaggtatgtaaagggagtataaagataatgctagctctgtagatgagtgtcttccaaggaaagcctggcacttttctccccggtcatggaagaaaagcagcacttaggggagaagcagtgtctgcatatgtcacatatcgggaatacctctgctggactcatgaattcaggtatttctgggaggttctgggttactctagagtaggcgaggaatccctaggctccaccagctagctttatttttgtagagatggagtcttgccatgttgctcaggctggtctcctgggttcaagctatcttcccaccttggcctctcaaagtactgggattacaggtgtgagccactgcacctggcctccaccagcttacttagcacctgcttctcaatctgagaagagagaagcagatgaccttagattgttctggagagttttgctacaagttttccttatagacattgtacagtggtccttaccagaagggagtgcccaagtctgtttacattcaggctcagcacctatccagagtcccagccatgagccaggtgctgtctgaggtgcgctcatgtgatcctcacagtaaaacctgtgatacaagcaacaccgtatatctaatttatttgaccacagatttagaaaagaatctttaaaacctaataacataccacagatgcattttggtaaatgctgctttagattatactttagctgaatccattagttgaatcctaagctataatataattttaagaacctccttgcctttcaagccaaataaccaagggactttctctctctctttccctccctcccttccttccttccttccttcttctctccctcccttgttatctcttttcctttcctttctctccttccttccctcttccctttttcctttctctccttccttccttccttgcttccttcttccctccctcctttgttctctcttttcctttcctttctctttttctttccttccttccttcctcactcactcttttcttttcctttctctccttccttccttccttcctccctccctcactctctcttttctttgcctttctctccttccttccttccttttcctccctccctccctcccttgttctcccttttccttccttccttctttcctttcttccttccttccctcttccctcactctctcttttcctttctctccttccttccttccttcattctcccctcccctcccccctcccctccccctcccctcccccctccccccctcccctccccttcccttcccttcccatttttcttctcaccatgttgcccaggcttgcctcaaactcctgggctcaagtgtttctcttccacctcagcctcccaagtagctggggctacatgtgtgaggcatcacaaccatggacttttcactttcttcactccaggttaaaaacatcacagggataaatctcaaaacaccaaaactgtgaaaatgctgctaaccatgtgggtctgtctaaactggagtgttacttgtacaactggtttcagcccctccggagtgttttgaatgccatgtagatgagttgtgaactcatattccactttgtagtctcatatgttctgggacacgagctattccattctgacttctttctgcctcttgcagttccttcatccattctggacttggtcgatgatcaccatggctcaactgggggacagacggtgaggtgcacagctgaaggcacgccgcttcctgatattgagtggatgatatgcaaagatattaagaagtatggaaaacagatgtgtcttcttctttcgtggtcagaatatttctcccttgacacaaatgatgtcaaatacattttacttattgactataagatagggttttgggtgtgatagcttcagggtgtgtatcttttgtcatgaatagctgtgagaagaaggtccagggctctcattagaccttcaaaatgtctccaatctaaaaacaagagtgaattttaagaaccactgttctaagaagatttttactaccctggctcacatatcttatttggtgaactttgtttggtagtcggactgcatgtaaacataaatgtgactgcttagtcccttatctgcccacctgctgtttggtgggttaattcgccattccctcctccctcccccgagtcctcagccttcttaaatgggcacatgagcaatgtgtttacacttcatccatggtaactggttgtgttcagaagcctcagttgtttcttcctctagacagagactcctcatcttaacttctagggctaagaacagacttggatgttgactggggtttctagtagattccagtgtggagcaggattctaggtcttataactcaatctgaggatcatcgcaaccctagtgacaccctaggggctcttcccagtgtgagtgttgagaagggagggctccaggcctttttgaaggggtgggagattgagatcattaaatatggttgaagttgaactgttcagtttgctcataggttcaagattggggaatggtagtcatattttattaaacttgattatctctgcctgctatgtaaacacttagctttcagttgttcatgtgtgagttattccctcttcagcacatgcagacaagttttaatgttcatctgcatgtaaaataaatcagtgtgtattgccccgaaatgcagacaaggtcccaactccttgccatcttagagtgttcccgtggctccactcattgccatgactctcaggaattggccctatacttaggccctttttctctctagatgtaataatgaaacttcctggactattttggccaacaatgtctcaaacatcatcacggagatccactcccgagacaggagtaccgtggagggccgtgtgactttcgccaaagtggaggagaccatcgccgtgcgatgcctggctaagaatctccttggagctgagaaccgagagctgaagctggtggctcccagtgagttcctcaacagtcaggacaactcatcagctgagccgcatctgccccaggcggaactttgaatcccagataggggttatatagaaatgaaggtcccaaggcagaaattcagttatgaatgctcttaaagtcatgtgggactttgttttattttgttttgttttttgagacagagttttgctctgtggcccaggctggagtgcaatggcacaatattggctcactgcaacctctacctaggacgttgttttagattcagatccaaaactgcatttttgcagaggcccctcaacattttgcttgtctaataatatagctacagtctctactttgaatgtctgtgtatgtggatggagtgtggggaaggatcttctgtctcattgctccttaaaagatagatgaagccaaaagcaatataagcaaaatgcaacttacaaaataagctttataataaagcatatgaagtagaggtgtctgcccatatagtagctgtcaattgcatttatcctattcaaattctgtccacaaggttactgttggagcaactttggagaaaatactgagttctcctgattgaattttgtccccttcttgtataaggaaagagttgatgtagtttcctgggtgtagatggtttgagagatggtactgcctatccctaaaatgaaccaggcagccctcacacttccccaccagcagtgagagattcctggctcagacacagccacactaccttgctgcccctgtgcatgtctgccaggaaacttttcattgtgcctctctctcttgtcacgtagccctgcgttctgaactcacggtggctgctgcagtcctggtgctgttggtgattgtgatcatctcacttattgtcctggttgtcatttggaaacaggtagatattttctcataaaactaaagatctttgaagccaatgagaacaagcatagcaacctagttcagtgcttggcacagagaaggagctcagcaattacatgtggagtgaacgttgttggactctactgtgtccagtcactgtgctgcttcagtgaagctctggtgcactgggactttggtaattcaccagttacctgtcctggtcatttatagaaaccgaggtatgaaattcgctggagggtcattgaatcaatcagcccagatggacatgaatatatttatgtggacccgatgcagctgccttatgactcaagatgggagtttccaagagatggactagtgcttggtaagttccatggggtaacctcccaagactcccttttcccttgcacacaactttacaatttataggccttggcagaatagagatctgagcttgtgcttagtaagaactaggcaatggaaatttgctttcagaaatacatttctgtcttgacagtaagttaattggatcattgcaatgatttttttaaatctctttccataacaaattatagttaaggaaaattttacaaagggagaagagaatatgaagagggctggcaaagatacccaccaaaattgcttttctttagaaatgacacaaattgaaaatgaatttctgtgactaaaaatgagcagatgagaaatgaatgaggacaaccacaaaatgtattttgattcagtacattctgaagatgcattagatactcctttttacatatttggaatatggaatataaaaatataggtacattttgaggcaaaatatgtaaaaataagcaagccaacttatcacaagcatttcaagtatttcaatcctgggctgagaccaagtatatgaagctttagtccaagggagtatttcttttttaaatcacattcctaatgaatgaaagcaagacaaaggcaaatgaaagtagaggtagaggttgtgttatgatgaatgatctaacagtatatatgttaaagaatgccaaatgcaggttttaattatccaccggtctcattgcaaaatacagaagagtttaagtcttcttagagagttaggtaaactgaaatcaagcaaggcaccagagtgaaatcacctttgcaaaaattgtaactgaggaaattatgacagtgaatgagatatgacctaaccaactccattttgctttagcctccaagttgtccttgttccttcctgggcataggccgaactaactttgagaggaacttagtttatagtttgactttgaaaaaaagacaataatagccctttgccaaaacaaaccctctttttccctgggaactagactgcctttgcgggactaacgaattagctacaagattagaaagtatggtttaggggtcactgttgtaaaacctgaggtcagtgcttgagatattttggagaccctgtatttcgatgcaccagctgacaccacccaggtcaataaactggctcatctgatcttggggcccctacctaggaactgactcagtgcaagaggacagcatcagctccctataatttcatctttgacccaaccaatcagcactccccttttcaccccctacccaccaaatcatccttaaaaaccccattcccccagtttcagagacactgatttgagtaatagcagaatagtagaaattcccccagtttcagagacactgattcgagtaatagtagtaatagtagaataggtctcccgtacagctggctctgtgtgaattaaaccctttttctattgcaattcccctgtcttggtaaatcggctctgtctaggcagcggacaaggagaatccatggggcggttataagagctgccccccaatttcaaatatttatatctaagctttctttattttcctgcctatttcccaacaagggatgaggagcttagggagttaaaaagtagtaaaatatggggaaaagggcataattcccattataccaagaggcattgctggtgaagcaatacctttccaggtacgattttcagtaacacagacgtgcagtaagaggcagtgttggctgttagtgtcttttatgagccaagtcttttcctggcttggctatccgtggtgagactgacaccccgggaaatgtttctctcagggtgagctctttcagggtgggacaacagcttcagtgtctttacgtatgtctcctcccaacatgaagctaattgctgtgctctcgggcatgtttagctcttggtagagtggctttcctaacaaatagggagcagtgagcccagcctgaagtttttatttagtcactccttagaatcagtgatattttgaatactgaagtatttccagtggctagtaatttactaagacaaaagatgcccctgtttgcatatggaaaacagaaggggagagagccaggaggtgtgggtgagagccccgaaggcaagaggatcccaggggctggcccagcacggagctggtagacagcgcgctcacaccagggagggctgcaccctcctttctcccgtctgtgttttctttcccttgcaagtgttattcgacaaaagcaattatgctaatttccttccctgtgggctcaattccttttttgacacgatgacttggaggagtcattatgattactccaaacaggaaagacactcgcccagctgtccgcccgcagagagctggctacggtgcagaaagctgaggaggcgtctggagtttttgggtgttaatgattctgcctgcccacaggtcgggtcttggggtctggagcgtttgggaaggtggttgaaggaacagcctatggattaagccggtcccaacctgtcatgaaagttgcagtgaagatgctaaaacgtaagtgctccttcctggggattttttgagcacggggattttttgagcatggggatattaagggaatttctcaaaatcatgcagctagtaaataagacatttaggactaggtcctgattattttgactccaggttttatgtgtatttagattaggtttatttagattgctcttgctgcctgtatgttggaaaattaagagcttgttatttccagtgacttctttttactagaaagaccaggaattagttattagcactgaggccaagtagctatctgcttcttttagacttctggtaaatagaatgatatccaatcacaggattagtcatattcttggtttttttctgagaacaggaagttggtagctcagctggactgatatgtgatttattctttcaacagccacggccagatccagtgaaaaacaagctctcatgtctgaactgaagataatgactcacctggggccacatttgaacattgtaaacttgctgggagcctgcaccaagtcaggtgggctcactgacctggagtgaggattttcactggacacatgtggttgtgaaaactgttcaatcaggcttaaatcctccactctccatccccacacatggcagggaatagaagtcccttgaatggagctgactggtcccttgaattgatggaagctcattggtttttgagcaaaatctgttgccagtccagtcatagccattcatggctctttattaaaaaaaaaaaaaaaaaaaaaaaaaaaaaacttttttggtatcttatttttttctgtgccatatggtctgcaggacaattcatggcttttctgttcttcattttcatacccatctcctaacggcttttgtccccataggccccatttacatcatcacagagtattgcttctatggagatttggtcaactatttgcataagaatagggatagcttcctgagccaccacccagagaagccaaagaaagagctggatatctttggattgaaccctgctgatgaaagcacacggaggtgggtgcaaagagagatgttgctgtctatcattatcttacaggcatcacaaatggaaagacccatgtcctgatagatatcatgtctgcagattcagtgcccaaggtagcaagacttagagtcaaaccaccctgtccagtctttccatggtcatgcagagagatgcatgatgtctaaaggtgttttggactggggtgtcacatgggaaggccttgctgataggtttgaatgagagtgagttagaatgactctgggagctcttctgctatttacatgtgatccacttagacctataaaatgcagctctggccagggatgcttgagttctggaaccttgcaagaactgtctgtggatctccaagctcgaggtccttgctgaacctggacctataaatgacgtcaatgatagtgatccctactgcagaaatctacaagtggctataaagaactctgtaggtaagaaattctgtaagatcagaaagtacaatgaattcacttcataataaattacttggtggacaccaaatgggtgctaaattgattgggtagaaggaattgtatgcccaagccacatggccacacggctcaagttccaaccaaggcttgtgagttgaaaaactgagaaagaataatgacagacttaacgtagtgaattcttcaaactttaagtgtaatggacttacaggtccatgggagcacagccccactgtcttagatgtggctcttcaggatgtgcgggctcctgctaaggatgtgcagggaactggctctgaaaacaagtgaacagtagtcatcatggcagctgacatttgtggagtcctttgtatgtgccaggtgccatgacaaatattccgctagtctttcccatctttgtcagtgggatccattctacgtcttctgaaaagtgcttccttgacccccagatcaagtcattttccttacaagctattgaaacctttcttccttcacaacacagctgagtttgagttgatctgtgtatttattttgttttttacatttctttttttccctatttaaaaaatttttttatttccataggtttttggggaacaagtggtatttggttacatgagtaaattcttcagtggtgatttgtgagattttggtgcacccatcactggagcagtatacactgaacccagtttgtagtcttttatccctcacctgcctctcaatttttccccgagtccccaagtccattgtgtcattcttatgcctttgcatcctcatagcttagctctcacttatgagtgagaacgtacgatgtttggtttccatttctgagttacttcacttagaataatagtctctaatcccatccaggttgctgcaaaagccattaattcattcctttttatagctgagttacatatatatatatatatatgcacacctacacatacatatgtatagatacactgcagtttctttatccactccttgattgatgggcatttggggttggttccacattttttcaatatgtgaattgtgctgctataaacatgtgtgtgcaagtatctttttagtatgacttcctttcctctggtagatacccagtagtggaattgctgtgatgcatgtatttgtgcgactatttgattaatgctcatttccttgactagatcacctcatgtgaaaggtatggattggttttgcttttacccagttagctcccatgcctacctcagtacctggcacataatcatcatctactgaaagtggaatgaccacttcagaagggcaccctgggtaagatttctctttctgtttttacagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttaggtaaaagtgtctatactcactctgggtgttgggactttccagtggtttaatatgatacttaaagtatttagagggaagtgtatagggatggtaagtgaacctggcagcccacgtggtctctaaatgcaggtctgcacaaccagttctgtgacatgtttccaggtttgtggcctgtaaattgaaaagaataaaagctgacaatgtaacaaattttttaaactttaaatttaatagttttaaagaattttcttggtgtgttcctgcagtaaacattttttaaaaaaaataattatttattctgatataatgaacttccttttttattgctgtctttttcttttttaatgaaaatatggtgattgattttttttaatgcccttacttggcagaattacaagttggctgtcttatgttggttcctcaccttgctttttttcccttaagttttagaagtctctgatgtctatgagttcagtaacccttgcttttacttttcctaacattcaatttgtgataggaactctagagtagataatttgcagttatattttctggaccagtgtttctgttgaatgtattttgaaggtgggtctatctgtttttcaagtacatgaatatgtggcagggttaaattgatttataaactccagggagtccagctgatgcccagaccagatggatcacttcacatctgctcagggtggttcctccagagccctgaactggtcacagacatgaagctggaagtctgacattggcttgtcctgtgagcttgcctttttgggtctgagccttcccattagtcaatgcaaaaaagtgttgagctgccctggacattgttttggaaattattgatgtgctctgaatgttttcaggttcttaagtgaaaggtacaatccatttaaaaaagaatgtgtttgttttgcaaagctcagtacacaatattttccatttctgcggttccaagttccattcacttctcattgccaaatgggtgaacttccaagcgcttttaaaagattagccagtgagagttatcggaaccagtacttcctctcccctcccatattgttaaaaatagtttacattgcttcccaggctgggctggtggagttggcacgagatgtcagaggaacctgagtcatgctcaggcccaagccctgttggcaggcagaccactgctttctggccttccgtgactatctgaaaaaaatcgtgaatggctagagctactcttcacttgctgaacattttcaaaaagaattgagaacttctggattaaattgccttcttcctcgaaaaccctgggacccttccagatgggactaactggggaaagtggacaagttacaaacaaagaaactcaaaggaaagtcattggcactgatctctaagatgctatcacatgtgattggtggttgattttattaacaaattataagcaaagtactacaaaggtggctttaaaaagaaaataaagcaattcacagaaactactttttcatgtagcttgtatgtgtgctccatgtatttcatcatggaagattttagtgtgtgtttatgtgtatgtgtgttttaaaggtagctgagatgatttgctaattatggttgaaaaaaagaaatttaggaggtaaacaaaataattatgtgtaagattggtccttgtggctgtgtgtgtgttttgtgtgtgcgtgtatgtctctgtgtgttttaggctgttcttttattgctataaataaatacttgagactgggtaatttataagggaaagaggtttaattagttcatgattctgcaggctttacaggaatcaagatactggtagatctgctcagtttttggagaggcctcatgaagccatgaagtcatggcagaaggcaaagcagtgcaggcacatcacatggccagagcaagagcaagcgagagagagaaagagagaggtgccacacacttctaaacagtcagatcttacaagaagtcacttactattgcgaggacagcaccagaaggatggtgctaaattgttcgtaagaaatctgtccccatgatccattcatctgccaccagtccccacctccaatactggagattacaattcaacatgagatttgggtggggacacatattcaaactatatcatactgaccctggaccctcccaaatctcatgtccttctcacatttcaaaatacaatcatccctccacaatagtcccctcaagccttaactcattccagcatcaactcaaagtccaaagtcttatctgacacaaggcaggtcccttccacctatgagcctgtaaaataaagaacaagttatttactttcaagatacaatggggttataggcattgggtcaacattcccattcccaaagggagaaatcggccaaaagaaaggggctacaagccccacagaagttcagaacccagcagggctgaaaactccaaataaactccattgactccatatcccatgtccagagcacactgatgcaaggggtggagctcttgggagggatggaacaccctgtggctttgcagggtttagcccctgcagctgctctcaggggctgttgtcgagtgcctgtggtttttcctggtgcagagtgcaggctgttggtggatatattattcatggaggatggtggccctcccctcgtagcttcacgaggcagtgccccagtggagactctgtgtggggacttcaaccccacatttcccctctgcagtgccctagtagaggttctctgtgagggctccaatcctgcagcatgcttctgtctggacaccctggttttttaatatatcctccgaaatctaggcagaggctcccaagcctcaactcttaacactctgtgcacccacaggctaacaccacatggaagcggccaaggtttatggctgtcacaagctgaagcagcagcccaagctgcacctgaactcctttgagccacagctggagctggagtcatagggatgcagggagcagtgtctcgaggctgcacagggcagtggaccctggggctggcccatgagaccattcttccctcctaggcctctgggcctgtgatgggaggggctgccatgaaggtgtctgaaatgccttaaaggcctttttcccattgttttggcaatcagcctttgcctcctttttagttatgcaaatttctctagcaagtggttgcccagcagccctctttaattctctcccaaaaaagcttttactttctctgtcacatggccaagctacaaattttccaaccttttatgctctgcttcccttttactttttttttattttaaagagatggggtctcactatgttgtccaggctagtttgaactcttggactcaagcaatcctctcactcatcctcccaaagtgttgggattataggtgtgagccactgcgcccagcctctgcttctcttttaaatataagtttcaacttcaagtcatttctttgcttctgcatctgactgtaggctattggaagcagccaggccatatcgtgaacactttgctgcttagaaatttcttccaccagatatcctaggtcatcactctcaagttcaaacttccacatattcctagggcatggacataatgtggccaagttctttgctgaagcttaacaagggtgacctttactccagttcccaataagttcttcattttcatccgagaccttggcagcctggatttcattgtccatatcattatcagcattttggtcacaagcatttaaccagtctctaagaagttccaaactttccttcatcttcctgtcttcttctgagccctccaaactcttcttatctctgcctgttacccagttatctttacagcaattccccattccttgataccaattttctctattaggctgtttttgcattgctataaagaaatacctgagactgagtaatttataaagaaaagaggtttcattggcacatggattctgcaggctatacaggcatttgcttctggagaggcctcaggaagcttccaatcatggtggaaggtaaagggggagcaggcatatcacatggccagagcaggagcaagtgagagagagacagagagagagagagagagagagagagagagagaggtgccatacagttttaaacaggcagatcttgtaagaagtcactcacttttgcaaggatagcaccaaggggatggtgctaaaccatttgtgagaaattcacccccatgatccagtcacctcccaccaggccccacctccaatactggggattacacttcaacatgagatttgggtggggacacatatccaaactatatcattgcgtgtgtgtgtgtgtgtataatttttaaaccagatatatgtttctgcatatctctttcctttctttcattctttctatcttttttttttttttttttttttgagacagagtctcactctgtcacccaggctgcagtgcagtggtgtgatcttggctcactgcaactcattgcaacctcctcctccctgattcaagcaattcccctgcctcagcctcctgagtagctgggattacaggcacatgccaccatgcctggctaatttttttgtattattagtagagatagggttttaccatgttggccagactggtctcaaacttctgacctcaggcaatccacccacctcggcctcccaaagtgctgggattataggcataagccaccatgcctggcctatatatctattttctaagatagaatctttgcatagtgatattcatctgtgagatctaaacattctacaaaaaaattaagaaaatatttttggatgtgttctttgggcatgcctctgcaacctgatgatttcctgctgcctgccagcaccaatacatttaatttcttttctgcagactcagaagtcaaaaacctcctttcagatgataactcagaaggccttactttattggatttgttgagcttcacctatcaagttgcccgaggaatggagtttttggcttcaaaaaatgtaagttcaaggaacacagacctttttagacccagatttcagtgagtggagtgtggacggagatgctaggagatagatgttggaaaggccattaataacaggggcctcttacttacctgtctctctccttcatcccctacgcaggtcagggagtctgaaatcatcaggcatctactcttctctagagctttctctctgttgggagtgggtggagtgagaacctgggagaaggccagccctttatatccaggcagacagctccaagtgccaccatggatcagccagtcttgcaggggtgatgctattcagctacagatggcttgatcctgagtcatttcttccttttccatgcagtgtgtccaccgtgatctggctgctcgcaacgtcctcctggcacaaggaaaaattgtgaagatctgtgactttggcctggccagagacatcatgcatgattcgaactatgtgtcgaaaggcagtgtacgtcctcacttccctcactggtcaggctcatcctccttcactttaatctctaaagtcaggtgttgcttctagagattcggtgcctgttttttaaaacatcaatagatttcaaggggtcagtacactgccttggcagcagattgcccaggtttgagtgccagctccaccacttacttaatttggatttggggctagatacttgactgttctgcccctctgtctccctgattgtagtgggaggtgataatagtacctatttgctgagttgctatggggattaaatcaatgaattcatgtaaagtgcttaggacagtgcctggcatatagaaacagcactcaataatgttagctattttatttatttatttatttatttatttatttatttatttattttctttttttttgagacagagtctcactctgtcacccaggctggagtgcagtggcgcaatcttggctcactgcaaacttctgcctcccaggttgaagcaattctcctgccttagcctcccgagtaggtgggattacaggcatgcaccaccatgttcagctaatttttgtatttttagtagagacagggtttcaccatgttgcccagactggtctcgaactcctggcctcaagtgatctacctgcctcagcctcccaaagtgctgggatgacaggtgtgagccactgcatctggcaagtgttagctattaatatgtcaattgcgtgtatgcatggacaagcatgcattcccaaggatggtgtctttacattttaagcttttatcagattttcaaaagccatctgtgacccctaaaatagattggaaccatttgggtttatgtatcttggaggcacagtttccttaaagatactcattttgttgtctacttgaaccattcttcccatcccttccacttctcagcagatgacatagctccctgtggggatatatctgctccctgtaggtacaattccaaatcacctcactgcactggatgtgagacagcttatggcagctgctgcttccacctagagaaagacatgggcctgcatccatgctgtgtgtgattcatgtactcatgtggccgtgatagctgtaatcggctcatagatcattggatctgttcttagttttgttcccaggaatatctaaaaataggaaactggtccattcagggcttacaccttttgggtgaaaattcaggattaatgtttttggatattattcctttggaggacataaaaggcaatattgaccattcatcattcatctagtatttattgagcacctactatgtgccagggactgagagttcagtaatgaacaaaacacatgtaaaagacactcaaatgggacaagataattagcacaagttattaagagcccaaggggaacccttttctatttccactgctgtggatcatcagtgagtagacatgggtttaactgtctccctccttccttgcagacctttctgcccgtgaagtggatggctcctgagagcatctttgacaacctctacaccacactgagtgatgtctggtcttatggcattctgctctgggagatcttttcccttggtatgggcctgacattgctgcttatttgggctgttctgaaacaccactggaaggaaaatgtgttctttcaagccccaggatgtagacagtgttaagataacctggtgtgaggccagtatgctgcagccacctcaaaccacatgttgtgccttattgtgtctgagataggcccatgcaggtggagatgggggtttttgttgggggttgcgtcttactcctggcctctgcccctcctctcctttgggctatgccagagtgacttcctcccactggaagtggtcccaatgacattcgcatcccagctgctttttcattttgggctttgggtcacatgggttcacccatggagagtgggccctccctcacctggtggcgattgatgctcaggtgaaaaggggtacgtggcgggaagggcagggctctcattcctggttgtcattggccagtcttgacaacccaggtgctgaacaacccaggtgccctgggctatccggtgaggtccctaagagaaggatgagccataaccctgacatctggatggttcatctggggagatgagacttacacacttagggataaacagtgtgctgctgatttaaaattgtaatttgagtcttgagtaaagagaaaggagtcctggaatagtgtgggaaggcttcagagagggaacttaacttgacctggccttggctttgaaagtgtgaaatgtttcatgaatttatctgtgatcaggatgtaatagtaaagtgtgtcttcctgccccgtctcctttttcatcctagttctccctccatggatgatcacaatggatcatcccccagtggcttaatggagtcctgtactcccttaaaagcagagaggccacaactttgatttttgctttagctatttgaacatacctggtgaaaaagactctctgggttttaatgattcagaatttctccttgcttttctagttcattttgtctgtgttgatccagtagtcatacacattgaaaaacacttgaacgcttatttctaaagatgtagaatttttgtgatggtacttggacttgaccaacctggagtcctaattaaacttaaggtttgagctggtctctgaagtcaaggagatgatgacactgaattttcttgaaaaaaccagtgcttcaaggctataggatctgaaaggttttctaacagtgttctatcatgccaagtgtttcagcaatgcactgagcgtttgttagtcctggtgttttattgtttggcttttaggtggcaccccttaccccggcatgatggtggattctactttctacaataagatcaagagtgggtaccggatggccaagcctgaccacgctaccagtgaagtgtgagctccttccccatcccgggggcctgtgttcacagtctgtgggtctagggggagggaggggccctgagacttccccctgtgcccactcttgagttctgtccccacagctacgagatcatggtgaaatgctggaacagtgagccggagaagagaccctccttttaccacctgagtgagattgtggagaatctgctgcctggacaatataaaaaggtgtgtttggatctgtgggtggaaaggtctggataaagctggaagttataccagtgagctgtgctgttccgcagttctagaggagcattttcaaaagaggcaaaagactgtgtgatccagtggctgggcttcatggcggtgctccacgagaccctagtagcaatgatgaatgaaaaccctccccttcccgtggggctttcctttcatcttatatgtacagtacctgtaagcactattctccagatgtttgagtatcagaagttagtgtgcagttagaagactcagggcatccatggccattacatcactaatttgagtgcacttaaatccatgcgaaattggcttttaccagcggactggaaggaacaacctcagctgttatctgtggcaccagctggttttttgtggaatgggaagcattgttcaaaggaacaaatgtaatttcttggaaccaggcaggatatgtaaatgaatgaaacaactttctgctgaggtgttgagaggaaaactcagacataacctcagtttcttagattgagattagtccctgtgtagactttttatacttatcatttttcttccttcttctcaaggaggaatagtgttaggagattgtgtgccgaactggaagttaaatgcttctgtctgttaattatctcactgcccactacaactttcacaggtgaggcagtgaggaggcagaaggaaattaaccctcagttggtcaaagatgctctgactggtggaaatgtgttggtgggaagagattgaagttattgttgaaaatagggtcttttcacatccaatgttagacctctccaatgtttaaggatcatgaaggctttgggtattatccacccaatagaaggcctcactgcctctctatgggacccatccaagccctggaaaggcaacgtgatggggaccagaaggattctcagttgtagctactgacttggagaaggggctactggtatcttagcacctaatggcagaagctctttaccattggtggccccttcttcatgttctatgtctctggggatagttgacatgactctccttcaactaagtcccacatcttccaggtagtttggagatatgtacagttaaataatagtaagttctgagtgtctctattcatttttgaggtttggttgttaacacttgattaaatatgttcaatgaatgtttatagagttatgaaaaaattcacctggacttcctgaagagtgaccatcctgctgtggcacgcatgcgtgtggactcagacaatgcatacattggtgtcacctacaaaaacgaggaagacaagctgaaggactgggagggtggtctggatgagcagagactgagcgctgacagtggctacatcattcctctgcctgacattgaccctgtccctgaggaggaggacctgggcaagaggaacagacacaggtagctgtgggggcagcctcggtgtctcacctttcccctcccctataggccctgaaggagaggacccattttcccgataatggtgcactcccggttggtaaatatgtactcagggacaagttgcagaatcctcaggaggtccacgtggttttgaaaatgcttcccagatgattctaatatgttccccctggggctgggagagggatgtgcatgttgtggggagagggacatgcttccctggtggagaatctttgagctaaattctcaggtaatttgatcaaattgatacagaactgtgattactgagatcatataagcctctcctgccattgtcttaaatagtcattgaactggggaaaaagtgaagagaggcgggactgggtcctttgacgctataccctacctgtgaattggaatcacctgcagagatttaaaaactgctgatctacaagcctcacccaaaacaacaaattagaatccctgggggtggtggccaactgctccctggctgatttgtttcttctttcttttaaattttgtattatggaagatttctaacgtgtgcacaattcacatagtatagtgagctgttcagtattcgtcacccagcttcaatgactatgccctctgccagcctggatgcacacatggccatgtctgtctctcctcagcctcctctggattgtttggaagcaaatcctagacaccttatcatttcacccataaatattccagtgtgtgtctcttaaagataagggctctattttaaagaagaacaacagttattaaaaataactacaatgccgttatctcacccaaaacagggacaataaatcgttaaggcatcaggcagccagttaaagttcaaattatctcacaaatattatcatactccattaaaaagtgggcagaggacataagcagacacttttcaaaagaagacatacctgcagccaacaagcatatgaaaaaatgctcaacatcactgatcactagagaaatgcaaatcagaaccgtgatgagataccatctcacaccagacagaatggttattattaaaaagtcaaaaaataacagatgctggtgaggttgtggagaaaaggggaagcgtatacactgcttgttgaagtgcaaattagttcagctattgtggaaagcagtgtggtgatttctcaaagaacttttaacagaattaccattggatccagcaatcccattactgggtatataaccaaaggaatataaatcattctaccataaagacatgcatacgtatgttcactgcagcactattcacgatagcaaagacatggaatcatcctaaatgcccattgacagtagactggataaagaacatctggcacatatacaccatggaatactatgtgttgataaaaaagaacaagatctgagataccatctcccaccagtcagaatggctattatttaaaagtcaaaaagcaacagattgtggcgaggttgtggagaaaaagaaacacttttacaatgttggttggagtgtaaattagttcaaccattgtggaagacagtgtggcgattccccaaagacctagaggcagaaatactgtttgacccatcaatcccattactgagtatatacccagagtgatgtaaatcattctattataaaggcacatgaatgtgtatgttcactgctgcactgttcacaatagcaaaatcatggaatcaacctaaatgcccatcaatgatagactggataaagaaaatgtgatacatatacaccatggaatacgatgcagccgtaaaaaggaatgagatcatgtcctttgcagggacatggatggagctggaagccgttaccgtcagcaaactaacacaggaacagaaaaccaaacaccacatgttctcacttataagtgggagctgaacgatgaggacacatggacacatggagggaaacaacacacactggagcctttcaggggttggggattgggtggaacatcaggaagaatagctaatggatactgggcataatacctgggtgatgggatgatctgtgcggcaaaccaccatgacgcatgtttacccatgtaacaaacctgcacatcctgcatatgtacccctgaacttaaaaagtggaaaatacaaaaatgaaattaaaaaaagaacaagatcatgtcctttgcagcaacgtggatggagccggaggtcactatccttagcaaactaatacgggaacagaagaccagataccgcatgttctcacttataagtgggagctaaaactacgagaacacatggacacaaagaggggaacaacagacaccagggcatagttgagggtgcagggtgggagaaggaagaggatcagaaaaaatacctatcggatactgtgcttattatttgggtgatgaaataatctgtacatcaaaccgccatgacatgtgatttatccatgtaacctgcacacgtgcccttgaacataaaataaaagttaaaaaaaaattatcatacacttgttttgttctgtctgagatccagataagagtcacacattgcacttggttgctatgtctctgtaagttcactatgtctctattttttgccctcttacatattatttgtgaagaaaccatagtgtttgcctgtggagttcccacaatcggcattttgctgattacatccttgaagtgtccttctcaggtgcttctgtcttctctatgtgttgtaaactggtagttagtctaggaacttaacctgactcaggttagatctttggcaaacatgcttcatagatggttctgtgtgcttctgtcaagaggtatgcactgtccagttgtctgccttttgtaacattatcagtcattgggtgatcattacctagaatttctttttttttttttttttttgagatggagtctcgctctgtcacccaggctggagtgcagtggtgtgatctcagcttactgtaacctccacctcctgagttcaagccattctcatacctccgcctcctgagtagctgggattacaggcacatgccaccatgcccagctaatttttgtatttttagtagaaatggggtttcagcatgttggccaggctggttttgaactcctgacctcaagtgatctgccggtctcggcctcccaagatgctgggattataggcatgaaccacctcacccggcctagattctttaactcagcaccaaggtggagctaatgcccaggcaggactgagaatcactggctgacgtggtcagatggaggagaccatgccccagttctccgctgtctttgcatggcccttggacagaggtaggagaaggtgatgatagtggcccctagttcaaggtccaagttgcttgtgtgtgtgtgtgtgtgtgtgtgtgtgtgtgtgttttcctcttctttcccatcagaacattattttggaggcttatgactgtgacctttgttaaccaatttaggtataatatgtagacagcccttgtttatttgtatggactgggtaattttgaaagtatggcttttctattttgttttagaatatgttatgtgatttgaagatgggacacagtggcccatcagtcttcggttttttattatgctttgctcaggccagtttttataacgtgtttatatctcttgagcatacggtgttcctccaagttttgggggtctgcgatggaacttcacgggggtcggggaaggctgggcagtgaatctagggctctctgtctcagatcctttctcaatttggttactttgtgtttgtgggctctgaataatatttgagttgtaagagggttctgcttttatataaagttagaaagtcacattggaataaataacatgagaaaggtgcccagaagttttctagggctacaacaggctgagctgcagaatttgacacgccaggaattgaactttctcagttgaagttcacgttcaagttaagtaacttgtgtggcatcacacagctagtaagtggggggaccattccagacctaaggctttctgactccagaactcccctttcagccacttctctagtacgtaaggagccgtcacctgggccctcaagttgggggttggtgggggggcatttgatgtcaagagagaggggaagagggcattccaggcaagtggcaggagatcctgagaacacagtttggatgctcaggaggcttccgggagagcacctgatgggcctggctgcagcttgcaccctgatgggcctgacttcaccccctgctctgccttcccaggcctttggatcaggcattgcttatgttctcttccactaggattgagtagggaaagtagaaattcttgcagcttgtcagtaactttgatgaaagacccagcagaaaagcaggaaagctgaagagtaaaaatgatgggtggaccttggttttccacgtggcctaccacagcatgtcaggcctgggggcagaatcttgccatactgtgcagcccaaatttgaatgccaaaggctttcgtttgtctctggggggccacagtctaggtctagttctgtgcaggagttgtaatatttgctcttctctccctcctccagctcgcagacctctgaagagagtgccattgagacgggttccagcagttccaccttcatcaagagagaggacgagaccattgaagacatcgacatgatggatgacatcggcatagactcttcagacctggtggaagacagcttcctgtaactggcggattcgaggggttccttccacttctggggccacctctggatcccgttcagaaaaccactttattgcaatgcagaggttgagaggaggacttggttgatgtttaaagagaagttcccagccaagggcctcggggagcgttctaaatatgaatgaatgggatattttgaaatgaactttgtcagtgttgcctcttgcaatgcctcagtagcatctcagtggtgtgtgaagtttggagatagatggataagggaataataggccacagaaggtgaactttgtgcttcaaggacattggtgagagtccaacagacacaatttatactgcgacagaacttcagcattgtaattatgtaaataactctaaccaaggctgtgtttagattgtattaactatcttctttggacttctgaagagaccactcaatccatccatgtacttccctcttgaaacctgatgtcagctgctgttgaactttttaaagaagtgcatgaaaaaccatttttgaaccttaaaaggtactggtactatagcattttgctatcttttttagtgttaaagagataaagaataataattaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatggtaatagctttagtgaattaaatttagttgagcatagagaacaaagtaaaagtagtgttgtccaggaagtcagaatttttaactgtactgaataggttccccaatccatcgtattaaaaaacaattaactgccctctgaaataatgggattagaaacaaacaaaactcttaagtcctaaaagttctcaatgtagaggcataaacctgtgctgaacataacttctcatgtatattacccaatggaaaatataatgatcagcaaaaagactggatttgcagaagttttttttttttttttcttcatgcctgatgaaagctttggcgaccccaatatatgtattttttgaatctatgaacctgaaaagggtcagaaggatgcccagacatcagcctccttctttcaccccttaccccaaagagaaagagtttgaaactcgagaccataaagatattctttagtggaggctggatgtgcattagcctggatcctcagttctcaaatgtgtgtggcagccaggatgactagatcctgggtttccatccttgagattctgaagtatgaagtctgagggaaaccagagtctgtatttttctaaactccctggctgttctgatcggccagttttcggaaacactgacttaggtttcaggaagttgccatgggaaacaaataatttgaactttggaacagggttggcattcaaccacgcaggaagcctactatttaaatccttggcttcaggttagtgacatttaatgccatctagctagcaattgcgaccttaatttaactttccagtcttagctgaggctgagaaagctaaagtttggttttgacaggttttccaaaagtaaagatgctacttcccactgtatgggggagattgaactttccccgtctcccgtcttctgcctcccactccataccccgccaaggaaaggcatgtacaaaaattatgcaattcagtgttccaagtctctgtgtaaccagctcagtgttttggtggaaaaaacattttaagttttactgataatttgaggttagatgggaggatgaattgtcacatctatccacactgtcaaacaggttggtgtgggttcattggcattctttgcaatactgcttaattgctgataccatatgaatgaaacatgggctgtgattactgcaatcactgtgctatcggcagatgatgctttggaagatgcagaagcaataataaagtacttgactacctactggtgtaatctcaatgcaagccccaactttcttatccaactttttcatagtaagtgcgaagactgagccagattggccaattaaaaacgaaaacctgactaggttctgtagagccaattagacttgaaatacgtttgtgtttctagaatcacagctcaagcattctgtttatcgctcactctcccttgtacagccttattttgttggtgctttgcattttgatattgctgtgagccttgcatgacatcatgaggccggatgaaacttctcagtccagcagtttccagtcctaacaaatgctcccacctgaatttgtatatgactgcatttgtgtgtgtgtgtgtgttttcagcaaattccagatttgtttccttttggcctcctgcaaagtctccagaagaaaatttgccaatctttcctactttctatttttatgatgacaatcaaagccggcctgagaaacactatttgtgactttttaaacgattagtgatgtccttaaaatgtggtctgccaatctgtacaaaatggtcctatttttgtgaagagggacataagataaaatgatgttatacatcaatatgtatatatgtatttctatatagacttggagaatactgccaaaacatttatgacaagctgtatcactgccttcgtttatatttttttaactgtgataatccccacaggcacattaactgttgcacttttgaatgtccaaaatttatattttagaaataataaaaagaaagatacttacatgttcccaaaacaatggtgtggtgaatgtgtgagaaaaactaacttgatagggtctaccaatacaaaatgtattacgaatgcccctgttcatgtttttgttttaaaacgtgtaaatgaagatctttatatttcaataaatgatatataatttaaagtta
